United States Patent 9,328,346 (POLYCOMB-ASSOCIATED NON-CODING RNAS) - sequence listing, part 142

SEQ ID NO: 192133 - RNA, 228154 nt, Homo sapiens
cggaaggacgggagggcacgggagugcagcccgcccauguggcuacuggaggucacguucccuaacugaucccuugguucucucggguggagccuucagcgugcacggcgggguuugacuuugccaccgucucucuucuggguuccaauaaaguuuuccucuuccucuccucguacggaguucaagauggcggccuccuggucgcucuugguuacccugcgccccuuagcacagagcccgcugagagggagauguguugggugcggggccugggccgccgcucucgcuccucuggccaccgccccugggaagcccuuuuggaaaggucagugacugugccaugaguaguccgagccgacugcauaugacuggagaagccucugggauuacccucccuguccgaucuaccccaggugucuccugcuuucacgaagcugagggcuccucgagaggaguuuccauuucucuugaccuuuuauacugucugugaaugagcccugagcacugagggaaaugacccugagugacuuucauuuugagggucagagguugacucagaguuuguuccuuccgggacguuuagagagcugaaccuagugggagugccuggcuugaagagaugcaggugugggguuggggccuggggaccccuacccucugcguuuuccaagcucucggggcuggugacugacgggcacuggaggaagagccgcgccugggaccucugcaggcccugaugucucucgugauucuaggaaggaagguccacacacauucucagauugagggaucgauucuugguguucuuuucaagucacuaggggcuucaguggaauuauuuugucaccgggcuuucuuucucccuggcuuccuucauucaguuauauguucaugaaugaaugaaugaauguauauucugaguaaccaagagugccaguuuuacugcucuauucauguauucgcacuaaacugcacgauuuucaaaggcaaggacauugugucauuguuuccuaagcacuuagcgcaaugauugguacuugacgugcaaauaugauuuuugagugaaugaaugaaugaaauuauucuccuugucucccucauccacauacucguuuuccuuuuucucaaauccaagcaaccccuguaauauaccuuaauagauugauagaccuuaauaagguauauaccuuaauagauuauuuauuaauuuagcuaaaaauaugacaaucuuugacccuuaucaucaaugcaguugaaauuaauacuagaacuuugauuaggucaccuuacgucuuucugcaaagauuagcauaaugcauuuaguauaauggaauaggcuccacacacugccuggggguagcccugaucugcuggaguagucguuaaaaguaaauaaauaaauaaagauauaauggaauauucugguaguguaagcuguggauuauaauauaaauuuuauuuuucauuuuugguagucaauaaaagcaaaugcuauaaauuucaacaggugcaagaaagaauauggcaaaauguaaggcuuuuuucuaucccuaucccuuagcugcuuaguuuuucuccucagaggcaaucugugauacuaguuucuuauguauucuuccagauauauucuguguauguauaagcauauacauauauagauaaugguauuaaaaaaauagaaguaguaacaugcuguacacauuguuuuguguauacagcaguuaauucuguuaauuguuaauuucuuuuuaaauuuaguagcuuggagaucauuccauaucaauaccauaucaauuucauaugaauagaacugccucguguuuuaaguuuuaaaaauaguauuccauucuauguauauaccaugauuuaugaacauuaaagauuuaaggagcaucauuauaacauauaaaauucacugaaugcuuauucugugucauacaauauacuaaguacuuucuacauacauuaucuuauuauuccucauuauccucauuuuggagaucaugaauccaagguugcugaaguuauauggcuaguaagugucagaacuggauucaagugaaggcugugcuauuaaucuauacucacacuuucuccaauacacaaaauuuagccaauucugggugugaagauuugaugaaaaugcaguuagguuagagguccauuuaauuguaucuaaggacgcucccuuccccucuuuauuuuuauuuuguuuauuuauuuauuuuuuugagauagagccuugcucugucucccagacuggagugcaaugguacaaucucggcucacugcaaccuccaccuccuggauucaagcaauucucccugccucagccucccuaguagcugagaucacaggcacccaccaccacgccuggcuaguuuuuguauuuuuaguagagaugggguuucaccauguugggcaggcuggucucaaacuccugaccucaggugauccggagccucggccccccaaaaugcugggauuacaggcgugagccauggugcccugcccccaucuuuaaauaaaaggaaaauuuuaguugaaauuuuguucaguauucagagucugauuuacaaaucgauuuucuaucccuuuccuguuuuuuuggggggguacauuucuauuuuaccuucauuuuucaucuuuugaagucuacuauuuaguacaguguaauguggcugggugugguggcucacaccuguaauccuggcacuuuggaagccugagggaguaggaucacuugagcucaggaguuugagaccagccugggcaacauggcaaaacccccucucuauaaaaaauacaaaacuuagccgggugugguggugcacgccuguagucccagcuacuugggaggcugaggugggaggaucacuugagcccaggaagucgaggcugcagugagcugagagagauggcgucacugcacugcaggcugggugacagagugagaaccugucucaaaaaaaaaaaaaaaaaaaaaggaaaagugaaugaaccugaguucuagcccuugaauagcccauagucuugagaggcauauggaauuaugguagccagcauuugaugagccccuucuguguucuaggcacuuugcuugcaguuucuguuucauaauuuaaucuucauaaaacucuauaaaaauuauugucuuuauuuuauagaugaauaaacaaggauggucacccaacuuggauuuuaaacccagguguuuuugcuucagagucacaaacuuaacugcuauuuguacuagcuuuuuaauguaacagugaacauuaauaacauauuguaccaugaucuaagccuguuugaaguguuauaagacugcagaggaggaagcagcucugcuuggagaggggaagaauuuuuuuuuuuuuuuuuuuuuuugagacagagucucgcucugucacccaggcuguagugcaauggugugaucucugcucauugcaaccucugccuccuggguucaagcgauuuuccugccucagccuccugaguagcuggaauuacaggcgcccgccaccacacccaacuaauuuucguauuuuuaguagagaggggguuucaacauguuggucaggcuggucuugaacuccugaccucaggugauccacccaucuuggccucccaaaguguugguauuacaggugugagccacuguggcuggccagauuuuuuauuuuuagcaaaaguguggaugugagcuguacauggcccuuauugguuuauggucucugagagagcaguuagagaugaagcuguaaaggugggcugaugugguugagaagagucucuuacaguauguuaagaugucuaagcucagugggacacuaguggaaguuucucaggaauagaagugaucagaucuauuuuagcaugauuucucuuguggccaccugaaaaacaaaccagaaaugccuggaugggagaauacuggaagcugggugauuauuuaggaggaagcugaaguagauagaguguuagggagugguuuaggggcugaauuacugcuguggugaaggagagcagggcagcugagggagggaauucagagacacuucuuugauagaauuaacauacuuggccaggcacaguggcucaugccuguaaucccagcacuuugggaggcugaggcuggcggaucaccugaggucaggaguuugagaccagccuggccaacauggugaaaccucgucucuacuaaaaauacaaaaauuagcugggcgugguggugcaugccuguaaucccagcuacuugggaggcugaggcaggagaaucgcuugaacccaggcggcggagguugcagugagccaagaucacaccacugcgcuccagccugggggacagagcaagacuccaucucaaaaaagaaaaaaaaaaaaaauaaauuaacauacuuggacauacuuggaagagacaaggaaagggaggagugaagguaaauuuagguuuccuauugcaggugaaauaaugacauaauaaguaaaaaguaaaacaauaaaaaagcaauugagguuucugaguuugggcaauguaaucaaaagaaacaaaacaaaaaugaaacuaaaugauagggccaaaggauuuuagagggauauucaauauggggcuuguuaaauuugaggcauuuauuauaguuccagguaaauaagucuaguuaguuguaggacacuuggggaucugagacuaagaaagaaaauaugagguauugggagccaugagaauagaagaaugagccugggaauauauguguagggugaaaagagccuguggcuugugccugaaaucccagcuacucaugaggccaaagcaggaggauugcuugcggccaggaguuugagacaagccugggcagcauaaugagacccugucucuaaaaauagaagagaaaagaaaagaaaaagcaaaagcugagggcuagugcuugaggaaacuugacauuuugugagcagaagaagggggccucauagaguggucuuaggagacuaggagagaagccagggagggaaauguuuauagguuuucuaaaaccuaaaaauuagcauaucugaaauuccauuuucuuuaagcuagccuuagaaauuaaauguauuucauagaagcaagguaauaugaggaucacaucuuaugauuucuuuuuauuaugcugacaauauaacaauauuauauuuuuaggugccucuauuaaaugaugauucauauuuaacuccacaaucucuuuaguauacauacauaggaguuuauucccuauuaggguuuuuuuuuuuugagguggaguuuugcucuugucgcccaggcuggaaugcaauggugcaaucuuggcucacugcaaccucugccuccuggguucaagcgauucuccugucucagcuuccuaaguagcugagacuacaggcaugugccaccacugcccagcuaauuuuuuuguauuuuuaguagagacaggguuucgccauguuggccaggcuagucuggaacuccugaccucaggugaucugcccaacuuggacccccaaagugcagggauuacaggugugagccaccagacccauccccugauuagguauuaaugugaguagaacuaacccuccuauauaugaauugguauaguuuauuuuuuauuuauuuguuuauuuauacauauuuuguuucucuuuuacauguuacuugccaagguacaauuuauuaguaguacauauuacuaguuaagaaaauauuugucuuuggacuuacugucuguuucccuuaauacucacugguuauagcguuugaacuuacuuuuuuuuuuuuuuugagacugaauaucacucugucauccaggcuggagugcaguggagcgaugucggcucacugcaaccuccgucucacagguucaagcgauucuccugccucagccuccugagcagcugggacuacaggcgcacgccaucacgccuggcuaauuuuuuguauuuuuaguagagaugggguuucaccauauuagccaggauggucucgaucuccugaccuugugauccgcccgacuugaccucccaaaaugcuggaauuauaggcgugagccaccacgcccggccugaacuuacuuuuaauuauccaauuagaugaauaucuuuaugugaacuuauuucauguuucuuggauuuuuguuaauauuuauuauauuagaaaagaaugucaugccuaucccugagacugauuaucuuuaugauaauggaggauuuuguggugcuggugggaguauagcaguaaggccaaccaggggucacucucaucgccaucuugguuuugccuggcuucuuuacugcaaguuguuuuaucagcaaggucuuuaugacuuguaucuugugccaaccuccuaucucauccugugacuaauaaugccauagccuccugggaaugcagcccaccaagucucagacuuauuuuacccagcccuuauuuaaaauggaguugcucgaguucaaaugccucugacauuuccccccacucccuuuuacaagggaacccuuaauaaguguugaagagaaacaaagaucuaucuucugcaacuucuucaggcugaauaggggcaaugcuauuccugccuaacuauuagggucucuuguauucaggguagagaggagcucagucagaaagcguugguauggcaagggccauucauaacucuugaguucugacaaaaggugauaucuagaagauuaauaacuguucaguuuaaaagaacauugaguaagcuuauccugcauuccuucaugaagaguacaauagcaauauauuccacaacaguaagguaaaauaaauaaaauuaucccaaguaaaugaacuuagaaggcuuuccaugaacggggcaacuguuggaaccacgcugaugugggguugcuaggugauuccaauaugugcccaggauuagaauauugauccagauuuuuacauuacccaucccucuuguuucuucugaguagcaaccagagaucacugauugauuuacaagaauaagcagagccagucuaaauugcagaaaaaccuuaaaaacaacagaugagacuagauuuuuuuuuuuuuuuuugagacagaaucucguucuguugcccaggcuggagugcaauuggcaugauuucagcuaacugcaaccuccgucuccuggguucaagugacucuccugccucagccuccugaguagcugggauuucagguguccaccaccaugcccugcuaauuuuuguauuuuuaguagaggcgggguuucaccauguuggccaggcuggucuugaacucuugcaggugaucugcccgccuuggccucccaaaguacugggauuacaggcgugagccaucgcucccagcccgagacuagaauuuaauaacagguauaccacaguucuugaaacauaauuuuucucuccggucucccauuuuuacuaaagacaaaucaugguaagacugauuugcuuuguuauacuuggccugacauuuguauaaagugcaggaaaaauaauuauuuuucacauaggcuuuuaaaauugacuuugauggaacucuguuccauagaaggaaucucagauaagacuuuuuuuuuuuaaagccgagcccagccauggguuuguacccucaaauaccuaugaguugaguaaauaccucuucucuugagguuccgagauaacuuggggcuccugggccuguacuuuacuuauuuacuuacuacaggucaggaacccugggcacggacuguguagacaagauacgaggccaguuuccaaaggagcuuuuauuggcgcuauaagucaaguuugauuccuuaaaggaaagcacaccacuccagucaaaaccuugguaaaauaaccaguuucuccaauugugcccuguuacaaaugaaaacagauuuuuauugcacuuaugcaaauaacuauugccguaaguuaagauacucacuaauaauuuucaaguucuggagaaaucagguagagagaaacaauuaugcuccaaauuuuguuuauaggaguauacuuugcuuaauuguuaaaagcugucaauagcucaaaaaaaaaaaaguuuccuugacucuggaaaucggaguuucgcucugucacccacugcaaccuccgccucccagguucaugcgauucuuguguuucagccuccggaguagcugggauuacaggugugagcugccacaccuggcuaauuuuuguauuuuuaguagagauggguuuugccacguuggccaggcuggucuugaacuccuaaucucaagugaucugucugucucagccuuccaaaauguugggauuacaggcaugagccaccaugccuggccuuuuuauuuuuuuaaauuagagacacagucucacuauauugcuuucccuggucuggaacuccugggcucaagcuauccuccugccuuggccucccgaaguguuaggauuacaggcgugagccaacaugcccagccuggucucuaauuugagcucaagugauccuccaaccccagucuccaguaguagacuucagguguguuagcucuaucuucucuccuaaaagcguuauggaugcuagcucuuccuggugucuuuugccucucuugcccaaguucucuguugaggaccauuucuacuccuugccuggagauaccugauacuucaauuuccagaaucucuuucauaaccucuuuuuaccauccugcuuaucuuucuuauuucuucucuucauugcucccaucccagaagcuacucuaugaacauguuaucuauccauacucuugaccagguggcaguuuucaacaaguuuuuaagccugagcauguaauucuuuauagucguuccuccauuucuucauaauaucauuuaaaugcaacuccuguagauuccauuuugaaauucucauuuauauauguguguguauaaaauuuaaacuaacauaacaaaugaauggguuuaaaaaucuuuugaaaaaaauuagaucccuuagaugucuuuauuaaauaguaugugaacagggugaauauuaaggaguuacucaguaugcugggccaugccuguaauuacuucagaauagcuuuauucagaucuuuaggcauuauuucacugauuuguuaucaugaaauuuaaaguacaauuuuuuuuccuuuuguaaaguuauacacauuggcacauuuaagauuaacuagcuucugaaggaaaagaaugguaaccaccaagcauuuaguuuuaauuuucauaauuuuucuauuuaaaucaaaagcacccuuuuaaagccccuaacuaagccuuuuauaaauaaaguaaaucaucuugcagugcauuccuugaugauggcuuauguuguuuuucuaaagaaaguuuaauuaagauuugauuuucuucuauucuguacuuuguuuauucaucacagaaugaaacauaggucuuuaaugucaaugguaagucugacuuuuugggucauugaugaccauugcaguuuucaaaaaagcagcugaauauuuaucuuuuggguaugauuagaacauaauagagcauaaaaugggcugccuaugaccuuagcaugggcuucugucauugcaggagaacauuucuggucaguggccacuguuuaugguuuguuaaaaucagcacaaauguacaaauaacucaugaauaauugugaacacaguauuuaaauggauguuuaauaaauaugcauuaaaaaucucauuacaguaaugaaguuuacagcugaaauuuuaauccagcccuuuagaaauauuaaagugcuuuuacugauugugcauuuuucucacagcaguuggguaaacauuuuaaacuggaaaucugaauuccuuauauaguuuugauuucauuuaacuaagcauguguucuuuuuggcaacccucuucuuucucuuugugaagaagugaagcuccuuuauuccauaacuguuacuuugaagcauuuugaucaguucuguuuuaggaauggugaacauaugggauaccagacgacuaauaaaaacugaucuggaaaagacuagauugugauuuugguuucauucugcagugcuggaucaaucauuugauuugguauuuccauuugucaucuauagaaugcgaugcauuuuccuaacucuaccuuccuugcagguaauuuaugagacucaaauagguuauuaugugagaaagucuuuugaaaacuguaagaaauguuacauaaauguauguaauugaaauauuaacaaugacaugccagaggugguggauucuagucagugaguagaaauggaauguacucaacuuuauacagaauuucuagagccauuuuaauucuggagaggcucauuauauuaacaauggccaagggccuagucugaauucagugcuuugaauuccagaaaaugcaguuuugauuuuucugagauugugcaaagggccucuguagauaaccaggugugguuuuuguucuccuggacuucacuaccuuuccucuggauacucugaacaccuagagguucuuagaaauuaugaauuaccucuuuuuugagacagagucuugcucuauuacucaggcuggagugcagugguaugaucacggcucacugcagccucaaccuucugggcucaugugagccuccugacagccucucgaguagcugggaccacaggcacaagccccaccaguacgcccggcuaauguuuguauuuuuuuuucgugaaccucuaagucuacuuuauaauuuuuuuagugggagguagagacaggguuucagcauauugcccaggcuggucuugaacuucugggcucaagcagugcgcccgccucagccucccaaauugcugggauuacagucgugagcuaccacaccaggcuaugaauuacuucuuuugccauuauguuucaaagaaagcuguugaaauuugauuuauacugugcagguaaacuaucuucauuuaguaggaaauggaugcugguuucaaaaggaacuggagugauugugaauuauuugcuguacagugagaucuaaagauagcuuuuuguuuguuuguuuguuuuguucuguuuugagaguugugcucuguugcccagguuggaaugcaguggugcgaucuuggcuuacugcauccucuaccucccggguucaagugauucuccugccucagccucuugaguagcugggacuacaggugccugucaccacgccuggcuaauuuuuguauuuuuaguagagaugggguuuugccauauuggccaggcuagccuugaacuccugacuucagguuaugcacccaucucauccucccaaagugcuaggauuacagaugugagccacugugcccagccucaagauggcauuucacagaagcauagaguauuagugcugcagagggccucugggccauauagucaaacaauguuagacauguagcuucugccuuaacugcuucuuuuugaggcuuccuauugauuuuuggauagccuuaauuuugaaaaaacucuaaagugggaugaaauuugagcauuuauguaacuucuccccauucaucuugaaucuuuccucaggugcgguauaaaacacuaauacugauuccaugugugaccgcucuuuuaacauaucaagacugauaauauuucauucauuuauuuauucauuuacucauucauuuuucaaaguauugggugccaccuugucccaauuccauuuaaucaccuuuaaacauuaaaggcuuauuauauuucucccauucauucauucauuuuccaagcacuucuuguugccacccauaugcuacaugcaggaugcugggauguaugcuaaaugucuuguuaaugucagcagucuuuugugcugucggucaagucucacaacauaguuucuagauccuugaacuccuucccuucuugagauuacugucuacuuucugaaugacacucugaaaauguggcccccauaucacaauauauuccuucaaguauggucagccuagagccuuguuuagguuaccuuuucuguguccuguggcauuaacuuuugguggucaggucacauucauaucucacuugcgacucuuagaguuauuaaaacaggucucuccuguuuguauuugauuuauuauuuuuucuguuuaaacauaaauuacuuuuuuuuucuuucuuuuuuuuugaguuuuugagauggagucuugcucugucacccaggcuggagugcaauggcaugaucucagcucacugccaucuccguuuccuggguucaagagauucuccugccucagucuccugaguagcugggauuacaggcgcaugcuaccaugccuggcuaauuuuugcauuuuuaguagagacaggguuucacaauguuggccaggcuggucuagaacuccugacgucgugauuugcccaacuuggccccccaaagugcuaggauuacgggcgugagccaccgcauacggccuaaaaauaaguuacuuuuaauuauaaaaauacuacaucauguuuacaguagaaaauauagaaaagacaacugcuguuaacuuuaauuuuucuuucaucuuauuuuuuuuuuuuuuuggaaacaggguuuugcccagucgcccaggcuggaguacaguggugugaucacagcucacugccgccuaaaccucccagguccaaguaauccucccagcucagucuccugaguaacugagacuacaggcgagcaccaccacgccuggcuaauuuuuguauuuuuguagagauggggucucgccauauugcccaggccuauauaguacugcuaugaauauguuuguacauauauuuggugcauauauguaugcuuucuguugggcagauaccaaauaauagaauugcuggcucauauuuuauacauauguucagcuuuaguagacaaggccaguuuucuaaaaugguuauaucaguguaucuuuccauuagcagugugugagauuucaguuacuaugcauccucacuaacagcugguauucuuuuuaauuuuagucacucuaauaaguguguacugauaucucauuaugauuuuauuuugcuuuucccugauacauuuuaagguugaauacuuuuuuauauauuuacuggacauuuggauaggcucuuuugugacaugcacauugucuguuucuuaaugaguuguaguucuuuauauaaucuugauguaaguccuuugucagauacauagauugcaaguauuuucucccagucuguagcuugcuuuuuaauuuuauuuuuucauuuaucucuuaucuuauaagugguauaaggcuagcuuuuucauuaaaaacauuuuuuuugagacuagaucucucugugucaucaaggcuggagugcagugguacaaucaugguucacugcagccuggaccuccugggcucaagcaguccucucaccucagucucccgaguagcugggacgacaggcaugcgccaccacacccagcuaauuguuaaaauuuuuuauagagacagcaucucucuauguugcccagguuguucucagacuccuggccucaagcuauccucccaccuuggccccucaaaguguugggauuaccagcaugagccacuguguccaauuuagcuuuuucauugcuaauggagucuuuucaugaacagaagcuccaaauuuuauuuuacuuauuuaauuuuaauuuuuuuagagaugggguuuugcucuguugcccaggccagagugcagugaugcaaacauagcucacugcagccucaaacuccuggguccaagcgauccuccuauuuuagcuuuccaaguagcuaggacucuaggguugugcccagaugaagaaguucuaaauuuuauuuauuuuauuauuuauuuauuuauuuauuuugagacagagucucacucugucauccaggcuggaguacaguggcacaaucuuggcucacugcagccucuccaccucccagguucaagugauucuucugacucagcuuccugaguagcugggacuacaggcgugugccaccacgcccagcugcuuuuuuguauuuuuaguagagaugggguuucaccauguuggccccgcuagucuugaacuccuaaccucaggugaucugcccaccucagccucccaaagugcugugauuacaggugugagccacugcgccuggccaagaaguucuaaauuuuaauguaguccaauuuagcaaucuuuuuguguguguccuauuuaugaaaucuuugcuuaccucaaggucacgaagguauuuucauauguucuuuuagaagcuuuauuguuuuaccuuucauguuuagaucuaugauaccucuggaauuaaguuuuguguaugacauuagguuaggaucaagauuuauguuucuuuguauggauauccaguugauccagcaacauuuuuuauauagagcaucuuuuuuuucugggcuacugcagugcugcuuuugacauaaaucaagugaccguguaugugugggcuucuauuuuguuccauuggucuauucuuguaccaguaucauacuguccuaacucuguagcuuuauaauaaguuuuaauaucugguuguguaaguccuccaacuuuguucuuuuucaagauugaccagaccugagcuuugauaccaucgccauuagccacauguggacacugagcacuugaaauguguaauaugacuggggaacuaaauuuuuaauuucauuuaauuuuaguuaaauauaaaauuuaaaaaggauacuugauucugcuauuggaaaacuguucaccuauuggaaaacuuuuaaauauucuuggaacaucuugggaaagugaaucuacuuuuucucaacuguagguuuuaugaagucuaaauacagauuaaauauuuccaaugaaaauuuagcuuccaaauugagauguguugcaggugucaaauacuuuaagaccuaauagaaaaaagaacacaaaauaucuuauuaauaauuaaaaaauuuuuauuauauguugauuacaugccaauuacaauucuugaugucaacaucucucaggggucugagauuuuuacccagcuugcaagacaacacuuuagccuguuacuguuucauggauguuggaaaaagacauggaacuccuggaucagagauaaagaacuuuaucauggacuagcaggcaacgugagcuuuaugugugccucaguuccccuuuuuccucaagucccauggggcuauucagagaucgguccaggugggugauguauacucagcagguuugugucacgguucaggaaccccaagcuuaggaaaccucaucuuuuauaaggguugcaaacaagccuucccggcuuuugaccugggggagacguuauuauacuagacagcaaacaagccugcaacauuuacauuuccaucagcagugucugagguucuaauuucucugcaucuucucuaacacuaguuauugucugucuuucuuaucauugcgauccuaguagaugugaaaugguaucucauuuuaguuuugauuuauauuucccaggugacuaaugauauugaguaucauuucauguguuuauugaccauuuauauaucuuuggagaaaugucuacuuaaauccuuuguccauuuaaaaauugcauuugucuuuuuauuguugaauuguaaaaguucuuuauauauucuggaugcagauuccuuaucagagaugugauuugcaaauauuuucuuccauucuguggguuguauuuucaccuucuuuuuuuuuuuuuuuuugagacagagucuugcucugucaccuaggcuggaguacaguggggugaucucagcucacugcaaccuccaccucccgggcucaagugauucucgugccucagccuccgggguagcugggaguacaggcgugugccaccacacccggcuaauuuuuguauuuuuauuggugaugggguuucgccauguuggccaggcuagucucaaacuccucggcucugaagcaauccucccacuuaaaccccuugaguagcugaagguacaggcaagugugucauugugccuggaaguuaauauuauuuuuauucuagaauucuuauuguaacggugaaugggauccuuuuuuuucuauuguauuuuccaacugguuaucuaugguaugcugaaagauuaagauaguaaaauguguuucucuguuuccaguauccuucuuuuuggcuuaagagaaggcauaagccacugcauucuuuaaaacuuuuaaguggcuccuguggccuuuaaggguuaaauucaaacugcuuaucauugcaaugcucugccucaccgggcucccuuguacuccuccaguaguucaucucuuaccucucuccgccuuucacuuuacgucucagccaaacugaacuuguucuguuuuuucuaguguuccacacugucguguuucugggccuucuuucaggcuaguacaucucccuccuuccuucccucccuuuccauggcacacuucugucugcccuucugaucucaauggaaacaucauuuccucugaguacccuuccuaaacucccuaaccuagauuacuagcuuuggcccugugaucuuacagcaucugcccguuccccuuaugacauaccauacacuuuauuagaguuguuuauccacuuauuugugucuaccuuuuguuuuguuuuguuuucuuuuuuugcuuguuuguuuuguuuuuguuuuucuuuuuuuugagauagauguguugguguguugcccaggcuggucuuaaacuccggggcucaagcgauccucccgccucagccuccugaguagcugggauuacagaugcacuccaccaagcccagcugucacugcuuugagugcaguuaacagcauccauccagcucgccacugauuguauuugcaguuucuagcacagagcuuuguacacuauagacgcuuuaucauuauuuuugaaccauuuauuacuucacuaaacucuccauuuuauacuuuuuaaaacugauucuuuccaggauaauuaaguuauuuauuuauuuauguauuuuauuuuauuuuauuuuuuuugagacagcgucuugcucuguugcccaggcuugaguaaagugguacgaucucugcucacugcaaccuaugccuccuggguucaagugauucucaugccucagccucccgaguagcugggauuacaggcaugugccaucaugcccgacuaauuuuuguauuuuuaguagagaugggguuucaccauguuggccaggcugaucuugaacuccuaaccucagaggauccgccugccuuggccucccaaaguguugggauuacaggcgugagccaucgugcccggccuaaaauauaauuuuaaaaagaaaauguuuacuuucuguugaaagauucuggucccucauuuuuccuaaguuucuaaagcauaucaaauauagaggccaggcaaguggcucauaccugugaucccagcacuuugggagccggaggcaggaggaucacuugaggcuagaaguucaagaccagcuugggcaacauagugagacccugucucuacaaaaaaguaaaaaaaauaaaaaauuacccaggcauguaguguguaccuguagucccagcuacuggggagacugaguugagagaaucacuugaacccaggaguugagcccaggaauuugaggcugcagugcuaugcuugagccacugcacucuagccuggacgaagagagagaccuugucucuaaaauaaaguaauaauaauaaaaaagaauaucaauacaauaaagauauugaauccaguccaacuuaaagcaccaaagaacacauaggccccauauucccuuugcuauuaucacccuagcuauguggaaacagugucaauacaauuaagcuuuaugacauaugucaagauuaagauuaucuugccugugucaacaauguuuccccuuauguuuuuuuuuugguugugagguagagucucacucuguugcccaggcuacagugcaguggugcuaucauagaucauaguucacuguggccuugaacuccugugcucuagugauccucccaccuuggcuuccuaaagugcugggauuacagguaugagccacugcacccagccuuccucucauguucuuaagaugcagcaguccagguauccugauuucacagguagaaguacaaaggcaggaaggagcacgucccugucuuggucuccuuuugaagaguaucggggaagacuuugccagaagcuaacuuccccauuaggcaucacuggccaggguggugaucacaugcucaguccaccauggagaacaacguuaucaugauuuagagcugaaacgguggagucaggugaggaaucuggagguuauuauuccagagcccacauuccuuccacuauuauaacauccugccuuccuacuauacugggggccacagaugccacuuccuggcuuugggaacauggacaaguuacuuugccucucugugccucaguuucuucaucuuuaaaguagggauaauauuaguaccuaccucaaaggguaguugugaagaucgaaucaguuaauguacagacauuccuuagaaaaguaaccugguacuuaguaaauacucaguaaagguuaacaauugcuacuguuaguaacuacaugaucuuggucuauuaaccuacaaugcuaacucccuggcccaaaucauagacauugcuuucucucuuucuuuuauuuauuuucuuuaagacagggucucacucuguugcccaggcuguggagugcagugacauaaucacggcucacugcagccuuaaccuuccugggcucaagugauucucccaucucagucuccuguguagcugguacaaaggugugcaccaccacaccuggcuaaguuuuguauuuuuuguagagacgggguuucaccauguugccuaggcugguccugaacuccuggacuccagugaucugccugcuucggccucccaaauugcuaugauuacaggcaugauccacugaguccagcccauagauaucucuuaacucaacuauuugaauagucuccuaauuucuacuuccacauaaaaaaauacauaguaguuuuauugaaaauaauucacagcugggugcaguggcucaugccuguaaucugagcacuuugggaggccaaggcgaguggaucaccugaggucaggaguuugagaccagccuggccaacauggccagaccauggccaacaugaccccaucucuacuaaaaauacaaaaaauuagccagacgugguggcgggugccuguaaucccagcuacuuaggagguugaggugggaaaauugcuugaacccggaagguggagguugcagucagcugagaucgcuccauuguacugcagucugggcaacaagggcggaacucuaucucaaaaaaagaaaaaaaaagauaagaaaauaauucacauacuauauaauucacacauucugcuuccacuuugcauuccuagucuuauuuucuaaagcaaucuuuuauuaucaagccuuauuaucuucaauaauaucuuguacccugaucaaaaccuucugcuucuucuuuuuuuuuuuuuuuuaagagauagagucucgcucugucgcccaggcuggagugcuguggugcgaucuaggcucacugcaaccuccaccucccagguucaagcaguucuccuaccucagccucccugguagcugcgacuacaggcacaugcugccaugcccggcuaauuucuuuuguguuuuaguagaaacgggguuucaccguguugccuaggcuggucucagacuccugagcucaggccauccgcccgccucggccucccaaaauugcuaggauuacaggcgugagccaccacuccaaaccccuucugcuucuuagagggguuaaguuuaauaauaauaaaaaaaggaaaucaaaacaaaacagaaaaaccuccuuguucucaauccuacuuacaaaaucugccuuacuuaccauggcuuuuaaggcccuacgucauuuagugcuuguacuuuuuuuuuuugagacagugucuugcucucacccaggcuagagugcaguggggugaucuuggcucaugcaaacuuugccuccuggguucaagugauucuugugcugcagccacaugaguagaugggguuacaggcaugcacuagcaugcccagcuaauuuuuuuguauuuuuaguagagacgagguuucaccauguuggccaggcuggcuuuaagugaucaccgcccgccucaagugaucugccugccucgaacuccuggccucaagugaucugcuggccuuagccucccaaaguauugggauuacaggugugagccacugugcugggccucuuauuguccuuuccaaccucuucuuguagcacauacucuaccuugcucauuugcaucaacuauauaaacuuccuuucucuucccuugaaaaugugaagcuuauuuccauuucuacuuugccucaucuauaaccuuaggcugggauguuauugauauuucucaugggugacuccuuuuggcauucgggugucaacuuaauguguuuuucacagaaaggcuuuuuccugauaaucuguaggagucucuggucauucccuggcacagugcuucucaaccuuuaaugugcauguaaaacaccuaaguauuuuguugaaaaugcaaauuuugauucagagggcugggguagggccucagauucuguaugccuuccuuccuuccuuguucucuuuucuuuccuuccuuuuuuguugcuuuuuuagagauaggggcuuccuuuguugcccaggcuggagugcaguguuauaaucauagcucacuguaaccucaaacuccuggucucaagugaucagccucccacagugcugagauuacaggcaugagccacugugcccagcccaacaguucuuuuuuaaacagugguucuugggcuggaugugguagcucaugccuguaauuccagaucuuugggaggccaaggcugaaggaucguuugagcccaggaguuuaagaccagccugggcaacacagguagaaccccucucuacaaaaaaugaaacgugagccaggaaugguggugugcaccuguagucccagcuacucaggagaauggaggggaaggauagcuugagccuggaagguugaggcugcagugagccaugaucaugccacugcacuccagcauaggccacagaaugagagacccugcuuaaaaaaaaauuauaaaacauugguucuuaucuuguuuaaaaaucggaaaguuggccgggcgcgguggcugacgccuguaaucccagcacuuugcgaggccgaggcgggcggaucacgaggucaggagaucgagaccauccuggcuaaaacggugaaaccccgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaaaucggaaaguuguauauuuaaaggacuugccucagauuaaacauacucacacauaauuuucuuucuuuuauagaacucauaaauuaauugacaaauaauuguauauauuuaugggguacacucugauuuuuuuuuuuuuuuuuugagauagagucucacucuguugcccaggcuggagugcaguggugcgaucucggcucacugcaagcuccgccucccagguucacgcccuucuccugccucagccuccgaguagcugggacuacaggcaccugccaccacgccuggcuaauuuuuuguauuuuuaguagagacgggguuucaccguguuagccgggauggucucaaucuccugaccucgugaucugcccgccuuggccucccaaaguccugggauuacaagcaugagccaccgcgcucggcccgcucugauguuuuaacagauauauauguucuagaaagauuaaaucaaguuaauaacauccaucaccucaacuccuuaucauauguuugugaugagaccauuuaaaauccauuauuaauuuugaaauauacaauauacaauuuucuuuuaauuucaagaggcuccaagacacguaccuccccuuaagucugucuuggaugccaacucagaccuuguuaagaaaaaaaagcccuauauuuauuauauaacaauucuuguaaggauaucagugacaauuuggauugccucuucuuuuuggauggugcuauuaagaagaacaugauuaugaauuuguaauuaccuguuuacugcacaggcaaaaucaauccccugagacuguggcauugcaguagagaaaagaguuuaacugaugcaaggcagucccacacaggagaacuggaguuaucccucaaaucagucucucugcaggcuucgagcugaggguuuuuauggacaauuucacgggcagggggcuagggaauggcacuguugauugguuggggaugaaauaauagggguguggaaaucgauccucaugcacugaguccaacugugggugggacaacaggaccaguugagucaugagucaugaguccagguggggucagucugaaagacauuucagcaaaaccaaucuuagguucuauaacagugauauuauuuguagaagcaguuggagaagucacaaaucuugugaccucuggccacaugaccccugagcaguaagggauuguagaaacuuggccuacacuuuagcagaguucaggcuccucucauaauuuuauucuuguaggcuuucauuagucuuacaaagguggcuuuugguuuuugagaaauggugggguuagccuaagggagggagcaauaauauugucgucauuauuuuaaaguuaaacuguaaacuaaauucauccuaaaguuagcuuggccugugcccaggaaugaucaggcagagcuuggaggucagaagcaagguggagucaacuaugucagauuucucuuacugucauaguuuuguaaagacaguuucaguuuauuauauauuauuuguuuaauguaguaagauuaguuaaggggagcauaucagcauaaacuugggacuccacagcuucaggagaauuuuauuuguuccaaacuuauauuuuaaagugaaaauggaaaaauugaaggaaaucauguguuuucuuguagauagcauucccauaaacauggugaaugucucuaaaacccucuagacuuucuguaacauguguggcaugugccaaguaccaacuucaugccaagaucaggauaagaagggcaaggauucucugugugcccaaggaaaguggcguuaugauaggaagcagaguggcuaucaucaucauaggcagacuaagcugauuuuccagaaaaaggcuaaaacacaaagaagacugugcugagcuugaaugcguugagcccaacugcagaucuaagagaaugcuggccauaagagaugcaagcauuuugaacugggaagagguaagagaaaggccaaguguugaucuaguuucuaaguaucaucuuuuguuuuauuaugcagauaauaaaaucuugagguuacauuuacuuaaaaaaguuggagaaaauaaaaguaauuacgacuauacacaaagccugaggaaacucauuuuuucccuggggaaaguaaaacuaaauaggaguaauuuuuaccauaacaaggaaguuuuaauagguuauucagauguaggacacaagauauugauuaaaucuuuuagaaagugggcuguggaguauaguaggaucuuccugaaacuuaguuuaggagaauauagugaaauaagguacaaaauugaaguauucgaaagaauagcgcagacuuuuuggguuccuaaaaucuuucauuuauguuuguaaauuaguguguggaacuuccgaauggcauuuucccacuguccauuuggaguacaauaagacaaauuaauacaaaucaaaauaauauggcagcagcaucacauaauuuguguacacugauguaguaacagauuuaauuuaaugcagcuuuugagaagucuuuuguauuucaauuuauacagcugcuauccagggcuaagcuggccaaucugucagccuugaguaucuugccugacugauucucuuuuuaucucugcugacuagcugaauuuaugccucaucuucacuguaccuugguuuucuuuuccaaaaacugggaaugaagucuacacuauuaaaucaagauguuaggcuagugaaaauaaaaguagaaggacuuuaagccucuccaaaggcagaugccaagauaaacaguacguuuuacccacaauacugauauuuccuaugaauaacuuuuaaacacuuuaaaauuaauuaauuaauuaauuuguuuagacagggucucguucugucacccagacaggagugcaguagcaugaucuccacucacugcagccucaaccucccaggcucaaguuauccucccaccuuagcccuccgaguagcaauaguuccuaguaguaguaaucccuauaggacuagaggcauauaccauuaugccuggcuaauuaaaaauuuuuuuuuuuccaucuguaaagacagagguuucacuauguuucccaggcuggucucgagcuccugggcucaagagaucuuuucaccucagcuucccaaagugcugggauuacaggcgugagccacugugcuuggccaaaacaauuuuuauuuaucuuauuuuuauuuuuuuuagagaugaggucuugcuauguugccaaggcuggagugcaguggccauucacagguaugaucauggugcucugcagccuccaacuuuugguuucaagggauccuccugccucagccucccaaguagcugggacuacagaugugugccacuccacccagccucaacuuuaaaaaauuagguauuauuuauuuauuuauuuauuuugagacauaaguaaauaugcucuguggaugguagucucaggccuguuguguuaacccuuuucugcacauuauuuguacuaaauauaauccucugaagugaggcuguugggaaauaggggugguguggguaugugaaugagggggauaugaaaagggugggacuuugugccccccuuuccacuuuucucuuuaauaaauugaggauucuauggaagauuuuguauguaaaaaagguacagcuauuaaaaaauaaaguuggaaaaccacuccuuuaaacaaugagacgaauuucaagccaaagauugauaaaaucacauuuggauuuuaguaagaucagcccuggaguuggcagaagauauuugacagaucaugguagugguaaauuuggcacagugguggugaucagagucauacaucaguacauggaggcuauacauugauuugaccuaaaauagugggacaucuugaagggaguggcccgccggucaaagcuggauuaaaagauuuucugauuugcaauugguuaaggaaacaaagcuuugucuaaaaauuucgggucaacagaaaagaauguuagcucuggcuggugagcauaaccuccuccaggccccucaggaagaaauuuagaacaaagaauaguggucagaauucaguccucuguucccccuuaucugaggucugugugccaguggauccauuugguagggguuggaguuucugaaaaacaacucagugacauguauuaagauguuaucuuuaguuucuauagggaacaucucuaaccucuuuggccaugauuuugagcuucuauuaucuucuugcuuaucaaguggcucauuuacuucucagggcuagcuaggugucuggaauuucccuugaagaaauuccagguuuuucuuuauuuccacguugcagggggcauggcaggcccuaagagagaccccugcuuccuuuaaagggcucaagcuggggugguaggaugaggaaggagaggagggaaugaauuagagaguauuucgcauacaaaauugaguagcaucgaugauugauuggcugagaaccugguugaggagaacaggauugugggaggaagaggaauauaucaguaaucacccugaaguuucucacuugguugacuccagaagucuaaaagaggggguggagaagagcguuuuucucuugugagauucucaaauccuguaacacuaacuggguauucaacaguucaauuugauucuggcacucuuuauuugaagugagcaucagaucccacaaguaaaagggcucagucccauagaauguccccacuucacaugccagcugcaaaugggguauacaggcuacccacauaucuaccuggcaacuacaaauuugggaauucccauagccuuccuccccuuuagauuugauaauuugcuagaauagcucacagaacucaggggaaaauuuugcuuauguuuacugauuuaugauaaagcauacaauucagggagcccaguagaagagauggccuagggggauaccuagagguugaacgcaccuagauguguucaccaacccagaaguucuccaagucuccuugaguguuuacagagcucaaucucuaaccccaccuuccuggggucagugcguggggcugaaaguuccaaccuucuacccacuugguccuucuggcuaccagccucacccuagagucaccuccuuaacauaaacucaggugugaugcaaugaauaacagaaaacacuccuauuacucaggaaauuccaaggguuuuaggaacucugugccaagaaccagggacaaagaucaaauauauuucuuauuaugccacacuggcaaauaucucaaauugccgggaacauuuaggaacucucaaccugcaucuccagcuucaacauugaacccaaaccuuauccugguacugugaggccuaguguuccaggauacccuuagauucuguuuuacaggccuuaagcaacuauaucaguuaggguacaacuuaggcuucuguaacagagaccccaauuauacacuacuuuaaaagcaagauagaaguuuauuacucccuuuuaauuucuuuuggagagagagucucacucuguugcccgggcuggagugcagugguguaggucauagcucacugcagccucaaacuccugggcuuaagccguccuccuaccucagccuccccaaguagcugggacuacaggcacaugcuaauuuuaagccuggcuaauuaaaaacaaauuuuuuuuaaauuuguuauuuuuaguagagaugagguccuacuauguugcccaggcuggucucgaacuccugagcucaagugaucugccugucucagccucccaaagugcuaggauuacaggugugagccacugugccuggccggaaguuuauuauucuuuuacauaaaaauccagguaggcaauccaaagcugguuuggcagcucagcauuguuggagaaccaggcuuuguguaucuuguugcucugcuucauucaacauucugugugcaucucauugccucuuccagcugcagucauuacacuuucacuccaguuagagagaagggaggaaaagggagccaggaggauaugcccuuuuccuuuaaugggguaugucagaacuacacacguuucugcucauaucccauuguuagaaccugcucacauggccauaccugacugcaagagaggccaggagauguaauaugugucugggcagccaugcauccagcuaaaacuucuauuuagaaagguggaacaaauaauggaagacagccgucccuaucuccaacauucaugauauauuuaaggacuuuucccccucuuuuggggaaaacauggaccuaacauugugauuguuaauucuuuuugcuaaaguaauuuuuauguuauugugacaaaggaaacaugauguucaaugaaaugaauaaaaugcuggcagaguaccuuugggaaaucuuguucugaaaaaugugccagguugcugcuguuuauuguugcuucuaaacaguagagaaggaguuagcugcuuauuaaaccugccccacauaaggaauggaauuaugguuggaccucgccacaaucauuucucucccaggagaggccaaaaauaggaucagaacaccacccugcuuugaagcagacacucuugcugugucucaauuccauguccaacuccguaaagguuauggaaaacagaaaaagaucucagaagcagagggcugaaaucgaugugguaauaucugaauguuauguugucuuugaguagagaauuaaggaacaguggaaaacccuugggacuagucuucacgucuuugucuuggugcuuaagaaccagaauuaggguuuacucaaagaaaggcaacucucuugcuuugggaaggagaugaggaaccccagugucuccuucaguggacuggaagcaaagcagaagcuguaguaggaauaggccuucuggaagagagguuacaauuauaguuuauggguuugggguuuguuuccuuuuguuaaaauaaaacaauuagaaauauauucauuguuuaauuauuuuuuuuuugagaccgagugucacucugucacccaggcuggaguacaguggcacaaucucugcucacuucauccccugccucccagguucaagcaauucgugccucagccccccagguagcugggauuacaagcaugcaccaccaugcccagcuaauuuuuguguuuuuaguagagaugugguuucaccauuuggccaggaugaucuugaacuccugaccucaagugaucugccugccuuggucucccaaagugcuggaauuacaggcgugagccaccaugccuggcugaaaauguauuuuauauuauuuuuaucaaaaugacauuuacaaaaacugcuccaauagauauacuuguaacuaguuaaaaguuugaauuugacccuuaagaaauguguagagcacugugaaaauguauuuaagaaagucuaaaauuuuauguuuuuguuuauagccuauacgguucagacauccgagagcaugaccccaacugccacuucagagacuuauuugaaagcuuuggccguuugccauggaccucuggaccacuaugauuuucugaucaaagcucaugagcuaaaggaugaugaacaucaaagaagagucauacaguguuugcagaaauuacacgaggaccuuaaaggauacaauauagaggcagaaggccuuuuuucaaaggugaggcuugugugauaugaaagauuaaacaguuaaaaguguaagcauuuucuaaaauggaugcaaugcaguaggacacaaucaugaaacaucuugaaaaauuuucaccaguuccuuuacacaaauucuguuggauccccauuccuggccuuuugauguuccauagcuuucuuuugccuucagggguuugaauagcuucauauuuagguauuuaaaaaaugcaguccagucuaaauaaaaacuucuauggaaauuaaagcuuucccuuuccucuagcucaggccucauccagggaucagcaguggaaaaggaggagugauguguucuuucccuuuucuuccuccuucuuucucuguuugccugacaucucuagggucagaaugagaagaaugaaagauuagagugaaacagcagccuuaagugaccaguuaguuacuggggccuuuguaugguagaugcugacgugcuagcucuuuguugagggucuuauugguggguucuucaagacucccauggggaccuccacacuucuccagucuuugacuaaccucuuaugacucuggggaagcaacucacaacccugcauucugccgacaccgccuugcucuugcccuuagccuucuugggugggguccuuucaggacuuuuuuuuuuuuuuuuugagacagagucucgcucugucacuugggcuggagugcaguggcacgauaucuuggcuccuggcaaccuuugccuccuggauucaagcgaucguccugccucagccucccaaguaacuggguaacaagcguggaccaccacacucagcuaauuuuuguauuuuuaguagagacgggguuucaccauguuggccaggcuggucuugaacuccugaccucaagugauccaccugucucggccacccaaagugcugggauuacaggugugagccacugugccuggccugggacauuucuuauugggucaucuuuuaugguguccgugcaggccacaggaaacauaacaucuccuuucgccaccccuugcugcaugggcagccucagucagccuccuguccucagacuucugcaagcaagaagcaggcacugguuucugucuuugucaugcauaccccuuucuccuggggacuuauaucaaguucucccaugaacucuuccacacucugcucuggcagcugcuugugcauuuccuuaccuaggcaagcauccagcuggggagagcgauguccaucucaauuuauauucaauccucaucucuuuggaugcuucucuugggaaccccucguauuuguuacgagauaucugaagggcacaccauggcacucuacccagcuaacuuucuaccuugaucacuuucuucaguuucacuuugguuuuagggcuguuuugccuuuuuuuuuuuuuuaaaccuaauuccugcauggaugugacuaguguguauuuauuuauuuauuuauagauggauuuuugcucuauugcccaggcuagagggcaguggugugaucuuggcucacugcaaccuccaccucccagguucaagcaguccuccugcuucagccuccugaguagcugggauuacaggcacacaccaccacaccuagcuaauuuuugugcuuuuaguagagaugggguuucaccauguuugucaggcuggucucgaacuccugaccucaggugauccgcccaccucggccucccaaagugcugggauuacaggcauaagccacugcaccugaccuauuuauuuauuugagacagaguguuacucugucucccgggcugaagugcaguagugugauaucuuggcucacuguagccuccgccucccagguucaaacgauucuccugccucccaaauagcugggauuacaggcaccugccaccaugccuggcuaauuuuuguauuuuuaguagagaugggguuuugccauacuggccgggcuugucuugaacuccugaucucaaaugaucccccugcuucggccucccaaagugcugggauuacagacaugagccacugugccuggccuauuuuuuuuuggagauacugucucauucugucacccagguggggugcaguagcacaaucauagcucacuaguagccuugaaguccugggcccaagugauucuccucccgcagcccccugaguaggcuagggcuacaggcaugcaucaccaugcuccacuaauuuuuuaauuuuuuuguagagacaggaccuuacucuguugccaggcuggucuugaacuucuggucuuaagcaauccuccugccucagccucuaaagcacugggauaauuggugugagucaccacacucagccuaugucuuucuuuagcgugagugggagcuuauuuucccuggucaucagcuuugagcuuuuguugaaauucuaugacaacaggaaaacuccuguuccuuaucuaauauagaagccaauagucucaucuuuaaguucuggagaaaacauuaauaguaguaagaguuaaaauaugguccaaccuaagaaacuaguuuuccuuuaauugacuuuccccacccccugccaaauacgcuuuuacuguaacgucuuuagaagaaaggcaccauagaacaaccauuaguaguacuuuauuuaaaaaugaaugaggggccagacgcaguggcucacgccuguaaucccagcacuuugggaagccgaggugggcagaucaccugaggucaggaguuugagaccagccuggccaacaugaugaaacccugucucuacuaaaaauacaaaaauuagccaggcgugguggcaggugccuguaaucucagcugcucaggaggcugaggcaggagaaucgcuugaauccaggaggcggagguugcagugagccaagaucacuccagccugggugacagugagacuccgucucaaaaaaaaaaagaauaagggccaggugugguggcugaaccuauaauccuagcacuuugggaggccaggguggaaggauagcuugaagccagaaguuugagaucagccuggacgauauagggagacccugucucuacaauacaaauaaaaaacaaacaaacaaaaaaugaaugaaaguaauuuuacuuuuuaauaaagcuccugagaguauaauuaauuuuauuuuuauguaaagaaaaugucuucccauuguguuaacacuauuaguugaaagaaauagagauucauuuagauugcagaaagaaauggagauuuagaauaagauuauauaagaacauagcaaugaaaggcaucuccaugacacagcuaggccuuacagugcucugccauucaugucauucauugucuucguccacuugggcuucuauaacaaaauaccauaaacuggguagcuuauaaacaacagaaaaagauuucuuguaguucugggugcugggaaggccaagaucaaagugcuggcaaauucagugucugaugagggccugcuuaacuauucuuggacagcugucuuuucacuguguccucacauggcugaagggacaaaugagcucccucaggccucuuuuguaagggcacuaauccaacugaggagggccccacucucaugaccucaucaccuuccaaagguccuaccuccuaagagccucacuuuggggguuagaacuucaacauaugaauuuuggggugaugcaagcauugagaccauagcacccacuuauuuuguuguuccuuuucucucaugucugcuuccacuucuguucacucuaccaacuucuuaauucucucugugugucuguaguuuaaauuccugaguaaggaucucauaggccaaccaaugacuucaucccuguuugggcagagcuuucacauuggguuucuuagaggccguuaaccagcguaaagauuggcuuaccuauggucccaugcagggcugcuccugugagcauggcaguugcucucagaaguggacugugaguguggugggcaccaugagugaccaguccagcacaaugguuauagguaaugaugaauuauuucuuuugaugaccaaccucuuuuccccauauuucucaguuuauaguugaguaaagaaccaaaaaauuugaaaaauauagacugcuuauguacugcauaucuaguuauaugugauauauauauagggauauauuugcauauaguauauaaacuauaacauauaaaacuauguaauuauauaguuugugauacaggugggcauccaaguaaaauaacaauuugguuauguggccuagccaggaaacaacauguuguacucaacuggauauuuugguuaucugagacuugaauugcuuuccugaauuuuacaucuuguucccuuucuaguccucuuccuuuuggaaauauauuccuuuuguuuuguuuuguuuugagacagggucucacucuauugccuagcuggaaugcaguggcacaaucauggcucacugcggccucgaccucccgggcuccagcaagccucacaccucagccuccccaguaacugggacuacaggugcaugccaccacacccagcuaauuuuuuguauuuuuuuuuuuuaauagagaugggguuuugccauguuguccaggcuggucuugaacuccugagcucaagcaaucugucugccccagccuccuggaaauauauuccuuuuaucccuccucccuacucuauagcauccccaggacccaucuuacaguaguuggugacaucccauccaaucacaaguauccuguaacuauuaacuuauuugguugccaauucaacaauggugguuuuuaaaaaaaucuuuggcucuucuuagggguauuuucccguauguccaccuuugauaucugaguuggcuaugaugggccagcuagugaauaacccugguuuuacuggguaguugaaaucuaauguaaauggaagauuugauaugucagguagaguuucaaaugugucuaaugaaagguccuauuuguuaaauccuagugcaugugaauaaauguuuaguagguagagcaacaucuuuuucuaauaguauuugucuuauucccucccucccucccuccuucccuuccuuccuuccuuccuuccuaucuucccuccuuccuuucaagacagggucuugccauguugcccaggcuggucuugaucucugggcucaagcaauccucccaucuuggccucacaaagugcugggauuacaggcaugagccaccgcucuuggcccuuauaguuuccuaaacccacuaaaucuuuauuuuaaauaaagauuuuacuuaaaaauguuauuuuuuauuuuuuuugagacagagucucacucugucacccaggcuggagugcaauggugcgaucuuggcucacugcaaccucugccuccuggauucaagugauucuccugucucggccucccgaguagcugggauuacaggcgcccaccaccacgccuggcuaauuuuugcauuuuuaguagagacgggguuucaccauguuggucaggcuguucucgaacuccugaccucaagugaucugcccgccuuggccucccaaagugcugggauuacagaugugagccacugcgccuggccccacuaaaucuuuaaaauacugaaagagauccaaacaucuaacauaauuugaaaaaaaguauauaaaacuuuaguuuuuaaagaguguaaagacgacacagaccuauuuuuuuucuaaaaacaaacacugauaugccaauuaucagaaaaggaaacuuugggcuauuagguuuuccagugauggaaaaacuccagugauggaguucuuuauucuggugcuaugguucgaauauuugucucuuucagaacucauguugacauuuaauccccaguguggcaguauugaaaggugaauucuuucagaggugacugggucaugagaucucugcugucaugaauggauuaguccauucguggaguaauggguuaauggauuaauggauuaucauggaagugggaccgguggcuuuauaaggggaagagagucuugagcuagcaugcucagcccccucgccaugugaugccccugugucaucuggggcucugcagagagucuucaccagcaagaaggcccucacuagguggggucccucaaacauggacuucucagccuccaucacuguaagaaauaaauuccuuuuuuauuuuuuuuuuuuuuuugcgacugagucucacucuguugccaggcuggaguacaguggugugaucucagcucauggcagccucccccggguucaagcgauucucuugccucagcuuccugaguagcugggacuacaggugcaugccaccacgcccagcuaaguuuuguauuuuuaguagagaccagguuucaccauguuggccaggcuggucuugaacuccugaccucgugcucugccugccugggccucccaaaguguugagauuacaggugugagccacugcgccuggcucauaaauuccuuuucuuuauaaauuacucaguuucugaagauaaaacucugacuuuggacuguaaaccuuugucuuggguaugaaaccuugacauuguugaaagaagaguggaaacuguaagggacaacaaguuucaccacagcacagucuucuuucucugauaggccauccgaacagcuaaggagaagacagaucacucaagaacuuaaguuguuuauuagcuacagcauguuugcugcuuugauacacauucagccauuuuggaggaaagcuaagcaguacugacugcccauuuucgugaacuuuaaauaacaaauacuauuucucaaggucuucauuuuaucauuaaauucagcuaauuacuaccuguuuaaaaauaaauaaauaaauaaauuucagaauaucugaaacucaauuucagauauucuguuauaagcgacagaaaaugaacuaagacaugugcuaaguaggauuuaugauuuuaugaacuuuggauuuuguuuucaauacaguuguuuaaacuucauuauaggcugggugugguggcucaugccuguaauuccggcauuuugagaggcugagaugggaggauugcuugaggccaggaguuugagaccagccuggccaacauagggagaccccaucuccaccaaaaaaaaaaaauuagcuaggcauggugguacaugccugugguccaccuaauugggaggcugaggugggaggaucacuugagcccagaagguugaggcugcaguaagccgagaucgugccacugcacuccagccugggcaacagagagagacuaucucaaaaaacaaaacaaaacagaacaaaacaaaacacaaauagacuucauuaugguggacuuauuuuuuuucccucauuauacuccuaagaaacuuucuguaagucuaugcuauaauauuaaaauaaaguauaccuucuucauaagauaccaaauuuauuaaccaaggugauaaaauuggugacaaacuaccaggcugcuuucaccuaccuauguaacaauguuuucucuaguaaauuaacauuugaagauguuaugaacagaugaccaugccauaugagcaacaaacuaugaagaaugaacauuuauaaacacuuuacuuuuguuauugaauaaaauuuacaaccagguuaaucugacacuuuuaauguaugcauaauuguuauugugcugugagguaauuaggcauaaaugguaaguaguucauguaaaucacuauaauuagaauuacuuuuacacagccaaaucaagcauuuccagagucagggagggagagaauuaaauagaguauggagcuacucugaaaaucucuauuuccauuaaucaggggucuauaggcagccagguuuuuucaucucuugggaggagacaucguagcccaagagaccugagaauugggagccacagaacuccuuuccuuuuucuccugcccucuaccagauaauuuucaguuuuucccuaaugagaacuuauuuccaacucccucuuauauccuaccaucuuuuauuuggauaccuccuccucacccuuccaagagcaaugcaugaggcagauggaaaagaacuacucaauucuaccauugcacucagagcagccacaggcaauacauaaauaacuguauuccaauaaaucuuuauuuacaaaaacaagugucaugcuggauuuagcccauggccauaauuugcuggccuuugcucuagaugacugcuaccugacuagauaugagggcugguagaucauuaauuguauucaaaguccugcuugaacuuuaccuagucuagcuuucaaguuuaauauuccauuacuauauuguauuccugcccuauucaacaggaacuauucacuauuccauuaaauagacagacaaauagaacaaaauagaaaguucagaauauacaugggaacuugauauaugauugaguugacauugugaauuaguaggaaaaggauugucuauucacuaaauuagcaugggaucauugguuaucuaugugaagauuaaaguaaaauuagguacuuaccucuagaaauaaaugcccuaaauuuaaagugaaaacuuuagaacuucuugaagaaaauauagaggaguaacuuugugaacuugggaaaaggaauaauuucuuuucuuuuuuucgagguagaguuuugccguguugcccaggcuggagugcagucauggcucacugcagccuugaccucccaggcucaagcaauccucucagcuuagccuccccaguagcagggacuacaugugcauaccaccaugccuggcuaauuuuuuguauuuuguagagauguggucucaccauguugccucggcuggucuuaaacuccuggccucaagcaauucaccugccucagucuuccaaagugcugggguuaccggcugagccaucacgcccagccagaagaauuucuuauacaagauaugaaaguccaauauauauguucauguuguccuguaaauuaaaaagaaaauaaaaaaguucaacuuauaaagguaaacacugauacauuugacuauguuaaaauuuaaaacuucuaguuaacaaaagguaccauagaaaaagugaaaagguagacgacagacugggagaaaagauuuuucaucaaaaauaauugacuacuggcugggugcgguggcucacgccuguaaucccagcacuuugggaggccgaggcgggcagaucaccugaggucaggaguucgagaccaaccuggccaacauggugaaaccccgucuguacuaaaaauacaaaaauuagccaggugugguggcgggcgccuguaauuccagguacucagaaggcugaggcaugagaaucgcuugaacuugggagguggagauugcagugaggugauauccgccacugcacuccagccugggugacagagcgagacuccaucucaaaaaaaaaaaaauugauuauggaucgcucucuagaauacauaaagaacccugaccaggugcaauggcucacgccuguaaucucaacacuaugagaggcugaggguugggaggaucgcuugaggccaggaguuugagaccagccugagcaacauagcaagaccuaaucucugcaaauaauaauaauaauaaagaauauauaaauaacaucuaccauauaauagaaaaacagacaacccaguagaaaaauagacaaaggagaguauuuuuuuucagaaauaacuagcagaugccacaagacuggauaaacaaaucagaauguauuuauaaaauggaauguugcuuagcauggggaugauaaacuauacauucagguggcuaauacugaggaggaaggggacaaaggaggcuucaacuauacuuaaugcuuuauuacuuaaauuugaaauaaaugucaacauagaaagauuugauaaagcuggaggguggguaacgagguguuccauauagucuucaauuuugccuguuuguaauauuccauugugaaaauauuuuacaugugauugugagauauuucaacagguuaguuuuguuuuuguuuuguuuuguuuuguuuuugagacagagucuugaucugucacauaggcuggaguucaguggugcgaucucggcucacuguaaccucugccuccuggguucaagcaauucucgugccucagccuccugaguagguagggcuaaggcaugcgccaccacgccuggcuaauuuuuguauuuuuaguagaugcuguguuucaccguguuggccaggcuggucucaaacuccuggccucaaaugauugccacaucagccucccaaagugcugggauuacaggugugagccacugugccuggcaggguuaauugauuuuuuuuucauuuugaaaaaauuacaacuuuucuugaaaauauaauuuuagagucuacuaguucagccuuuccuucuuacaaauagacugaggggccggguguggugcgucaugccuguaaucccagcacuuugggaaauugaggcggguggaucacuugagcccaggaguuugagaugagccugggcaucauggcaagacuucaucucuaaaaaauaaaaauuaaaaaauuaaaaaaaaaacaaauagacuguggaaggagaauuauuagcacaguccuccagaaaggcauaugaaauauguuuauaagaggguuuuagcaaugcaaucuuuuccucuuucugaaauuucauaaacugaauacuuauaaaucugaucacacucuucuccugcuuaaagcuuucagcccccucaggauaaacuacaaacucagcauguccuucaaaguucuugagagccuagucccugcaucuugccagccuccucugccauuguucucugcuggcaauaaaagucccagcuaugaugaccugcuuaaagauccuuggacgaggcugagacuuuauuuugucucugggucuuugcuaaagcugcccacccuccauccuuucguuauggcucaccucacauugccugcuuggugaccacaugcuccucugguagauauuguauuucuuucuuucuuuuuuuuuuuugagauggagucucacucugucacccaggcuggaguguaguggcacgaucucagcucguggcaaccuccgccucccaaguuaaagcgauuuucaugccucagccuccgaagcagcugggauuauaggcguuugccacugugcuuggcuaauuuuuaguagagaugagccaggcuggucuugaauuccugaccugaagugaucuuccuaccuuggccucugaaaacguugggauuacaggugugagccacugccccggcugguuuuucuuuucuuggucuucugggccugaagaucccagcccacugccuagcacaaaguaggugcucaauacucaauucauguuuguggaacaaaugaaaugugaaugaguaacaaagccaucacuaaagagucauagagccuauccauguaucugugugagaguguaggugucuccauugugugccuauauccacguaugucucugugaauauguccucuucucauucccuccuuaacaucaguuuuuagcuaacccugaagaugccuggaaggccaguuuaauuucucagauucagaacaacaacagcguucagaacaagggauauuuuccaccucuuucuuuugaugaagcgcagauuggcuugagaguaaugcucguaucucaauaguggacugaacuaguaguggacuggaauagaccagaccuagcagagcuucaccuaagcuggccaaaagcagaguaucagguaggagcaaagugaacauggaaggauuugccagaaaacuagcccgcugucauuugucucccaguggugcacacaggaacuuauaaauguuugugacuugaaugcaugagaugucaaaaagucauuugcaucuuuaaauuguguuauaaucagaaauugagccauuucuuacacuaguaguuuuagaguuuuaagcacacccccaacuuauuuagauacuuaaauaggcuuaauuaugcuaguaaacugagcaaguugguguauuauacuuuaggcugccgagauucuuuugcaaaucagcuaaagacauuucaaaaaccauuuucauuuaaagagaauuuaugggugcuaauauauaguucaguuuuuuaguuuuuaaagaucuucuuagaaaccugaaaugaucuacuuuuaucaaaaagugguccauguugagaaugcuauaaugccaguuuuuaaaagauguaauuaugcucagcauuccagcuggaaucauuguuucugauucuaucauuuugggagauaauaaugcaaugguggggggaauggagagaaacaggaaaaguaguauuccugcauuuuaaacaaauugaaaacaacacuuuuuauuuuaacagcaccacccuuauuaucuaauuguccuaguggaaaugaugccagaguagcagguggauagugacccagaaaggcagaggacgugcuauuucaauguauaacuuugaugagaaucaccuuggaucauuuuuuaaugcuagaauuuuaauaucauagggaacaaaggauaauauuaaaaucauuaaaucaaaauauuuggaaugauggaugacauacauucuuuuaguuugcaguaaaggaauaguuuugauaacaguuuugaaagcaaaugucuacaauacaaauaugcagauauuuuugaauaauuuuaggcuuauuucaaaaguaaaaguaauacaguagucaccuuaccaaauuuuguucuguuuuuuuccaacuuuucauuuugaaaaauuucaaugauauacuuagauccacuaaugguuaauauuuugccacauuuguuuaauuuucucucuaaauaucuuauuuucuagaaccaucuacaaguaaguugcaucauaacacuugaccccuaaauauaucacauauaacgccuaacaaggaccuuuuccugcauaacuauauuaucaucaucacauuccagaaauuuaacacucauuuaguaauguuaucuaaaguaggguuggcagauuuagcaaauaaaaauacaggcugcccagauaaaugugaauuguauguauguauguaagagauggggucuugcuauagcccaggcuagucucuaacuccugggcucaugugauccuccugccucggccuccuggguagcuagauuacaagugcaagauaugacauuuuugaaaggaauguagcacgaucuaaccuugaagauaugaacuaccucaagcuaauaguuuaccugauauacgagagauguugcuguaucuuccugaaacauuuaaaauagcccuuagggcuccuuugaguuugcugcagugcccugggugccucaauuugagaacuucaauucuuugcaauauguuguauugacuuuuuaguacaugugagcauuguguguucacuacacaugcaguauauauuauguuauaugcucuguguguuuuauuauuugugcuuuguccccccuucuauuccgugaguuccuuggaaacaaggauuguuuucuacacauuauuguauccucagcacauagcacaguacaugcccauaaaugcugguugaauuguaugaaauugaaucuagguuaaucuccuaauuuuauuaaugagacacaaaggccuaagguuagcagaaauaucucguguucagaaauguuuguuagugauaaagagaucuuaguucucaaauacgacccugacuugagccucugcuuuucaguuaaguagaaaccuaaauuggacauauaucauauauuauggguaguaacaaugagguauauugaaauaaauaaucaaaaaauuccgaagcuaaauauuauaauguucaucuugggauuggugcuuggugguuacaugaaagacagggcuuuuacuaaagcuuuucuguuuuuguuacuaaauccucagggagaugguguaaugaaaacauuucacugcaguggcucaugccuguaaucccagcaauuugggaggcugaggcgggagaaucccuugagcccaggaguuugaaaccagcuugugcaacauagggagaucucaucucuacaaaaaauguaaaaauuagcugggcaugguggugggcaccuguggucccaguuacuugggaggcuagggugggaggaucucuugagcccgggaggucaaaccugaagugagcugugauggugccacuggacuccagccuggguaacagagcgacaccuugucucaaaaaaacaaaagaaucauuuuggacuuuggagucagauuugaagugcauuuccauuuuggcucugacacuaucuucaucuuugucuuaguuuugccaucuaauucauaagucauuugcuaagagugggaauauuuaucucugagaaaacuuuuuccuccaugauuacaaaaugugaaauauuuaagaaagagcucugugaucaaauaaguuuaggaaaugcuaugugaauaacucucagagaaucacaaugccauuaguauaucaaagacucugagaaauucugcaguaaacaaacuuuuuuuuguuguuuuuuauuuuuuauuuuuuuguagagaugagaucucucuauguuguccagguuggucuugaacuccugggcucaggcauucuuucugccucagcuuccuaaaguguugggauuacaggagugagcuaccaugccuagucaaagaaacuuuuaaacuuugguccuguaauucaguguuucuccaacuugaacacguggcuucuuuuaaaaugaacacccauaaacauaaugcagaaauaaugcuuuaugcaauaaacuuuagaaaacccuacuugcuucauaggaauuguuugaugugucugacauguagugagaacucaacaaaagaugcgagaccccguuaccaagacacacauccuggauucuggcuuuaagacauucaaugcuuauuuauuuauuuaucuagacagaguagucuugcugugucacccagguuggagugcagcggcaugaucucagcucgccugucccccuacaucuuuguuaauacaguguccucucaaacuuucagauuuuugccaugaugguauuucauuaauauuuuaaaucuuaccucuuguauugugaaugagaguauucuuucaacguuaaagcaauuugcauuuguuuuucuuacugauugauuuauaaaagcucuuuguuuauuaagaaaauaaacucuuuuuuuuuuuuuugagacagauucuugcucuuucgcccaggcuggagugcagugguguaaucucagcucacugcaaucucugccaaaugauucuugugccucagccucucgaguagcugggacuacaggcacgugccaccacaucgacuaauuuuuguauuuuuaguauagauggaguuucaccauguuggccaggguggucucaaacucuuggccucgagugaucugcucauguuggccuuccagggugcugggauuacaggugugagccacugcacccaggcagaaaauaaauucuuuaaauuuuuuuuuuuuuuuuuuuuugagacagucuugcucuguugcccagccuggagugcaguggcaugaucucugcucacugcaaccuccaucuaccagguucaagugauucucccaccucagucucccauguagcugggauuacaggugugugccaccaugucuggcuaauuuuuguauuuuuaguagaaacgggguuucaccauguuggcuaggcugguuucgaacuccugaccucccgccuuggccucccaaagugcuggauuacaggugugaacuacugaaauucuuuuaaauuauuuuuuaauuuuuaauuuuuguggguauauaguagguguauauauuuaugggguacaugagauguuuugauacaggcuugcaaugugaaauaaucacaucauggagaaugggauauccggccucucaaacauuuauccuuuguguuacaaucaaauuauauacucuuuuaguuacuuuaaaaucuacaauuauugacuauagucauucuguugugcuaucaaauaguaggacuuauucuuucuguuuuuuuuguacccguuaaccauccccaccucccccuccaccccagccucccacuacccuucccagucucugguaaccauccuucuacuugcuauguucaugaguucaauugcuuugauuuuuggauccuacaaauaagugagaauaugugguguuugucuuucugugccuggcuuauuucacuuaauguaaugaccuccaguuucauucauguuguugcaaauaacaauaucucauucuuuuuuuauggcugaauaggacucuuguguauucuugcccauaauaacugaugcaguuuuuuuuuuugcaguuuauuugcuguuuuuccuuccuuaggauuuuuucuaacagaaaguuauaauuucaguguuuuuuuuuuuuuugagauggagucucgcucuguuguccaggcuggagugcaguggugugaucuaagcucacugcaaccuccaucucccaauuucaagcgauucuccuccucagccucucccaaguagcugggauuacaggcgugugccaccacagccagcuaauauuuguauuuuuaguagagacagggucucaccauguuggucaggcuggucucgaacuccugaccucaagugaucugcccgccucagccucccaaagugcugggauuacaggugugagcuuuauaagcuguugauaaggauuacaagagaagaggaauuuaaugugaugggcccugguuccugagaagguagaugggguauaaaaucaaacacugauagaagguuggaagaaggacaggaagaggaaucguuuuccuuuguaacaggaggaaugucacaggagggaggaauggaugggugcagacgugggugggauugcaguuucacauaggaaguugaaggacuuucaacccaaugccuucuguucucuuuaugaagaaguaggagacaucuucugaaagugaugagugaaauguaguuuugcuuaaugggaaguaagaagguuccagagauucuuugcagagacacagugaacucaccaggaaaacagaauuguugacaauauggagggcccagagagaggguccucucugcacgacugucagacuuuuuucagcaauccucagcaaucugggugaaguucauggaaggguauauauuuuaguaugagauuuuucuauuuuuagcuaucuuuuuaucauuuauauaugauuuuauuaaauuaugguuagaguacauuugauucuuuggaauuuauugaaguuuucuuucuggcuuagcauauggacuauauuugaaauuaugcugcuaguucuugaauguauucuugguuuguuggguuuagaguuuauauggauguaaauugcuugaacuuacuaauuguauuguucagaucuuugagagggaugugucaaagggugugauguuucuuuuuucacgaauuacaggucugaguauaaacagguauugguaagcacauuauguuugcagucuuuggcgugauuacacaugcaaaggugagcagugauggggaacuucccugugcugggcccugcacccaacagauaaggagacagcagguuggagaguugagagggcuuacccagggucaccuagcuaauaaauagccagccaggauuuguaccuagaucuuuuggguucaacucuaauacucuucugccauaucucuuaugcuugguggagguaggugguagguuaucacugucuuccaacaucauccuuaagcuuaugagcuuaugaucuaucugcacaaucuaaaaggugaugucacuggauccucaucaaaagcccauuagagaaggugucaucauccuacuuuacaaacucccuaagauacagguaacuugugacaaaucuuauaacuggucacuagagaaacuuagucauuucagauuuugaagucugagucuaauguuacgugugugcauuuugggaguccgggauguaucagaguccuggcagaaaacaauucacagcagauguuucaauaaagaccaaauuuagagacuacuuagagaggcaugggcaggcuuaaggcagcaaacaagggauggaagggcaaaggaggagacuggugagagcuggagcuguggccugagggaugggucgcuuguuggucuggagggaugcagcucuacugggacacagcucugaagcagggagggaugggagagaacgacccaucccuuucuaugcccucuguccuguuuccugcaaggaaugccucccacaggcugaaccagccaggagccagccagaaagggcagucgcuugggguacagacaggacggagaaggcaucaggggaggggagcacauggagaaugaccagcaccaagaaacaguguaaggguggaguucacugugauuucugagacauaaggacaaguuauagggaauuaaauuuaaggaaggaaauuuaauagaaaaauagcauuaaguugugagaaaauguaaauuaggagcaugcaaaugauguggguuccuaagggacagccauuuugaagaaaaccguguaacccuuccucuccuugaaaucacuacuauuaauaaagaauucaaaaacuucuuuaggacccauuuuauauccuucugauuagucuuacuguucuccauuugauccucugauuuuucccuuaagacauagauuuuuaaaccccuuaaaauaauuucaauaauuauuagaaaacugaaauuuuuauuaggagaaaauuagcuuguuuccccaaguaaaaauacguggaguauauaauauuguuuagauagacuaugucugugucuaaugauucucguuaggaggguauucauuuuguugaucaauuuacuuauauuaaaauccccgucuuauacaguauucaugugauaugagguauuugugaucuuagacguuugaggaucuuuucuuuggcacagcaguaucucuuugucaucuucugaauauuacuauaaaauauaauacaacauaacagauuauauauguaauauauaauguaguauuugcuaaagugcucuuuauaaaauauauugaguugagagggaaaaauagaagagaggacugugagugcaacuuuuucuuuuucuuuuuuuuuuuugaguuggagucuuccucuguugcccaggcuggagugcaauggugcgaucuuggcuuacugcaaccucugccucccugguucaagugauucuccugccucagccuccugaguagccugccaccaugccuggcaaauuuuuguauuuuugguagagacgggguuucaccauguuggccacuggucuugaacuccugaccucaagugaucugcccacuggggccucccaaaguguuaggauuucaggugugagccaccacgcccggccaaccuuuuuguuuuuuuuuagcagcauucagcucucuccaugcaaucuuuccccccaucuuucuucauuccuuuucccugaacuucauuuauucagccuaucuugaguauauaauguagcaguauuagaauaggccuuaaacuauucccacaaaauguauugugaagaauuaugaauugcuaugacacucucaguuaccuaauacaaaaugcugcuuucaaaauauuucacauacauagaauauacuuagagauuauuagguuuuaugcaaguuuuccaauuugaagcuguucuaaaauuaagagcauaaugcuuuuucuggcaaguugaaaauagaauaaccauugcaugauaaugguucauauaagaaacaaaaaaacaagaaaaauuaagaaguuuuggcaggaguagaaaacuguuuugaguggagauuuaagaauagauggagaguuaacaugcagagagauaccaggaagccauccagauggcagagucaaagcaaagaagauccuuuugucuggccuagaccaugagugaggucuagaaggcacaagcuacauuuaguagagaaagaaagcaaaaaggaacaggaaagcaagagagguuucugaggcagguuggaaugaacccauaaauuauaaaacaaaaacaggccagguaugguggcucaugccuacaaucccagcgcuuugggaggccuaggcagcaguuuaagaccagacugggcaacauagugagaccccaucucuacaggauaguuuguuuguuuguuuguuuguuuuuugagauggagucucguucuguugcccaggcugggugcaguggugugaucucggcucacugcaaccuccgccuccugguucaaggugauucucccaccucagccucccaaguagcugagauuauaggcaugcaccacagcgcccagcuaauuuuuguauuuucagaagagacaggguuugaccauguuggccaggcuggucuugaacuccugaccucaagugaucugccugccuuggccucccaaagugcuaggauuacaggcaugagccaucgcgcccagccuacaggauaguuuuuuuucauaaaaaauuagcuggauguagugguguccaccugccccagcuacucaggaggcugaggcaagaggauugcuugaguccaggaguucaaggcuguaguaugcuaugaucaugccacugcacuccagccuggaugacagagugagacccugucucuaaaauaaauaaaauaagacaaagccaaaagccuuauggaugagacccugaaagcuagguuuugagaauguucucugccaaauuauugaccacuccgguugaugcuaaguggcauaaucuucacuuuuuucuguuuuacccucccuuucugaacucacuccacccugucauaccuuguuuuuugcacagguguuaggaacugcugcagaguaugaagguuacucgucuaaguguaacaaaauucaagaugguuauuuggguugauaauagcauuagguaagauaaguucuauuuugcuucaucuccagagcccuucaguuuccaguuuugcucuggaccugacugcuuuccugaccugcagugccacugugguccuggaagcaggccucccucugacaagcuuuuuucccucucaggggcccucuacauuucccagagccuauguuuucuucuugcugaguaggaaguuuuguucauacccugaauuuaugaaaggacaauuuuccauuuucacacuugaugaauagauuggauggauugguaggaaaucauuuuuccucaauugaaacaauuucuuuuuuguaaaaauggugucuugcauuguugcccaggcuagucucaaacuccggggcucaagcaauccuaaugccucagccucccaaacaucauuuauugaagagacaauuucuuucucccacuaugcuuuauauaguuuuaguagcuucucuuauuuuucuucaguauauuauuauauugacuucacuuuuauuuuuauugauugauugauugagugagacagggucuugcucuguuguccaggcuggagugcagugaugugaucucgauucacuguagucuccaccucccgggcucaagcaauccuuccaccucagccuccgaaguagcugggacugcgggaguacaucaccaugccggcugauuuuuguagagaugggguuuugcuauguugcccaggcuagagcucaaacaaucugaccaccuuggccucccaaagugcuggaauuauagaugugagccaccaugccuggcccacuuuuauuuuugagauuuuuuuuuuuugaugucugaauaguccucuguuuccucugaguuuauuccccucugcauauuuguucuggucucugacuuuuauguuggaaguuuuuuccaaauauccauugaccauugguacuaacaagcugauugaaacuccagcuugagagguuuggugacuggugugcuuuaccagaagguaaucugguagggaucuaggucuuucuuugggagaagcuuaaccaguguaagugccuucuggccuuuuuaucuggagaucauucaguuucuccagaaaaauucuucuacucuauuaauugcugagaaugaaccuagcugucauuguuuggggagcccaucugggaaagaagaagggaaagacuacauggcugguaaaugguagaggggauguacauucaaguugugugacugugaaccccucgcugugggcuacuaugguuauugccuccuguguugaauccuaagaggggcuucacagcauuuuuuccaauuuccuuuugugguaaauacacacauaagauuuaccaucuuaaucauuuuuuaagaguacaguucagugguauuaaauacauucuuaaugucaugcagccaucacuaccauuuaucuccagaacuacuuucaucuuguaaaacugaaacucugaacccauuaaacaauaauuccccauuccuuccucccuccagccccuggcaaccccuuuuucuacuuuuuuuuuuuuaaauugagauggggucuugcucuguugucuaggcugcaguacaguggugugaacauggcucacuguagccuugaccuccugaguucaaacaauccuucaacuucagcccccugaguaacugggaccacaggcgcaugccaccaugccuggcuaauucuuuuuaacuauuugcagagaugaggucucccuauauugcccaggcuggucuugaacucuugggcucaagugauccucccaccucagccucccaaagugcucagauuauaggugugagccacagcaccugacuucuacuuucugucucuuuaauuguucgcuguucuaaguaccucauguaaguggaauggagaauauuugucuuuuugugacugguuuaugucaccuagcauaauguccccaauguucauucauguauacguuagaguuuuuucccuuuuuaaggcugcauaauauuucagcuuuaaacacuuuuauaucaaguuuuuuucuuacuuauuguauauaauagccccucuugguucuguauauaggacaguuaggaagacuauguauaugauuauauuuaauuauuugcaugguagagauuuauaauuuguucuuaauuugcagcuuuuuucaaggagcaaaccuccaaggggccuguauguuuauggagauguugguaaguguguuaaaauaaguuuugggugggcaaaacagaaaguuucucagcuuucucucagggaugauuucuauuucuaucccucaaucuguuaccagcaagggaauaggaugaggcaggguaagguagggagagaagaaaagggagagagggcaguuaucucagcuuuuacuuuacuucucacaggauacagcuguagucuagggcagaauuagucaccauguuagggugcaaacauuauuuaauguauaaaguaauuaauaucagggaaggaaaucaacuacagauagguuauuagacaaaucaggauuccaugacucauuaacucagcuuaauacuuuuuaaaaaaauaagcuguucuuuuuuacuuuuaauuuccauuaauauuucuagucauaaccuaagcccuuggaugaauaauuuagucguuauuaucuuuaauguaguugacaguagauacucuuaaugcauaagugguaacauuuccuuggucucccaguucuagacauugggcagaaagacucacauauugcuggaaacuuucugaguggucacuucuuucuagguuuuccuaaucauguagugucuugcuuaugaagucuucccugaccucauucuuacugaaauauucuguuuugugguuucuauuuucuucaaacaaauccuuuucucuuagucuuaaaccucuccuuggccacccucagccacugauaucaugaaggaguuucuacuuggcuuuuuugccuccuugcuuucaauuauuucuuugaugucuuuuuuaauuuuuuaauuuuaauuuuuucuaaucccucaguuuacugucaaucaauuauuucuucuacuggcauacucaaaacucacauucacauguaacgaggucaguuuuggaccuagacuaauauucacacucuaggcuccccuauagccacaacacauuugcguuaugagggagugauggcaggggauauuaucuuaguaacauuuuuaggaaaagaaaaaaaaagggcauugaauaaguagguuuuguuuuguuuuuguuuuuguuuuuguuuuuguuuugagauggagucucucucugucacccaggcuggugcgguggcgcgaucucggcucacugcaagcuccgccucccggguucacgccauucuccugccucagccucccaaguagcugggacgacaggugucugccaccaugcccggcuaauuuuuuguauuuuuaguagagacgggguuucaccguguuagccaggauggccucgaucuccugaccucgugauccgcucuccucggccuuccaaagugcugggauuacaggcaugagccauggcgcccagccaaauaaguaguuuuaaugccuuaaagauuaaacuguuccuuucuaaacuguuccuucuuuuucuaauuuguuuacugcuaccuugcauugaauguccguuuuguauuuccagauuuagcuaaucuaauaagagagaauaauuuaguucacaaaagugaacauuagagauugccccuuaaaauucuucagguucuugaaauuacagaaaagaaggucaaacuauucuuuuucuuaguucauuggcuaauugguacuuuugagaccaauguauacuuacuucuuauuuugaaagcaguuauaacagacacuugaucaauuuuauguuccugcaccuuugggcaccauuaaugauucucaucuuguugucaggucucauucuuugccuccugagaacaucuacuuccaguaccuucacuuucauauuaagucaucgcuaaaaucaacaacuuuguuccuccuguuaccuuaaccaccugaccauaaauggagaugguuaaagaagcauaacugcuuccacuucuguaaaagcacuuuuuuuuuaaaaacccuaugaauguuguuggauuuuaguuuagaaaauacagccauaugguaacuaauugaagggaagcauauuacaaguuauucaucugaguguuugaaagcaauagaaaagaugugauaguaugggauguucauauaguuuggguagguggcaaccuuuguuuggaaacauccuuauaauauagagaggggaagagaaaggaauucugaaaugggaagugagacgaacauuuugguggcuauaauaaguuuaguucagaccacuuauaaaauauguaaucggccaggcaugguggcucauaccuguaaucccagcacuuugguaggccgaggcgaguggauugccuaagcccaggaguucaagaccagccugggcaacauggcaaaacccugucuccacaaaaaauacaaaaauuagccuggugugguggcaugugccuauagucccaauuacucgagaggcuaaggugggaggaucacuugagccuaggaggucaaggcugcagugagccaugauuaugccacugcacuccagucugggcaacagagugagacccccaucucaaaaaugaaauaaaauagguaauaaaagaucaaguuuucauuugaggggcucucuguaugggagaguagccucaaaaugccaccauaagcucuuauucuuuauucuuuuccuuuguuggacuugggaaacagguauuaaauuuuaacaaggcugggcaugguggcucaugccuguaaucucagcacuuugggaggcugaggcaggaugauugcuuaagaccaggaguuugagacuagccuggacaacuaggugagaccccaucucuacaaaaaaauuaaaaaauuagcugagcaugguggugugugccugugguuccagcuacucaguaggaugaggugggaggaucacuugagccugggagaucaagguugcagugaguugagauugcaccacugcacuccagccugggcuacagagugaggcccuaucuuaaaaauaaauaaauaaguaaauugggcuaggugcgguggcccacgccuauaaugccagcaacuuuggggggcugaggggggcgggucauugaggucaggauuucagaccagccuggccaaaauggugaaaccccgccucuacuaaaaguacaaaaauuagccgggugugguggugggugccuguagucacagcuacucaggaggcugaggcagagguugcagugagccgagaucgcaccacugcacuccagccugggcaacagaacaagacucugucucaaaauaaauaaauaaauacauaaguaaauaaaauaaaaauaaauaaauaaacaugcuugagcucaggaguucgagaccagccugggcaacauagggagaccucaucucuuauguauuuuuuuuuuuuaagaaaaauuuaaauaaauaaauaauuuuuaaggagacuucaugggauagagaauaccuaccugguagcacucccuucccacuuuucauucuugcacucuauuugggcuuuguccugcucacuucaccucuuucuucgcagauguguugagaugauugacucagauggauucuaaauccugggaacugcaguaggguugauguaugaguuggagggauuauuaucaugguucaaucuugaaaugaauuauuuuuguuauaaaauguuuaucacaucucauauagaagccaaaagcugugguaguaguauuuugugacuucauucauacccuacagcuggcuuucucacaacagagccucagcucuugaccagcugacugcgguggugauggcagaguuaaugauuucucugguacacuagaagagaauaaaaguacauuuugcuuaucagccccuuuccugcugccuccugguuucaccucaccuguuucacauugauucagauucuaguuucaccaggugaaagguaggcugguuuuaagguuaggaguuaggaagcauaguucucccuggcuuggauguagggauacaugugccuacuacacaccuaggcuguauuauagaaccuauuccuccugugcuacaaaccugugcagcauguuacuguauugaauacuguaggcaguuguaacgcugugguauuuguuuaucuaaacauaucuaaacagagaaggugcaguaauaauacaguauaauagauaaaauaugggaugccuguuugaccaugaauggacuggaaguugcucugaaugaaucagugagugaguggugaguggaugugaaggcugaggacauuucuguauacuacuuuauacaagauguuaucagugcuguguacuugggcuacacuaaauuuauaaaaaaaauuaauuguacuuccauguuaggauagcuaugacaucacuaagugauagaaguuuuucagcuucuuuauaaucuuuugggaccaccauuguguaugugguccauuguugaccaaaaugucauuauaugcguuacuguuuauagaaaugcgguggauuuuuugaugaccuuguauccugugaucuugcuaaauuuaauuauuaacucuaguggugauuugguagauucuuuaggauuuuuuuguguguauacaauuaggucaucugccaauaaagauaauuuuacuucuuuaaauuuuuaugccuuuuauuucuuuuugcugccuccuugcaccagcuaggacccgaguacaauguugaauagaaguggugcguguagacauccuugccugugucaaauuguaggggagaagugugcagucuuuuacaaauaagcauauuaacuauauguuuuaaaaaauguauucaauuguuuuuauuaugguaaaacacguaacauaaaauuuucccuuuuaaacauuuccaguguaugauucaguaucauuaagucuauucacauuguuguacaacuauuaccaccauccauuuucagaacaugaguguagacauccuugccuuugucaaauuguaggggagaaguguucagucuuuuaccaauaagcauauuaacuaaagcuuuuuaaaaauguauuuaauuguuuuuauuaugguaaaacacauuacauaaaauuuacccuuuuaaacauuuucaguguauaauucaguaguauugucuguucacauuguuguacaacuauuaccaccaucuaucuucagaacauuuuuaucuucccaaacugaaacucuguguccauuaaacaacaacauccuauucuaccucucucccacauuuuccacaucccaccccagacuccccuggccuggcaaccaccauucuacuuucugucuuuaugaauuugauuauucuucaguaccuuauauaaauggaaucauauaauauuuguccuuuugggucuggauuauuuuacuuagcaaaauaucuucaagauucauccauauuauuguguauugcauaugaguuggauuccuuuuuaaggcugaauaauauacuugguauucaugggggauugguuucaggaugcccuuggauacuaaaauuugaggaugcucaagucccuuauguaaaaugguguagcauuugcauauaaacuuuguguguuguccuguacacuuuaaauccucuagauuacuuauaacaauguaaaugguacauaaaugcuauaauaguuguuauacuauauuguuuuuuguuuaugaugaugauuauuauuauuuugaagcagggucucgcucugucgcccagguccugaaguguaguggcgugaucucagcacacugcaaccuccaccuucugggcuuaagcgauccuccugccucagcuuuucgaguagcugggacuacaggcaugcaccacaaugcccaacuaauuuuuauauuuuuuuguggagaugggauuuugccauaucacccgggcuggucucgaacaccuggacucaaguaaucugccugccuuggacucccaaauugcugggauuauaggugugagccacuccaccuguuccuuauauuauuuuuuauuuuaaaaaauauuuuugauccacuguugguugaaucuggggauguagaaacuagauacagagggccaacuguaacauuuuauguauauaccacuuuuuguuuauccauucauccauuaauggauguuuggguuguuccaucuuuugacuauugugaauaauucugcugugaauauugaaguguaaauauuuguuugaaucccugcuuucgguuguuuugugcauauacucagaaguggaauugcuggauccuauggucacacaauguuuaauuuuuuuuuuuuuuuuuuggacacaaagucucucucuguugcuuaggcuggagugcaguagcacgaucauagcucacugcaaccuugaacuccugggcucaagcaauccucccauuucagcauccugaguagcugggacuacaggcaugcaccaccaaaccuggcuaauauuuuaaauuuuuaguagagaugagaucucacuauguugcccaggcuggucuugaacuccuaggcucaagcaauucucccuccucggccucccaaagugcugaaauuauaggcaugaaccacugcacuuggccuguguuuaauuuuuuugaagaacugccauacuguuuuccacagugacaguaccauuguuauucucaccagcaaugcacagauuccaauuuuuauacauccuugcuaacacuuguuauuuucuuuuuuuuuuuuaauagucguucuaauguaugugaagugguaucuuguaguuuugauuugcuuuacccuaaugauuagugaaugcauuuuugguuagauaauucaugacuuuauucugaaucuauaaguauacuacacugcaugcagcagaauuugaaacuuuauuaacuuuucuggguaaauauaauuauuuaaaaucuacugcuaaucacuauaucaagagauacuguacugaauauuuuugcaaugaaugacuuuccaucaaagugacuucuuuauuaaaaaaauguuugguggauuguuuuuucauauacaaaagcacucugacauucaaauggcaugggcccagugucaucuuguggcuugaaggaaacccaaaagauaagacuuagaucuuccuacuuucugaagugccuuuggauucuaguaauugcaaaggaauuacuagacaggaagugaucuugugguggugggagauggggaagcagggaggaugugagacuggacuagcacaugcuagccuggcuuacugaggaaugccagguacaaacugagcuugggccacugacccgaaugcccuaggcuuucugagagggaauaaggcauuuuaugcuaccugcauuaaaugcucaggcuguuggauauucaauuacaguaguuuccccuuauucacagaggauaguuccaguggaugccugaaaccucacauaguacugaacccuauguuuuuuuuuuguuuuuuuguuuuuuaagauggagucucucucuugucgcccaggcuggagugcaguggcacgaucucacugcaaccuccgccucccagguucaagcuauucuucugccucagccuccugaguaguugggauuacaggcacccaccaccaugcccagcuaauuuuuguacuuuuaguagagacaggguuuugccauguugaccaggccugucucaaacuccugaccuuaggugauccacccaccuuggccucccaaagugcugggauuacaggugugagccaccacgucuggccuauauacuauguuuuuaacagagaaggccacuaagugaccaacgagagggcagugaauacaguguggauaugcuagacaaagggaugauuuauguccugggugggauggaacggggugacaugaggccucuucaugcuacucaggauagccacacaauuuaauauuuaugaauuguuuauuuuuggaguuuuccauuuaauauuuuuagacuaugguugauugugggccuugaguaacugaauucucagauaagaggguucuacuacuaaugcgauuguagucauuaaaaguuuuagaguguugaaaauuagauaauuuaauuacaaggauugacuguaucagaauuuccucaaguaggcuuuauuuugagagaucuauuuucucagcuuuuuaaaaauagaaguguuacaauugacaauucucuagcucuaaucuacauauaugauucauguucaauauuuauguuagauacuaaucuuuauauuucaucuuucuucucuuuuuuuuuuuuuuguuuugagaugggggucucgcuauguuucccaggcuggucuugaacucuugggcucaggcaauucucccaucuuggccucccaaagugcugggauuuuaggcaugagccacugugcccagccucuuauuuuucauuuuugaauuuucccauagugccuaaaacaguuccuuaugcauaguaaugacccaguaaauauuuaauuaaguuauuuuauuuaugcuagugucuuuuggaagagaagacuguaaaucuugccaguuuaugcacauaguuuucagggggaaauagcccguguaauguuaacuaaauguuguauuuccuauaaacaggauuuuaacagaaaagaguaauauuaacauuuuauuuuuagcuaguuuaacauacaaaguaagcucccccuucuaaagaagugacauagucuucagcuuccuagcggaagaguaugguuucauuaucucaaagcuaaugaacaaucauuacagcaaucaguacauacuauuuaauaguauucuuaaaauuuuuuuuauuuuuaagguacaggaaaaacaauggugauggacauguuuuaugcuuauguggaaaugaagaggaaaaaacggguucauuuucaugguuucaugcuagaugugcacaaaaguaagcaaugaucugaaagaagugauuuuuucaguggggaaacgcuacaaaaugguuuucuucauugaaugaacauauacucuuuaaaaauuagauuuuugcuugcaguaagauuuuauuugguuccauuuguuuugugcuauguugaaacagucaguaauguguccagaguugguccuuaagaccaauuuaauacuuucaaaucagagaacagagauugcuguaugaagcucaggcauuuucuguuucuacuaagggccaauaaaaaaauguuaaaaaugcaccuguuuaaauaagugauucuugauuaggcccuuuacucuguguuaccuuagcauguaggcauucaguuugaguacgcauguaagcuuuauugcuuugcuagugaucuuacguuauuucacuuuugcaugauuuguuuaccagcugcacuguaaccuccccagagcaggaaucauguguuuuuuuccucuaauacuuguagcauuuaguacacacauaaugaaugaaguggacuggccuuaguguauuaggcuagagauaagggugcauuucgauugcauaugcuagacauaacaugcacuacuugggcaggaucacauccucugcucucaucccugaaauaaaggacuaagguggauguguugaugcaucuaaucacuugucuauuaccuugucauuucugaaaugauuaaagaguagaaaugaaaugaccuugaaguuuccuuacaacuauaagaacauaauaauauuugaaccaacuuauuuuguagagaaaaugcaaacaauuucaaugaucaaauuugauuuuacauggaguuuaaacuuaauuuuauguccauacuaaaguuucauuuagagauuuuaaaaauauguuauaauugucuaaaaaguacuaauauauuucaucuguguuuaauuucaugcauuuaaggaauacaucgccuuaaacagaguuugccaaaaaggaaaccaggauucauggcuaaaucauaugacccaauagcucccauagccgaagaaaucagcgaagaagcaugucuccuauguuuugaugaauuucagguaaaguagagauuuuucauagauauagaaugguauauugaaugagguaugaagauuuaaauuuugcuccugauuuuaucauugguuuauaaggugauuugacacauuaucucuuacugcuucaauuuuacuaucuaguucaggagcuggcaaaucacaaccugcacagcugcacagggcaaaucugaccuuccuguuuuuuuaugguuagugagaaaagaagaguguauacacacauacacacacacaugcacgugcacacacacacacauauuuuaagacacaggguccugcucugucaccgaggcccaggcuggagugcaguggcauaaucaaagcucauuauaaccucaaacuccuggguucaacuucccgccucagcugaguagcuggaacuauaggcucaugcaccauaccuagcaaauuuuuaaaaacaauuuuguagagauuaggucucauuauguuucccaggcugguuucaaacuccuggccucaagugauccuccagcuucagccucccaaagugcugaaauuacaggcaugagccaugacacccagccaaguuuuuguaauuuuaaagguagcugaaagaagaagaagaagaaaaagaagaaaguacaaaagagacccuauauggcuugcaaagccuaaaauauuuacuauucagucuuuuauacaaaaagucugcccaccucuaaauuuuggucgaugacuguacaucuccccuacaccacaaagauaauguaauuauuauaaaacaaugucuuuaaagauguuuaaguauuuuuaaaaaguguuauauaaagaacaagugauucaucucauuuaagccucacaacauauguaucugugauaaagggagggaauugccuuaguugaacuuuuaaaguuucucuuaguuuuaggauucucugaaauuaugcguuuaaauugguagugaguuauuuccuguucuucuguguuuuauaaucuggauuagugggaagaugauauggccaagaugcuuuuaucccaaagcaugcaugauuggucuccuuuagcaacugguacacauagcuaacaauagucuagauuuaugauggaggggaaagaauuuucaccagcaaugcuguuacacuaaaccaucuggggaagagggaucuuugcuucuuucugccuucagucauaauaagacagacuggacucaccuuuguauuuggaacugcaaaggucuuccaaguaaaggcuuuauggaaaagaacagaugcucuccugccgcucugaagaggcauacuaaccacaucaauguuuugcaggagaagggccucauugagucguuugaaaaagcacugacuuaacaguuaugcugcuuucaagaacaaaagucaguggugaaucaauagaggccauuucucuugauuuuccauuacuagccuuuuaaccaaauaucucuaaauaaaacugaacuggcauaguuacaauuuugauuaagguauugaaguuaaauuuuuaaagagguuuauuaauaccuagccuuuguaaaaugauccguaguuuacaauguguuuuuacauccuuaucucauuuaauucugcaaaauaguugauaucuccacauggagaugagaaaucuaaaggcauuagaauuuccuagguaucauguaaaaaucauuacccuuaauuuuaaaaauguagauuucaaaacuuucagagaaaugauuggcuuuuuuguuuuuauuuuuauuuuuuuugagauggaguuucacucuuguugccuagacuggaaugcaauggcgugaucuuggcucacugcaaccucugccuccugggucaagcgauucuucugccucagccuccugaguagcugggauuacaggugggcgccaccaugcccagcuaauuuuuuuguauuuuuaguagagacgggguuucaccacguuggccaggcuggucgcgaacuccucaccucaggugauccacccgccucagccucccaaagugcugggauuacaggugugagccaccaagcccggccugauuggcauguuuuuauggcauaagcguauuggaaggcaagacuaagaagguuaggaugcuaugaaaaucuggcugugcaaagcacaugauccugaagaagauacagagcaagcagggcaacuugcccagucggugcagcagacauagugucuagggcucaugauacuuuuagggaucaagaaaauauuauaauuucuuuuaaaauuuguggacauaaaugaauauaucaauaaugacuccagccuguaucugucuauuuuguauuauauuuguccuuauaccaacauagucguaauguuuuuuuaauugaggauggggcuuaugaaaguaaaaguuccuagggcuuacaagagucauaaugccaccuugauagugaaguccuaccaaaaaccugccugguuguacugacauacgccauuggguuuagauuucgaaagguugauauauaacuagaaagaaggaaacaaaaacaacugucagaacacuaauguuccaaaugaacugagucuugcaaagaaaugcaggccacagaaaggauuuuucagauuacauguugaguguaagggagauccaggggagacaggcucuuauaaaaugcugcuugcugauggagagaaagcagaugugauagagaucccuguuauugccugcccuguccagauugcuuugauauuuauucauucauugacuuauucaucucaaggaugccuugaaggcccuuauuccguaucacaggacagggcccuaucugucccauagcuaaauggaccaugccuggacagcugaucuauaaguagcuaauccacaaucuccucagcagccuuggacuuguaugguguggcuuggcgaaugggccagucguagacccucucuauugaauuucaacuaaauggcacagagggaagcucuucuuaguaaugaaacagaaacaaagaaauauagaaaguaauggagcuccaguucccauaaggugccaucaguauuguccccauccuggaguuucaaguaaaucucuuuucuucagcuggaucuccagugccuauuucuuacaaacagucuugaugagaauagaacuauucaagucauauuuugcucccaucugcuaugugaagacguauuucccuaugaucuguaaaagauagcauaaacauugguaagaaguacugugaggaaaugucacuuuccuuaauaugaaaucucuuaccuccaguggaagaauuaaucggugagcuaaagcccaggaagagaaagaugagguaucugcuaggaaugcuuuuggccacaggaaacagaaaacccaacuuaaaagggcuuguacucuaacggggaaauauucuguuauauaagguagugucauuuuccuugcucaaacccuucugcuuccucucugaccuugucuccuacagguucagccucacucauugcuuccuacuguucccaauacuauuuucuucauagauuaaggaaccgcaguuaguaguuggguauuauaccaacuacuuauuucuugcagggcucugaagaaaacaugcacagagaugacaaaacaagacaauaccaaauugauugcuuucauuugaucccaaauuuuaguguagcauuuuuuuucuguucccaauuauugcauaauauagcauucuuguauguuagaguugacaacaugggagacccuauuccccugagcaaguuuggccugaauguccuagaaugcaaaaauguuaauagucuugcucuuuuauuuccuuuacaauuccaacuugaaucuuggagauuacugcugcacgcaagaaaaggcugauaucugcauauacccaguguuagcagagccagagaaagugaaaauauaagggcaagagugugcccccuaagggaagaagugaucucugcuaguuucaguauccugaacugucuucuacaggucuuaaagaaguuucuccaauacaccaaaauuagaugaucacaaguccaaaucucuacuuaucccccuucccuaaaacucaagagguugaaauauacuccaaaauguugcugcaccagcacucugauccccaccauccacacaauguauaaugaacaagcagagccuuugcacuggggauucuuucugcacagaguggucccucuguucugagagcccccagcuaaauugggguuccagcaccagagcggcuggcaacccugcccuaacaggaaaugcagggagcuggacauagguguuuacagcaugccuuucacaggguacuucuuucaccuggaggauggccuaaugccugguugucugacccaugaccagggggucccucacacaggaaacuuguuuauacuggcauaugccuuuguggcucuucucugaccuauguccaguuuaugccugucugaccauugcucuggcacugggagccugaucuuguguucuuccuggcaucccagaaaaauccuggccuggcgcagacccugguucuucagauggaaggugcaaaucaauacaccacuacaauagaaaauaaguucaaagauugauuauuuacagaugcugggcagggagggagcaaugagucagaaggccagucuuucgucucuggucacaggaagcaguaaugaagagucaggcagagagagagaguauggcaacuagcagcaugcguguauguguguacuuuauauauauguaggaauaggacgggguaacuauguuugugagcaaaagccugaaugguucauuuaaaguaaaggaagcagcaggaaaagugaggagccccaucuuguaagcaagagcuaugccucuaagcucuuaucucuggccacaggcuugagccauuggguucuacuuuuaaugccuaggcagcaaccguugcugugugguuucccucacacccuaacauauuccuaagaggaacucccucauuucaucauaucuuugcucaauuaccuccuuaacaaggcccaucuuaacacccuauuugaaauugcagcuuaccguugacccccacacuucuggugccccuuacccaccuuuuuucccauaucauauaucaccuuuuaacauauuauauguaauuuacuuauuuauuguguuuauuguuuaucuguauucccagaauguaaacuugaaggcaugaaucuuuauuaauugaugucucagguuucuaggacagugucugagaaugaaugaauaaguagugaauaaauaaaugaaugaaugaaugaaucuaauaccaaaugaaaacuguggaagugguucccauauuaagucccacuccccuuacauauaauagcauuucucaagcaaaaucagcauuuacagaacccaagguauauuauaacuucaacccacauuuuuuccugucaucauucugaauuaucugaacauuuuugucuaauugaauacauaaaaaauggugucuuguuuuaauuuguauuccuuuaggaaauaauaugguugauuuuuuuucauguuuguuuacaugcuuguuaaauccaucuuuuaugaacuauuugagguauugcccauuuauuuauuagaaugcuuauauuccaucuauuauauauguucuauaauauuaguuacuguuuauugaguguuuuucuaugugccuguguucuuaauaacuguauaaugcuaaauauaauucuagcuacagcuaaaauucuauguagcuauacauuaauaauacagaauuauauuaauacuagcauauauaccauacauagguaauagucaaaguuaauggucucucauuucuugagaguuuacuuuaugucucauaacaauauugcaagguaaguauuauuacugcuuucguugcauugaugaggaaauugagggucagagagguucaguaacuugaccaaggucacacaacugguaacuaacaguuuaaguccagcacuaaugcucuuguuuaccaguaacagcuaugcuauacauuuuccuuaguauauaaagucuuguauuauguguuuaaauauacaauucuagagcugggugggguuuugguagauguuuuagugauggaaccuaaaaauuauccuuaagccuauuaagccuaguacaauacuugcugauuuauuaaaaaagaguuuuuaaggcacuuuauucuuagugacaguauaucuacaaucaccacuucacuuuuaaaauggaaucguauuaguagccuugauuuuuagcuaguuauuauuggccuuuagguaguguuaauuaauauaauauuuauuuuacuagggagacgaaugguaauuauugcugcuuaaaaacauggauauacuccuuuuuugugcucuugaauuuaaggaauuuuaaagauuauguuuugguaagcauucagauuacacuugcagaaugcucuucauuaguuuggucuuccuuacuaaguguagaauuucagcuuuuuuuaacuuuuaguuucaggggugugugugcagguuuguuauauagguaaacaugugucacaagaguuugcuguacugauuauuucgucacccagguacuaagucuaguagccaauaguucuuuuuucugcucuucccccuccucccacccucuacacucaaguaggcgcauuucaguuuuaccugagguguuagauacacgauucuuaccuugguugagaaauguguuuggauaguuuuuuuuuguuuguuuuuuguuuuuaacauguguuuugguuggugaaauaaauaauagcuuaucuucagaguuuuccuuaggaucuucauuauguccucuuggaauauuuauguuacauguuaaacuguuuaugauucugaagacaucagauuagugaggaaaacugauuuuuaaaaauguuauuucuucauaucucuucugagagggacacuaaauagauguuuuacuaauauggguccagaaaaaaaaaaaagaauucugaugagcagaagaucaugcaaaauucuccucuaucagcuaucaauaucauuuaaaaaauagguuuaaccauuuuuaugaagcaggaagaaagcuauuaaaaacugcuaauaaaaaauaggugcuuauuuuugugcuaauccuaauuacugauaaugcaugcuuauguuugucacucauuauauggcacuguaccaaucaguggaugacugagacucaagcacucacacauguaaauuaaccauuagauuuuuuuucuuuuuuacuuaagugagucauaauggaaagcaacucuagguuauaaaaaaaucuuuucucuuuaaugcuaaugaaaugucuccacucucuguauuagcagacuacccuuauugguaaucuguagccuucucuuuuguucguggugguaaugaaaugcuggguacugaaaaagccagcucuccaagaauguguggccaauugucuucuguucacuuauacuguaaaauuaccguuccccggcaaggccgaacaagugcggggacaagaucaaaagaguauacauuggcacccggcuacagcaagugacuccugcuuuauuaauuagucauagcuucuccaagcuaauuuacucugauagggcaaaaacauucugaaauauaaaaacagcaaauuauaacucaacuacaagccuuuacuguuugcuuucuucaacuuucaguuuaaaccuuugcauuauguuacaagcuaaaugucccuucaguuuucuaaaccuuagggcacaaaagcuauuuuacauuuuuuucaaagacauuaaucauacagucaaaugaccauuuuuauucucuaaaaucggguaaacuuucauugauacuguucuuuuaaaaagucaguguauuggcaauguaauuuaaaagugcaguugcuauuaaaaugugcaagcucguucuguccucucaucagaaaugccacugguguucaagcauuugaaaaggacuuucucugucaguguuuuugcggaagccaaauuugacagugauccuaaacuccaaauuaaauaauaucagcaccacuuuccuuuucauuuaaucaccauuuugaaguuccugaagucuuuuuaauguaaggaaucuuuagcaguuuuuuaguuauaaccugagacagccaaaaaaaaaaaaaaaaaaaaaguacaucucuauuucaugguuuuguuguuuucaggugggaaagaagauauuagcuguaaaaagaaaagugauuuagaccugugcaacccagguuauuguuaauugcauuauaaccauucgguuuguaacuuuuaguauuuugauuuaauugaaagaauucaccaauuuuuauguccucuaaugggguuuaaaaauaacaauguacuauaucuuguggauauauguaaagcaaguuguacugagauuauuugaaaugugcuaucaaagaaagaucaaaacauuuuuacauugggaguaucuaaaguccauguuauuauauacuuaggggaaguugcaaugauugaugucaaucuucauuacacauuuauuuuuggagucaacuucuuucccuucuuaauuguugucuuugugaauuuuaaaagccuuuagaaaaaguuacaucauuaagcuuacuucguaauugugaauuuaaaaaauaauuuuagaaaagaucaauaaaccuaacuuggauggaauaguuucaucuguauuaugcauuucuuguauugucacaaguuauuuuuuuaagggacuauauuagccauucuugaaaggugguuuuuuuuguuuuuuuuuuuuuugguagaaggaauauuuguguuugugaagguuagcagaggcuggcugugcuggaagugacugcagugccuuuugauuauucauggacaguaauagaaggcacuuaaaaagaacaaugaaauugcuuauuuuugugaugggccaucuguugaauuguuuugugcaacaauugcacaauaguaucuaugucauaucauucuauuuucaacagcagcugauuaugucucacuggcuacuuguccuuauuucuaaaggcccaugaccauuuaaagucaccuuuccagggaccuuugccagaaagguauuagaaaucucaaacagccuguguauuuuauuauuauuauuuuuucaucucucuuuuuugagggggugugggaagcgggugggaagaggaggaggguguuggucauguuaguucuaauuaauuagacuuccuaaauguuuaggacaauuaucuaugcuuuccaccuguaguucuauaaaagaaguuaucauagaaccauuugguaauuuguguagaaaugauaggcuugcaaaaaagaagagucaaguuuaaaagacugcuauacaguguuucaugcuuuuaauuaucuacucuuuucuucaugaugauaauuagaauuuuucucuuggaauuuacuuccaucuuaaaaaaaaagaugauccacuagcaaauuuguuacagcagaagugaaauuaaaauaaaacaaauguguuguugucaauaggucacugacauugcugaugccaugauucugaaacagcuuuuugaaaaucuguucaaaaacggggucgucguuguggcaacauccaacaggccaccggaagguaaaaacaaacauugugcuagucucauccaauuagguggaaacuaacaagcuuuuaaaaauccauaauuuugaacuaaauguauuguguuaauaaaucugaugacuuugcuuauuauuaguuuuauaacuggcuuaaucugaaaaaucaguugguauuugcauuugaaaaguuuuguauccuuagcaagcuaaauccaguugauucccauguuuggugcacuugcuguuuuuuuguuuuuuuuuuucccuaaauauuagauaugucauaugugcuuagcaaaaaaugcaggccuuuuggacugcuuuuuauggcccauaaaagaaacucaaccaaaugaaagacgaaacucauaauuaaauuuuagaaaaagaccgaaaacuugcuugcaugaauaguuucuaauacuucacuuaaauuaucauuucuaaaaaagcacuuguggcuuauuaggaaaguacuuaaaaauuaaaauacaaguaauauuuagauuaaaaacaacaacuuuaaaaucuugcaucuuucagcccaucacgugcucaguuaaaggucuaagaaaccacaaauauuucaugagagacuuaaugggaacaucuuucugccuggagugcuguuucuccagauaucugcauggcuaagcccucaccuccuuugucuuugcucagaaguuacauugccagugaagccuagacuugucucccuguuugaaccugcaacacaucccuuucuucuuggugcugcuucccuuuacccugcucucucuuuuacccauagcacuauggaccuaccauauaauuuacuuauuuauuauauuuauaguuuauugucuguucccuuccaggauacaaaagcuucaugagggcagugauuuuuaucucuccuguucucagauguguucucagcaccuauaacagugucuuacacauagaugguucucaguaaauagucuuagaaugaacauuggaugauugcauguuuuaaaaagaucucucuggcugcaguguugagaauagaguguggguaugggguuucaggguuagaaguaaggagaccuuuuaggagacuacugcagcaaucccaaggggaggggaggugauggagcaguaaaguggugagaagagggcagguucuggauguacuauauaggcagagucagcaggauuuacugauggaauggagcuagaguaugaaaaaagagagagggaucaagaguaacucaaagguuuuggccugagcaauuggaaggauaaaguugcuguuuacugagauggggaagacuacagaaaaagcagauuugguuagggagguggagguagggguuucuguggugacaagggggauacauauaagaguuuggacuucauuggaaaagucugggcuggagauauacauuuggaaguuaucaguccucaaggaggcaggaaagagcagcuggugagguaggaggagaaccaggagagugucaagugaggaaaagaaaaguaguacaaaaagaauugaugauuacuucuguuaagugcugcuacaagcugaaaaugagguugagaauuaaccauugcaauuaguaacauggaauucauuagugagucugaaaagaguaaugccauagugggaacuuuuuuuuuaaaguaagcuaugccacauugaugguguauauugaauuuuaaauugcuaacagacccagaucuuacuauguagccugcugugaaacuaggucucucucauucuauguuuguguaguggauuucuuuuucuucuauuacauuucagcuuauuagucuuauguuguuccauuuuauugauuuuuauugaaguauuuuuuauuuuuauuuuuguuuuuuguuuuuauuuauuuauuuuuguuuugcaaauggaguauguuugaaguauuuuugaaguaugauucuaauauaauuuuuuuuuggcuaucccuacuaugacauuuauacauuugauaaucauauuucuaugucuuuagccauuccuuaauuaaaauguguaaaucagauaggacuaaauuaaguuacuuguugcauaccacuggaggccuuaucuuaggaagacaucaauuaacuaaucaacaccuuuuggauccaguuauucaaacaauuauagucauaccucauccauuguacuacaaaagaauuaugagugauuuugcagauguacuuauuaaaauccauauaauguuauauacagcauucuugugauuaacuaguguuagccacccuaugagccaagggagugagcuuuuuaauauuagaucuucuaucuagguggaagugaaacuugucucuacuacagcugauguguugauuugacaguggcaucaguauuaccuuuagacauucagugacaagcuaugcucguaaauagcaaagagcuagaacaauuuuggaagcccuuuagcaaagacugcugaaaggauaauuaggcugcucagacuauggcagugugguuaacuaacugaggaaggacagccaccaggagggauuaaggaauguuuugcagcuccuagcuuuguaggagugaacaaagcuaccggugugucaggguagccugcagaaaucugagcuggagccacccuucuggagaagacuguaaguucaagaugcggaauugcaaaaauuggacaaacuuagagaaagccuuuucuaaauauaaacaguggaaggaaugggaugcuugucacagaccagguuuuuuagccacagcagacaaucaucauaaauaacuuaauauuuuaaaguaaugaagaugacauguauaugugugcguguguguguguauaauuuuauuuguggagaaaaagacucagagagacuaagcauaucaggaagagguaaaacuguaagacgaagaaugaagcagugauugccaagguccagggugaggagguguuugacuacaaaggggcaggcucaggaugcaacugcugcauccagauuguaguggugguuacaugugcuaaaaacucauagaaccguaggccaaaaaaguuacauauuauaaguaaauuaaaaacaaaugacauggauagugaaugacagaacaaagacuagaacuuagguuuugugacucuuuuuacacauuguuuucuaucuuuuugccuuauggucaucacugaucucugucuauccuguccuagagaaagaacguccuuuucuuaaaacagcagcucaaaguacuguauuaaaaaaaggugggagggggagaagaaaauaaagaagaguguccucuuuuccagccaucaaaaugcguucaacuuuuuuuaggucacaauuuuuuuuuuuuggagacggauccuugcucugucgcccagacuggggugcagugcgcgaucuugguuaacugcaaccucugccuccuggguucaagcaguucuccugccccagucucccaaguagcugggauuacaggcacccaccaccaugcccagcuaauuuuugguauuuuuaguagagacaggguuucaccauguuggccaggcuggucuugaacuccugaccucaggugauacaccugccucggccucccaaagugcuaggauuacaggcgugagcuacugcacccagccccagauugaucuggcuggcuggcuggcuggcuggcuggcuaucuaucuaucuaucuaucuaucuaucuaucuaucuaucuuuuaaaauagaaccaacuucuuagacugcuacaagagcuggcagaggguugaggcaaagcugaguggcuggagaaaugacccauuugagguagccaguggggcuagaguggagagugagggggagaaggaugcaguaagguacaaguugaucuguagaggaaagagcuaaaccuuuuagcguaauaaggauuuuggauuuuauucuaagagaaacgcuaagccacugaagcuuaucuuaagcagggacugaugugaucugaguuggaaauauccuucuggcuguaguuuggagaauagguuacuagaugggguauaguaauaugaugcaugcagggagacauauuaggaagcuguuguagcacacuagacaagaaaugaugauaccuugguauaaggguauaaggcagugauuuucagugaggggccucuuuugcucacuagggaauauuugguaacaucugagacauuuuugguugucucaccugguggaagagggcugcuacuggcaucuaguagguaaaggccaggaauauagccaaaguauccuauaauuuaaccccugcaacaaggaauuauguagccuggguuaagaaacccagguacaaggugauggcaauggauauggagagaaggauagauuugagagagauuuagggggugaaguagacagcacuuggauauagguuggauacugaggaaaaaggaaaggacacuuucuaauuuucuggcuuguacagcugggugaauggugugucugccauucaacagagacagaaaacuagagguuaggagucuagaacacgcauuuucuuuuuuuccucucucuauuaaucguuuagccccucugauuaauuccuucugcuucauucaucucauucccuccauuucuaguuauaaugcuuugguaauugguggucauguaaagcaacaccaaguuuaggaaccuaagagaguaaauagcuguggaguggagugucuuggaaggucuuguggaagacaaggggaagucauacuugaggcggguggagggaauaagguaccaaagacugcuuuccugcacuucacuguuuuuucuagcccuaacuuccaguucaugccuuguuuggguccaaggccucacccucuguacaccaugcagcuguuaaaaccccaaaucaguauaagcuugugauuacuacuuuauuuuuuguuuuguuuuauuuuuguuuuguuuugugacagucucacucugucacccagacuggaguguaguggugugauaccacuacaagacacuagaaauguuguuuaaaauaaacuaaacaggcuggguguaauggcucaugcuuacaaucccagcuuuuugggaggccuaggcaggaaaauugcuugagcgcaggaguuugagacuagccugggcaacauaaugagacccuaucucuauaaaaaauuuaaaaugaguugggccugguggcaagugguacugcucacugcauccucgaccuccugagcccaagugauccuucugccuuagccuugugaguagcuuggacuaccaggccaagcaaauuuuuaaauuuuuuguagaucucccuauguugcccaggcuggucucaaacuccugugcugaaacuauucucccaccuuagccucccaaaauguugggauuauaggcuugagucccugugccuggcaugauuacuauuuuaguuuuuagcuuucucuuuguuuuuuggucucuagggauuuuccuuucuggcagucucaaaauguuuauuaaauuuaauuaacuaauuauuuauuuuuagagacagagucuuacucuggcccaggcuggagugcagggguaugauuauggcuugcuguaacuuugaaugcgugggcucaaaccauccuccugccucagccuccugaguugcuaggacuacaggcauguaccacugugcccaacuaauuuuuaauuuuuuuuguagaguuagggucucauuauguugcccaggcuagucucagacuccugggcucaaguaguucucccuccuaguccucccaaaaggcugggauuauaagcaugagccaucacgcccagccuguuuaguuuauuuuaaauaacauuucuaguaguaguacuauuauguauguauauauauauauauuucacuuuauauaaauuauguaaauucacuuuuuuucauuuauuucaaauaugugaugacauaacuauaaaauuaacauuugguuauuuucuuuauuuuuuaaauuuauuuuuauuuuuugcuaggaaaagauuuuuauuuuauuuuuuuacuuaccaaauaguuuuauauuuuagcuaugaaggucaauuaccagagccaaacuuguucuuuuuuuuuuuuuuugagacagagucuugcucugccauccaggcuggagugcagugguguagucuuggcucacugcaaccuccgccuccuggguucaagcgccucuccugccucagccuccugaguagcugggauuacaggcacgcacuaccaugccuggugaauuuuuguauuuuuaguagagaugggguuucacuauguuggccaggcuggucucaaacuccugaccuugugauccgcccaccucggccucccaaagugcugggauuacaggugugacccacuguaccuggcccaaacuuguucuuaacaaguaaaauuguuauguccauuaagucaaagagucucuuaaaccuuucugggccuauuuacuugcagagaggaguagaaacuguaaccagguucuucaugucaugcauucacaugugaugcccaaucuucauaugcuguccaguuucuuuaagauaaaaagagugauucucagcagggccauguacaggaggaaguucuauauggaggagaacacauccucaugcaucuucucuuucaccuccuccagguccagcuuuggcaugaggcccuccauccagaacaucauggucugacucagcauaugccaugcucugcucuucucagugguugccuugugcccagaacucagccuagauuuuuauuuuuauuuauuuuuguuuuuuacuuuuuuauuuuucaacuucugucuuagauucaggggguacacgugcagguuuguuaccuauauauauugcaugaugcugaaguuugggguacaaaugaucccaucaccuagguacugagcauaguaucuaacaguuaguuuuuccacccuuacccgcuucuacccuuccccucuaguagucccccgugucuaucauucccaucuuuauguccaugaguacccgaugucuagcucccacucauaagugagaacaugugguauaugguuuuuuuguuccugcauuaauucauuuaggcuaauggccucgagcugcauccauguugcugcaaaagacaugauuucauucuuuuuauggcuguguaguacuccuugguguauauguaccacauuuuccucauccagucgucauuaauggguaccuggguugaugcuaugacuuugcuauugugaauagugcugugaugaaugugcaaaugcaugucuuuugguagaaugauuuguuuucuguuggauagacacccaguaaugggauugcugggucaaaugguaguucugagauuuuuuuuuuuuuuuuuugagauggagucuagcuuuguuacucaggcuggaaugcagugacaugaucucggcucugccucccagguucaagugauucuccugcgucagccucucgaguagcugggacuacaggcaugcgccaccaugcccggcuaauuuuuguaguuuuaguagaagaugggguuucaccauauuggccagacuggucucgaacuccugacaucaagugauccacuugccucggccucccaaaguggugggauuacaggcgugagccacugcgccuggccgguaguucuguuuuaaguuuuuugagaugucuccaaacugcuuuccacaguggcugaacuaauuuacauucccaccaaugguguauaagcauucccuuuucuccacagccucaccagcaucuguuauuuuuuacuuuuuaauacaagccauucugacuggugugagaugguaucucauugugguuuucauuuguguuucucucgugauuggugauguggauuuuuuuuuauauguuuguuggccacugugugucuucuuuugagaagugucuguucauuucuuuugcccauguuuuaauggaguuauuuguuuuuugcuuguucaguuguuuaauuugcuuauagauucuggauauuagaccuuugucagaugcauagcuugcaaauauuuuaucccuuucuguagguugucucuuuacucuguggauaguugcuuuuacugugcagaaguucuuuaguuuaauuaggccuuacuuacaaauuuuuguuuuuguugcaauuguuuuugaggacuuaguaauaaauuguuucccaagacugauauucagaaugguguucccuagauuuucaucuaggauucuuauaguuugaagucuuacguuuaaaucuuugauucaucuugaguuaauuuuugcauauggugaaagguccaguuucauucuucggcauauggcuagccagcuaucccagcaucauuuauugaauagggaguccuuuccccauugcuuauuuuugucaacuuuguugaauaucaaauggcuuuagguguauagcuuuauuucuguguuccuuauuucauuccauuggucuauaugucuguuuugguaccaguaccaugcuauuuugguuaccauagccuuaugguauaguuugaaguugguuaaugugaugccuuuggcuuuguuccuuuuguuuaggguugcuuugguuauuuuggcuccuuuuugguuccauaugaauuuuagaauaguuuuuuccaaaucugugaaaaaugacauugguaguuugauaggaauagcauugaauucauagauugcuuugggcaguauggccauuuuaaugacauagauucuuccaauccaugagccuggaauauuucuccauuucuuugugucgucuaugucuuuuagcaguguuuuguaguucuccuuguagagaucuuucuccuccuugguuagauguauucguaggcauuuuuuguguguauggcuauuacaaaugggauugcauucuugauuuggcucucaguuugaauguuauugguguauagaaaugcuacugauuuuuauauauugauuuugguauccugaaacuuuccugaaguuauuuauuaguuccaggagacuuuugauggagucuuuagaguuuucaagguauagaaucauacugucugugaagaaaaauaguuugauuucuccuuuuccaauuuggauuccuuuuauuucuuccucuugccugauugcucuggcuagcacuuacaguacaugaauaggaguggugagaguggacauccuuucuuauuccaguucucaaagggaaugcuuccaguuuuugcccauuuaguaugauguuggcuguguuuaugucauagauggcucuuauuauuuuuuagguguguuccugcggugucuaguuucuugaggguuuuuaucaugaaaggauguuggauuuuacuuaaaacuuuuucugcaucuauugagaugauucuaugguuuuuguuuuuaauucugucuauguggugaaucacauuuauugauuuguguauguugaaccaaccuugcaucccaggacugaggccuacuugauuaucaugaauuaacuuuuuuugguguguuguugaauucaguuuucuaguauuuuuugaggauuuugguaucugugcccaucagggauaucagccuuuuuauugucucuuugccagguuuugguacuagggugauacuggcuuuguagaaugaguuagggaggagucucuccucaguuuuuugaaauaguuucaguagaauugguaccggcucuucuuuguaugucugguagaauuugugugaauccauuucuggucuagggcuuuuuuggauuaguagguuuuuaauuauugauucaauuuuggaacuugauauuggucuguuugguguuucgauuucuuucugauucaaucuugggagauuguauguuuccaggaauuaauccauuuccucuagauuuucuaguuugugugcauagagguguucauauuagucucugaggaucuuuuguauuucugugggauugguuggaaugucaccuuugucauuucugauugugcuuauuuggauuuucucucucuuuuucuuuuuuaaucuagcuagcagucuauagaucuuguuuauccuuucaaagaaccaacuuuugguuucgcugauucuuuguguggauuuuugagucucaauuuuguucaguugugcucugauuuuaguuuucuucugcuagcuuugggguuaguuuguuuuuguuuuuuucuaguucuucuaggugugauguuggauuguugauuaguaucucugggauauggcuuuugcuauaucgcagagauuuugggauauugugucuuuguuuuuauuuauuucaaagaaucuuuugauuucagccuugauuuuauuguuuaccccaaagucauucaggagcaaguuguuuaauuuccauguaauugugugguuuugagagaucuucuugguauugauuucuauuuuuauucuacugugguccaagaguaugguugauaugauuuugauuuuuaaaaaauuuaucaagacuugcuuuaugauugagcaugugguuaaucuugggguauguucugugugcagaugagaagaauguauauuuguggucgauauauagaguauucuguacauaucuauuaguccaauuggucaacuguuaaguccagaaugucuuuguuaauuuccugucaguggggcguugaaguccccuacuauuauuguguggcucucuaagucuuuuuguaaguuuauagguacuuguuuuaugaaucuggaugcuccgauguuggauacauauauauuuaggauaguuaacuuuuauugaauauaacccuuuaucauuauguaaugcccuucuuuguauguuuuugccguuguugguuuaaagucuauuuaaucugauaauaagauuuuuuuggucuuuuuuuucugccuuuuuuuuugguuuucuuuuugcaugguagaucuuucuccaccccuuuacuuggagcguaugggugucauuacaugugagaugcgucucuugaagacaacagauggaugggucuuguuucuuuauccaacuugccacucuuugccuuguaaguggggcauuuagaccauuuacauucaagguuaauauugauaugugaaguuuugauccuauugugaaguuguuagcuguuugcuuuguaguuucuauuguuuuuuucuuuauagggucugugggcuauguacuuaaguguguuuuugugguagcagguaucauucuuuuauuuccauauuuaggacucccuuagggaucuauuguaaggcugcucuagugguaacacauuccuuuggcacuugcuugucuggaaaagauuuuauuucuucuuugcuaugaaacuuaauuuggcagaauaugaaauucuugguuggaguuucuuuucuuuaagaaugcugauaauuggcucccaaucucuccugguuugcaagguuucugcugacagguccacuguuagccugaugggguuccuuuuguacauaaucugccccuuuucucuagcugccuuuaagauuuuuucuuuaacacugaccuuggacaguauggugacuauauaugucuuggugauguucauuuuguauauaguaucuugcagguguucucuggauuucuugugucuggaugucuaccucccuggcaagauaaggaaaguuuccuuuuuuuuuuuuuugacauuuuucacaaauuuauuuauccauguucuaaggacuagggaaguuuucuugaauuauugccucaaauauauuuuccaaguuguuugcuuuuucuccuucucucucaggaaugccaauaauuugaagguuugguugcauuacauaaucccacauuucucaaauaauuuacuuauuuuacuuauuuuuaaaaauucuucuuuuuuuuuuuuuuggucagauuggguucguucaaaagaccagucuugaaguccugaaauucuuucuucugcuugguccaguccauuuauaaagcuuucaauuuuauuuugaaauuccuuaagugagcuuuuuaauucuagaggcucugauugauuucuuuuugagauguuuaucucuucauuuccuggauugcuuuagaaguuucuuugucucaauuuuuaacuuugucuuggaucuccaugagcuuccuugcaagccaugcuuugaaguuguuuuuuuguuuguuuguuuguuuguuuuuuugauacagagucucacucugcugcccaggcuggagugcagucauguaaucugagcuuacugcaaccuccaccucccagguucaagugauucucugccucagcuuccugaguagcugggauuacaggcacaugccaccacgcccagcuaauuuuuguauuuuuaguagagaugggguuucaccauauuggccaggcuggucucgaacucccgaccucaggugaucuggccaccuuggccucccaaagugcugggauuacaggcauaagccaccacacccggccuaugcuuugaguuccuuaucuguuauuucugaguuucuauuuugguuagguaccauugcuggagaucuagugaaauuuuuugguggugucacuaccuucagcuuuuucauggugccagaauucuugugcugguuccuucucaucuggagacccuggcacuucugauuuuuguaauuauuuucaugcacguaggauuuuuuucuuuuucuuuuuuuucccuguaauguuguuguuauuauuauuauuauuauuaauucuucuuuccuuucccuuuucccugcuugccuaggggaugugacuguagagaaugcuugguaagaucuuuuggcuuugcuugaacagcccuaugcugcugcugcugcucuucuccuucuccuucuucuuuuuuuuuuuuuuuuuuuuggagauagagucucacuuagucacccagacuggagugcagagugcaguggccugaucuuggcuuacuacaaccuccuccucccaggucugagcaauucuccugccucagccuccugaguagcugggauugcaggcacccacuaccaugccuggcuaaguuuuguauuuuuaguagagacaggguuucaccuuguuugccauacuggucuugaucuccugacccaagugauccguccaccuuagccucccaaggugcugggauuacaggcaugagccaccgcgcccggcugcccuauguacuucuuucagcauguuuuauauugggcuguggaguuugucuuacaagccuguagauggcaugcacaggugagagccagcuacagccaguguguuuggguauauacuugauccuuauuuacuggcagaagcucucuguugcuccaggcgauuagcugauuuguagaaugcacaguggucugcacuccuuguucagcucugguggugacagggguugggaggguggcaaugggagccgugaagggcagaggcagaccuggcaaaucugccugcagguccccugaugguaggcacaagcacuagugccaagagagaauccagugggugaccaugagguacccaaagguuuuccuagguguggagcugggaaaccugcucagcuccaaauucucugcaugaggaugaggagaugcccuaagcuccucauccaggagagugggugcuccagaugccuggcgcacugccuggacauggagcagagagggucuugcugcacuaugaucuauacccaggaagcguggggcagcuuaggcugcugaaccagaugagagggugcucugaaugccuggagaucugccugguugugaggcagagagggccucuccauaccagacucucugcacaggaagaguggggcaggucaagcugccgauccaggugagugaugcuccagaugccuggagauuugccugggcauggagcagagagggcccccgugcaccaagaucuuuacacaggagggguggggcaacuuaggcugcuggaacgugcacgcagguggucugaaugccuggagaucuuccugggcauguaacagagagggucccccugcaccaggaucucuguucaggaaggguggggcagcuuaggcugcugaacccggcaaacagguguucuaagugccuggagaucugccuaggugugaagcagagagagccucgcagcaccgcaaucuguguccaggaagggugggguggcuugggcuacugguucaggcaaguacguauuccaaaugccuggauuucugccugggguuggaagagagagggcccugcugcaccaugaucucagggaagcagaguggggcacccaauaauggcacacacagaucaguugcagguuuccaagcuggcccuggcugcaagucucgccacccaggagaaacugcagcuguagcagcucucuuccgugccaggcuugugacaggggagagcacaauuccagcaccuacugcugaagcacuuuccacaguucuggauguggaggcccccuauccaacucuggagcagguguuccaaucucuggccugagacuaaaaugcccauacagccaugcugcaggucaccaaagaauggccgagauuaaaaaugguguccugcucucagucucagaucugggaaaaugccugcagcauuucccagugucuuuccuucacagugucuccaauccucuccucaaguuaacucucgggcuugggagaagcaaaaugcuuucccuuggccuggguugcuuggauccccaguggaaaggugagucacagaggagacuucuuccuuucucacauacuggggcuucacucaucucuaucagcuggaugcuaucaugggggcuguuuucuggcauucuccuccguggguucugggauguccuuuaugauucugguagauuuccauuuuccuccuugaauuaaaacucacagaguuuaucuuuauauacuaucuugcuauuuccaagugucugaggcaggcugaaagccgcuaauccaccaucuuggaaaaaagccaaccaaaaacacucauuuuauauuucaugggacaaucugguuaaggcucuugaaccugaaauaaagaggaucuuggaucagauccauaggaauaggaaauuauuugaaaaguuucagauaaaauauacacagagagaguucguauuuaauuucuuauuuuuauaaagcuucaaguaaauuauucauucagcaauuuugucauuuagguaaauaucuuaaugucuacauacaaguagauacauuuuuacuuuucuuuuuuuuuuuuaaucagaagagaccuggauuaugguuuuuacuuuucaaagauucuagugucaggaccugggugcauuugcacaugucugucauccuagcuacuugggaggcugaggcaggagaaucgcuugaguccaggaguucaaggcuacagugagcuacagucaugccuaugaauagccacugacucuagccuggacaacauaggaagaccuugucucuggaaaaaaaaaaauuauagugucaagucaucagaauagcuagaaacaaaaauccaugauuugaaauuucacauacgugauucucacguuuuagguacugcaauaaaauuuuguuaauuucaugacauuccaauagggaaauauaauacgacugauuuaaguggaugaagacucugacaacaaauuaauaauagacuaguagguuaaauuaguuaaacauuugaaauuaaauuaauaguucaacuugagaaauuuauucaaucaaaaauagaaauacauuuuuauggggaaauagacuacaugaauugaaaugacuaugcuucuuuggcagauuaacagaaggugcuaaaaaugucccaugcugacugacccuagaacuguaagagcagugaacuuuggaguuucugguuuuuauucacuguuuuuuuuuuuuuuuuuuuugagauggagcuuugcucuuguuguccaggcuggagugcaauggcacagucucggcucacugcaaccucugccugccagguuuaagcgauuuuccugccucagccucccgaguagcugggauuacaggcacgcgccaccacaccuggcuaauuuuguauuuuuaguagagacgggguuucuccauguuggucaagcuggucucgaacucccgaccucaggugauccacccgccuuggcuucccaaagugcugggauuacaggugugagccaccgcgccuggcuauucacuguuuauuauaaugaaaaugcauuagauagcauuagaaugucaaaauaauacuauuuuucuuagauuaucaggcaauggcauuaugugauuccuacucagaccagcauauucauacuaaauaaaagacugaauaucacuagaaaguuggcuaacaguuauggguaugcacguacacacacauacuaauuuuaauuuauuauuuuaaugcuucuagggggaaaaaauacaauguucaucaccuuaaaggccgacaaagcauuuggcaaaauucaacauuucuucauagaaucacuucauaaaauauaaguaaaugaauaguuccuuaauaugaauaccaaauguauguaucuuaguuaaaaagucugaauuaugcuuagcagggaaacuauggaggcauuucugucacaguuaugaacacauccaggaugacaaugauuacuuuuuaauauugaacuaaaguacagacagauuaugacaacaacuaggugggaagugagggaaacuaggaaaaagccacauaucuugauuguagaguugcaucagaauuagaccuuguucaagauuauauacacgugcuuaagaaaauacccuaauaugagaacaacaaaagauacugcagcaauaaaucuaauucuuaaaaggugaaagaagcugagugccguggcuuaugccuuauaaucccaucacuuuggaaggccagguggguggaucacuugaggccaggaguuggagaccagcuuggcccacaugguaaaacucugucuccacuaaaaauacaaaaaaauuugugguggugcgcaccuguaauucuagcuacucaggaagcugaagcaugagaauuguuugaacccaggaggcggagguugcagugaacugagaucaggccacuacacuccagccugggcaacagagcgagucugucugaguacauaaauaaauaaauuaaauuaaauuaaaaaggugaaagaauaacauccuuuuacagaugaucuacuagagcaaagagaaguauguuuuaggaauuuuuuguuuuauauuauucaaaaaucaggaaaacauagacucugcaauacagaugauccaagcugagaaaagacaacagauugagcugaaaacugauuuacugagaucagcugugauaaaagaaagcaaaaugaaauagaaagagauugaauuaauuaaaauuaaauaaauuaaaauuuucaguagaagcacugaacuguagacuuaaaacugaagaaagugaaaucggucauguaggaaaacuaacauaagaagcucugccagaauacagaaauagaauaauagaaugaugaagaaaggaaaaaguccuuugguuauaaaugauaauuuuguucccuuugcagggagaguuuacagaucuugaggggcagugucaucaguuguaacacugguaauuggagacagauacagucgagcauuuuagaauuugaaauaugccuucugcuuuucaaauuacuugaaaaucuuuucuacaaaaguagaaaagaugaaagaucaaagaaaaaauauuucuuagagcaaaagcuagaaaacagcaaaaaaguaugaacaaaaaaugugaaacaagaucagauauuucacugacagggaauauaaauggguugaguucccuauuaaaaacgaaaaccucuucaguauauguaaggccauagccaaaugaucuuucugcagguaauaaugauaaauucugagcaaaauacucuacacaacuaugugaagguccuggagaguaaaaaaaaaaaaaaaaaaaggcuggcagauucuugaggaaagacaacacuuggaagaauguccagcauggagaguuuccuguuuuucaugauaccagccucagggcaggguaaagucagugcugcauugauaccugcuauucucauagaaaauccagucuuucuggccugaaaaaccagaugacagaguuugcgguaagaacuacugcuggaaaaugagaaauggaucccagagagaacuagauugguauagccugagguucuguguguaaccccugcccaaaucucagacugacuucugaaccaugcauaugcagggcagacuaacagcuacccaacuagggguagguccagaacugagauuugaguugcugcccaagagaagaguuuguaguuugaauccaagcaagauaauugccuacuaaagcaaaaauaucaacauucuucagugaagaaaaugaaauucacaguauaacauucacgagguccaggauacaauccaaaauugaaaaugaggaaaaugugucccauucugaagacaaaaagcaguuaacagagacuaucccccaauaugaacuggauuagcagacaacuauuauaaagcagcuggggaagcaauugcugggagagggugagguaaagaaaauauguucagaaugagugaaaagacaagaaaucucagcagagaacugaaaucauaaaaaauuuaaauucuagaacuauaaaauauaauaucuuauauaaaaauucacuugaugggcuuaauagcagaauggagauaacagaggaaagguucaaauaacuuaaaauuaucccauguaaagaauagaaagagaauaauuagaagaaaagaaacagagcauuaggaaugugaggaacugugcaagcuucuaacauauuuccaauuagaaucccagaagacaaagaggagagaaugaggcagaaaaacuuuugaaaaaacagugacugaaaaauuuccaaaucugaaacacauaaauuuauagauuccagaaacuuagugaacuuaaagcagaauaaauuaagcacacuuuaguaaaacugcuaaaaaccuaagguaaagagcaaaucuagaaagcaaccagagaaaacgugacacauuaaauauagagguuuugggaacaggcccccaaaaucuggccauaaacuggcccaaaacuggccauaaacaaaaucucugcagcacugugacacauuugugauggccaugaugcccacgcugaagguuguggguguacuggaaugagggcaaggaacaccuggcccacccagggcggaaaaccgcuuaaggcguucuuaaaccacaaaugauagcaugagugaucgaugccuuaaggacauguucuugcugcagauaacuagccagagcccaucccuuuauuucagcccaucccuuuguuucccauaaggaauacuuguaguuaaucuauaauccauagaaaaaaugcuuaucacuggcuugcugucaauaaauauguggguaaaucucuguucgaggcucucagcucugaaggcugugagaccacugauuucccacuccacacgcuauauuucuguacgugugucuuuaauuucucuagcgccgcuggguuagggucuccacaagcgagcuggucucugcauggaggagugaugauugggaacugaugacuucuguuagaaacuuuggagcucagagacaguggaacaucuuuaaaauguugagaggaagaaccaucaacuuagaaucuuauucuagaacuuccugcgagaaugaagacaguagcucacaccuguaaucccagugcuuugggaggcugaggcaggaggauugcuuggggcuaggaguuuaagaccuaccugagcaacauagugagaccccaucucuacaagaaauuuagaaaaaauuagcuggugugguggcacaugccugcagugggagcuucucaggaggcugagguuggggaaucacuugagcccacaaauuugaggcugcagugagcuauaauugugccacugcacucuagccugggcaacagaaugagacucugucucucaaauaaauaaauaaaagaaugaaggcaaaauaaagacauucuaagauuaaaaagaaaaaugccucuccugggcaugguggcuuaugccuguaaucucagcacuuugggaggccaaggcggguggaucaccugaggucagaaguuugagaccagccuggccaacauggugaaacccugucucuaccaaaaauacaaaauuagcugggcaugguggcgcauaccuguaaucccagcuauuuggggggcuggggcaggagaaucgcuugaacuugagaggcagagguugcagugagccaagauagugccauugcacuccagcuuagacaacaagagcaaaacuccaucucaaaaaaaaaaagaaaagaaaagaaaagaaaaauaccuaagagaauuuaucaccaacaaacuuguacuacaagagauuccaaaacauguucuucagguagaaggaaaauaauggguggguacuucagugaugaagaagugaaaugcaucagaaaugaaaauggugaauagugggguaaauauaagcacuaguuuuuucucuuaguuucuuuaaaauguaauugauuguuuuacauaaaacuauaguguugucuuauagaguuuauaguguauguagaugugauacaugugacaccaguagcagaaagggggauguuuaguugguucuauacgaaugcaguguuucuacauuuuuuugaagugauaugauauucuaaguagagcaugaaaagcuaaggauguauauuguaaucauagaacaacaacuaaaauaaaggcugauagauuaaauuaaaaaggaauuuuaaaauguauucaaauaauccaaaaaauguaggcaaaaaguaaaagaagggacagaaggaaaacaaauaauaaaaucauggaccuaaauauuaaauguuaaugaacauuccaauuaaaagguagagauuaucagaacaaauuuaaaaaauaccaagagauauacuuuaaaaauaaagacacagauagaucaaaagcaauuguaugcaaaaagauauagcauccaaacaguaaugauacgauggcuaacauggauguauuagugccagauuaaauaaacuucaggaaaagcugggcuucucuuucacagcaaagauggauucugagguggauggggaguucagcuucccaggguggcuucccaagguggcgaaggcuguggccacaccauggucucagaugcugaggcaggccuaugugacugccaguggguaggccauggugaguggagaaaacaggcaguuguccccucugcaugcccugcacauacaccugggcuaugggccccaccagcggauguuugugcagggcucagccuuucccucguugguuucuggcagaacuaggccugugucccuuguuccugggccauagugcugaaguuugucuucuagggauuagguuguagauaaaucaaguauuguaugguggcuuguggaagacaguuuugacucuaagaucaguucaacaaccguuagcuucagcuauaaucauuuaugauaucaaaaagaagaaauauuuucaacauuaaggaauugauuacaugauuuuuaaguuuuuuuucuuucuuguaucaagggacaagucauagauuaaaaaauuuuugacagcaagcccuaucuaauuuuauaguugacaaaugugugcuauuaucacaaaggagaagucagagaaagaugcuacagacugcgccaauucauucauacaauuuuucuguaguucaaaaaccacaaugucucacauugucuagcagcuagaauuuuuuuauuuauuuauuuuuuuuuuuaguuuaagaaaagcaaaagaccacagugaacuuaaaugaacucuuuaaacaaaugaguugaauaauuccauccacuuacacuaacaccccaucugguaguaaggccuuuagacuccaaagacaaucuagaggcaaaguggaagcuauuguuggcugagccucagucacucauacuucauaaugaaauagauaguuuuaaaaguuaacaggaugauucuggucacugccauuaguuuguacauggguuuugggucuuuuucacacacaaaggauucccagaaaugucuaaguuuuguucucuuuaucauuuuuuauugcgucuauuugauucuucucucuuuucuucuuuauuagucuugcuagcgcucuaucaauuuuguugauccuuucaaaaaaccagcuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuagaucuuuccugcuuucuccugugggcauuuagugcuauaaauuucccucugcacacugcuuugaaugugucccagagauucugguaugcugugucuuuguucuuguugguuucaaagaacaucuuuauuucugccuucauuucguuauguacccaguagucauucaggagcagguuguucaguuuccauguaguugagcgguuuugagugaguuucuuaauccugaguucuaguuugauugcacuguggucugagagacaguuuguuauaauuucuguucuuuuacauuugcugaggagagcuuuacuuccaacuauguggucaauuuuggaauaggugugguguggugcugaaaaaaauguauauucuguugauuugggguggaaaguucuguagaugucuauuaggucugcuuggugcagagcugaguucaauuccuggguauccuuguuaacuuucugucuuguugaucugucuaauguugacagugggguguuaaagucucccauuauuauugugugggagucuaagucucuuuguaggucacucaggacuugcuuuaugaaucugggugcuccuguauugggugcauauauauuuaggagaguuagcucuuccuguugaauugaucccuuuaccauuauguaauggccuucuuugucucuuuugaucuuuguugguuuaaagucuguuuuuugagagacuaggauugcaaccccugccuuuuuuuguuuuccauuugcuugguagaucuuccuccauccuuuuauuuugagccugugugugucucugcacgugggauggguuuccugaauacagcacacugaugggucuugacucuuuauccaauuugccagucugugucuuuuaauuggagcauuuaguccauuuacauuuaaaguuaauauuguuaugugugaauuugaucccgucauuaugauguuaacugguuauuuugcucguuaguggaugcaguuucuuccuagccucgauggucuuuacaauuuggcaugauuuugcaguggcuaguaccaguuguuccuuuccauguuuagugcuuccuucaggagcucuuuuagggcaggccugguggugacaaaaucucucagcauuugcuugucuguaaaguauuuuauuucuccuucacuuaugaagcuuaguuuggcuggauaugaaauucuggguugaaaauucuuuccuuuaagaauguugaauauuggcccccacucuccucuggcuuguagaauuucugccgagagauccgcuguuagugugaugggcuucccuuuguggguaacccgaccuuucucucugggugccuuuaacauuuuuuccuucauuucaacuuugaugaaucugacaauuacgugucuuggaguuguuuuucucgaggaguaucuuuguggcguucucuguuuuuccugaauuugaauguugaccugccucgcuagguuggggaaguucuccuggauaauauccugaagaguguuuuccaacuugguuccauucucccuuucacuuucagguacaccaaucagacguagauuuggucuuuucacauagucccauauuucuuggaggcuuuguucauuucuuuuuacucuuuuuucucuaaacuucucuucucgcuucauuucagcuucaucacugauauccuuucuuccaguugauugaaucggcuacugaagcuugugcauucaucauguaguucucaugccaugauuuucggcuccaucaggccauuuuaggacuucucuacacugguuauucuaguuagccauucgucuaaucuuuuuucaagguuuuuagcuucuuugaguuggguucgaacuuccuccuuuagcuuggagaaguuugaucgucugaauccuucuucucucaacuugucaaagucauucucuguccagcuuuguaccguugcuagcgaggagcugcguuccuuuggagggggagaggugcucugauuuuuagaauuuucagcuuuucugcuuguuauuuccccaucuuugugguuuuaucuaccuuuggucuuugaugauggugacuuacagauggcguuuugguguggauguccuuucuguuuguuaguuuuccuucuaacugucaggacccucagcugcaggucuguuggaguuugcuggagguccacuccagacgcuguuugccugggcaucagcauuggaggcugcaaacagcgaauauugcugaacagcaaauguugcugcaugaucauuccucuggaagcuucgucucagagggguacccacugugugaggugucagucugacccugcuggggggugccucccaguuaggcugcuccugggucagggaccuacuugaggaggcagucuguccuuucucaaaucucaaacuccauacugggagaaccacuacucucuucaaagcucaguuggaaaugcagaaaucacccgucuucugcgucgcucacgcugggagcuguagacuggagguguuccuauucggccaucuuggaacccccaucaccccacaauuucuuuauguauuuguugauugaugggcauuugggcugguuccguauuuuugcaauugcgaauugugcugcuauaaacaugcaugugcagguaucuuuuuuguauaaugaccucuuuuccucuggguagauauccaagagugggagguagauacccaagagugggauugcuggaucaaauggaauuucuacuguuaauucuuuaaggaaucuucacauuagugguuguacuaguuuacauucccaccagcaguguagaaguguuccuuuuuuaccgcauccacaccaacaucuauuauuuuuugauuuuuugauuauggccauucuugcaggaguaaggugguauugcauugugguuuugauuugcauuucccugaucauuagugauguugagcauuuuuucauguuuguuggccauuuauguaccuucuuuugagaauugucuauucauguccuuagcccacuuuuugaugggauuauuuauuuuuuucuugccaacuuguuugaguuccuuguagauucuggauaucaguccuuugucaguuguauaaauugugaagauuuucucccacucugugcguugucuguuuacucugcugacuguuccuuuugcugggcagaagcucuuuaguguaguuaagucccaccuauuuaucuuugguuuuauugcauaugcuuuugguuucuuggucaugaagucuuugucuaagccaaugucuagaaggguuuuuuugauguuaucuucuggaauuuuuuggaugaaacauuuuaaaaagccaugcaacagaaugcguuucuagaggaugcauuucuuggucccucaacugcuucaugucuuuucucaccuaaaaaguaauaauaauaaaaauacagcguacaguacaaggcucaacauuguagguagagacugaaagccugccauuguuaauguuguuugcaaccagcguagguguucugaugaugcuaccaugcugcuuacuuaccaugaacacauuauuuuuuauuguauuaaugauaugucauauuuuuuccuguugaguauuuauaugugaauaaguauaagaaaaugauugcugugcuugcuuuggaagcacauauauuaaaauuggaaugauacagagaagauuagcauggcuucugcacaaggauaaguuuuauuuaaaagauguaaaauuuuuuaaaaaagaaaauguuugcuuauugguagcauauaaagacaggaaugauggugaugcuuaacaaccacagauuguccucauggguggcagagauagugauaccuucgcuuucugaucauuaaauguacacagucuuuguuucaugcacaaaauuauuaaaaauauuguauaaaauuacuuuuaggugauguauauaaguuauauauggaacauaaaugaauuucuuguuuagacuugggucuuacuuauuaugauuuguguacagugccuggcaaauuguguagcuucuaguagguauucuguaaaucuugguuccucuuuuuauuuaucuguugucuucagcacucguuucagugaagacauaguagaauucaucaauguguguugaauugaauaucaagcuauaauauacuaucaaaugggaacauuuaaugagcuguacuaccuacagauuuaguaaauuguuguuugaacuuuaguucuuuuaaaagaagcuauuucagcaacagcugcuuaaauagucuauagguagucuuuucuuuuagucuguaauacaauaagaaucuccuagaaggauaaaucaaauugguuccaugaaaccauaaaauuauugugugauaauuuauaggaaaccuccuuuaacaacauguuuuaaaaguuuuuguuacucuaaaucgauauguauauauauaaauaagcauuauucagcuucuugguuugacacuuggauuuuuaaggaaaagaucugcguauccaugugcaucuccaaaauauuuauuuagguacuuguaauuacuuuaaaaauccucuuuguuuguguuucaucuguagguauuauagcuauucacuguugagaauuuagagguacuuauaccauuuuuuacaaaaugaaugucccauaauucuagcauucuguuuuauaugaccaagugcucauuucacucuguuuagagaucaugaaggaaucauagucaagaacuccugaauuuuaaaauaguauuuaguaaugacaaauguugauauaaauguauuaugaaaucuuuaugucuaagaaaaauaauauuaaacagcuaauauuaaaaauuuuguuggcuaaauaacauuucaagagauggauguauugcauugauaauuagcacgauauuugaauuacaaaaaacucuucaauuuaaugcguaugguccauuuucacuuguguucuauaaaaaccuaaagguucuuaagccaaaugauuucuguuuagaauucuguuuagaauacauuucucagagcauauaguuuuggaugauauauauauccuuguaaaggcugauuuuuuaaaaaguucauccuuuaaaaaauuaagucuguaagacuuaaaggcauugguauucuacuuuaacuuuguugaugaguggaaaucuuuuaaucaagaauauuacaagugggucuuuacaucucucauugucauuaaugaacuaaaaggugcauacuuguuaaacuacaucucagagccuuauacauccauaaaaaagauguuauucuacaaguaggaccaaaguguuaccuuaacauagaugaacuuucauuaguguaguaucuuaguuuuaauucuauaacauugugcucuuuaauaaucacuaauuauauguauggcuuuuuucccaauaaaauuuuuaaagggcuuauugaaauauaguugacauauaauaggcugcacauaguuaaaggauacaauuuuuaaaauacugacauauguauaccuucaugagaccauugccacaacuaauagagugaacauuuccaucaccccaaaaaguuuccucuugcccuuuucucuuuuucuucuucuuucuuucucucucugucuuucgccuuccccuucccuucccucccucccuccuccuuuccuuuccuuccuuuucucucuuuucucuuucucucuuuucuuuccuuucccccuccccucccuucccuuccccuccccuccccuccccucuccucuccuuucuuuccagagucucacucuguugcccagacuggagggcaauggcgcagucuuggcucacugcaaccuuugccuccugaguucaagugauuccccugccucagccucccaaguagcugggauuacaggcaugugcuacuacacccggcuaaucuuguuuuuuuuuaguagagaugggguuucaccauguuggucaggcuggucuugaacuccugaccucaggugauccaccugccuuggccucccaaagggauggaauuacaggcaugagccaccaugcccggccuugccguuuuuuuuaucugucacuaccaaaccugucgucccuuccccaggcagcuacugauuagcuuucuguugcuauagauuuguuugcauuuucuagaguuuuauauaaauggagucacauaguauguacucauuuuuuuggucuggcuucuuuuacucugcauacuuauuuugagauuaaucuauuuugcuauguguaugauagucuauccuuuuuauugcugagugguauuucauuguacagauauggcacaauuuguuuauccauuccccugaugauggauauuuagauuucuucauguguuugguuaucccaaauaaagcugcaguuuuuagcuuauuuaugaacaaagcugauguaaacaucgaguaugauuuaaaaauugucugauuuuccauuuuuaccacuucccacaaucauggcuaucaacucuuaacauacaccaauguuuuuauccaccuuccucagcaacuuggcaauuaggaaagacugaaaauauuuaacauuaaacccauuuccugcauuugaauccuuuuacucauuagagguguuuauuauagggaagaaaaaaaucucauuuugaaucuugaaaucuaaauagccuggccagcauuauuuuaccuuuuaugacauuccuaaauaaaauuuuuaaauauaaccaaauugaaaccuguagucuuuaauuacccaaagagcuuaugcaaauacuuugcuuacuauaaugauguugugaugaaucuuuucuaaagagaauaaauguuuccuaaugaccauauuuuauuuccauaaguauauguggcauuugaagucuaucauaguuaucgaauuuucucuaaacaaggaaauauggaaaaaaucccauaaugccauacuuuuuaaaaaaaauugagacacauaaucuguguuuuuuauuauugaaaauuuuuuacuauuccuuuuuucuuuucuuuucuuuuuuuuuuuuuuuuugagacagugucucacucugcacccaggcuggagugcaguggcacuaucaugacucacugcagucucaaccucucagguucaggugagccucccaccucaucuuccugaguagcugaagcuacaggcauguaccaccacuccaggcuaauuuuucuauuuuuuguacagacagaguuucaccauguugcccaggcuggucucaaacuccugggcucaaacaauccacccgccuuggccuccuaaagugcuggaauuuacaaaugugagccagcgugcuaggucuacuacuguaucuauuuucauaaaauuuuaaaaaucucauaacuuuauagaaugaccuugagggagggagggagauagguagagagggagggagggagggaaggagagagagagggagagagagagggagagagauagagagagagagaauggagucuugcucugucacccaggcuggucacccaggcuggagagcaguggcacuauccagcucacugcaaccucgacauacaggguucaagcaauccuccuaccucaccuuccaaguaguugggcccacaggugugugccaccacacuuggcuaggugucuuuuuuuguuuguuuguuuguuuuuuguuuuuuuguuuuuuuuuuuguagagaugggguuucccuauguugcccaggcugaucuugaacuccugggcucaagugauccucccgacuuggccucucaaagugcugagauuacaggcaugagccaccaugcacaaccuauagaaugacuuuuaaaaggaauguuuauaugaaauaaaauuucaaccuccauuuuuuuaagaaaaauaugaagagcuuaaaacuugucccuuuucauuuauuuguucuugacaauacauauguuuacauguauguguguauaaauauaccuacacugugacaguuacguauauuaaaaaacaucuuccuaaggcaauaaauacuaccuguuuaugauauaauugcauuauauuuacagcuuauuaagaguuuuuaagaaauaguuuuaaaauuuucuguggauacauaguggguauauaucuuuuuuuuguuuuguuuuguuuuuuuugaggcagagucucacucuuucgcucaggcuggagugcaguggugcaaucuuggcucacugcaaccuccaccucccggguucaagcuauucuccuaccucagccucccagguaacugggauuacagguacucgccaccacccccagcuaauuuuuguauuuuuaguugagauggaguuucaccauguuggccaggcuggucuugaacuccugaccucaaaugauccaccugccucagccucccaaagugcugggauuacaggcuugagccacugcacccaggccauaguagguguauaucuuuaugagguaugugagauauuuugguacagguaugagauuauuugguaauauucacaucauggaaaacuggauauaccauccucucaagcacguauccuuuguauuacaaacaauccauuauacucuauuaguuauuuuaaauguacaauuaaauuauuauugaacuauaauaauucuguugugcugucaaauacuaggccuuuuucauucauucuuuuuuguuuuuguuuguuuuuugagacaaagucuugcucuguugcccaggcuggagggcaguggcguggucucagcucacugcaaccucugccucccagguucaagcaauucuccugccucagccuccugaguagcugggauuacaggugcacaccaccaugccuggcuaauuuuuuuuugcaaucuccaccuucuggguucaagcgauucuccugccucagucucccaaguagcugggauaacaggcgugugccaccacaccuggcugauuuuuguauuuuuaguaaagacaggauuucacuauguuggccaggcuggucucgaacuccugaccucaggugauccacgcccccuuggccucccaaagugcugggauuauaggcgugagcccuggcugauuuuuguauuuuuaguagagacgggauuucaccauguuggccaggcuggucucaaacucuugaccucaagugauccgcccaccucggccucccaaagugcugggauuauaggcaugagccaugacgcuccgccuuuuuuauucuuucuauuuuuuuuguacccauuauccauccccaccuucccccaucccccacuacccuucccagccucuggugaccauccuucuauucucugugaguuuaauuguuuugacuuucagauacuacaaauaagugagaauaugcgauguuugucuuucugugccuggcucauuucacuuaacccaaugaccuccaguuucauccauguuguugcaaguuccauucuuuuuuauggcagaauaguacuccacuuuguauaaauaacacauuuucuuuauccauucaucuguugauggacacuuagguugcuucaaaaucuugguuauugugaacagugcuguaacaaacaugagugugcugauauaucuuugauguacugauuuccuuucuuuuggauauauacccagcagugagauugcuggaucauguaguagcucuuuuuuuaguguuuugaggaaccugcaaacucaucuccauagugguuguacuaauuuacauucccaccaauagaguauugaggguucccuuuucucugcguccucagcaguguuuguuauucccugucuguuuaaaagccauuuuaacuggggugagaugauacuucauuguaguuuugauuugcauuucucuuaugaucaaugauguugagcacuuuuuuguuugccuguuugcuauuuguaugucuucuuuuaagaaauguuuauucaaaucuuuugcccaucuuuuaaucagauuuauuagauuuuuucccuauagaguuauuugagcuucuuauauauucugguuauuaaucccuugccagaugaguaguuugcaaauauuuucucccauucuguggguugucucuucacuuugccagcuguuuccuuugcugugcagaagcuuuuuaaccugaugugaucccauuuguucauuuuugcuuugguugucugugcuugugaaguaugacucaagaaauuuuugcucagaccaauguccuggagaguuuccccaauguuuucuuacaguaguuucauaauuugaagucuuaaauuuaagucuuuauuuuuauuuuauuuuucuauaaggugagauaggggucuagucucauucuucugcauauggauauccaguuuuuccagcacuguuuaaugaagagauggucuuuuccccaguguguauucuuggcaccuuugucaaaaauguguucacuguagguauguggauuuguuucuggguucucuauuuuguucuguuggucuaugugucuguuuuugugccaguaccaugcuguuuuugucuauagcuuuguaguauagugugaagucagguauugugauuucugcaguuuuguuauuuuuacucaggagagcuuuggcuauuuuggaucuuuucugauuccauauaaauuuuaggauugcuuuuucuauuucugugaagaauggcauugugacuuugguggggauugcauugaaucuguagauugcuuuggauaguaugagcauuuuaacaauauugauucuuccaaucuaugaauacggaauagcuuuccauuuuuguguuugugcccucuuuaauuucuuucaucaguguuuuauaguuucuauugcaaagaucugucacuucuuuuguuuguuuuuuuuuuuuuuuuuuuuuuuuuuuugagacggagucucacucugucgccaggcuggagugcaguggcagaaucucaacucacugcaaccuccgccuccuggguucaagcgauuucccugccucagccuccugaguagcugggacaacaggugcgugccaccacaccccacuaauuuuuguaguuuuuggagagacaggguuucaccguguuggccaggauggucucgaucucuugaccucaugaucugccugccucgaccucccaaagugcugggauuacaggcaugcaccacagcgccuggccaucuuucacuucuuugguuaauuccuagguauuugauuuuauuugugacuguuguaaaugggauuauuuuuuaaauuuguuuuucauauuguuuacugcuggcauauauaaaugcuacugauuuuuguuauguugauuuuguguccugcaacuuuacugaauuuguuuaucaguucuaauaguuuuccuuuuuuuuuuuuuuuuuuuaaaauacugggcauggugucaugugccuauagucccagcuacuggggaggcuggggugggguguggaaguaucucucuuuuuuuuuuuuuuuuuuuuuuuuuuugagauaaggucucauucuguugcccaggcuggagugcaguggcaagaucuuggcccacugcagccucugccucccaggcucaagugauccuuccaccucaacuuccugaguagcuggggcuacaggcacaugccaccacgccuggcuaauuuuuguauuuuuuguggagaugggauuuugccauguugcucaggcugguccugaacuccuggacucaagggauccaccuggcucggccucccaaagugcuaggauuacaggugugagccacuaugcccagcccucuugggaaaucuuuagguuuuuccaaauauaagcucgugucaccugcaaacaaggauaauuugacuguuuccuuuuccuuuccaauuuggaagcccuuuauuucuuucucaugugauugcuuuagcucagacaucuaguacuauguugaauaacaauggugaaagugggcauaguuugucauguuccagaucuaagagaaaaggcuuucaguuuucccccauuucguaugauacuagcugugggucugucauauauaguuuuuauuauguugagguccguuauuucuauaccuaguuuucugaggguuuuuaguaugaagggauauugagcuuuaucagauaauuuuucggcaucaauugaaauuauuauaugguuuuuguccuucaaagaauggaguuuuaauuuuuaggcaauuucacuuaaagugacuuuuuaaaaccuugauaucaaauauauaauauaauuugcauuauauauuuauauaaauauauauuuauuauuauaauauauaauuuauauauuuauauauaauaauuuauauaaaauaauuuauauaaauuauaauuuauguauaauauauauaauuuauauauuauauauuauauaauuauauauauauuauuauauauauuuaauauauauuauauauaauauauauuauauaugauauuauauauguuauauauuuauaauauauguuauauauaaaauuauauaauauauaauaaauauauauaauauauaaaauauauauuuauauauaaugcaaauauauauaauauauaaaauauauauuuauauauaaugcaaauauauauaaugcaaauacaugagcaauucuguugauguauuuucuaaaaaggcuaaccuuauuacucaauguuuaauucuuuuuuucuuuuuuuuugagacagucuugcucugucacccaggcugaagugcaguggugugaucuuggcuaacuguaacuuccaccucccugguucaagugauucuccucccucacccucugaguaguugggcuuacaguucccaacaccaugccuggcuaauuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuagaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccgccuggcuaauuuuuguauuuuuguauuucuaguagaguugggguuucaccguguuggccaggcugaucucgaacuccugaccucaaguggccuccccaaagugcuaggauuacaggcaugagcuacugagcccguccaaguucuuuacuaagaauuuucauuauagauugagaaaaggagagaauuuuuuuuauaguagaauucuauauauucaaguauuaaaugcuugauaucuaaucuucucauauuggguuauugauuuugaauuuuggaagugauacuuuccaaauucuuuuauugucucauuacaguuuaaaacuaauuugauugaauaccuuuugaucuucuuucuguggcuguuaauuuuuuucuuuuauuaaaauuauaauaaaauguguguaggacccaaagagaaaucaauuuuggucuuuuuuucuuuuugcuccuuuaucuuuuuuuuuaaucaguagaaagcuuuauuugccaggcuaaacgauaaauuaacaucaugauuuaggcuaagcaaaaaacuaauaucauuuuuuucuuucagaucucuauaaaaauggacuccaaagagcuaacuuuguaccauucauagcagucuugaagguaaaaacaaaucauuuauuuguguuuacuaagaucauacuuauugauaaucaagggcuuuaguaggauugucuuagucuuggcauucaagcagaauuuauuuuggcauuuagauaguaauagucaggggccgggcacgguggcucaugccuuuaaucccagcacuuugggaggccaaggugggcggaucacaaggucaggaguucaagaccaaccugaccaacauggugaaaccccgucucuauuaaagauacaaaaauuagcugggugugguggcaugcaccuguaaucccagcuacuuggggaggcugaggcaggagaaucauuugaacccuggaggcggagguugcagugagccgagaucacgccacuacacucuagccugggugacagggcgagacgccgucucgaauaaaaaaaaaaaaaaaaaaaaaaaggagacuugccagggcaacacggcaaaaccucuucucuagauaguaacagucaaagacacuaaaggagaaaagaaucuuuugauauaauauucauccauguguacacugaaaaaauuacaaaauauagucuaaauuauucucuaacugaaacauugaauaguuugcauuuuauaaauuuuaaauugagguaugcucauaaauauuauaguggaauauuuaaacuuauacauuuauuucugaaaaaaauguuuaauguucccuguuuccuucagguuaauggccauuauuaacauguuuucccagcuauuaaaguugcuauucuagaauagcauuauuacaaaaauauucuaauauauuuaaaugugauugccaucaaguuaugaaauuaugucaaguugaggcacauaaauuguuuaaauauuuguguguaucaucacugcauagaguuuaaaauagucuucauuacaauaugauuaagaauaaaauagccuccuuuuuuacuauuaauuuuaaguaauauuuuacaugauuauuuaaugauuucacauucugccaauauuuauuaagaaccuacuauguacaauguguugcauuaggcauaauggauaauagaauuaugaacuaagcuguuuuucuggcacauuauuuauaaucuaguugaggauguaaaauauauaaaaaaaucccuauaagagaaagcaaaauuugccaaaauauaauucccauaauuuuagauaaauacuuucuccccaugcacaucaacaaaucugaagaaaggauaaagaauuuuuuaaaacuugaaaccuuaaaaauucuuacccaagaaggguuaaaauguuuuaccuucagacaugcuaaagacauaaucagacaaucuuuuugacguguacuuugguuggaauuacuguucgugccaaacuuuauucccuaugcuauacuuaggagaauucaaacaucuguuuccuugaccaauuuuagguucccaaggauuuuaauuucucagagauauuuauagauguaggaaaaguacuuuuggaagauuuaugcuguuaguaauuuuuuucccuuuauauucaugcuuugcauuuagggaggacauagacuugcaacguuuucuccaugcuaggaauccaaaguaauaugguauacacagauaccaaaauauaaagaggaagcuaggaaaaauaggugcuaaaaauagugucuucauauagcauaaaauacacaaaauauaaaaagagaagucucagaaagaaacaaguuaagggguucugagggaacaacuuuguagcuguacuuuuuuuuuuuuccuccaaauauuuuguuguuguuuucuuuggccaguaauuagucauacuucaauauauaauagcaguauuaauaggcaaaaugaauaguaacaauuugaaagugaacaugaacugagagauauaauauacaauuuaaaguugaacauggacugaacuucccaggaaacuaaauaccagauuagaugagaaaaggucuaaaauaucuaauuuauucaagagacuuuucguauaugacaaaacaucaaugaaaugaaaacuagagcugguuucucugaagcuuuucuguuugggcauauaaaguuucuuuuguaaggaaagguaguuuaauauuaacuuaagugacuuuuugccucuucacagaugcuaguguuacuucuucauucuggccuagcugagagaaagguauagcaaaagucaaucuuaaaacaaauugagaaucuuaguuuaauaaaaagaaauuauuauaaacaagauagaaauuuguugaggaaaaaguauauuguaaaauucauuuuaaaaaauguucuucucuauaaaccaaauaguuauaaguuuguaauucaccacagaagcuugugguuuguugcuugggauauugaaaaauaacaaaaauguauauaagcucuuaguaaagccugcuuuauggcccaacauguggacaauuuuuguaaauauuuucuuuaaaauauuucuucaaaauagugaguacucuucgguuguuuuguauuauuguguagguuuguuaauuaugcuguucaaaucuuuauucucauauuuuuuuuccuaucaauuacugagagacuuaggggauacaucucucacuauaauugugaauuugucuauuuuucuuguaauucugucauuugccuuacauauuuggaggcuauguuauaaguugcauacagauuuauaauaauuauuuuauuuauuuauuuauuuauuuugagacagagucuugcucugucacccaggcuagagugcagucguacaauauuggcucacugcaaccucugccucccagguucaagcaauuuuccugccuuagccuccugaguagcugggacuacaagugcacacaccaccacaccaggcuaauuuuuguauuuuuaguagagaugggguuucaccauguuggccaggcuggucucaaacuccugaccucaagugaucugccugccuuggccucccaaagugcugggaguacagguguuagccaccacaccuggccagauuuacaguaguuaaauacugcuugugaauggagcuuuuaaauauuauugaguagcauugcuccuuuucaaguguauuuguaaccgucucuugaaacauuguuaucaugacugcuuuaaaaucuuuaucagauaauucuaacgucucugccaucuugauguugccauuucuuuacauucaguuugaggucuuccugauuuuugguauaagugauuuacaauggaagcuggcauuuucauaauuugucaugagacuuugaaucuuaauguuuuaaccaaauuuuuuauuguggcaaaauauacauaacaaaaauuacuauuuuaauacauuuugagacagggucucacgcuguugccuaggcuggagugcaguggcacaaucauagcuuacugcagccucaaccuccccaggcucaggugauccuccugccccagccuccugaguagcugggacuauaggcguauuccaccaugcccagcuaauuuuuguauuuuuuguagagacaggguuucacuauguuucccaggcuggucucaaacuccugaacucaagugauuugccugccuccaccucccaaaguguugggauuacaggcaagagucaccacaccuggccuauuuuaaugauuuuuaaggguacaguucaguggcauuaagugcauucacauuguuguacaagcaccaccaugauucaucuccagcauuuuucaucuuaucaaaaugaaacucuguacucacuaaaugauaaccacccauugucccccuuucccaacccugauuaccaccauucugcugucugccucugugaauuugucuuuucuagauacuucauguaaguggaauuaccuacuauuugucuuuuucuuucuggcuuauuucacuuagcacauugucuccaaaguuuaugcauguuguaacaugugucagaauucuaauccuuuuuauggcauaauaauauucuauuguaaggauaugccacauuuuguuuauccguucaccugccaaugggcauuuggguuguuucuaccuuucagcuauuaugaauauugcugcuucgaacauuuguguacaaauaucuguuugagucccugcuuucaauucuuuuguguacauacccagaacuuaaauugcuacaucuuaugguaauuauauguuuaauuucuugaggaacugccauacuguuuuccauagcggcuguaccauauuacguucccaucagcaauacacaagcauuccaguuucucugcauuuuccccaacacuuaucacuuauuuucuuuuuccuuuuuuuuuuuuuuugauaauaaccaucccagugggugugaagugauaucucauuauggcuuugauuugcauuucccaaaugauuaaugauauugaguaacuuuucaugugcuuauuuuauugauugacugauugauugacugagauggagucuugcucugucacacaggcuggagugcgguggcaugaucuuggcucacugcaacaucugccuccuggguucaagugauucucauuccucagccucccgaguagcugggauuacaggcacaugccaccacacccagcuaauuuuuguauuuuugguagagaugggguuucaccauguuggccaggcuggucucaaacuccugaccucaggugauccgcccaccucagccucccaaaaugcugagauuacaggugugagccacugugccuggccuuaucuucucuuuuuucaaauugggcaacaucucauucuacaaaauagauuguuauucuguuugucuuuguggaucuuauuugaacuuucuguuuuaguuagcuuuuuuuagacauuauucugucaagagaaggggaggcacugcuugcuuccuuuacuaccagauauagcuagaaauccagguucccuauucagccuccauugacaccugagcugugguuuggggugugcuccuuguuaccuguuacugcuggaaagaggguucugacucccaugugaucuccacugauaucauugugggaggaggaugcucauuacugguuggcugggaugaaaguuccaguuccuacuuggccuucugugacaucacccuggcagugguguugggauuccucaugacagccuuaugaggguggaauucuaggcuucccuuagccuuugccggcaugguuggggagguggagcuacaguuuuucucugugguauuugcuuuaguuagaacaguuauugucuaaaaguuuuacguuuuguuaaguugcccuuuuccugcuccuuuggcuaaagagaacagacuuuuaugggggccucauuuguauauuuccaucggcauuucuggguugcuggcuucuuuagcucuaagucugggauauaugagucaaagauaaacccuguggcucacacuuguaaucccagugcuuuggcaggccaacaugggagaaucgcuugaggccaagaguuugagaccagccugagcaacauagugagugcccaucuuuacaaaaaagaauuuuuuuuaaauuagcuaggcauugcgguguguaccuguccuccaagcuacuugggaagcugaggcaggaggcucacacaaggccaggagguagaggcugcagugagccaucauugugucacuguacuccagccugggcaacaaagcaauacccugucucuggaaauuaaaaaaaaaaaaaaaucaaucccacaggagggaaccucaccaucuguuguucuucaggucuugaacaggucuagcuguuuuuccuucuuucuacuuuucagggucuccugauguuucuuuuauauauaauuuccagauuguacauaugaggagggauagggaaaaguacaucuccaucuucccagaagcagaagucagcuuauuuaagguccuugucugcuaauuccaucauuucugguuauguuucuaugguuugauuuuuucccccugguugugaguccuauuuuccugcuucuuugcaagucaaguaaguuaugauuggaugcugcauuuagugauuauuacauugagucuguuacuuccuuuaagggugucaaauuuuauuuuggcaagugguuaaguuucuugcagaucagguugaucuuuuugaggcuuuuuuuuuuuuuuucccugugcaggcgucucacucuguugcccaggcuggagugcaguggcgugaggcuuauuuuuaaacuuugauagggugaauguagauuagccauuauuccaggucuguuuuagcccuucuagguguuagguuuuaggaccuuucuaagcucuuuacugaaucccugugguauucauugagguauuucagcuuugacuauaucagaaugcuuauaucucccagauuauguguauuguucuuugcccaacucugcauaugcaauuuguuauucagccaaagauuacauucccuaugcagauaucuggagcuuuucuuuugcauagcauuuuccugugcugaacucuacugugcaaauuccaacuguuucagcaucccaaaacucugaggacugucucuucaacucauuuagauuguucuauugcagucuagaaauugccucuagauagaaagccagggaauauggccagcuugcuugccugauuuuuuucccucauaucucagggauugcugucuuuugcuaccuauuacguaaugucugguaucagcugguucacauguuuuguccaguguuuuaguuauuuauuacagaagggcaaaauccaguuccaauuacucugccuuggccaaaagcauaaaucucuuucuuaguuuuuaguuauaaaggaaaagaagaucagguuuuuuuucuuuuuucuuuuuuuuuaguaauuuaggaacuuagagccauauuuuaucauagaaacaaaaaaauaaauaggauaacaauaaaaagacaguugugggcacaggaauuuuguuucagcuuucucucacacauuuagaggaacaguuagguaaaugaugaugcagucacaugaggggauauaacaguuauacggaauauuuuucaaaagcuuucgauaauguagaauaaugcuuacagauaacgugaguggaaaaguaugaugcaaggguacaucuauuccuaucucaacuguggaaauaauacacaugcaucaaaaaauacuggaaagaaauaucccaaaauguuaauagaauauauuucuggauauuaagauuaugagugauuuaaauuuucucuuuuagacuuuucuaagauuucuggaaugaucuuguauuauuuuuauaaugaaaaccauuuuugaacaggugaauuuugcucacuccucuuuggaaaucagcagaccugacuaggagaacucacaaucaaaguugagaaaucagcaaaaagcaaaauggauugaacauggguccuaucuguagagaccauuauuacaaaaauaaaugggauggcaggcacagggaggaaggagcaggagcggggggagaggcagagaugaacuaacaaguaaaagcacgugauagauauauuuuggaggaagaacuaccucaggaaaugggagaauuuuucagguaaaauuuucuauauucuaagagaaauuaaaguagucaugguacugaugacauaagagauuagacaugaaauaauuauaagauuagaugauaagugagcuggcagagcagcucucaaauaaacugagagcagaccauuaagaaaagaaaaagcaucuuagaaaaagcagaugauagaaucaacacugcugaaaauaaaaucagugauacagagcccaaacuuaugaaagaucauauaaaaugaugcuggaauaaucagacaugaaaacuacugcagaaaaaaaugcuagauauggaaagcagacagcagagaucauacauucacauaacucauauuucuaaaaaagaaaacacaaagauaaaucagaagaaaacuuucaugaaagaaaguuagguugaaagucuagauucaaaguguucauuguuuauuuccuauuguaugauccccccaucaagaaucauacauuuuuggcugggcgcaguggcucacaccuguaauccuagcacuuugggaggccgaggcagguggauuacuugaggucaggauuucgaaaccagccuggcuaacauggugaaaccccaucucuacuaaaaauacaaaaaaauuagccagccaugaggugggugccuguaaucccagcuacuuggaaggcuaaggcaggagaauagcuugaaccuggggggcagagguugcagugagccaagauugugccacugcacuccagccugggcaagagcgagacucugucuuccaaaaaaaaaaagaucauaaauuuuuugaugcacaacugaaccugaaccugaaggauuauaaaaagaaucuuacaaucauauggaagaaaaaucauugggaaaagaagucaagcuggucugaggcuuguaaacugcaaguagauacuagaagagaagagaagaguuuuuacuaaauucaguuuuuuaaaaaugugacaucuggucagcuaggcugucauguaccucuacgcccacagauauauguuuuggauauaugauaauuuaggauuuauaguccuuagugaaguuuccugaauaaacaacuuuaagauuuuauaccaccagucaaaauuaauaauauaaauggagauauugugguaagaaaauauugguggucauugaaucugacuaaacauugucuucuuccgaucuguaagucagacaauaaaaauuuuuaucauauuaugugagaacuucuguaauugaguuaacuaaaggaugcuaaaaaauaaaggggcccuaggagguugaagauggccaaauaggaacagauccagucuacagcucccaguguaagcaaugcagaagacgggugauuucugccuuuccaacugagguaucggguucaucucacuggggcuugucagacagugggugcaguccuuggaccaggguggggcauugccucacccaggaagugcaaggggucagggaauucccuuuccuagcaaagggaagccaugacaggcgguaccuggaaaaucgggacacucccacccaaauacugcgcuuuuccaacggccuuagcaaacggcacaccagauuauauccugugccuggcuuggagggucccaugcccauggagccuugcucacugcuagcacagcagucugagauugaacugcaagguggcagcgaggcugggggaggggcaucugccauugcagaggcuugaguagguaaacaaagcguccuggaagcucgaacuggguggagcccaucgcagcucaaggaggccuaccugccucuguagacuccaccucugggggcagggcauagcugaauaaaaggcagcagaaacuucuguauauuuaaaagucccugucugacagcuuucaagagaguagggguucucccagcacggaguuugagaucugagaauggacagacugccucucaagugggucucugacucccagccuaacugggagacaccucucaguagggcccgacugacaccucauacagcugggugccccucugagacgaagcuuccagaggaaggaucaggcagcaacauuuuccguucugcaauauuugcuguucugcagccucugcugcugauacccaggcaaacagggucuggaguggaccuccagcaaacuccaacagaccugcagcugagaguccugacuguuagaaggaaaacuaacaaacagaaaggacauccacaccaaaaccccaucuguauguugccaucaucaaagaccaaagguagauaaaaccacaaagauggggagaaaccagagcagagaagcugaaaaugcuaaaaaucagagcgccucuucuccuccaaaggaacgcagcuccucgccagcaacggaacaaagcuggacagagaaugacuuugaugacuugagagaagaagccuucagacaaucgguaauaacaaaacuucuccaagcuaaaggaggauguuugaacccaucucaaagaagcuaaaaaccuugaaaaaagauuagaugaaugucuaacuagaaaaaacaguucagagaaguccuuaaaugaccugauggagcugaaaaccauggcacgagaacuaugugaugcaugcacaagcuucaauggccgauuugaucaaguggaagaaaggguaucagugauugaagaucaaaugaaugaaaugaagccagaagagaaguuuagagaaaaaagaguaaaaagcaacaaacaaagccuccaagaaauaugggacuaugugaaaagaccaaaucuacaucugauugguguaucugaaagugacggggagaauggaaccaaguuggaaaauacucuucaggguauuauccaggagaacuucccaaaccuagugaggcaggccaacauucaaauucaggaaauacagagaacgccacaaagauacuccucgagaagagcaacuccaagacacguaauugucagauucaccaaaguugaaaugaaggaaaaaauguuaagggcagccagagagaaagguuggguuacccacaaagggaagcccaucagacuaacagcggaucucucagcagaaauccuucaagccagaagagagugggggccaauauucaacauucuuaaagaaaagaauuuucaacccagaauuuuauauccagccaaacuaagcuucauaagugaaggagaaauaaaauccuuuacagacaaacaacugcugacagguuuugucaccaccaggccugcccuaaaagagcuccugaaggaagcacuaaacauggaaaggaacaacugguaccagccacugcaaaaucaugccaaauuguaaagaccaucaaggcuaggaagaaacugcaucaacuaaugagcaaaauaaccagcuaacaucauaaugacaggaucaauuucacacacaacaauauuaaacuuaaauguaaaugggcuaaaugcuccaauuaaaagacacagacuggcaaauuggauaaagauucaagacccaucaguguguuguauucaggaaacccaucucaggugcagagacacacaugggcucaaaauaaaaggauggaggaagaucuaccaagcaaauggaaaacaaaaaaaaagcagggguugcaauccuagucucucauaaaacagacuuuaaaccaacaaagaucaaaagagagcaagaaggccauuacauaaugguaaagggaucaauucaaaaagaagagcuaacuaucuuaaauauguaugcacucaauacgggagcacccagauuaauaaagcaaguccuuagagaccuacaaagagacuuagacucccacauaauaauaaugggagacucuaacaccccacugucaacauuagacagaucaacaagacagaaaguuagcaaggauauccaggaacugaacucagcucugcaccaagcagaccuaauagacaucuacagaacucuccaccccaaaucaacagaauauacauuguucucagcaccacaucacacuuauuccaaaauugaccacauaguuggaaguaaagcacuccucagcaaauguaaaagaacagaaauuacaacaaacugucucucagaccacagugcaaucaaacuagaacucaggacuaagaaacucacucaaaaccacucaaguacauggaaacugaacaaccugcuccugaaugaacuacuggguacauaacaaaaugaaggcagaaauaaagauguucuuugaaaccaacgagaacaaagacacaacauaccagaaucucugggacacauucaaagcaguguguagaggcaaauuuauaacacuaaaugcccacaagagaaagcaggaaagaucuaaaauugacacccuaccaucacaauuaaaagaacuagagaagcaagagcaaacacauucaaaagcuagcagaaggcaagaaauaacuaagaacagcgcagaacugaaggagauagagacacaaaaaaaacccuucaaaaaaaucaaugaauccaggagcuuauuuuuugaaaggaucaacaaaauugauagaccacuagcaagacuaauaaggaagaaaagagagaagaaucaaauagacacaauaaaaaaugauaaaugggacaucaccaccgaucccacagaaauacaaacuaccaucagagaauacuauagacaccucuaugcaaauaaacuagaaaaucuagaagaaauggauaaauuccuggacacauacacccuaccaagacuaaaccaggaagaaguugaauccuuguauagaccaauaacagguucugaaauugaggcaaaaauuaauagccuaccaacccaaaaaaguccaggaccagauggauucacagccgaauucuaccagagguacaaagaggaucugguaccauuccuucugaaacuauuccaauuaauagaaaaagagggaauccucccuaauucauuuuaugaggccaaaaucauccugauaccaaagcccggcagagacacaacaaaaaagagaauuuuagaccaauaucccugaugaagaucgaugcaaaacuccucaauaaaauacuggcaaaccgaauccagcagcacaucaaaaagcuuauccaccaugaucaaguuggcuucuucccugggaugcaaggcugguucaacauacacaaaucaauaaaaguaauccaucacauaaauagaaccaaagacaaaaaccacaugauuaucucaauaguugcagaaaaggccuuugacaaaauucaauagcucuucuugcuaaaaacucucaauaaacuagguauugaugggauguaucucaaaauaauaagagcuauuuaugacaaacccacagccaauaucauacugaaugggcaaaacuggaagcauucccuuugaaaacuggcacaagacagggaugcccucucucaccacuucuauucaacauaguguuagaaguucuggccagggcaaucaggcaagggaaagaaauaaaggguauucaauuaggaaaagaggaagucaaauugucccuguuugcagaugacaugauuguauauuuagaaaaccccaucgucucagcccaaaaucuccuuaagcugauaagcaacuucagcaaagucucaggauacaaaaucaaugugcaaaaaucacaggcauuccucuacaccaauaacagacaaacagagagccaaauuaugagugaacucccauucacaguugcuucaaagauaauaaaauaccucggaauccaacugacaagggaugugaaggaccucuucaaggagaacugcaaaccacugcucaacuaaauaaaagaggacacaaacaaauuggaagaacauuccaugcucauggauaggaagaaucaauaucgugaaaauggccauacugcccaagguaauuuauagauucaaugccaccccaucaagcuaccaaugacuuucuucacagaauuggaaaagacuacuuuaaaguucauauggaaucaaaaaagagcccacauugccaagacacccuaagccaaaagaacaaagcuggaggcaucacgcuaccugacuucaaacuauacuacaaggcuacaguaaccaaaacagcauggugcugguaccaaaacagauauacagaccaauggaacagaauagagcccccgggaauaauuccacacaucugcaaccaucugaucuuugagaaaccugacaaaaacaagaaauggggaaagguuucccuauuuaauaaauggugcugggaaaacuggcuagccauauguagaaagcugaaacuggaucccuuccuuacaccuuauacaacaauuaauucaagauggauuaaagacuuaaauguuagaccuaaaaccauaaaaaccuagaagaaaaccuaggcaauaccauuuaggacauaggcaugggcaaggacuucacgucuaaaacaccaaaagcaauggcaacagaagccaaaauugacaaaugggaucuaauuaaacuuaaagagcuucugcacagcaaaagaaacuaccaucagagugaacaggcaaccuacagaaugggaggaaauuuuugcaaucuacucaucugacaaagggcuaauauccagaaucuacaaagaacucaaacaaauuuacaagaaaaagucaaacaaccccaucaaaaagugggugaaggauaugaacagacacuucucaaaagaagacauuuaugcaaccaacagacacaugaaaaaaugcucaucaucauuggccacgagagaaaugcaaauccaaaccacaaagagauaccaucucauaccaguuuuagaauggcaaucauuaaaaagucaggaaacaacaggugcuggagaggauguggagaaauaggaaugcuuuuacacuguuggugggacuguaaacuaguucaaccauuguggaagacaguguggcgauuccucaaggaucuagaacuagaaauaccauuugacacagccaucccauuacugggcauauacccaaaggauuauaaaucaugcugcuauaaagacacaugcacacauauguuuauugcagcacuauucacaagagcaaagacuuggaaccaacccaaauguccaucaaugauagaccggauuaagaaaauguggcacauauacaccauggaauacuaugcagccauaaaaaaggaugaguucauguccuuuguagggacauggaugaagcuggaaaccaucauucugagcaaauuaucauaaggacagaaaaccaaacacugcauguucucacucauaggugggaauugaacaaugcaaacacuuggacacagggugaggaacaucacacacuggggccugucaugcgguguggggagaggggagggauagcauuaggagauauaccuaauguaaaugacgaguuaaugggugcagcacaccaacuuggcacauguauagauagguaacaaaccugcauguugugcacauguacccuagaacuuaaaguauaauaauaauaauaaauaaauaaauaaaggggccugggcugggugugguggcucagaccuguaaucccagugcuuugggagacugagguuggaggauugcuugaggaguuugagaucagccugggcaacauggcaagaccucaucucuacaaaaaaauaaaaaauuuagucaggcaugguggugcaugccuguggucccagcuacuuaggaagcugaggugggaggauugcuugagcccaggaguuccaggcugcaguaagccacgauugcaccacuggauuccagcgugggcgacagagcaagacauugucuuaaacacacacacacacacacacacacagacacgcacacacacacacacacacacaaaaaaaaaacggggaaaaaaagaaaaagaaaaggggcccugacccacacuggcaguuugaguggaggagguagcacaugucaggaguauuuuuccaaagagccgaugaugcuuaaacugagacuuaaaagacaauuaaguuaccaagaaaagugggaaaggacguuuaccaugcagggaaaagacauagaaguaugagaacuguaauuaaaaauuuuauuuucaguaaucaguucauugagaaaaauaauuuucauaaaauaacugucacuagucuguuuacuugagguuggcagauuuauuuaaaacucagauuuuucuccaaauaaaagcaagauauguuuuguauuguauuuaaauagaaaaauuuagguaauucuuuuucucuugguuguaauuguaauaauugugccuccuucaauaagucuguacuuuaacuugaaauuuccuucugaucauaugacauaguaucuuuauuuuaccaauauuaauaaaacuuagguaauucuccuaaaguauaagaacaaauauaauuguuuuauuuuauuuuauuuauauuuuuuugagauggagucucacucugucgcccaggcuggagugcaguggugcaaucucggcucacugcaagcuccaccucccggguucacgccauucugcugccucagccucccggguagcugggacuacaggugccugccaccacgccagcuaauuuuuuguauuuuuaguagagacggggguucaucauguuagccaggauggucucaauuuccugacuucaagauccaccugccucggccucccaaagacaaauauaauuguuaaagcauuuguugguaucuauauagcaucauuuuauaaaguuaaaggcauucauuuuacccucugcacugaaaguauuuuaaaguagccugugauaguuuauaccaggguggacaaacuauagccaguggccaaaucuggccugcugccuguuuuuauaaaucaaguuuuauugaaaaauuuuaugcucauauauuuauguauuaccuauggcucuuuuuggaguacaguugcagaguugaguggcugcaguggagacuuacggcuuucaaagccuaacauauuuaguaucugacccuuuacaggaaguuugcuggcccugaucuauauaauauacaaagggcaaacaauugcuuaaaacgacauaugucaauagcaccuuuuuuuucuaugaaguaugacuuguuuuaugugaugaaaauccugugucagcauagauuuauuaguaggucuuggagaaaggggcauuccaagagcuugcuggauaaaugguugaucgaagggaggaagcuuggugagugaaccaaaagcaaagauagugauucgguaucaauuucagauaauuuaguaacuugagaaauaucagcuuuguuaggaucaacuuucuuagaaauaucuucaauuucauacauuuaaaaggaauaauauaucuuaaauguacauucacugaacaauauuuauggaguauaaucucacugcauuuguaaacauuauuuaaaauuagugugguuaaaaggaaaagggaaccaguugauauuuugaacagaagaauaguuuauuagguuacuuucaauuuacuauuacuagccuucuugaagauuagauugccuggcaagcauugcuauucucaucugaucaagguccagcaauucaugauauuuuacacaaauuuuuccauuuggguaaaaaucugucuguuuacuccaucacuuacacuuucauaaaccauuuaguuuguuucauuccauaaugaacccuaaaagagauaaaugcuauucauaaguuuuaagguuaaaaaaauuuucaaugugaauuucauuagcuuucuuuuuaugauuuucuuaaucaguuuaacagugugaaauaaucuaaaauaaucuccccaggggaaauguuccugugcaagauuguauguaguguuuuugcacacaaugauagaucuuaauaucaguaauuuagcacuuugauucucauucacaaugacagcuuagcaugcuaucuucuuucuuaacuuuuaaauuucuucuuaaaauuaaauguuugaugauuagauuacugaaugauaacuaaacuggugaaaaauaaccaacaaggcauucuacaauagaauuuucucuugaugaauuucagaugguucgauuagagaaaaauaauuccagcauuaacucuuauaaauaugaauuuuccuuuuccuaauaaagaguugcccauuuggaaggcaucacuaucugauuuauuuguucgguuuaaauauguaacauaaagaagugauacuuuauaaugugagguaguaacaauuuuguucuuauuauugcuacuuuuguaauuuguuuaauguucagguaaugacaucauaucuuuuacuugguuguucauguuucuugacuguugugcauccuuuacauaaaacuuaaaaaaauuaagugauauauuaguuuuuauguuuuuauuuccugagaaaauuuuuccaaugauaagaaaauuuuuccugauaguaaacuagaauauucccauggugugauuuccagcuacaaacuuuagaaaacuuguuugauuauaacccuuagauaaaaugcuucaguguucagccuuuguccagccaucugcauuaggauuuauagacuugcuaaauaaauguauauuugccauuuuuccugccacaguuuucauuucauuggugaaauugauuugucaguuuguucauuguaacuuucaauaccagagcuuucagagugcuaaauaaucagaaucagccuuugaggucagugucagucagccucuaugaccucuacugcguugucaccugagucagccuugcagggauuaacccuuuguuagugugauaaugucuuuacuuaugaguuggcuuuuuaauacuuaagauugaaagaaacaaaagacagaacaaaaguagcagacaacuccugaauuggaaagaguuguugcuuucccccacaaacuguaugugguaaaauauuucuaaaauuaucaaguuuuagucuaagucuaggaaaucuacccaagauauuuuauuaaauuuauuuaauuuauuaaauuaaauaaaaauauauuuuuauuuuauuaaaaaauaaaaauauauuuaauauuaaauauauuaaaacauauauuccauauauguuuggaaaaauuuauuuaagaaaauuggcuguaguaacaggcacuaaaguuuuauuuguaaugguguuuuugugcugugucguugcaauuaauaaauaucuaagaugaaaaugguugugauguggauuuaaaauacaguccuuuuccaucuucauaacagaauguagaccuuguauuagucagggccuaucuauagaaaaguaauuuuagguguaugccuuuuaaaauauuuucucuaauuaucucauauaaaauaaaaauaaagauuuuucgcgacauauguaaauuauauauuuguaguuaucuggaaaaaaacaagcuauugcuuacauguaaaauauauacuguuuaggacuugaauucucuucucuuagaacaauaaauaguuauuuuugguuaaaucacaagauaucaauuauuugaugacaaaaauggcuuaaaggaagugugucuuaaauauggauuagcuaguucuuugaaugaugagauaaauuaguuuaauuacacguggcaauuuucuuggcuagugauguaaugugaaauaaaauucucccuuuccccucccugaaaacucaagccaauuaauagaacuuuuaagcucuuugucauaggccaccauggaggucugcagagaagaacuuuaauccaauaaacauuucauuuagaucaugaaaagaaagcaugaggagaagcuccuguaagagaggguguuacuaugauuccaaccaugaagagaugugaggaauuugccaaauuaaccaagagguccucauauugaacgcauaaaugugucaaaacuaacagaaucauuauuuaauuugcuugaacucuauauugaggaaacucuaaaaagccacaacuguuuucuucaaagccuucacuguugggcuggauggacagggcaaagggagguugugagaaauccagauaccaaauaacacuggccgaagcuggucagaaaagggaauagauaauuaggcguaauuagcguguaugaaucguugucucucugcccuuagcuugaauaaauuuugaagaaaaaaacccuaguggugaaaauccuuugauguaggaagagucauuguggcuuggcagcauaaaggcaguguuuuauacuuuuuacauaaugguugugauacagacagagugaauggacccugcacccccccugucugcuuuagaccaaggacuuuuggauucucuugaaacaaaaugcaucacaaguuuucaguuguucguaaugagguagcggaccucaucagggcucagaggaagccaucuuuagcuuuuguuuaaaccuuaaucucaguuuuuuuucuuucugggaaaucuguuuucuuaaaucaacacuucuuuuuucuucuuugcuugcaccuccaauaagagaugggaaucaugcuuaagaaagcuaaauggaaaaguuaaacaaaaauuaucacauaaaagauguaugcauuuuuuaaucccacaugaaaaagaugcuugcuauauucccuuuugccuuuaaaucaguaacauucuaguaaaguuguuuuauaauagaaaauauaagaaaacauauagggaauaauuuuagauuguuuuuggaaagaacuuguuuucaaauugaaauuauacaaaguaaaaugguaaguagguuacuguuucacagaauuuaaguuuuuaaguggaaaucaguuugguuaaaaauauuaguagcuuuacugcaaacuuuguuuaugcaagaggcauaguuaaaacauagguuugagaaccuguguccagaauaguuaauuuguccgauauccacuacugggaagucaagaaauuauucuugagaaagcauugcauuuauucugaggcagguggauuacuugagcucaggaguuugagaaagcauugcauuuauuuugaaauuuucugaagcacugaaacaauaagucaccuaaaaugcaguuaucaacuuuuucuggcaguugaauuauguucacuuugucuauccaaaauauuuuuuuaaaauuaguccucagcaaaaaaaaaaaaaaaaaaaaaagaagaagaaaugcucuauuucagaaucuaaaguaaaucaaguauuuuguugggggaaggaggugcugaaauaauuuguauauuauccucaauaucagaauagcaucucuaaguaaguuuuauaauucugauaaauguucaaucucuuuauuagcuacuuugaaacuacguuuaaaaaaaucuacccuucaaauacuucagugcucagguuuccgucuaauuaauauuauucuuuuaacguauuuuaauuauaggacuuucugcaguagucauccaugauccauuccuuaauguguaaucugugaagcuauuuuuauaagcauugcccugcuuuagaguaguuuuacuaugacguuuugauucuggauagacuucuuucaagccacaaugcucugagaugcuuuuggcuacuuaacccauuuugcauauugugccauuuguagaauaaaguagccuuuuauacuugaaguugauuugaacucugaaaggcaacaccugaacaucucacaaaacuggauaauuauggcugauuguguuuuucagguauaggucacaggaaauucauuugggguaaaguaugcacaaagcuaagaaauaugcagauuuucuguuguaggacuguguaaaaauuauuuacaguuaauacuugcauaaagguuagaaagguugaugaagugauauuuaguuuugcuuuacuauucacugcaugucagaauguaauuaugacugauucaugaaacugucuuagaaacgaaccaucuuuauuaaaaugcugaucaagauaagagcugacaguaauaaagaauagaacauuuuagucuuguugcuuuugaaugauugcuaauuaccccagaggucauguauagugcuugguaggauucauugacauuauuucuuuuaagucugcuguuucaacaacaucugagcaugaagacacaaacugugugcacauugaacaauaguuuggcuuaaguuuuuagggcuucaagauaucuaagaaaucuucuucugccauagugaauuuaguuuuucuguaucaaaauuauauuauauuaggggugcuugguacaaaauacauuguauauuuauuuacuauugacuguaucuacaccucccauuuuuaaguugcguuaaauaguauauauagguuauugggacagugucaccucuaaauauauacacaagcauauacaaguaauaagaacaaaaugaguacuaacauuuaaguuagaauacauaaaaggacuuauuaauguguaaucagaauauacucaucagaauauacaauuugaacacuaacuacugauaguuugguuuuuauuaaaugugaacuuuguaauuugucucuaaauguauguggaaauccuuaucauguauuccuuagccaauuaugauugauaggauucauguauuauaaauacauaguugauuaacugaauaaacucugacauacuguuuaaaauaacuuaaaucuuuauaauuauuaacugaaaguagaagaauguggaauauauauguaauaugcaugcauguauguguguguguuaguauauguauauauacaaacuacacaaucacaucacacuuuucuuuuuuucugguuuccaugauguaacagaaaaaucaaugggaugagaaggcaaucuuuguggaccuggcucugucacugacuuugcucugucacuggcaagccucuuaaaccugugugagcucauuuccucuguaaaugaugggauuggacuacaagguugcuaaggcucucaugaagcuauuuauuuucaaaaagauuaaguuucagaaguuuacuuauaaauuauuucuuuuaaacuaugauagauuucucccucaaauaguguucuaaauaugauaauaaagucuuaggcuaccuagucuacaaaagccuaauugccccaaauagcucauauuauuauacucuuguaaaaugaaguagaagaaagcaauaguuagauuucaacaugcauuuacgaagggcuuagucauugggguuacaaugauaaauguguuacugaguugaauccugccaucagggaaauuaggauguucuaguaggggaaguagacaaaaaaugauuauuauauagcauauaaaaauauuauaauguuagagauauauuguaauauauauaauagagaaugaguuagaagugguuagcuguguggugggagguuauaauacuagcaauuauguaaauugcaauauauuaaauuaaaagcacaacuuuuaaauacguuuucucccucugugaugcugguaauuguggaggaggaaaggaugagauaguaauguuugugaauuuugaaaggacuccuguauguguuuacaaguuucagagguugaugaaacuggaguuuuguuuugccuuuuguuuucuuuauauaaauguaucacugccaucacucuugguuuaauagucaugcuuaugauacuggaaugaaauggagauuuccuaagaaaacuggacaaagcuuagaagggagacagaaagagcagaggaagaaagcuaaaaauguuucaguguauacagaagaaguuaccugacguagaacugaauaaguuaugcauagugacagcugagaaauacagagcaaggcauauguagaaacucuuuuugagggugggcagugggaaagggauggcacucuagguuguaaccagagguuaagagagccuuuuuaacuccuggaaugucacuguguguagaaggcagaauacaaacagaggguuacacaugguagacauuuuauaauuuaagaaugcuuguaaauaaggaugguuguucacacuuuuuaaaaacugguauagcauugacagaccaaacauagcagaugcuggguugugaucaguugccccauacugguguaugcuagugaguaccagccuuaccuauaaauaguguauguguguguguguguguauguguauacucacagaauuugaaggcucuuuagaaacacuuaucccaccaccuuauuauacaguggaggcgacugaggcucaugccugagaucaucuuaccuaagauugccuggauagcagcagagccaggucuacaauccagauuuccuaguuuuuauugagagcucuuuccgccaaaccauguugcacaauauguguguguguauguguauguaugaagacauauauacauacacauauauacauauauucacuauauuuacauauugcauaccuuauugucuuuagguggaauuaauuauauucccaauugcucuuauugauaaggaacucuuuaucuuucuuuuauauaaaaguauaaucuaucuuauuaaucuagcuuuagucauacacaaugguaaguuaaauauagugauauccagauacuguuuuagauaauagcuuaaaauuuacucuucagaucuuuuaucagcgauaacaauugacuauuguuaagagugacuaaauuugucucuuuucaucuucagauaaagguacuaauaagcagugaaaugacaaaaaguugagcaaauacaaugaagaaagaacagaaccaaaguuuagaauauuuauaaaugcuauccuggauacuaaaacucuaaauaaugaagccucuguaaauggguaggggucauuuuuuaagcuaaauauuuuauugagauauucuuuuucuugguuauuccagagugguaauuacaguguaaaugaaucauaugccuuaugggcuuuguguaauuauagugcacuuuuuuuuuuaguuagaaaaguuaugcuuaccuaugauuauuuauacagaagaagaaaaaaucuuguggguaaauuuacuggauguugaaaaacuaauuuugcaaagcugcauguauagugggaacuuccuauuagcuugaagcuguauugcauaguuccuuucugugggagaaaauuaaagcuuacaggagcugcaguuguguguuugguaguauaguuauaaaaaagauccucaaaaagugcacauuucaacuucuuugcagccuguggugugccacucuucuacuuuucuuuucuuuuucucccuaggaaugaggacucugauuuucuuggauaagguaaacagugggagaagaauggaauauuaauuaaaauucuguuuguuaugacagaguuggaaauguauaauggaugugauuuccauaagacagcuaucagcuuuuucccagcaccagcaccagucuuuggggacaauacucaaagaucuuuccuuuuguaaauuuucauaagaguuaaaugaaugcaugauaggcuaacaaaugccaacaucacauaaauauauaaacuaaauauuaaaacucccccuucaccacucuucccucuucccaucccuccuccaccuucuacuccaccucauuccuacuucccuccccaggaguagccacuauuaaaaauuuaguuuguaucuuuucaagcauuuuucuuuacauuuaugugcauacauaucuauauauauguccaaacauauaguuuuguuuuguuguaaguuaaugaggguaauauauauaccuuagucugaguuauacuuuuauccccagagauauccuaaagaucuuuugauauuagauauaauucaaucucauuuuuaauuuuuuaauuuuuauuuauuuaucuuuuuggagacggugucuuucccuauugcccaggcuagagugcaguggugugaucauagcucacuacagacuccaucuccugggcucaagugauccuucugccucagccuucugaguagccaggacuacacacuuggcuaacuuuuuuauuuucuguagagauggugucuugcuauguugcccaggcuggucucaaacccguggcguuauauaauucucuuaccugccacucucaguuuuaaauggcugcauuauuauuuuaaaacuaaucugcuauuuuuguauacuuagguuuauucuaguuuaguuuacuuuuaaaguaaugccuuaaaaauauguuugcaaauguguuuuuagugcauacgagccaauauuucuguagguuagauuucucaaaauggaauuuuuuuuuuuuuuuuuuuuuugaguuggagucuugcucugucacccagguuggagugcaguggcauaaucuuggcucacugcaaacucugccucccggacucaagcaauucccuugccucagccuccugaguagcugggacuacaggugaacgccaccauacccgguuaauuuuuguauuuuuaguagagacaggguuucaccauguugguaaggcugaucuugaacucuugaccucaagugauccaccuaccuuggccucccaaagugcugggauuacaggcgugagccaccaccccggccucaaaauggaauuucuaggucaaaggcucuuguaauuaaaacuuugcuggauuuugucauauugcucuuuacuuguguauuagcuaacauuaaaaauuaaguuauaaaauacauuucuaaaaaguuauuauauauuuguauuucaguagcuuuugggguacaagugauuuuugguuacaugaaugaauuguauaguggugaaguuugagauuuuaguguacccaucaucugaguagcauacauuguacccaauauguaguuuuuuauacucaccccucuauaaccacuccaucuucugagucucuaauguccauuauaucacugucuaugcuuugcaugcugauagcuuagcucccacuuguaagugggaacaugugguauuugguuuucuauuccugaguuacuucacuuggaauaauggccuuuaccuccauccaaguugcugcaaaagacauuauuuaauucuuuuuaauggcugaguagcauuccaugguguauauauauaccacauuuucuuuauccacucauuggucagugggcacuuagauuaguucuccauguuugcaauugugaauugugcugugauaaacauaugcauggaggugucuuuuugauguaaugguuucuuuuccuuuggcuagauacccaauagugggauugcuggauagaacgguagaucuacuuuuaguucucugaaaucuguauguuauuuuccauagauguuguaguaauuuacauucccacgagcaguguauaagaguuuccuuuuuaccacauuuacacugacaucuauuguuuuuugacuuuuuaguaauggccauucuggcugggguaaggugguaccucauugugguuuuaauuugcauaucccuggcaguuagugauacugagcauuuuuccauauguuuguuguccauuuguauaucuucuuuugagaagugucuauucguguuauuuuucaacuuuugaugagauuauuuguuuuuuucuuucugauuugcuugucuuccuuguauauucuggauauuaguccuuguuagacacauaguuuauggguugucuguuuacucuaaugauuauuuccuuugcuguuuagaagcuuuuuaguuuagguaccauuuauuuauuuuuguuuuugcuguacuugcuuuuggggucuuagucauaaauucuuucccuaugccaauguccagaagaguuuuuucuaggcuuucuucuagaauguuugugguuuaaguuuucaaaccaucuugaguugacuuuuguauaagguaagggauagggauccaguuuuauucuuccaccuguagcuauccaguuuucccagcaccauuuauugaauaguguguccuuuccccaacuuauauuuuuauauguguauuagucuguucucaugcugcuaauaaagacauacccgagacuagguaauuuauaaaggaaagagguuugacucacacuuccacaugacuggggaggccucacaaucauggcugaaggcgaaugacgagcaaagucauauuuuacauggugccaggcaagaagaacuuguguaggggaacucuccuuuauaaaaccaucagaucuuguggagacuuauucacuaccacaggaagaacacgggaaagacccauccccaugacucaauuuccucccaccagguccuuuccacacgugggaauuaugggagcuacaauucaagaugagauuuggguggggacacagccaaaccauaucaguauacuuugucaaagaucagcuagauguaagcauuuggcuuuauuuuuggguucucuguucuguuccauuggucuguguaucuacuuuuauaccaguaccaugcuguuuugguuacuauagccuugcaguauaauuugaaucugaguaaugugauacccccagauuuguucuuuuugucuaggauugcuuuggcuauuagggcucuuucuugauuccauaugaauuuaggauuuuuuuuucuaauucuguggaaaauugcuuugcugcccaaagcaauuccuuucaaaauacuguaguuuuuuuugagcaguauggucauuuucacaauauagauucuuccaaucaaugagcaugggagguaguuucauuuguuugugucauguuauuauguauuuauuuauuuauuuugagauggagucucgcuguguugcucaggcuggaaugcaguggcacgaucucagcucacugcaaccuccaccuccuggguucaagcaguucuccugccucagccuccugaguggcugggauuacagguacccgccacaacgcccggcuaauuuuugugguuuuaguagagauaggauuucaccauguuggccaggcugaucucaaacuccugaccucaaauguuccacccgccuuggccucuaaagugcuaaauacaggugugagccacugugcccagucauaagaugguauuuuuuaagaagccacauuaaccuuucuagaauacaguagggcauauaaauaaaugacaagaaaucaucuaaguugagguaucauacucuggacauuuuauuggguguugcuuauacuuauugaauuaacaacaagcuauugcaaaauuaucauuaccaaaauauuuaagggugguggaaguuuugaacuuuuauucugugccuuguucuggacaugggagguauguguagugguuaagagcacauagucugcaaaccugauuucagcuacugcuucccacacccaugaacaggcuuaauaacucuagacagauagagaucaaaauacuugauccuuuugaacaucagguaaugcauugacaaauuggagccaaugagccugucuuuaaagaaucuuaucuuuaaagcuauaaaauuaacugcacaauaaaugauugcccuuguuauuuuuauucuucuguaacaguguuauaaagauaacugugacuaaacauuuauucucugguuuaaaaggcaguggggcauuuucugucuaacagauaaaaacacauaagcacuauauaguuccccuucucucaaauuuuaccauuuuguaaauuguuuggaugaacagaaguaacucuucauauuaacauuaggauuuuuuguuucauuuuccacucccaugccaaauaauuugaauaguauaaggacaagacuucaucaauucuuacuugcucggcauccuggcacauagcuauuagaaugcaaacuaguaccuuagaucauucacaucaguuuccugauaugcuaauagacccaaggucuugaccaaguugacaauguugguacagauuuuuauucuuuauaauuucuuuuuuuuuuggaggcgaagucuugcucaugucacccaggcuggagugcaguggcgugaucuuggcucacugcaaccuccgccucccagguucaagcgcuucuucugccucagccuccugaguagcugggauuagaggcaccugccaccacgcccggcuaauuuuuguauuuuuaguagagacaggguuucaccauguuggccaugcuggucucgaacugcugaccucaggcgauccgccugccucagccucccaaagugcugggauuacaggcaugagccaccgcgccuggcuauucuuuauaauuucuuacugauauucuaaagauuacaaauacuauauuuuacaagagucugaauaauuuguagaaauuauuaugucuaagauagaguauggaagaaaaaguaagucauuggcauucugaacaagaccucugguguuacacaguagcaguugccacagucagauguuucaccuuucuuuguugcuuuuuuuuuuuuuuuuuuuugagacugaguuuugcuguuguaacccaggcuggagugcaauagcacgaucucagcucacugcaacauccucuucccagauucaagugcccguguagcugggauuauaggcgccugccaccacaccuggcuaauuuuuuguauuuuuaguagagacgggguuucaccauguuggccaggcuggucucgaacuccugaccucaagugauccaccugccucggccucccaaagugcugggauuauaggcaugagccauugcgcucagcccggcccucaccuuucuuuuuauaauuagagugauggugucuuugaagcaccaugguccuccacagaguuccagacacugacagggagacccuacaacucucugugcuggucuucagugauacacuuguaguucgaucugguaugccaucaggugccggcgcuuugccugguuauuauuauuuuugguucuaaguacuuugaaaauauuuuuagugacauauccagaaagucuuuguuucagagggagauugguauguuccaaaucauagugguccucaaaaagauaaaaaugucaccuuauuuacaauauggguuggaaacccaacuguauaacuuacggucaucugguuugagauguugaaaugucuaacugaauaaucuguaguaucucaccacccaggacuucuucuaccccuucuguacauucuuauguguuuucucaagcccucuuuaaacuacuucagcuuuggaacacuuccuuagcuuuaccaguccuuuguuuccacaguacccuacucuucucaguuuauucaaauaguucuggacuacucauauacuuuuauguccuuuacccccauugcggaguaauggugauuuucuuuucauuuuauuuuauccaaauauaaaccagaaggaaguuauugccaccaaucucuaccucuaugguucuaagaucacaaacaccagcccucgaugauccuauggcuuuaguugccacccaugguggacauuguaguugucuacccaaaauucauuucacucucugcuacuguguaguagccaugugguuuggauggaacugaccagagauggggccugauuaggcuaagccagugguucucaauccuggcccauugggauuaccuaaggagcuuaaaacaaaacagaaaaaaaucagccaaccaaauccuccucccugaaaugccugggaguggggccuggauguuggcacuuucuagauacuucccaggugagucuaaugggcagccaguguugagaaccacuggucuaccaucuucccugccacuggcauugguucaggaaauucacaccuaugccaguuagcuuuugccauuccccaagcuacaggaacugguugucgugguuacaaucaacauaaucaggguagcucaggacuuucguuuuauagacauagaaaaguacucagucuccucucuuuguuaugaggaaauccugccgugggaugaaauuguuacuuugaagagggcagaaaugacagauuugaagagaauagaaccagggcccugauuaaacuguuuuauacccccagacuuuucaguuaugugaacaaauaaaucugcuuuauuauuuaauuggucuucugauacaugugacuaaguuaaccacaaacauuaacuuuauuauuguuauuauuauuauuauuauuuuuugagagacagagucuugcucagucgcccaggcuggagugcaguggcgcgacuucagcucauugcaaccuccgccucccggguucagccaauucuccugccucagcuucccaaguagcugguacugcaggcaugcaccaccacacccagcuaauuuuuguauuuuuuuuuugguagagacgggauuucacuauguguuggccaggcuggucucgaacuccugaccuuagguaauccacccaccucggccucccaaagugcugggauuacauguguaaaccaccacgcccagccuuauuauuuuauuauuuuauuuuuugagauggaucucacucuguugcccaggcuggagugcaguggcgcgaucucagcucacugcaaccucugccuucccaguucaagcgauucuccugccucggcuuucugaguagcugggauuacaggcacaaggcaccaugucuggcuaauuuuuguauuuuuaguagagaugggguuucaccauguuggccaggcuggucuggaacuccugaucucaggugaucugcccgccucugccucccaaauugcugagauuacaggcgugagccacugugcccggccacauacauuaacuuuaaaaaucacagaaauguaacuuuagaagaagagacuauuucuuuuaaaggguuacagccugcaacauggccaucccgcaggcugggaagcauagccuuugacaaagaccaagacaggcacuuaaagggaacaggaauuggaauaggagcuuuaugcugaauggguugucuaaauauacauauugaacagguuauaggaggagcuaugaauauuuaugaaugugguucugacacauguauauugaacaaacaugcauguaacauaguacccauguucaccuugggauggagacuuaacauuuaaauguauuacagcucuaugcugauggcuccuaacucagaauuuuugucuuggcuccaacuccuagagugccaagccuaauaucuaggcuggacaucugcaccuagagaagucccaagauccucaaauucaccaugccaccgaacugaaugauccucucccccacuugcucuuacuccaguucuuuguugaauggcauagccaugugguugccuaagccagaaacccaacagucuucuugacucuuucuuccucauucuuuaccuuuaaagcaaucaagcucuguugaucuauccacuucucucucuccuuacucuauugcuuuucuaggcuacuuucacaucuuuccuagauuuuucugacaccugcuaacucagcaauguuuaugcaguuuucuuccccccuccauuguuuucccaacucuggagcagugauccgauccugucaccucccuuccuaaaucuuuacauuacuuccauuuuauggacuuaggauauuuaacuugcaaagcucuuuacgacaugagcucuugccagcuucuauagccccauuuugggccacucuuagaauacaugcaacugaaagcauccuaaugcuugaacucugcauucuugcuaugcugaacuaauuuuagauccccaauucgcuaagcugucuuuugcaucucuagauguauaggugauauuucuugaguuugaaacauucuuuccuacaucuucucccucaccugcuaaaugaggcuacuugccacauuuuugggguuaguuguuacuguucaguguuccagagcauccuguucugauucuuaaccaucugucuuccuugcuagacggauguucugaucaccuccuauuuacccugucaguaaaggagggauccccaaccaaauagugauuaagaugcccgacauuggacaaacgagauuggcagcaguguauuagucacaugaacucacagccugagggauagggacacuacacacauaacgauuauaaaccagaaggggcuaugggaggcaggcuuuguaguaagaugaaggugggauacagcuggucuggcugauagggauacuggccagguaggaggacuuuaccucugggcaugggaaccacuggguguaucugacaagagcagggaauggcucugugaggcucaaaaaugucaagguagcaccugaguguuuaggucuuacaacagggcugggcacaguggcucacgccuguaauccagcacuuugggaggcugaaauggaaggaucgcuugaggccaggagcuugagaccaaccugggcagcaaagccacacucugucucaacaaaaauuacaaaaauuagcugggcaugaugacacaugccuguagucccagcuacucaggaggcugagguggaagaaucgcuugaggccaggagagaagauguuuccucauauagacucgaguguguggcacucaggguguggguaaugagaccugaugaugaguagguagagaugggcugugaacuccagggugcagccuuuucaaaauccugccguuuucucaguugcugaccuuauaacuggcagaacauagcuggaagaaugcuucauuuugucauaaaagcuccuugagaaagggacugcacugguuggcuucuuccuguaguuccuaacauacuaacuugcacuagagcuuuacacauaugugucugcuaaugguuuguucaguuaauaaauauuuacugagcauuuacuauguacugugugcuagauaguaacugcugaagagacaaugaugacaaaacagacaugauccuggucacauagaacuuacaggcuugaaacccaaaucugucucuacaaucucauucaguauagaaaaaugacccauuuuguuauguuacaauguaauauauaacagcuacacaaaguuucuugaaagcugccccauaucauuuuuguaugagauuagguuuuuuuuuagacagagucucgcuguguugccaggcuggagugcagugucacaaucuuggcucacugcaacaucuaccucccggguucaagugauuuuccugucucagccuccugaguagcugggacuacaggugcacaccaccauggucagcuaauuuuuguauuuuuaguagagacgggguuucacuauauuggccaggaugaucuugaucucuugaccuugugaucugccugccuuggccucccaaagugcugggauuacaggugugagccaccgcacccggcugagauuagguuuuaaacaaauaaaccaaucuguuuauugcaacguagcuauuucucaggaaagcaagcaaguuugggccuuacucagugagcacaggagcagagggcaacagauguaggauuuugugaggcaagcugucaguacugugaaaaccucccaacaagcccaugugaaucuuccauugccuuuuguguauccaagcaagagccauaguugccugagcauaucaugggcugugaugaaacaccagagccaaaaugccugcguuugaauccugguucugucacuuuugggcuguuugacaauggacaaguuacuuagccucucugugcuuuaguuucuucauccauuuguaaaauagaauaauaauaauuucuaccucauagagugguugaaagaauuaaaugaauacauuuaaggaucuuagaauagucccuggcacaugguaagcccuuauaccaguguuugcuauuaccauggcgucuuaguccaggcugagaaaucuaagaugagggcaccagcagauuugguaucgggugagggcucccuuucugauuccaagauguuaccuuuuagcuguguccucacaucauggaaggaagggacaaacaagcucccucagccuuuuuuuauaaaggcaguaaucucauucaugagggaucugcccucaggacuuaaucaccucccaaaggcccuaccuccuaauaucacacuggagauuagguuucaacauaugaauucuggggggacacaaauauuuagaccauagcagaugauaaugauggacucauuuauuuacaccucaaauucccuuaccaaguuuaugccaggucuuauuaugggaccuauuaaaaugugagaggaauuaucauguguauuuuguggaagagaguaauugucccagauuacuuuguacuuuucauuuuggcaccucugagagagagcggggaaaucaucauccuuguuagacucucuucugcuuugaagggucugugaguauaugguguuguguaggauuaagaggcagucccacugucuuggaguuuccaagacugacauccuugguuuagaugaucaagugaaagccauaggaacaguggacuaugagaugagcagacauuuuagauaaacauagaaaauguccuacguaauggaaauuuacuauaauauaacccauuauaguauagaauuuaguaugggguacauuuaucucauacauggucuuggacuaaauacguaaaggaaauaauauaaaaucauauuguauggcccccagaagaguaauuaguauauuuacacugugcagagguaauuaauuugagaugggagggagagguggaggagcaaaaaugaauuauguaaguuguguaagacuaaagaaaaaugauccuguggcuaccguugaauaacucagugugacauagugggaggaccauggauuugguggaggcaagauuguccuggucaaaucacagcucagccaccuacaaacuauguggccucuuuuuggaugcacugugaauugugaauuuacugagauguuuucuuuuggcuguggcugcagaaagagucagauugugacucaccucacaagcaaguguauggaggugugcuuuuagcuucuguccugacuugcuugcuugcuuuuuugaaucuugcaauuauucuuucuuuuuuugcucuuuuagaaaaugccuuucuguaugcuuauuacuggagcaagguagcauauuggugauuguauugguuuauuaggacuucuaaaacaaaauucaacagacuggaugacuuaaaccauggaaauucauuuucucacgguucugguggcuagaaggacaaagacguuggcagguuuggucucuccugaggccucucuccgugacuugcagguggccaccuucucacuguguuuucacauggccuuucugugggguacacacauaacuguauccacauguccacauuuccucuucucauaaggauaccagucagacuucauuuuaacugaauuaaaggcucugucuccaaauacagucacauucugagguacugagagaguuucaacaugaauuuuggggagaugcaauuaagcccauaauauuacuuuuuuuuuuaaguuaccucucugauccuauguuuccucaacuguaaaauggggauuuaaaaaaaauauugccuugcccuguagauggauauuaugaggaagauaagagauaaagccaagucaguugccuagcccaucuaaagcacaugauaagcacuucaugaugcuuaaauaucccccuucccgcuuuuuggaaggagaaagaaauucugaaacugcuugauaaaaagaagggauacaggccuuaccuaauaaguuaaucagguauggguauuugaagugugagacaaguaggguagcuagggaaagaggaguggggagauauggaaaaaaauguuuuugauuuacuuugguauaugagaugaucaagaaagcaaaggaggcugauauagcuugagguagacucaggccguguggucugcucuaaagugagguaagcccaaggaagaacucagcccugaagagcccugaagugagagaacuucacgauaauguuaaaaauuuagagcuuaaagggaucguaaucaauuccuuuauuuuguagaggagaaaacugacaucuggagagguuacguaacaggcuaaaaccacacagcgugacaauuggcagaggacuucucaauuuaucaacuugaaaaauuacgucuaugaucgagagaagaaaaugauaacuugaacaaauaucugauuacuaccagacugucagagcaaacgcuauaucuuauucaucauuauaucucuaguagccagggaagugcccaaccuguaguauucaauuauguuuguuagguugauccaaaauaaauauuaaauuuggaggggacuuguuaaaccauaagugcacauuuuugugauauaaaacaguguggcauauuuuauuaaauauaugaaacaucuuuaguaucauccugaucuuccauguagauggaagaaucucacagacguaaaagaacccuaucacaaaagaauacauacuguaugauuucacuuauaaaaagcuccagaaacaggcaaaauucuauggugcuagacuuagaauaguaguuaccucuggggaguagaaggugauauuaggggggcuucagagauucuggugauauucuauuucaugacugagccggacacuuauaauuuguauacuuuccuguauuaaguuauacuuaaauuauaaaaagcuuaaaauauggagcagcuuauguauugaauuuucuuauauaucauuguuuaagcuuagaaguaguaguacaugauuacuuuaaauaugacucaaacagcugucuuagaauguauagcugccucaaaauaaaguaagacagucuccacucagucucccacccuuaaauuguauucuuagcaaaaaaaguuaguacaguaugcaauuaagcuuuucuguauuuaaguguuuauuuucuuucauagaacuuuuaagauaucaaaaaaauuaagcauagaacuauauauaauaugauagaugucuaccucuguaaucuccauauguauaggaaaaacuuauauaagcuauaaacaaacuuuuuucugagaaagggguauucauuucuacuguuaugcuuuuaauauuguuugaauguuuuauaauaagcauggaucacuuuuucaguucaaaaaagauacauuuuuauuuuauuuuuugagauggagucucauucuguugcccaggcuggagcagucucaguucauugcaaccuccaccucccagguucaagcaauucuccugccucagccuccugaguagcugggauuacagguguaugccaccacacccagcuacuuuuuguauuuuuaguagagaugggguuucaacauguugggcaggcuggucucaaacuccugaccucaggugaucugccugucucagccucccaaagugcugggauuacaggcgugagccacagcaccuggccuaaaaaggauacguuucuuaaagaaucaaguaaaaugauauaucuuaguuauuuaaaauuuuauuuccuggaauaagaaaaagucucgacugggcgugguggcucacaccuguaaugccagcaauuugggaggcugaggcagguguucaagaccagccuggccaacauggugaaaccccgucucuacuaaaaaauacaaaaauuagccgggcaugguggcgggcaccugcaaucccagcuacuugggaggcugaggcagggagaauugcuugaacgcaggaagcagagguugcagugagcugagaucaugccacugcacuccagccugcacaacagagugagacuccaucucaaaaaaagaaaaaaggaaaagaaaagucucaaccauuuuuucuuuuuuguuguuuacucauuaaaaauuuauaaaauaaauuaguugacuguuaaucaagaaaaacacuaauaauuuugauucuuuaaaugccuauuuaauauagucacuuagauaagggauagaaguucgauuuauguaguugggauuuuuuccucauguuccaaauuucuaugauaagugaaauugcuuuuauaauaaaaaaugcuaagaugggcaaaucuguguuuauuauuucaaucuuugcuuaagagguuaguauguuauaguuuuaaaagauuuucuccacaaugucuuuauucuuuguuccaacugggauggaguagaagcuauauaaaguuauuuugugagauggcuguuuuucuaaugguauuauucaggauugcuaaaaauacacacaauagauuuuggggacaauauaaacugcuuuaauacaguuccuuuagucauacauuuuucuuuccaaacucaaaggccuuugacacaugaguaugcucagaagggugugcuaaccucccuccuuuuccucuccaaauuuucuaauugcauuuuuuuuagauuguguaauuguauuuguccuuuguauauauaaauaugcaaacuauuuuaaaauaaauuuuguuugcuggcugauuaguguuguauauuagaauuggauggugauaagaggucacaggccuuguaaauaucacuggaaauuaggaaauuucuuagagaucaugcucuuuugacuagauucacugucgacuugcagcuuagcuuccccccgccuccacccuucugcaaagagcuuugaagaaucuagcguaagugaaugaaaucugaaaaucugagguuuauuuaaaaaaaaaaaauauauauauauauauauaaacugaguguuaguauuuuucagacaauuaagugcuaacaucuaagugcuuugguaauaguucuuuugcugcugauuagguauuccucaguggugauuagugaauguacaaaugcaaucauuucguaggucuuaaucacucauaugaucgagaaguuaguuacccagaaagagaaauugaagcuguauaacuuucauuagccuuauuuuuuaauagcaaaaaauaagaaaacuuuuugacuaaauuaggaauacugagucauauaagauaaauuguaguuuaaaagaaauagagaaccuggcaaauauauuuauaugacuguauugugacacuguauuugaugucuguaguaaagauagcuuaugaaaaauugaccauugcuuaccauaguagggcagguuuuucucagggagauugaguaagacauguucccugcauaaggacauuuuuccuucuucuuuuuuuuuuuuacugggugacugagcucucgcaauuauagcaggaacaagggaaagaaaguauuuuuucacauuuaugacaucaagaaaaacacagaacaucuugaggcaaggggagaaauauauauucauauaucucuuuucuucucaagaaguaauguaguauauauauaaaacacaggacaucuugaggcaaggagagaguagaaugcauguuuuugggcaaugcuguauuuuccucuggugggauugguuauagggcccagguccuaaaggagaggccuggggaguuggguuuggacaacuuggagugaugagcuagggauaucuguauagagacuccaacagguugcucaugccagcauugcagggagccaugacuuuugcuaguuuuucagggcuguucuucaaauguuaguucaaaagccuagguuuguaggccucccuagaggaccagcuucuuggguguuauuuuaugcuaaucaaauucagaauugcugauauauaaucaaaaugcuauaccuauacuagccacaacccagucuuugggucuucacucaggguaaccaagcaucccagauugucuaggauuguccuaguguuagcacugaaaguucuauauccagaaaccccccuuagucuuggggaaaccccucauuuccaggggauuguuggucaccuauuuuacucuccugagccccuuagcaccugcagcaugggaggaggggaaaugcaaucuaugcccuggaugcagaugauaaacagcccucagcccuugcguaacaguacaacccaggaugcacuuucagggaggaagaacauugcuacuucucaagugugcccagauauugcuguucugauuaucucuugcugcauaacaaauuacuguaaaaugacuguaaaagagguuuaaaaaacauuacuuuauucucuccugguuucuguaggucaaggauuugguaaaggcucagcuggcaauucuggcucccucaguaagaguggcuacagcuagaacagcuggggacugucaacaccucugucuucaugucaucucagugccucuccagggccuccucucucuguaugggauaguuuaagcuuucucacagcauaguagccuccaggcaauuaaaugcucaacuggcacuucagaguuccggagcaagcauuccaaccaauaagaagcugcucaagugucaccuaggauauuauugcauagaccauuuccaucauagucacaacauucaaggagugggacauagacuucacuucuugauaacuggaauaucaacaucacauuguaagaagaacauguugggauggagagauuauuuuacaauguacaagucuuaaaacccaccacaauuacguugguuccgaagguuugaaaaaugcaguuuuugacugggcgugguagcucaugccugcaaucccagcacuuugggaggcugaggggagcagaucacuugaggccaggaguucgagaccagcuuggccaacagggagaaacccugucuccacuaaaaauacaaaaauuaccggggcauggugacacaugccuguagucccaccuacuugggaggcugaggcaugaaaauuguuugaaccuaagaggagaagguugcagugagccaagaucaugccacugcacuccacccugggcaacagaguaagacucugucgaaaaaaaaaaaauugcauuuuuucauuaauaaaaauagugauguuguuaaaauauauuuuucccaugaauugccauuaagacaauuuucauuuugaaugcaaacaaaaugucagccuauaguuguuucuugacuuguccugaaaucccuuagucaccauucuucuacugaagugaauaucucccaucuaucuaucuaucuaucuaucuaucuaucuaucuaucuaucuauaucugcacaggcauaccuuagagauaucgaggguuugguucuaggcuacugcaauacaacaguauugcaauaaaaugaguugcaggaagcuuuugguuucucagugcauauaaagguuauauuuauacuauacuauagucuauuaagugugcaaugguauuaugucuaaagaaaaccuuaauuaaaaaaauacuuuauugcuaaaaaugccaauaaucaucugaacuuucagugaguggucaucuuuuugcuggucuugccucgauguugauggcugcugacuaaucaggauggugacugcuaaagguuggaguggcuguggcaguuucuuaagauaauguugaagguugcuauauagauugacucuuccuuucacaaaagguauuuauggcagauauagccuuacaaaauguauuucuuaaauaauaauacuuacaaguugaaauuacuucuugauucaugcaugggcugcagaauggauguuauguuaacaggcagggaaacaacauuuaucuccuugugcacuuccaucagagcucuuugaugaccaaguggauugucaugagcaguaaucuuuugaaaacaaucuuucuucuaagcaguagcucugaacaguaggcuuaaaauauuuaguaaaccauacuguaaacagaugugcugccauccaagggcuuuguuauuucauuuauaaagcacaggcagaguagauguagcaaaauucuuaagggccuugggauuuucagauugguaaaugaacauuugcuucaacaucaagucaucaguugcauuagccucuaacaagagagucagccuguccuuugaagcuuugaagccaugcauugacuucuccuuucuagcuaugaaaguccuaguuggcaucuucuuccagcagaaggcuguuucaucuccagugaaaaucuguuguuuaguguagucaccuucaucaaugaucuuaacuaagucuucuggauaacuuguugcaccuucugcaucagcacuugcugcuuuaccuugcauuuuuauguuauagagauggcuuauuuauugaaaccucaugaaccaaccucugcuagcuuccaucuuuucuucugcagcuuccucaccucucucaaccuucauagaauugaagggaguuagggccuuucucuggauuaggcuuuggcuuaagagaauguuguggcuguuuugaucuucuauccagaucacucaaacuuuucuccauaucaauaauaaggcuguuuugcuuucuugugguucauguguucacuggaguagcacuuuucauuuccuucaagaacuuuuccuuuucaaucauaacuuagcuaacuuuuuguugcaagaggccuagguuuuugucuguuguggcuuuugucauaccuuccucacuaagcuuaaucauuucuagcuuuugguugagagugagagaugugugacucuuccuuucaccugaacacuuagaggucauuguagggcuauuaaucgacauaauuucaauauucuuguuucucagagcauagggacaccuaaggugagagagagagagagagagagagagagagagagagagagagagagagaaacagccaguugguauagcagucagaaugcaaacagcauguauaaauuaaguucacccucuucuaugggugcaguuugugguacccuaaaacaauuacaguaauagcaucaaagaucacugaucacauaauaugugaucaccgaucauauaauuaaugacauaauuuuuaaaaguuugaaauacuacaagaauuaccaaaaugugauacagagacacaaagugagcacaugcuguuggaaaauugaggccaauagacuugcuucaugcaggguugccacaaacuuucacuuuguaaaaauugcaauauuugagaagcacaauaaagggaaacacaauaaaaugaaguaugccucucaucuauguagagauacacacacacacacacacacacacacacacacacacacacacacacacacaccccuacauauauuccucucauugcccccaaaauccaacugaccaagaagauagguguugcaaaaguacauuugcucucaaaguaagaauuugggaugugugugguguaugugcuugugugcacauaugcacccugggggaauggaaagaaaggagcacuugggagaagagaagggcauuaguggcacagggugacucggguugaaaggaggcauccacagcaggaaagcgcacugaaauguugguggccagagaggaaacuaaaagggagacaugggcaguggcagccauuuagaagcgaaggaugggcauaccuacgacaucauucuaguuuggucauuugguuuaaaauguggacacuaauguucuggcccaacucucucucucucuuuuuuuuuuuuuuuuuuuuugugugugugugagacaaggucuugcucuguugcccaggcugaagugcaguggcacgaucauagcucauugcaaccuccaccucccaggcucaagcaaugcucgcagcuuagccggccaaauagcugagacuacaggcgugugccaccacgcccagcuaauuuuuguauuuuuuguagagauggguuuugcuauguugcucaggcuggucucaaacuccuggacaaacacaaucugccugucucagccucccaaagugcuggaauuacaggcgugaaccaccauuguccacucccagcucucuuaugcugccucugcccuccuguggugcuuaagacccaugaguuauucuuucugguagccucuaguuucucacuccaggguauuagaaauugggcuauuuuaaaaaaaacccagaugaaguuauuuggggaauuugcugacagcacuuuuuaggcaauguuucagaaaacaugaugcaaauuuuaauuuuuuuaaacugauauuucaguggcuugauauauuuaauauugcaacuuuaguuuuaugaaucuugcaugaguucuguuguuuucuugucaucucauuauauuaguuuuugagcaaacauuugaaaaauuuuaaaaauguauaguauaagggaaggauuguaauucugagccacuacuuguuuaaaaaggcacuucauuuguuuggauuguaggaauauuguaauacaguccagcuagauucugggauagauuaccggaaaagggaacuuccugcugcaggaaaacucuacuaccuguaaguguuucuaauuuuuaaaguuuaaugucuaaucguuaaucagaaaaagaacauaaaaauaagcaguuuaauuauuggaacgugaaaggcugguucugaagcccaugauuuuuaaauugcaaauguucucauguuaacuucuucaacccgugucuuuaccauccauauuugcaucauuuauaaugugugauuggacaaaacccuaauuaguuuuuugggguggaaugaugacagaugguuagaauguaaugaguauccuuuuauaagagacucuauuauuacgagaauaucuuuaaugugugaaguaauuaauuauuuguggauaucaucugacaagugugccauuuccguuccccccaaaauuguuguuuuauuugucaaucuguuuguauuuaucauuguugauugacuuccauauauaacugaucuacaauauauauacacaaauacaacuggauauauuuuugucuuuuaaaagcuaagaugcuccugaguaggagcgauuuauaauaauagguguauucagcacgugcaguuaauacugaaaaacaaauauaguuuguuuuaaaauguccuuugugagaacgugaaaaggaaaaagugcuuuaaaaaagcaaacuuguuuaguauaugccaacaguguugggcacauagcaaauucucaguaaauagaucugucuaaggacuaauuguaauuuaacuaaaaggcauguuucugguaauuuaaauuuugaugacaacgugcauuugagagguugagaaaaguucuugucucugccaccuuguaagcagaaguacuuuacuguuuuugaagcagaaauuagcuagaaaaaucacauaauuaaaauugcauacuuuacaguguaccaaggggacuauuuuaguuuauuauucagauccugaugauuauuauaggagauucuucauuuguccucaaguacuuugucuuuaaaguacuuuauaauuuuaaaaaauucauagagcacauuuuucugcuuuaacuuggacuuuuucuucccaguuucuuuuauguuuguguuuacuggauauuuuauuuuucuaauauucacagccuuucccugauuuuuugcuaccugugucuugauauuccagauguaugguaccaaugcauuaauuaauuauuauucucuuuauucuuuuuuuaaaggagguaauucuuguucucuguuuuuuuucaaaaaguguauccucauguggaaaaauaaaaauauuuuccugauggggaguuccuuaaauaaagaugguagucugagucuaaauuauaaaauuuguuucauagugccaaagaggucuuggaaguuacuggaggugaaaaggcuacuuuugcuuggagcguagccauuuuuugucucugacuuacccuguguuaccccuuccuuuuccugauaaaaguaauagcauucuaacccagugaaguucaguuuugaucuuuaaaaauaugcuagaggaaaaccaacacuaacaauguccagaguccaggaaaccagaccuacaaaggacaccaggaaacucuggaccagcuuuccugagaaguauauaaauucaaaggccaggcacaauggcucaugccuauaauccaggcacuuugggaggcugagguuggaggaucacuugagcccaggaguuugaaaccagcugggcaacauagggagacccugucucuacaaaaaauuuaaaaaauagugggugugguggcaccugccuguagucccagcuacuugggaggcugagaugggaggaucgcuugagccuaggagguggaggcugcaguaagcugugaucauaccacuguacuucagccugggcgacagagcaagacccuguuucaaaaaaaaaaaguauauauauauauauauaaguguauacauauacacuuacauauauacacacauauauauacacagacauauagauauauauagauagauagaugucuaucuauuaucuaucuaucuaucuauucauuuaauccucaaggaagauaaauuuguuccugaauuuaacauccaaagggcuugaccauagucaagaauagaaagccugggggcaccccucagucagaggagaaggcagauauguaaguaucccugaagagaauuagcaauuaaaaucaucucagaagugggaaaauaauaugaguuacuaagacaggaugcuagagauguguauuauauuguuucacaugaggacuuggguagaacuucuuucaugaagauuuucugagguuauguuaacauuugauuuaauuagguuucuuuuuaucuuguucuuguagaaaaacuuuuuuuuuauuauuauacuuuaacuuuuaggguacaugugcacaaccugcagguuuguuacauauauauacaugugccauguuggugugcugcacccauuaacuccucauuuaacauuagguauaucuccuaaugcuaucccuucccccucuccccacccaacaacaggcccuggugugugauguuccccuuccuguguccauguguucucauuguucaauucccaccuaugagugagaauaugcaguguuugguuuuuuguccuugccauaguuugcugagaaugaugguuuccagcuucauccaugucccuacaaaggacaugaacucauccuuuuuuauggcugcauaguauuccaugguguacaugugccacauuuucuuaauccagucuaucauuguuggacauuuggguugguuccaagucuuuacuauugugaauagugccacaauaaacauacgugugcaugugucuuuauagcagcaugauuuauaauccuuuggguauauacccaguaaugggauggcuugaucaaaugguauuucuaguucuagaucccugaggagucgccacacugacuuccacaaugguugaacuaguuuacauucccaccaacaguguaaaagcauuccuauuucuccacauccucuccagcaccuguuguuuccugacuuuuuaaugaucgccauucuaacuggugugagaugguaucucauugugguuuugauuugcauuucucugauggccagugaugaugagcauuuuuucaugugucuguuggcugcauaaaugucuucuuuugagaagugucuguucauauccuucgcccacuuguugaugggguuguuuuuuuucuuguaaauuuguuugaguucauuguagauucuggguauuagcccuuugucagaugaguagauugcaaaaauuuucucccauucuauagguugucuauucacucugaugguaguuucuuuugcugugcagaagcgcuuuaguuuaauuagaucccauuugucaauuuuggcuuuuguugccauugcuuuugguauuuuagacaugaaguccuugcccaugccuauguccugaaugguauugccuagguuuucuucuagcguuuuuaugguuuuaggucuaacauuuaagucuuaaauccaucuugaauuaauuguuguauaagguguaaggaagggauccaguuucagcuuucuacauauggcuagccaguuuucccagaaccuuuuauuaaauagggaauccuuuccccauuucuuaagaucagauagucguagauaugcggcauuauuucugagggcucuguucuguuccacugguauuaaaaaaaaaaaaaaagaaaaacuuauuaacuuuacccuguaacagacuuuaaugugcuaugcuaaauauugcccuauuaaagcguguguuucuguuuauuaccaucuggccagacaucuguaaucgauuccugaauaugcaaguccagacuacccccuugucaguuucacuggagccccaacugccagaaaacaaacaagcaaacaaacaaaaacauaaaaaacaaaauuuuagcuuccuucuaggggaacaccaagcgcuaucucagaauuucauacaaguaaaaucccacauacgaucuuuaaugaaacagaaauauuaaucuucaucaacucaguauuuuauuagucugauuucccaacaccaauuaagaauauccaaaauacaauccaaauaauaucaagaauuaccacagauuucuaaaacuacccaaaaaguugacauggagcaauuucuguaguucauaauauugccugagucccacaagaacuaauucacauaagacauugcauguuuguauguaauauauaucacauuaaauuuaggaauccuagaguaccuucguaaguaaguuucagacguuuuuggcccuguaacaaccucauauacagcaaauucagagaauuuaaauuuagcaagcuacaaaacagagaccuugauugcaaauauccaaacuuuugcauagauuaaaacaccccaugcuuguccaguuuuuuauucuguacuaaaugcaugaucacuccagagaugagcacaguuuguuucuuuuuuuuuauuuucauuuuuuuuugugggggacacggagucuugcucugucacuggagggcuggagugcaguggcgugaucucggcucacugcaaccucugcuucccggguucaagcaauucuccugccucagcugaguagcugggauuacaggcacacgccaccacacccggcuaauuuuuguauuuuuaguggagacgggguuuugccagauuugcccggcuggucuugaacuccugaccuuaggugauccauccgccucagccucugcaagugcuggaauuacaggcguugagccaccacgcccggccaguuuguuucuuuucuaguugcuuggugaauagcacucaacaagguccccaugcugaaguccaaacagaucaaucaagcacugggcuuccauuugcaucuggauggagacuuggacaguaaucuauuuugaauugucugguacugaucaagggugaccccaucucaugcuuacagagaauuuaacugcuucagauuagcucucuguuugggggcugguaauacuagagguuauuauuuuauauaugcauaucuuuuuaaacaggaagcaccauugcugaaggauccaugauaugcuuccccaggccauuuugcuaucccuauugugaagcguuacugguuuccuggggagaggaguucacaucacccuggacucacacuugcugucucuuuuuuauuccaaggcugaguccuauagguucuuuucucuacuaagucuguugaagggaggguucuauucaaacaccauaucuuuccauacucacauacaaacacugugcccuccacacagaugccguaaccucaagagaaguuuuaaacugaaccaaaagggaugggggcaggcauugguccugggauuuuauuuuaccccacuuacgagccuaaaccuaaaauagguuugccuuuuauuauuucauaagugcugacagaagacaacagagaccugggucagagacacaggaucuuauuagccuuggcacagauagcaguaugagcauuagcauguugugucaguucccuccuugcuccuuagucccauggaguggaggggaggguguuuugcugagggccuagauaauuccugcaacaggcagugaauuguguuacaggaaaauagcucugagcuugugaaaucugccauuuuauagccagacauaagcaagucugcuuuuugucucgagggagacauugucucaucuuucaagguugcucacuacacacacaaccuugagaaaugguuagggccucgcauucuuggcauacucagcaagaugugauggagagacccauggaggggcuugucucucccaacagggggcauuuaccggacauuagaccuuaaagaaccgggcuuccucccuuuguuucaguuggcuucuguccacugaagucauccaccacuucaacaaaacuacaucugaagcacauuguucaguugcuuaaaacuuaaauugucucaagaccauuucaauauggggauuuuggaucauccugaaaauggugaaaaaucuaauuuauggauuuuuagauacagcccaaauauucacauauuugugcuuggcuaauauaauguauuuacccaucuuuugaacagauuucaaaaaaaaaguuuuuucuuaaauacuuuuacuaguggaaguuuuaugucucaagcacucuugguuuuccacuugggaaauaucuauuccaaauagaaaaucauuuuggagaauauaacuuugaacaccauuuuuuaaaagaauaacaauuagcugacaaaaagacacacagcuucaagguuauagcucuguuucagaagaaaggucugugaaaacuaagacugaagcuucuauguguuaaaacauacuuccccauaauuaaaaacuucauguuucuugccugugauauuacuuacaaacacuccucugcucucaacugugagaaucagauuaaugaaacuuaaaaacauuucuuagagugaucaucacaucuucccauaccuaaacuuuggcugagacccagcuucugccucuaagguugccaccuucugguuuaauggagugucuaggacagcuugguaccuucucuccaucacccaucauuaccauuacaauucugucccagacacuggaaucugcaguuucagucucaguuuuucuuaccaguuagacagcuagcccagucauuuccuguuucaauucccacugaagaaccucugaaacauucaccagugcaagcaacuugaaaaugcuuaaguccggcccccuuccuuuuaggccgucauuuguuucaauacguugugcuagacugcccagaguccuguagcaggcaguaugcacaccccauugaaauauuuauuucauccucuacaacaaaauuuuuauggucuuaugccaaauaugagcuggcucuacuccuccuccaguuccuuaaauucucucaugugucuuuuagacuccauuauauuccuaucauuucuacuucucacacuaguuugcauggugucacaauggaauagugaugguaucaguggaaaaauaccacacaguuuaagacuauaaaauuuauuuagcagucaagguugcagaaauguauccacauggagacacuugcacaaaacagaagauaauagagcauauucccagaugaagcuguaaguuuuuuuggccuuugagggcccauuaggugacaaagauagcaccugaucaagauaaggaucccauuagaucaccuuugucauucuuaggugaguggguuuauacccuccugguaagucuugauugcuguggagacucuggcuauaugccugccugcuugccagguacaauuaccaggugcaaacccuaagccaugacugaauguuuauugucaguguaaaucaaaggucaguuucccauccuucagcagcaccagucacugggccuuccugaagucuguucuuuuuuauuauuauuauugagacagaaucucacucuguugcccagacuggaaugcaguggugagaucucagcucacugcaaccuccgccucccagguucgagcaauucucgugccucagccuaccgaguagcugggauuacaggcgcaugccaccacgcccagcuaauuuuuguauuuuuaguagagcugggguuucaccauguuggccaggcugguuucaagcaguccgccugccucggccucccaaagugcugggauuacaggagugagccaccgugccugacccugaagucuguuccucagagaacaagagauagaauuucugucucuggcaaucaaagaaacugucuacuuucuugagguucugacuguugucuggcuaauuccucagucuggggaagggaugaagauauuugggauauuucugauguuuacagauuauguuuuacuucuucuuagcaucauggcacagaagaacauuuagguuuuucuacauaagaaauaaucagaaaugaaaauauuuacagaugaaauaauacaaugucuaggauuugcuucaaaauaauccaguguaggagaauugaggggagguauagaggaaacaagauugaccaugccauguauugagugggugauuuuacauugggguuuuaauagaacuauucucuucacauguguuuauguguaaaauuuuucauaaucaaaagauuuuuaaaaagauagccuucucuguuuuuuucugaucaugcuuacugcaguuuuaagucuauugaucuucccaacgaaacugcuuuuguuguguugauuuucucuauuauuacuuucuguuuucuauauccuuaauuucugaacuuucauuauuuccuuucuucugcuuaguuuggauuuaauuugcucuuccuuuucuaguuuuuuaagguagaagauuaaguccuugauuuuaaaccuuucugcucucauauaagcacuuucaaacuaaacuuuagcugcaucucacauguuuuauuaugucauguuuucucuccugauuuauuuuuuggcccauggguuauuaaaaguguguuauuuacuuucugaacguuuggugauuuuuuuauacaucuuucuguuaaugauucccagauuuaacuaauuaugguuacagaaucuauguuguaugauuugaauccuuuugaauuuauugaggcuugcuuuauggcccagaauaugaugcaucuuggaacaaguuucucaugcacuugauuauguauucugcuauuguuaguaguguguacuuuaaaggccauugggucaaguugguugacaggguuguucaagucuccuauauucuuacugauuuuuugucuucuuuuucuauuaaguauugagaaagaggugcugaaauuuccaaguauaauuauggauuuuucuauuuccucuuacaguucugucugguuuugcuucauguauuuugaagcucuguuauuagguauauaaauguuuaggauugauauguucucuugaugaauugaccucuucauaaguaugaaaugaaccucauuauuccugguaauauuccuucuacuaugcuuaauauuaauguagccacuucagcuuuuuuaaaauuaguguuugcaugauaugucuuuucucaucuuuuuuacuuucagccuaucugugucuuuauauuaaaauggguuucuuguuggcaacauauauuuggguauuuauuuuuuaugcaaucugacaaucuuuuucuuuuaauuggggauauuuaaaccauuuacacuugaugugauuguugauauggcuggguuuaaauauacuaucuugcuacuuguuuuuuuuguauuuuuuagaaaaaaauuauugagauacaauucacucuuuuaaagucuauaacucagugguuuguuaguauauuuagaguuguacuaccaucaccacuaucuaauuucagaacacuuuuaucaccccagaaagaaacccauaaccguuagcagucauaccucucaccccucuacccucugccaaucuaccuucucuauggaauuugccuauuuuauacaucucauauaaauggaaucacauaagauguaauauaaucaugcaccgcauaguaauauuuuagccaaugauggaccauagcauagauaugaugguggucacauaagauuauaauacuguauuuuuauuguaucuuuucuauguuuagauacacaaauacuugccauuauauuacaguugcuuacaauauucaguacaguaaaaugcuguauagguuuauagcccaggagcauuaggcuauaccguacaccacaagugcguagcaggcuaugccaucuagguuugugucaguauacucuuaucaugucuguaugaugacaaaaucaccuaacaacacucuuaaaacauaucaccauuguuaaguaaugugccacuguauauacgaugcauauuacuucucagucuuuuguuuaagaucaaguguguuaucuguuguuaccaguuuaauacuauaagauguggucuuuguuccuggcuucuuucacuuagcauaauguuuucaaaguuaauccauguuguuugcuuuuuguuuucuauugucccaucuguucuuuuuuccaauuucccccuuuuucugacuucauauuaguuauuuuuuuaagauucccuuuuacuucuuauuagcuauaccuccuugauuuuuuucuuuuaauagucacuuuagggcauagcguaagcaccuuuaacuuaucauagcuugccuucaaguaagaguacaacacuugauguauaacauaaaaaccuauaguauacuuccauuuuuacuaucccgggcuuugugcuuuuauugucuuuuuuguuauuuuauuauguaauuguguauuuuauuauauaauauuauuauaugcaguacuuuauuaucuuuuuagguuauaaacuccauaauacauugucauuacuuuugcuuaaacagucaauaauccuuuaaagagauuuuuaaaauaagaaaaagucuuuuaauuuaccuacauauuuacuauuucuuguauucuucauucuguuauauagauugaaauuucccccgauauaauuucucuuuuuccuaaaggacacgguuuaacauuucuuauaguaguggucugcuggugaugaauuuucucauauuaaaguuuuuguuuugcuuuuauuuuugaaagauuuuugcuggcuagagaauucuaggcugauaggcuggcuggcuuuccuuucuuccuucccccuuuucuuccuuccuuccucucucuuucuuccuuccuucacuuuuucucuauaguacuuuggcgauguugcuuucuucucuucuggcuugcauuguuucucaugaaaagucuacuggcauucuuuguccuucucugcauaaggauauaagucuuaucacuggcugcuucuacaauuuuauuuuuaucuugguuuuaaacaguuuuauuaugaugugcauuggugugguuuucagcauguuucuuuugccuggauuugguugugcuucuuggauguguggguuuauaguuuucaauuaguuuggagaauuuucucuuauuucuuuacaauuucuccccaucccuuccccuccucuucaauuucugggacuccaguuacacuuauauuagaccucuuuauauuaucccacagcucacugaugcucuguucacuuuuuucauucuuuuuuucuuccuguguuuguguuucauuuuggguaguuucuuuugcagugucuaaucuguuauuaauuauaauccaguguauuuguccauguuagagguggcauuuuuccuuuuuaaaagcuaaacuuggguuucuuucccuuuucuuuucuuuuuuaaaaggcaaagucuugcuauguugcccaggcuggucuugaacuccuggacucaagagauucuccccccuuagccucucaguaguugggacuauagacacacaccaccaugcugcggggguuucuuuuuuauaucuucuuuguucuuauacucaugccuuccucuaccuuauugaguauaugcagcauauuuauaauugcaguuuuaaugucuuugucuacuaauacuaucaucuaugucauuucugggucuguuucuauugauaaguuuuuguccuuuuuaugagcugauuuuccugccuuucaugcuuuuuuuuuauuguguuucagauacugugaauuuuauauugucggguacuggaguuuuuuguauuccuuuaaguacuuugagacuuuguucugggacacaguuaaguuacuuggaaacaauuuuauccucuugaggcuaggcuuuguaaagcagaaccagagugccuuuauucuagggcuaauuauuccugaagcaauacccuucugagaauuccaccugauacccuaugcuuuaguaggacuuuccucugacuagagggaacaugaacuauuccuggccauguaugagcuccagggguaaugcuuugugauuccaguggguccucucccaccugcccguuucaaguaguugcuuaugcauacacaguuuaguacucaacuaaagacucagggaagcccucugcagaucacuggacuucugucucuauaucuuuuuuuccaguauuauaccuugcaaauucuagcugugcuagccuccccaaaugcugaauucuauuuucucagccuccuaaaugcugaguguauuugugucccuauuccugaagucuggaaacucacuaggcaguaaauugaggcugaacugauuuguuucccuuucccuggggaucgcuguacugugcuuuuuguuauccagugucugcaaaccauuguuucauauauuuuagauuguuucgguuguuuaaggcagauagguaacucugggcccucuuauucccaucauggccagaaguggaagugucuagaccauuauucugaaaaauugguaaauaaaaggaaagaaucaaguauuuuuuccugccuguuuuaaaauaacugauccauaguauaacauaauaguugaugaggggaagcuucucuuuauaaaaguuuucuagguagcaauugaaaaaauguugagagaauuauaauagaauuagaauaucaccauuuuguaaaacacucauaauuuaauggaucuaguuaaugaucacaaauucuauaauaauugcuacaaaaugaaaccugaauuuuauccauuuacaggaaauauaggggcaauggaauauguucaauaacaucacaggaauacauccaucaaaauguagacuguagauuuuuuaaaugacauaaaucaauugcuucuucaacaaauaaauaagaaagagagagauggauagggaaccuuuaguuuaaaggagacguagaaacauaucaacaaauuacagugcaugggccuuauguggauccugaaucacacaaacuauaagaaugaaaacaaagacaaaacaaaaaaaaagcuacagcgcaauaaaaaaugcaaauacuacaggauguuucaugacauugaggaauuauuguuaacuuuguuaggugugauaggguauuauacuuauuuuuaaaauuuauuuuuauggcuuuaucaagaugcaauuuuaaaugacauaaaucaauugcuucuucaauaaauaaauaagaaaaagagagagagauggauagggaaccuuuaguuuaaaggagacguagauaauaaagauuaguagaaauuaaugaaauagagaauagaaaaacaucaggaaccuauuuguaucucugaaucuaaaaccugucuccuauagacagcauguaguugggucuuuuuuuauccagugugacaaucucugcuuuuugauuaaauuguuuaauucauuugcaaauuauguuauuauagauggaauuaaauuuacauuugcuuuuuacuuuuuguuuucuuuauguuucuuguucauuuccccucaucuguucuuccuuuacugcuuucucuuacauuaaguguuuucuguuuuuugauuuuuugagacaaggucucacuauguugccaaggcuagucucaaacuccugggcucaagaaguccuggccaggcgugguggcucacgccuguaaucccagcacuuugggaggccgaggcgggaggaucaugaggucaggagauugagaccauccuggcuaacacggugaaacccugucucuacuaaaaauacaaaaaauuagcugggcaugguggcgggugcuuguagucccagcuacucaagaggaugaggcaggagaauugcgugaaccuggaaggcggagcuugcagugagcugagauggcgccacugcacuccagccugggcgacagagcgagacuccgucucaacaaugacaacaacaacaacaacaaugacaacaacaaaaagaaguccuccugucucagccucucauguagcuggggcuaaaucugacuucuuaguaacauuuuaauuuuuugaauaauuuuuuucauuguauuuuuguuacuuucuuagugaagaacuauuuauuucuaugagaaauacaaaguauucaaacugagaugucucagauucaaaucaaagcauuguguguugccauauguuuuugauaaguagcugaucaguaaugguaaugaaucugugcucaaagaacaccugggagggggaagggcucugugguggggaaauauaguugguucucaaaaguagaugcacgguaguaucuuugucauaagaacuccuguugauauuuuaugaaugaguaaagcccuguuguacacuuauaacuguauauuauaaacaacuacaaaacaacaacuuuuuguuuuguauuuuauaggacaugauccaguaggcuguuucuucuuguuuguuuguuuuugagaccaggucuggcucaguaguagcccaggcuggagugcaguggugccaucucagcucacugcagccucguccuagacucaagccauuuucccgccucagccuauugaguagcugggacuacaggcacgugccacuaugccuggcuaauuuuuguauuuauuuugguagagauugguuuuuacuguguugcccaggcuggucucaaauucuuggccucaagcaauccaccugccuuagccucccaaauugcugggauuacaggcaugagccacugugcccagcccaaguagacuguuuuaaaaaauuguuuuaugucuauugaaaaucacaaaaggcuggcagugcacgguggcucacacauguaaucccagcacuuugggaggccgaggugggcggaucacgagggcaggagaucaagaccauccuggcuaacacguugaaacccugucucuacuaaaaguacagaaaaauuagccagaugugguggcaggagccuguagucccagcuacucgggagggugaggcaggagaauggcgugaaccugggagguggagcuugcagugagccgagauuguaccacugcacucuagccugggcgacagagcaagacuccgucucaaaaaaagaaaaaaaaaucacaaaaggcugggugcaguggcucaugccuauaauuccagcacuuugagaggcugagauggguggauugcuugagcccaggaauuugagaccaaccugggcaacauguagagaccucaugucuacaaagguuaaaaaaaagcuaacugggcuugguguugugugccuguggucccagcugcuugagaggcugagaugggagaaucgcuugaacccaggaggucgaggauguugugagccaugauugugccacugcacuccagccugggugacagagugagaccuugucucaaaaaacaaacaaaaaaaaacacucccgaaucacaaaauuguacauuugguauaauuuagauguccuucuaaaucuuuauuaauuaaucuugcauuaacucaaaaacuacugaacuagaaauuaauuucacuauuugaaacagcaccuauaaagugguacagcaacaaaagaaguccaucuaauauagacuucaguaccagguuccaccagucaguuuaguaugccuuuuaucuccuauuccuuuauugaauaguguuuguuuuccagcaggagaaccagaauagagcuggcccacuaaauccagcuaaacacauggacaaaauauccaauuguauggccacagucaucuaguagaguguaaauaauaauuguguauauauauaauguguauauuaguagauaauauguauucuuacacguauaaaaauacggaagaggguauuuagauuuccuuagaauuuucauugcauuauuucaucuccaaauagaucacaguuauaacugaagaucaaucugcugcauaagaaaagcugaucuggcaaaaacccuaggucuuuaguuauuugcuguguucauuuuuagcuauuaaaacucccuggccucagccgggugcagugacucacgccuguaauccagcacugugggaggcugagacuggguggaucaauugaggucaggaguucaagauagcuuggccaacauggugaaaccccaucucuacuaaaaauacgaaaauuagccagguaugguggugcaugccuguaaucucagcuacucaggaggcugaggcaggagaauugccugaaccugcaaggcagagguuacagugaacugagaucacgccacugcacuccagccugggugacagagugagacucugucaaaaaaaaaaaaaaaaaaaaaaaaaaucccuggccucuggccucucuuucccaaguggaugugaccaucuuuuucuccugaagagagguuagagcuuuuuacucuccaacuucuucucccuccuuuuuuuuuuuuuuugaaaucuucaaucauuauauccuuucugaaauuccauuuuaaaaagaaguauuuuuauaucuaccaaguugcaauucuagaugucaugguacugauuuauuuggggaaaaauacaauauauagauuugauagaaauuuuauaugggaguuuguggcugagaagaggaggugaaggucuggaauuugagagcuaagggugcuagauaccacuuucugcauaauguacaggucaagauuaauggaaccagguaaguuacucuccaggugauugagaagggugggaaauuuagagacugaaauggaucucugaacagucaguuaagccuuugagugauugagaagauaaauacucagacaaaauccauucuaacaacugauuucguuauguaaaacaaaccuacaggauuugaaaugcaaccaagucuguuuuauauuaaggcaaguauaaaccaacuuaauuuuagaccugccuccagccccagauuauguuugguauaaggacaaagagcuguacagcaugaaugcgcaggcaaucaguagagugagaaggcucacugccagggaaguuuggcaaagaacucuaagaggaaggggaaauuucugcgucgaaucaacuuuggcucucuggaauagagaacauggagagagagggacuaaggaaagccaacccuauucuacuuguugauaccuuaacaagcuguugauuuuugaaaagggauaaagaagcaaaguguggguagcauucuguucccuugagucaauccuaaugaaguaggagguucuugaagaaauuaauuuccauuuaaauucaugcgugacccucuuccagaaacccccaaguguuuuggaauuuuuguugagaauuucaaaugauccagcaauaauaaggucuuuuuugacauguucuguuucuuugagagucuaaguuuuauguugaaugccugauuuuagcuguagaaauuuucucaaaauggaaaugacuugauuacuuuccucucuguucacuaauuuaauauggaaaaauaaaucaugauucucauacucgcaaagcacucaggcuuuucauccaggguacuguacucacaggauuccuguaggagucgaugccaaauuuccuggcaacugaacaguggucgauuccaggguuuuucugacuuaaagacacagugguacuacucaauagaaaauagaaaccugccccuccgcugcaguuucugaguuuaacaaaaggugacagaagcaaugaaauggauggguuuuaucagggcauugcacaacaaaagaaaaaagagcccaucuucuguugagcuuugcuccucaacccuaccucccaacccccuccccucaaaaaacaaaaaacaaacaaaaaaaacacuugaaaagagugacucugcuucuucaucagauaugacuucaguuucuuuacugugaucaacguuugauuaucaguggguagacuuucuuguuugcauugucugcacaaaggccuacuuuauaguagcaucccacugauggggcaauuacucagaauggagcuguuucacaggaaugaaaggaagucacuuaaauucuuuauccuuacucagugucugucucuccuuaggagaaggaagaggagaugauuuauagcaacugaacuuaauuuauuuauuuccaccugaucauuuuuaugcuacccaggucacuauuagucaagauacucuucuuugugguuaaaauggaauuauacaaagcugaacgggauauuuucuucuaugcuaugugacauuauauucuuguggccccaaaagaaaacucuaaauuuagcuccuuauuuacacugaaaaagaaaaucauguuaaauuuagugccgucuucaugcuguggucuuuccauacaacuacuguugacuaccagaugucucuacuuccucaaauuuuacugguuaggcuggaauaucuuucaauuauguuuacaguuugaguuuaauuuuaaucacuguuuguauuuuuauauaaucuauauccuugcauauuuuuuguacauuuguuuuucauauaggcuuguugcugaccuuaggucuuaugucccaaauaccagauuuuuaaaaaugagauaauccugguccuucuuuagagccucacaagcauggauauauuucugaauagagauuuuuaguguaaggcaauguuacuaucuuuuuaaaugguuucacuacagaacuaacaagagggcccuagagucauagagucacugcugcugcugcugcugcugcugcuaaaguuuuuacaauaaaguuguguucuuaaauuuuccuacuuuaaaaagugaagauaucuugaagcacggguuuuaaaauuuuauguguaucaugacaauugagaaaauguuucuagauuaacuauuuuguuuauuuuuaauuuuuaauuaguucuuuuaauuuaauuuaacuuuuuuaaagaguuauguuuaacacuuuaaaacauagugacacuuuuuuaaagugucacuauguugcccaggcuggccucaaacuccugggcucaagugauccucuugacucagccucccuaguagcugagacuauaggcaugagucacuacacuauggauuaagucuuuuguuaaauuaaauuacauuuguguuuuuaugcccaauccuuguuaaaaaauaaacuugaggcaacuuauauugaagucauuuauaauuuauccaccauaaucacuaaaauggaagagauggaaaaugccaaguauuggcaaggauguggagaaaauggaacucuuuuuuguaucacuggugggaguauaaauugcuacaaccaauuggaaaacuggcaacaucuccuacacugaacauagguauaccccauaugcagcaauucuagccauaugcccaacagauauguauauaugaguuuaccaaaaggaauguacuagaauguucaugguagcacuauucacaguauccccaaaaugugaacuacacaaaugcucauuguuguggacugaauugugucccccaaaauucacagguugaagcccuuaccccaguggaacuauauuuggagauagggccuuuaaggagguaccuaagauuaacugaagucauaaggauagggccuuaauccaauaggacugguguucucauaagaaaaggcagagaccccaggagugcgugcacacagaggaaagaaaggccacaugaggacauagugaaggcggccgucugcaagccagaaagagagcccucaccaaaaaucgauccuggcagcaccuugaucuuggccucuagccuccagaacugugugagaaaaaaaaauuauauauauauauuuuuuaaaauauauuuguuaaaauauauauauuuuaaaaaauauauauauuuuaaacuauauauauauauguuguuuaagccacccagucugugguauuuuguuaugggagcccuagcagacaaaugcacccaucaccgguaaaaugauaauaaauugugauauuuuuaugcaauacaauacagugacaaaaauaaacaaacuacuucuacacacaucaauauagaugaaucucacaaacauaauauugagugagagaagucacauacaugugaauaagggaaaugagcuuauaugaagcaauauguacuuaugcccagcuugaaauugauuuaggaugcacucuuagagauuugaccaaugucagugcaaaaucaaagaauuuuccugugucuggaauauuugucaaccagcaaagaucaggacugucaggguaauuaaugcauuguguuucagaaguuuuuaauuuuaaaaauaauaacuuuuacauauuaaauauuugagguacuuacuuuuuuuuuuuuuuugagguggaguuucgcucuuauugccaaagcugcagugcaauggcacgaucuuggcucacugcaacuuccugcuuuccggguucaaaugauucugccucagccugccaaguagcugggauuacaggcccccgccaccacaccuggcuaguuuuuuaauauuuuuaguagagauggaguuucgccauauuagcuaggcuggucucaaacuccugaccucaggugauccacccaccucagccucccaaagugcugggauuacaggugugagccacuggguacuuacauuuuaaaguaauuuuuacuuagcauuuauuuuguguuaauggucuuauguuuuccacuuuacaugucuguaucagguagagaucacuuuuacauauuauugcaacauauaaucuugucacaguacauugauuuauaauagugauaagccaugcauuuauuauuauacuguuauuuuacagaaaacuacugaauauaacccuaugguagagaaaugauucacuauuauuaugggcaugcauuauuguuugaaaacacauaaaauguaauaaauacagaauaacuuaugguuucaggauauuuuuuaagauuaguaucuauugggaauuugggaacauguuuucugggauuccccaacuugcagcuuuccucugguuauucaugucagaagacugcagguuuucuacuggaguuuuaguugaccugagcaguacugacugcacugucuucagucugaaagcuguaagacuggauaacuaaccccauauuuaucccuucucccaagugucagcaccccaccagaaucuguucacuucuguccacugucccaugccuucagaugccuguuuuuauauuuuuccagaguuuacauauaguuguuaucaacagggaggguugguugaagcagagccaacuugguccuauuagaagcagaacucuucuccuuguucuaaauagaacacacccuugaguaucauccugagaaggguacaugggaaauauauauuuugaaaacucacauguccuaaaaauguauuuguuuuacuugauuaauaguuugaaugaucacgguuaucacacaauaauauucucuuagaauauuuuagacacuauaccauuaucuucaagcuuccauuauugcuguuacaaaguuggaugugaaucuguuucuugacuuuuuauauuugaccuguuuuuuccucuugaaguuuuuagaguagucucuuuguuccugguuuccugaaauugcauaaggauaugccuuggaauggagcuuuuuuccauucuuugugcuggguauucauugaacccugucagcuuuagaaagucauguccugcaguucuaggaaagucaauuuuauucucauucuuuucuucuccccaccccuccaccccaccucauauucuccggaacuccuccugaacuuugugaauugaacugaaucuugugaauugaucuucuaauguucuuuuguuuucucuucuauuuuccuuuuuuuuuuuuuuggucuuuuuguucuauuuucugauaugaccucaacuuuuuccuucaauccuuuuccugcauuuuggaucuagcaguccuauuuagagcucuuccuuaugccuuuguuguucuuuugguuugcagcauucuucuuugucuugugggugcaauaucuuauucucuccaagcauauuauaguguguucuucccuuucugcucucuuauuuuuuucuuugcuuccuccaggguccuuuuaaaaaugucuuuauuuugggucuuugucuuuuaccuuuggaaauacuugguuguccauucacauguaagaauaaggcauuaaaaagcuaaucagaaguucugagugcauaagcagaguuuuauugauuggugggcuucacuggagggugauaagguggcuggucauguuuuucacuggagaucuccaaaugugaauaucuguaagucuuucuuuuggcuauucaguuuccuccaaagguaaaucuuucugucuaauuccugggauagaaguuuugcugguaggguucuggaugcugaaaagguacagauuguuaguuacacuauuuaauauguaggauuuuauacaacucaagggacauuaaaaaaaaagaaaagaaaauuuuaauguaggcuuucaguaugguaucucucccuuuuucuucauuguuaaaucuaccccagcugcuaaacuuacuguuguggguaaugacugucuggcugguugugugagugauaagaagacaguuguggguaaagaaagacaaauguauuagagaaaguaugaaaauacguuguaagggugcaacaggcaggucagcaagaaagaagguggcugcaaggagacagaggcuugcuggggauuuuauaggcugguacuugugcugugugcugaagagggcuuugugcagugauaaugccaagguugcagugaacuaacuugcauuuuucuaucaacugaguggcuggugauagcugggcauaggaggauuuugaguuauuugcacaggaggaguauguguccuggaccaucaagaaaggcagacuuaucugcuuucucuuuuugcuuuccucugguccugccagccugacuuuuuucccuuaauuagaauuccagacuugccaguuucugcuggaguggaggagggcaggaaucuggcuauccaaguggaaggagagaaucuaaggaacugucuuuaucuuauuuucaaacaaauacccguuugcagccuaacuccucaccuguacauucagcuguaucugcuagugccaagccuuuggagaguucuuuggugagaacuggucugcuucauuuuggcucuguauuccaccucucaccuucugauuucccaucaauuaagguucugcucauccaaguaaggagagcaaugccagucauuccuucuucuaggcucccuaauguuuccaagucauucucuuagagaacacuucccucaucacuugccuuuggggaggauaagucgucauccucuucuuucccaaggggaaggcagggaaaggcucuuaucacacauacuauacccaaaagcuagugacuguuguuccauuucccccuccuuauaaagacacuguguugugggguauaacaggagaugguggaggagggguggcaauagaaguggcacugcuuauauaaccaugagggcuuauauagaccuaguggcuguuggcacuagguggcucauuggcaguucuguuuagaaaguagggggauacuuaacacucuaaccaucaacuuugugccuuaauuguaauucuaggacaagagggaaauauuacacuuacagaacugcuuacucuuccauuguauaaguguauccaaauguacuuaaccaaauuccccauugugggacauuucuuuuucacuuuugugaugcuaggaacaguauuacagugaucacccuuguaguaguuaaccauuauuauguccauagguaaaauuccuaugaguuucauauuucauaaaaacauacacauuuuuaguacuuucauuaaauauuaucuguuugccugaaaucugguacuauuuuuguacuccucccagcuguacauaagaguguuguuugagauaacugaacaggaggagaucgacaggaacaugaacaagaacucauucacauguuaggaggguggcacagcccagcuccaaggggacagauacuccugugcuaaggacccuugcagagcucauuguauguaucucuucauuuggcuguguauuuauuuucuuuaagauauccuuuguaauaaacuauuaaacaagaaucuuggucgaccagcaucuuggucgaccaugaggagggagaaaugugagggcaugcugacagaaucguuucaacucuucucaauugaucaucuuccuaaaaggugacuaaguggaauguagugaaugugagugaaucuuucuugagggugagauuugaaaccucuggaaauaauuaaugagaacauaaaauucucaaccuucauaacuaugacgaaggcagagacaccguauaagacugaacuaaauaccacuggccccaggacuggaccugaucauuuuucuuggacuaaaccucugaugcaaauauguuuuuaucaauacucuuggaucucccaucacuccuaagauaguauugggccauagaaaugaaauucagaauguuucauuuaaauugauguucuaucguguucuucuucuuuuuuuuuuuuuuuuuuuuuugacacuguugcccaggcuggagugcaguggcaugaucuugacucacuacaaccucccccucccagguucaagugauucuccugccucagccuuccgaguagcugggauuacaggucccgccaccaugcccuguuaaguuuugguauuuuuaguagagaugggguuucacuauguuggccagguuggucuugaacuccugaccucuugauccgcccgccucggccucccaaauccaucguguucuuauuaaaaauuugaaaacaugcugccuccuauuuacaccagaggauacuucgacaagaaauauaauuaugggaccauguuuucaucuugccuucuugcuucauuccgaaacuugcuuacucuucucuuuucauauucccaaguuccucuggagucauuauacagaacagagcauacugggaaagcauuauguuaaaaaguaucuaaggacgcaguguccauugauggauaaauggauaaauuguggucuauauacacaauggaauauuauucaaccuuaaaaaaggagauccugcaauuugcaacaacauggauaaaacuggaggacauuauauuaaguaaaauaagcuagauacagacagaaagauacuacaagaucucacuuggauaugggaucuucuaaaaaagucaaauacuuagaaacagagaaaucaaauaaguagaaauagaauagagcagucauuaccagggauggggguugagugaggagaaggggaagggaugaggagagguaggucaaaagauagcaaguugcaauuacaaaggaugacuaagucuaaagaucaaauauacagcaugaggacuauaguugaaaauaguguauuguauacuggaaauuugcuaaaagaauagauuuuaggugcucuuaccgcccccaaccccucacacacaaaagguaacugagaugauggauaugucaauuugauuggcuguagugauaauuucacuauauauaucaaaacaucauguaguacaccuuaauauauacaacaaaaaaguuuaaaauauuuuuuuaaacgaauguccauuugcuuaggauaguuuaucuuuuuccuucucucugccaauuuggauagaagaauggcaucuuauuauuuuacuuugcauuuguuauuacuuguuaaaaacagaaugauuuuacauaugcugcuuguucaccgagcuaucuuuuuuuuuuuuuuuugagauggaaucucgcuccgucgcccaggcuggagggcaguggcacaaucucucucccucccucccuuccuuccuuccucccucccuccuuucuuuuucuuuucuuuucuuuucuuuuuuuuuuugagucauggucucccucuguagcccaggcuggaguccaguggcaugaucuugggucacugcauccuccaccucccagguucaaggauucucaugccucagccuccugaguagcugggaucacaggcacgcaccaccaugccggcuaauuuuuguauuuuuuguagagauaaaguuuugcuguguuggccaggcuggucuccaacuccuggccucaaguaaucugaccaccucggcuucccaaagugccaggauucuaggcaugcgucccacgccuggauuacaccaauaaaauuuuuuauuuugcauuuuguaacuucugagugauuauaauagaauucuuauaagacacuguuauaacaaaaauaauuuugugauauuucacauguaauuucacuauauagaaaaucaaguauuguaauuucacaggugacuuaggagaggugaccugauugaaguuuagugagucacauuuugauaauauaguauauacgagaccauagaguaauaaagaaaucaccacugaggaagauugcaaggaauuauuuauucaccaaauaugcuuuuggaggccugucuucuuucuugguuguuuuucagaauucaguuuuacuccuauguugaguaaugugccuguccuaaggaaagauuaacuuucuaaaugacagcagaccauacugagugggugguguugcucucuuuucgcuauguuccuuaaaaagcagcucacuuuuuuaaaauuuuuuuuauuuuuugagacagaguuuugcucuuguugcccaagcuggagugcaauggcacaaucuuggcucacugcaaccugcgccucccggguucaagcgauucuccugccucagccuuccgaguagcugggauugcaggcgcaugccaccacacccagcuaauuuuuuguauuuuuaguagagacgggguuucaccauguuagccaggcuggucucgaacuccugaccucagaugauucgcccaccucagccuuccaaagugccaggauuacaggcgugagccacuaugcccggccagcucacuuuuuaaaaauauauauuuuauuuuaaguuuggggauacauguguaggaugugcagauuuguuacauagguaaaugugugccauguuguuugcugcaccgaucaacccaucaccuagauauuaagccccacaugcauuagcuauuuauccugaugcucuuccucccucuccccccggcuccugacaggcucugguguguguuguuccccuccauguguccauguguucucauuguucagcuuccacuuuagaagcgagaacauguaguguuugguuuucuguuccuguguuaguuugcugaggauaauggcuuccagcuccauccaugugccugcaaaggacgugaucugcuuccuuuucuggcugcagaguauuccauauagucuauguguacacauuuucuuuauccaguccaucauugauaggcauugggguugauucccugucuuugcuguugugaauagugcugcaacaaauauaugugugcauuuaucuuuauaauagaaugauuuauauuccuuuggguauauauccacuaaugggauugcugggucaaaugguauuucugguucuagauccuugaggaaucaccauacugucuuccacaaugguugagcuaauuuacauucccaccaacaauguaaaagcauucuuauuucuccacagccuuaccagcaucuguuguuucuugacuuuuuaauaaucgccauucuaacugguaugagauguuaucucauugugguuuugauuugcauuucccuaaugaccagugguguugagccuucuuucauaugucuguuggccgcaugaaugucuucuuucaagaagugucuguucauguccuuugcucacuuuuugaugggguuguuuguuuucuuuuuucuuguaaauuuguuuaaguuccuuguagauucuggauauuaaaccuuugucagauggguagauuacaaaacuuucuccuauucuguagguuguuucuucgcucugaugauaguuucuuuugcugugcagaagcucuuuaguuuaauuagaucccauuugucaauuuuugccuucauugcaauugcuuuuggugauuucaucauaaaaucuuugcccaugccuauguccugaaugauauugccuagauuuucuucuaggguuuuuaugguuuuggguuuuacauuuaagccuuuaauccaucuugaguuaauuuuuauauaaggcauaaggaagggguccaguuuugguuuucugcauauggcuagccaguuuucccagcaccauuuauuaaacaggaaauccuuuccccauugcuuguuuuugucagguuucuuaaagaucagaugguuguagauguguggucuuauuucugagaucucuguucuguuccauuggucuaugugucuguauugguaccaguaccaggcuguuuugguuacuguagccuugcaguauaguuugaaguuugcuagcgugaugccuccagcuuuguucuuuuugcuuaagauugucuuggcuauaugggcucaaaaguagcuuacuuuuaagcucuuuuuuuucuuuuuuugcuuguauacaccaaaggugguguugguuccaaaugaauucucaagaauaaugucuaaacagacaugugcuuggcaugaccauugacauuuacauugguuugugugauuucuuuuuccuuuaagauuguuucugucucuaaaauuacuuucuauagugucauuucauuauuuuaauaccacucuauuugaauaugacacuagaccucauggaagucaaauagcauuucuccugcaaaguugaccauugcaaaugauguuuuuaauguccuuugagguggagugguuauuacuuggaaugugacaauuucaaacuuuucauaauaacuauaugcuuuguugcauuuuaaagacauuugcucuagaacaguugaagaauugggugcuuguguauuaaaugccuaccaccugauaauuaucucaagggagaauuuguuuaguuuaagcuuaaucuaaauaaaagauaaccugucacacuaauuuucaauaagacuuuaguaagauggauguccagaauuuaguuuaauugcuuccacuacuacguaagagugaucugugugucaaaauuaagcauauuggcaggucaaccuguaaaaguuuguauguggaguugaaguaaacuuacauuuuuacuugaagcucuuuuuaacaguuuauuucuucugccaguuauuuuauugacuguuaauuuaccaccccucuuaaaaaaaaaaggcgagaggaaaaaggccauagcaucaucucauuuauauaugaguucccuaaaccauauggugauuucuaauuagaauacaaaagauucugugaugagacuaacuucauaguagcuguaacagugggcaucacagaaggagagaguuuucuucaauuuccaacaaggagacuuuugagagaaacuguguggucuauaauuguccuuauacuagaagucugacaaaguuauugaugugcagaucaaguuggcauuucgaagguaguaauuuaauucuggagguuugauccucucagucaguggcuugacuugauuuuuuuaaaaugcagcuucaauauuuaauuucacauguacccucucaguagagauuucaaaggauacuuugcuggaugcuugacugccuugucuauuugcucuuguuuugcaugcaagagagagccagaagcuuucuucucauuguguacacaugguauuaauggauuuacucugccuguaucgucucauuacuggaaacagcuagaagcacagaagucuuucaguguaugcaaauaaggcagaaucaucuaccugagaguuaauauucucugcuuuuaaguguauucuaaaucuaauguuuguauuuagagcauaacauccuguucuuuuuuuuuaugggcaaaaagcuaagcagucucaggcagcuguuugauguuggcuucaaguguuauuaauuucauauucuauuauucuuuucacuguagcacaagugaagcugauguggaggcugucauggauaaguuguuugaugagcuggcucagaaacaaaaugauuguacguaaguuaauuucucuugaaagagaauacauuuagaacacaaugcccaaucuccacugaccaauuaauaaguuccauugcuguauauggguugaugccacgcucaaguggcagucauuguaucagcauuuugucuaauuuauguguugaaucaugugcuauuauucaucaagcuaugcauuuccuaucuguaagagaugaauuuuauaguaauuauccagacaagauugagucuuuguucauguucccauaguaacuagaccaaggauucuaaaagugcaaggcagagagcugcgccugaauaaagccuguggaaccguugccgacugcacauuugaagagcugugugagagaguaaguauccaggcacguccagacucacuggccuuuucacauguuaaaauacuucguguuuuccucucugcccauuucagauuuuaaaauaccauucacagagucagaaucgauuuaaaagucucauuaagggaaauacucaucuauuuuugccaugugcuuuuuauagauauuggcacaaaauuugcacuuagaggggcucuaaugcaaaauuagaaaugcagagagaacugucaacuguugcuagaagcaaaaauaaaaucaguuuuggggcuguuuuguaaaagucaaacauaagagauuuuggaaaaauauuugaggugagaguuaggaaaaaggaagaugaaauaaugcuaucaugauccaaggaagcaucacauaaaagaauuuccacuccuuguacugauugcccaucugauauugccauaacauuggaccuacuagggccagggucaaagaaggugaauuucuauaacuguggcaucuauauuauauauuaaauaauauguucaacagagaaaaaauguuuagcuguauaugcacacauucauauaacugagaaagaucuugacugcagauucauuauagauaugaauucugucuuuuaaaaaaucuggaauucuaaguacuucaguggauauucaauguauuuauugauugcaaaucuugaggaaaacaaauccaaauuagauauaauuuuaagcauaauuuuucgauugacaugcuuaauuuaucauucuagcuggucucugauuuaucuugacuuuuagguaacuaaagaacaguugcuuuucaguaagggaaaagacaaaauacuuauaccugcggccauuuuaugagugcuuuucuuaaaagcuagugacggccgggugcgguggcucgcgccuguaaucccagcacuuugggaggccgaggcggguggaucaugaggucaggagauugagaccauccuagcuaacacggugaaaccucgucucuacuaaaaauagaaaaaauuagccgggcguuguggcgggcgccuguagucccagcugcuggggaggcugaggcaggagaauggcgugaacccgggaggcggagccugcauugagccgaggucgcuccacugcauuccagucugggugacagugcgagacuccgucucgaaaaagcaauuauuuagcacuucagaaccagcauaguuuaggaucagugaggauccuccgacagggugguaauguugaucucuguuagugaaagucauucugggugauacggaccuuucagaccucuucuggaucaaucuuuaagguccugauaaccuaacaucuccugacaaaauucuauuaaggcucccacuuaggucugacuuauuuugcaaggaaaauaaacuugagaagaaucuuguauauccaaaagaugaagcuccuccacuuucugcagaagaggggaacgggaaaagacaggccuguugaaucuugggggaggaaggaaaagauggucucuuuuggagcagacacugaguuuuauccacauuuuaaaaauaugcucauuguuuuaggaguuuuaguaacaggaaaaggccacuuaucaggaaccaaaaucuucaguuuauuuacuguccgggggugauggggaagaagauugauugagacuuuaucuugaaaaaugaaauaacacuuauaaaaauaaauuguuuugucuuauuugacaaaaaauauggauuauaauagcaacuacaaacuaaacucuuagauuaaacaaugaacaagugcaguggcaugauuauggcucacuacagccuugaccuccugggcucaggcaauccucccaccucagccucccugguaggugggacugcaggcacacaacgccaugcuuggcuaguuuaaaaaguuuuguagagaugggggucuuaccauguuguccaggcuguucucaaauuccuggccucaagagauccacccaccucagccuuccaaagugcugggauuacagaugugagcuaccaugaccagccuugucaauuauuuucuuuugaaguuuuugugauguuauuauuuguugauuuuuuuuuucuccaaguuggccagaucuucauuugucagugaguuugcauggacagguuugccccuuaucuagacuguaauugugggguguuuacuacauuacacaagcacugaaugaccugcaaaaggcauugacgugauaagugggguuaggucgcaguguuaagcuaugagggaucuuucaggaagggcuaaguuuuuaaguagcuaguuuguuuaugacuauuuucuuguuaugaugauuuugcauugcuuugcaaccuuguaacugcaauucagauauugauuucuugcaugaagaggacaauugaaaucccucaacuucagauguagccuaaaacucuuaaugaguuauaaugaucuuaugagccaggcuaaauaauugccaaaaaccauuaaguaaagauaaaaacacauccaaccuaagguaaagaagcaggcaucuaucuggugugccugggacagucccagcuuuggaucaucuauccuaauuuucuagaaggcucuugaagcccaagacuugcccagucaccugauaccaucaugaaaaagucuuuggcaaggaguagauugguuaacaguccauaaugacuauuuuugagccauggccccuuccaaggaaaaaauaauacagaaacuuaccugugucuugauaagguaaaagaagguuuagauuggaagcccuugacauaugccauaaguaaaaugaaaaagccugacacauucugcuguuugcacaccucuucccucacuguuccaagcacaguuccucagauuuagaauccugcagguuaacaucuagcuucuugguaucuccuggauucucuuucuucguaaauuuguaauucaguaccgucauguucagcagucugaguuaggagacccugcaacacauacauaauaauaauaaugaauauagccacacaucagguaucauucuaagcgcuuuuauauauuaacucauuugauacuuacaauagguaggcacuaauauuguccccauuuuauagguagagaauuugaaacaccaagauguuaaguuaccuucccaaggucacaaagcuaauaagugguguagccagagcucaaacuucuugguaguuugggagucagauucugugcuuuuaaucacuacauuguaucugaagauguucuggacaaguuuuuccucaaucuuuaauauacuuuggacucuaucuuaaaguguaaucauuugggaggccgaggcaggcggaucacaugaggucaggaguucaagaccagccuggacaacauggcaaaaccccgucucuacuaaaaauauagaaauuagccgggcgugguggcaagcaucuguaaucccagcuacucaggaggcugagacaugagaaucauuugaacccaggagguggagguugcagugagccaagaucacaccacugcauuccagccugggugagagacucugucucaauaaauaaauaaauaaauaacaacaacaaaaauaaauaaaguguaaucagauaauuugugaauucucacaucugagcuaagcuuuaagaauuuuauggagcaugaagcugaauggggaacagacauccuccaguccugagagccucccucuguguugaaaaccuuaguacggaccugcccaacucauguguguuggcauacccacugggaaguccagcuacgagccccucugcucuucugaaggcuguaccuccaggguuuguggcuccaggcaagaggccccaagccuuaggcagccucaucccuuugcccauuaauaaaaauacuuucucuuccugccaugacaaagguugggaagugcugccuuagagaagugugggaggguggaggagaauauguuuggguggucuuuguucccugccguucccuccauaucagagcuguggcaaaggaacaugaagcagauccaucucuguggacaugacaugagcuuucaaguuuccuuuccuuaccuugauacagcuacuugguuuaauccaaggguaguggagaagucagaaauaugguuauugaagacagugguucucaaaaugugguuuauagaccucuagggguccccgagacccuuuuagggguccugggaaucuaaacucucuguaacacuucuuggcuuuuucacucugguaguauuuacaguaaugaugcaaaagcacugauaggugaaacugcuggcaccuuagcaggaaucaaggcaauagcaccaaaaaauacuauauuuuucacugaucauauacucacaguaaaaauaaauaaauaaauaaauaacccaguuucauuuaagaauauccuuaaagaagcaguaacaauuauuuuguuaaaucucaacuuugagaacaugucuuuugaauauucuuugugaugaagugaaaguacacguaauaaaacacuucugcacuauaucaaauaugaaggcuguccuggggaaaagcacuuguacgguuguuagaguugcaagcugaacuagccacuauuuucacagaauaccauuuuuacuuggaagacugcuugacagacaaacuaugguuauucagauuuggcagacauuuucucacaauguuugacagacauuuucuugaaaaugaaugaaauaagacugucauuucaaggaaaacaacugacaauauuuguugccagugauaaaauuugagcaaacaagugaaaauuagaauuuuggaaaacuuguuucugccaucaugagcuugacagcuucccaauucuuaaacaucuuucagaugagauugauggugauauuaacacaugcaauguuuugauaauuguuuaauuaaaugugucaacauuuggaagaucugcauaacucaaugaaccaauacuuuccaauaaccaaugcuugcucuuacaaaaucauacaugacaaaagaucuacuuaaagugcaggaaagacuaauggauuuuaauauaacagaauucaaaaaguauacugauacuacuucaguuucuacauugcaacuaacaguuuaaaaaugaccuccuuucaaguuaaaauuuuuuaauagauucuauuuuuuagaacaguuuugggcuuauggaaaaucaagacucuaguacagagaguuuccauauacuuccuaaucuaguuuccccuauuaacaucuuacauucauaugguauaucuguuacaauuaaugaaccaauauuaauauauuauuauuaacuaaaguccauauuuuauucagauuucccuaguuuuuaccuaauguccuuuuucuguuccacaauaccacauuaccuuagcuaugucuccuuaggcuucucuuggcuauggcaguuucucacagacuuuucguuuuugaugaucuugacaguuuugaggaguacuaguuagguauuuguaaaaugucucccaacugggauuugucugauguuuuccuuaugauuagacuggaaugauggucuuuggggaauagaccacagaaaucaaguacuacuuucaucacaucaugucaaggauucauacugucaacauggcuuauaaauguugaugcuaaccuucaucauacuugucugagauaauguuugucagguuuuuuuuugcccuaaaguuauucuuucucccccuuuccacaguguacucguuggcaguagcuucuuguugaguuuucauguagcaucaaagaauauccacaauuaucugauaaggcuauuaaaauacauuucccucuuucaacuacauauccacauaaggcuagauuuucuuauauacuucaacccaaauaacugaguugcaauagauuggauguaaaaauggauaugagaauccaguuauuuucuauuaauccagauauuaaagagauuuacaaaaauguaagacaaugccauucuuguuaguuauuuucauuucaaaaaaacagaaguauuuuuucauaaaaaugugauuuguguuaauuugaugggcuuaauguaauggcuuuaucauuguugcuuuaaaugaauuaauauuuuaaauuuuucucaguuuuaauuucuauuacaguaaacacugggagaaauaacccauauaagcaaacauuccuuggguuccucaauaauuuuuaaaaguauaaaggaguccuggagccaaaaaguuugagaacuccuugcuuuaggcuuaaacuuucauggaccaaaaaugaaagaauccuaccgaaagaaaauaagccaaagcuaaauucuaaaggcuuaaugaguaaacugacuagaccugaauuuuccuuguugagaaauauaauuuuuacaccugcagaaaauuuuccuuaacugauaacugcgcucaaaaguaacuguuugcaagagcaguuuguuauuugugucuuaaaaauaaugacagguggccagguguguuugcaaaaagucuaggcagaaaaauauaucaguugaugcauaugcauggguguacgcauugcucacuaucaacuucuuguuuauuaccuuucuucuuugguuuuuaguacucaggaaaugaaagcccaucacauaaguguauuggccuccauuuuucuauuaaucuugauuauaucauauuaguguauauauccuuagacuuauaaguauaccauauaguaucccuucgggagcuguuaagugacauuucccuucucuugcucuuuuuaugcuuuauuuagcuuuauuccaagugaaaccacugauugggagcuacuucugguuuguguccugugcuucauucacucucaguaaauaucauacuaaaggaugaauagcuuuuaucucuacuacuuggccaagagucaaggcugaugguguugggaugccaacagugguaauuagcaucaaggaauaagggcauuaaucaccagagcugaggcagcccaggaaucuccuuggccuuuuaccuucccagaagcaaaaccauuuuuauagcauugcugaucuguguaugcucauuucccacauuuccugauuucuggccuugccguguccaaauaagguagccagccagccuggccacagcauagugacagggaggacagaaaugagauugcaaagagcuuaauagagaaugggucagauucuuguagggaggaauaugaauccauugucacaaaugagccauaagucuuuugucuaccuuuccccauccacauuccuagucaauccuuaaacuaaagagucauagucuugguguugccaggcaccucaagggucaccuuaucuaaccguucaaccaacccugaauccuacaagaccccaggccuccacuugccuugcaaugccaaauuggggaaugcaguuaaauaugugagaagaaauauaggacauguucagauaggugcaaaauuuuaccauacacaccuagaccuagccuauuucacgaguccucagaaugauaaagaagguuuuuggaauaaaaucccauaauugacuuauaauuugauuuuaaaaaguaagauguacauaaguaacuucuuauaugaauuuauuuuguucugauauuuuauacauaaaagaaaaagugaacucucuguaagacuggagauuggacugagggauccauuuuugcuaauuguugauugauuauaucuuccaaagaaaucacuguauaucagguuaaaaguuguugauuuuuuuuuauaucuuacuauuuaaaggaaaaagaaauaucugaaaaagaaggucuggauuagaaauuugaaaacuguagccucuuagaauaauugugaacguuuccaugaugaaaagggagugaagaaggauuaaaggaaugaagagaacaccuuccuccuuucuucacuggcaaauuuucuguaauaggacacauaguggggcuggacaauccugcccagcuucuguucccaaacugaggcaagagcagcuucuuagaugaugccacucagggcugcacauuuuaagcucugcaagccauggacuucucagacucagcagacugaagcuccucugcaggagaaaacgugcuuucauuuucugugaauauauuuaugucauguuguuagcugaaaugguucaaaaauauugucucuccuguaauggggagaaaaugcccaaggauucccagagggucucaauggaagaguaagugugccaaaaacuguauacuuucaauauguucuccauaauauuauuuugaggauuggaucuaguaguagacacaaguccucauguuuguuuucaggucacuucuacucuaggaaaguaugagaaacuaauauuuaauauuugccucagucuuugagaggaauaugucauucauuugcugagacaauaauuaagaagugcaaagauuaagaaauacgaauuuaaauauauauauauauauauauauauauauauauuuuuuuuuuuuuuuuuuuuuuuuuuuuuugagagagagggucuuguucuuuugcccagacuggaguucaguggugugaucacugcucacugcaaccucagccccccaggcucaagcaauccuucccaccucagccucccaaguagcugggacuacaggcgugcaccaccaugcccaacugauuuuaguauuuuuuguagagacaggguuuugccguguugcccaggcuggucucgaacuccuggccucaagcaauccacccugccuuaaccuuccaaagugcugggauuacaggcaugagccaccaugcccauggucauuaauuuuuuaaaaauagaauuuguuuuuaauuuaaagauaaauuaucucauuugacuuuuaguaguaaauguaucagagcucuaaauaauaauuaagaauagcucucuaaacagaagaccuguaugaagagauugguaaagugcugagagaaaacaagucuaauucaaccaauuaauaugaauauaaaacacuuuaaaaguacuuguuugauuuuuuuaaaaagcuuuaacacugaugguuuuucuauugcuuaccugucaacuggccugguuuuucuuaaacagaaauuuuuuuuuaaucaaguaguccuuaaguguuuguuuccuaucauagaguaugauuugccauuuuccauaguaccuucucccagauuagaucaguugacccaaaauuaguaauuauuuauuacauugccaauuagaauauuuaauaagguacauuccauuuuaucacuuugaaauauauuuuauggaaaaaaguuuagaaauuguuagaauaugcuauuuuuguuuuuuaaaauggcuuggugaagauauuauugagucaggcaaaagauuuugagaaaaaacuagaaaggagcaaaggagccauaauaucuuaagaauuauaagauuuucacauauuuuaggguuaaauauuacuucauucuuuucucuuuuauuguuaaucaagaaauauaugcuauguaagauccagcccuccaagauuacuacauugacuuuggucagcaacuauuucuuuuucuuuuucuuuuuuuuugagacggagucuugcucugucacccaggcaugaucuuagcucacugcaaccuccgccucccagauucaagcaauuccugugccucagccucccaaauagcagggauuacaggcacaccucaccacgcccagcuaauuuuaguauuuuuaguagagaugggguuucaccauguuggccaggcuggucuugaacuccugaccucaagugauccaccugccucagccucccaaaguguugggauugugggcaugagccaccaugcccagccagucagcaacuauuucuuaaguacuucucuaucuguaugccuauguuaugaggaauauaaaagaagucaguaagaaguuucucucaaagaguuuacaguuuaauaaaggaaauaacauaagccaaauauuauacagcgaagcagaguagaaagaggcccaacugagucaggagauaacaauuccagucauuaacucaaauacuguuuagcugacacugggcgcuguggcacacacuuguagucucagcuacuugggaggcuggggcaggaggaucucuugaguacaggaguucuuggcuguccugugcuaugaucaugucugaggauagucaaggcacuccagccggggcaacauagcaagacucugacuacccccaccaaaaaaagauacuauuuugcugaguugccuuaggcagaucacuuaaccacuucaccauucugggucuaaguuccucacuugugaaaugcaugaugugaucagcacauuucugucauuccuuuuauuuuauuucauuuuauuuuuauaccaucaguuuugaugaauacugaucugucauuccuuuuagcuguaacagucuccuuuaaagagcagugcucacuaguuaacuacauaauaugaguguaucaggaguucaaaguaaggaugcuaaggguuggaaaggcuccaacaagauaugagauuuaaagaggaaauugaccuugaccuggaaaggugagcagaauuuagaugaguggaguaaaaguauuucaaccauaaucagaagccaagcaucacguguuucaggaggacagacugaugccuaaugagagcagagugcauguuggggaggaaaaggaaauaaagaugaaacagaucucggacagauucuaccaucaaaaucaggcagagaaauagucuucuuacuguaauccagaaagagucauuuuagguuuugagcaggaaugugguaccuagaguaauguuuuaggaagauuaacaggucaguauacucugggagagguuguaacuuucaccaacauguccaguggaccagcaaguagugucuccucuugggaagauccuucuuuccagaaggaaacuugguuaaauaaacuaacaugcuagauauuuguuuguucccuuaugcaggguaacagacacaguccuacccuuuuaauauuuuacucacacuucucccuaaucauccaccaaauauuuauagaguacuuaauagaaggcugucauauuucuaggaacuguaguggguaccaagaugugaguaagagucuccacuuuuauggagucuuaauuuagaagagaaaaugaggucaguacauagaucacuagaaugugaggcagauuauaauuaguacuacaggaucaguaugaccagaaugcuauggaugaucggaguggaacugggccuugaaggcuggaggguuggagauucuguuggugcaaagguuggggggaguaugaggcaguagcuguuugguuuuuccuaagcaaaggaaaucaugaggggcaucuuuaucaucucuuccuucucugaaguuuuauguuucuggggaaaacacaagaguuggggcugggcgcaguggcucacgccuguaauccuagcacuuugggaggccgaggugggcagggcagauugccugagcucaggaguucgagaccagccuggccaacauggugaaaccccaucucuacugaaauaccaaaaaaaaaaaaaaauuagcugagugugauggcgcacaucuauaaucucagcuacucgggaggcugaggcaugagaaucacuuguacccaggaggccaagauugcgccauugcacuccagccugggugacagagcgagacucugucuccagaaacaaacaaacaaaaaaccggaguuggcaauuacagaguauauucagagaacuacagacucagaaagguucuacuuccauuuaugucagaguagcuccuauuugaucaaauuaccuauugaucaccucugcaaacucuggacaaaaucugaaaaauaacuauccagaaggcacugcuuaucaaaagcagggagaaaguagagcacagccaacacuuggaagaaaggauugauacuggugaguuucucauuuuuauaguuuuucuccugagggcagaucacaguuagucuuauacggaugucuaaaacucaguagaaaccugcuguuuuuagcucgaagaaccagagaagagcaaaucagugaccauaacagcuggaaaguauaaggagaaaucugggaaaggagagaaccacagaggaauagccugaaauuuuuccuguaaacucugcccaaaucuugggcugaccugugaaauauacauacacagcaaaugcuaaaauaacugaacggagauuuucgcugcuacgcaucauggaggagacagaguuuggagcuugaggcuaaccaaguuaauuaccugcuaacauagcaacaacaacaaaaaaucaauauacuuaagaaucccaagucuccacgacauaccauauacaguguccagaauacagucccaaguuaccaugccccucaucaggguacauggcuggacagaguauggacuggauuucagcuccuaauugcugccucgaggaggggcaugaaccagguauacuugagagauugcacgaaacaagauaaauagaagagaaaucagaggauagggcauggaggaggucagggacgaggacaagccaccuagggcuccaacgguuucagucugaauaaccagagaaauggcaggacccuuaacagacaaaccaaaaugcuacagguaggagaacggggcuuacaaacaguuggaaauuuaggacugaagauaaagauguagaggucauuuauaaagguguguuaguuuggagccuaaaggagucaaugacaucaucugaacugacauagaaaaaggaagagaugagggugugggugggguugaaaaguauguuuucacuagagucaauggaaggaaacagagccagaggacuaguauaguuuaaucaaaggcacaggagaaacuauacacguuccucaccauuuuacugaagacuuuuaaaacauagaauuaauuuacuaggcuaggcgcgguggcuuacgccuguaaucccagcacuuugggaggcugaaguggguggaucacaaggucaagagauggagaccauccuggucaacaugguaaaaccccaucucuacuaaaaauacaaaaauuagcugggugugguggcgcaugccuuuuagucacagcuacucgggaggcugaagcaggagaaucacuugaacccaggaggcggagguuguagugagccgaaaucacgccaguacacuccagccuggcgacagagagagacuucgucucaaaagcaaacaaacaaacaaaaaaacagaaguaauuuacuagaucaguaauaucuuaggguuuggauguuacuuuguagaaaaucuuaauauaguaagccacugucauaaguuuauuaauuaccuaaucuuacugcuuuuuagccuuagcauaugugaaaaacuguaaguuguaaauuacuauacacauuuacaugggaauauaaaaauuaucuugcauacauguuuguacugucaauuucuuuccugaacuuucugcauugucucccuaucauguccuauauaaauccaaauaguuacauagucacaucauccgaacugcagccuuugcaaugcacuucuuaaucucccccuucacugcuuuauuaaagccaacgaugcuuugucuuucucaggcuacuucuuuaugccaaauuccauucaauuucguguucaugaaauagauuucuacuucccuacacugggcuauuucccucuguugaaaacccaccuucucuaagaauaucucucucuacugacggaugcucaguacauacuugguaacuaacaaaaucaaaagaggcacugcuguuuauuaucugaaguucuuacugacauuuuauuucccugauucucuuuugccuccuguuuaacugaaagcagaugaaauaagcuuuaagcagaaauagaauaauuuuagcauggauuuauuuaugucuuaucugauuccaaaaaguauuuuauauguguguacagauacacacacacaaccauauacacacagaauuaaauuuuuuaaaaaucaggacaaagggaaaauaaugaauacuuaagcugaaagacagaaaaguuaauauacauaaaucuacaucauaaacuucuacauaguucuuaaaaucaaacaauuaagucaacacucagccuucuaucagccaaagaggggaaaagauauucaguaaguuagaagauaaaaacaaaccaguuacucagaagugaugauuuuuacuggcacuuguaccuuucauaaauggacuucugaaagaugccaggagacauuuccucagcaccauuccugcugccgacauaugcuuguaucugauagauucuuauauccaagcugaaaacauaaugacaaaguaaaguuuaaugaaacuaugcuauaagggcaaaaauaguacuuuacagcugagcuuuucucuuuauuuaucuggcuugauccagaaaaaauaguucuaaauguuuagagauugaauagaugcauguuauuccggccuuucauggauguuuuuaucuuuuaauaaaauuugggcagcagauaauucaagguugucuuuuggcaagaagaugaagugaauaauucuguuagucuuacucauaguuugaagggcuuggcccuuuauuccagcagcacggggagauauucagucuugcccugauucacuuuuuaauaucuuuugaauaugaauuagaauuuuuaacugaguauuuccaugauuuggaaagcagaagagugggaggaagaaagcaacucuucaauauccacuucuuuuccagcucugauuaagcuuuucaaauauccaagccugagagaguuccauuucuuuccaauggacucucacaaagaaagcaaaacaaacaaaaacaacagcaaaaagcaaaacaaaaguaacaaaaccucugcauuuacaagacuuuaacguguucagaaguuacaguucucaaauuuaaaauaacuucuuagcuauucuaaagccuuuucuccuuuuucauuuugggauccuaaauaucucuuuuugugccacuuagcucugauuuccaaaggaaaaaguuaacacugguucaccuuucaugucacaugcacaugcaagacuggugucagagagucuagaaccugaccuugcacuaugcagcucaucuuucccauuucuucuggguagaucucaaagccagacaaauguacaagucuuuccucccaaggagauguagcaaauacugcccucuacugaggguacaaucaggauggcuugauuauguuaaugauuaaguacugauuucaaugauuaugguagaauaaugcugguacuaauuacuucaucauuauuauauacuuucuuauuaaaaucauuauauucagaaagagaauacaaaagugguggaaacauauuucagccuuggccacauucacuuauuauguucuguagucuggacaaucagauaucacagcacuaugucugaggcauucaugauaauguuuaaacuuccuucuguuuugaacuagcuaagaaaauaccuuuuccagugggaaauuagaaggaguuauuacaacauuauuuuaacaaaggagcuugugaaauaauucuagcaacaguugggcuauuuuucuuccccuugccaguauuuuuuuuuuguaucuacuggauugcuaauauucagaguaauuucacaggacuagcuauuaaugcaguuacaauaaauuuuuucuuuguucuuuaugacuuuaaagggugaauuguacauguuuaacaguacaggaucauguuaaaguaaaugccuuuuaacaaaaagcuucucaaaaauauuaaacuaaccaaucaaauaauuauacacacacacacacacacagagagagacauacauuuguaacggcauguuuuuaaaaaauguuauauuaucuguguuccuggaucuggaaaguauggguucuuuuauuaggcuaaaugcuuacuguaauguacuauccagcucacuugugcuguuccuguuuuucuagaacaggguuugcuuaggauuggccugaagcuaaacaaaucuuagcaagggagccgugagaaucaaaaccuagugauccgaaguguucccacagcaucugauaaacuccaaagcuuaaaccucugguuucuuuaauucagaaaccuuagauacugugagaacuaggaggagagucgagccaggcuaaaucgucugguggugaagauagcuuccagaacauggugagccaaggugugugaagacccauuuccuccagccucacaaaccaaagcagcagccuuguucuucacagacucccucugccuucugacugccccucacacuacaguuaagcugaaaacuuaagcugaauaaagaagcuaggcaagacuuucuaacucuagaaauauggagggucuuucugagugggggcucugagcuacacuagcucauuugcuguuguuaauucuguuguacggucgaacccaguuuaucccauuuccaaaaggagcaacuugacuucuccuagauuuuagaugucuaccaaacaacagauaccagguaauuagcaagguauagucugguucauucagucccaggugguuaguacaacccauuccacuaauuuuuaccaugucguggauaugcuuuugcaguuguuauguauugucuuggaguuguauugaugcuuacauuuagcgaugcucauuaaugaugaugaugcuaauuaggacgauuuccuacuucuucaucuucuuuuucuucuguuuuugagacacagucucacugucacucaggcuggagugcaguggcaugaucucagcucacugcaaccuccgcccuucagguucaagcgauucuuguacgucagccuccuguguagcuacaggccugugccaccaugccuugcuaauuuuuguauuuuaguagagaugggguuuugucauauuggccaggccagucucgagcucaagcaauccgcccgucucggccucccaaacugcugggauuacaggugugagucaccacaccuggcgucacauuuucauuuugguuuucuguuuuuaugccaauuguuuccauccccgcucccccugcuccccugccccagugaguccagcacggugcuuuucaccugguagaucugauucgauagaccugacuugauguggcuugugucuugagaaaauugucaguuucaggauccccagaauuagacaucuccagaauuuggagaucucuuuauuacauacacaaagcuggucgaguagaguagaggaguguacccuccucuaguuugucacauugauuuuuuuguuaagucauuguuucuacaagcaaaauaugccccccccaccccgcaaaaaaauacuguauuaaccauuaaaaggggaugagaauuuagcaaaaaucuggcagauuuagguagaaccaaccuccugccauugagacuguguaaaucaaauggcaaaacuuucccucagcacuccaaagaacacccugagaagcagaauguguuaagaauuggugauauuuucuagaauggugagauauuucccagcuggguguuuggacuucauauucgugagauuucucauauugaggugccauaugaaucuugggaaauuauuuacucugcaaauacacacauuucagugcucugcuuuucuuucuuuuuuucuuuucuuuucuuuuuuuuuuuuucagacagagucuugcucugucacccaggcuggagugcaguggucccaucucagcucacugcaaccuacgccucccagguuccagugauucuccugccucagccuccugaguagcuaggauuacaggcgugcaccacccugcccagcuaaauuuuuuuuguauuuuuaguagagaugggguuucaccauguuggccaggcuggucuucaacuccugaccucaagugauccacccaucucggccucccaaagugcugggauuacaagcaugagccaccacacccagccuuguuuuucuaauuauuauauuuauuauuuuggaaucuggcacauaaaaauagucuuaacaucaauucgugugauauuuucaguuuguuuugaaaaggauacauucauccuaauuccauucaagcauuuucuauuaaaagguacuucucuuuaagauaugaaguauugucauugccauguaaauaaaguaagauaccacgcauguuuguuuaaugaacagcuaucagcguauuccuacaaaggguuuauaaggaggagucuauacagauaaagaguaacccuuaggaccguauaaucuagauagagcuugaaaucauaaucguccuacuucagcugaaauaaugguagcagagcagagcauuagugaggcagaggaaaaagaaacuccagcugacagcucauuuggguauacugaaguggaucauuguagggcagaagguggucugaugguaaugcucgugcauuucacauugguguggcauugagaaaauucccacuucuggcaccagggucgauaccaaagcagacaacuggaccauuucacauauaggagaaaaaagacagcaagcaagcucuuuauuuuuaaguuuguuagagaaacugggcuacauauaaucaagcuguauacucuugguaauuaaggaaaacaaauacucuuugcaaagucauuauagauuuaaaguucuuuaaguuuucaucagguuuccacagaaacaaagaguuugaaacaauaguggagaaugcacaaaccaucgaguaaguggauuuuaauuguuccuguuaagaaaauuauucagauaaccagccacaucaaagacuauuaaacuuuuuaauugcucagguggaaagauggagaaugucaucauuaucuaucauaagaagaaucagccuuagauaauccuacuugaauuuugaguuagaauaacauacucaaggaugcuacuaacugaagugccauuuaguacucaaaaguaaucauaugcuuuaauuauucauagggcacaaugcaugaauucacaauacuaauuaugguuucaaaaaguguauuaugcuaugguuuaguuacauaggaggaucaacuaaugcaaaacaaaaguauaaauauuugcaacugccauagauauacugugcauguaauuuaguuguuuguuaguguggucaaaggaguagagaaaugucuuuucccuguguuuugcaaaguucuuguaggauuuaauacagugccucauauuuauuaagcauucaauaguuauaauugauuuugaagacuuggugauagugucuuuauuuauucauuaauuguguguuaugcaaaacucuguucccuagucugugcuaggugcuggggacacugaggugaauagaacucccugucuuguacaaugacguaaaugaguguggcaacagcaaauguaaauggcauuguagcuccucaaggucuuuaguauaugcuuuguguugaauauuuuacauauucaugauguauuguaauauuagggaagaugcaggggaugaaauagcugaaaaauaacgcacaguaaauauacuuuggaauuaauaaaaaucuuuaauguuguuuuucuacaucauuauuuugguuugacucuuuucugucauuauuuugcuucuuucuccuuuggaaaauacugacaaaucuaaaaaaaaugaagauuauuaaacauaccucuaagucuuucacuccaaccauuuagaaauaacaaguaacauuuuaaauauauuuacuuaugcuuuuuucugcauauauauuuugagcaaaacaaacauauaauuuugcauuaugcuuuuucacuuaguuuuuuuuaucauggcauguuuccauaucauaaaauauuuuucauggacaccauuauuuguuggcaacauauuauuuuauuacaucaaugugccuuaauuuauugaaccauucuucuguuaucagauauuaaaguugcuuuuuggugacauaguuauaaucuuauguauaaccuucgguugaauuucugaucacuuucuccugauugauuucuagaagugaaaugauggguguaaguuuauaacuuuuuuuuagggcucuuacuacaacccaucaaacuguuuucaggaacaacuaaacugauuugcucuuccagcagcgauggaugcugcauuacauguuugccggcaucaaauugcauaauuuauuuuucuuugccaaauugcuauuugaaaaaugauauaacauucuuauuucuuugaaauaagaauuucuuuauuacuacugagcuugacuauuuuuucauuuguuuauuagccucuuuuacuuacuauauucuuugcuccaugaauugucuauucaaauucuauauucauuuuuuuucuguugcaaugcuguuacaauuuuaguuuuauuguagucaauccuugucucacuuaauuccuuuuucauaucaguuugcucucucccugcauuucucugcuuguauuugauuggguccaugucuuguauucuaaaacgauaccacaaaauuuaccaacuuuuuccuucuaguucuuguauacaguaaaucauaaguuuuauuucuggaaauaaguuuuauauuacaccauaaaaauuccaaaauugauuauaaaaauaaaugaacauaaaauaaaugaugauauauguguuuaaauauacuuaucaauuaugcaaaacuaauucuuaacuauaaaagcuggaucauauuuuucugcaggggcuggacuugcuaaugacuuaaaagcuuucacuaguaaaucucuguagcaaguauaguguuuucguuagcucuugcugcauaauaaaucaccccaaaauucaaugacauaaacugaguaacaauaagcauuuguuauuacccucuagucuacaggcuaugggggaguucuuuggaucucuguuggguucauaugugcaucugcagucaauuugcugcacugggcuaggcucuucucaucuguguggggccagcuggcuguaugcagccuaggaugcucucuuggcuuuuguccuuuuuguguucucuccuccuccagcaggcuagccgagguauugcaaaagagugaacagaagcaugcaaagccucuugagaccuaaguucagaacuugaaaacugugacuuuugcuucauucuguuggccgugguaaaguugagccaugguaaagaauagacuccacgucacaaugcaagagcuggaaaguugcaauccaaaggauauggacaaggaggcaagaacaauugcagccauuacuauaaucagaugaccccucaccccacauaggccuucuucaauucuccaguggguuuuaaauuaucauaauuuaguucuagagaauuuuuuaguuaauccaaguaaacaucuuuaaauaacccaaacauuuuuaaauaaugaaugcuugggaacaaaagggugaguggcaacauuguauuuaaaucaguauuggucacagugaucaagaucucacacaucaaaaaugauauccuuuaugugauacacaggguuauguaagaugauuuggcagcaucgauauguaguuuggugaaaacauucauuauauuucuguauauuauauaaucaugagaagaaaaauaaacuuacaaauauauuuugaaauauaucggccaggcacggugguucaugccuguagucccagcacuuugggaggcugaggcaggcagaucaccugagaucaggaguucaagaccagccugaccaacauggugaaacccugucucuacuaaaaauacaaaaauuagacaggcguguggcaugcaccuguaaucccagcuacuuggaaagcuggggcaggagaaucacuugaacccgggaggcagagacugcagugagccaagauugcgccacugcacucuagcuugggugacagagugagacucuauuucaaaaauauauauauacaugaaauauugaauuugaauaaaacuaucaaauaaaauguuuucaaauuuguaaugagaaacuucccuccauaaauguaacuuuuuuuuuuuuuuuugagacagguccuugcucugucgcccaggcuggaguacaguggcgccaucuugguucacugcaaccucugccuccugcguucaagccauccucucaccucagccucccaaguagcugggacuacaggcacgugccacuacauguggcuaaguuuuguauuauuuguagagaugagguuuugccauguuacccaggcuggucucaaacuccugagcucaagcaauccaccaaccucagccucccaaagugcugggauuacagguauaagccaccaugcccagcccauaaacauaacuuucuaaaagucaguuuugauacuugaaaugggauaaaugaaauuccugauuaagacuuuuaaaauuuuaauccaggccaggcaugguugcuuaugccuguaaucccaguucuuugggaggccaagguguuugggauugcuugagcccagcauuuugagaccagccuuggcagcauagcaagaccucaucucuaccaaaaaaaaaaaaaaaaaaaaagcugggcuccauugguaggugcagcacaccuguaguucuagcuacucaggagcuaaggugggaggaucacuugagcccaggaggucaaggcugcagugagcugagaucacgccacugcacuccagucugggcaaaagagcuagagcuagauccuguccccaucacccccaaaaaaaccugaagaaaauuugaagaggaauuuuuuuaaaaaaauaauagauucaggggguacaugcacagguuuguuacauggguguauuguauaaugcugggauuugggcugcuagggugcuugucaucugaauagugaacauagugaccaauagguaauuuuucuaacccuugcccccuuuucuugcucccugcuuuuggggucccuagugucuauuuuuucaucuuuauguccauguguacccauuguuuagcucucauuuacaagugagaacaugcaguauuugguuuucuguuuuuuuguuaauuugcuuaggauaauggccuccagcugcauccauguugcugcaaagaacaugauuucauucuuuuuuauggcuguguaguauuccauggugcgugcguguguguguguguguguguguguguguguguguguguguacauauacguauaccugaucucaggugaucugccugccucggccucccaaagugcugggacuacaggcaugaaccaccgugcccagccgauauauuucaaaauauauuuggaaguuuauuuuucuucucaugauuauauaauauacagaaauauaaugaauguuuucaccaaacuacauaucgaugcugccaaaucaucuuauauaacccuguguaucacacaaaggauaucauuuuugaugugugacaucuugaucaaugugaccaauacugauauauauacauauauauuuacacacacacacacauacauuuucuuuauccaguccaccauugauggacacuuagauugcuuccaugccuuuguugugaauagugcuauuauaaacgugaaugcaggugucuuuuugauaaacgugagugcaggugucuuuugcacuacccuuuggguagauacccaguagugggauugcuggguugaauaguaguucuauuuuuaguucuuugagaaaucuccauacuguuuccauggggguugaacuaauuugcauucccaccaacaguguauaagcauucccuuuucuccacauuccucacccacaucugcuauuuuuuggcuuuuuaguaauagucauucugacuugugugagaugauagcucauugugguuuuaauuugcauuucucugaugauuaaugauguugggcauuuuuuccuaucuuuguugaccacuuguauuucuuguuuuaagaggugucugugcauguuuuuugcccacuuugaagauaauuuuuuuuuuuugagacggagucuugcucugucgcccaggcuggagugcaacggugugaucuccgcucaccgcaaccucugccuccuggguucaagcaauucuccuaccucagccucccaaguagcugaaauuacaggcacgcaccaccaugccuggcuaauacuuuguauuuuuagcagagaugggguuucaccauguuggccaggcuggucuugaacuccugaccccaugauccgccugccuuggccucccaaagugcugggauuacaggcgugagccaccgcaccuggccgaagagaaauuuuugauaguuaccaucuaugugaacaagaauccucauucauacaaggagacauuaagaaguuuuguauuuucaguaaugguugacucucuguaauuugcaccacauuuuuuguuagggcaaugaaggaagcuagaugaaauuaguaguaggauaggcuaacugcugcaacaaauaacccccaaauuagaggauuaauaaacaaacauguauuucuugaucauauuacuguccaaugcaggcugacaaggaaauguagcuccaugcaguccuucauggacucagacuucaucucuccuuuaaguccuuagaguccucucuauucaccugcagaugaggaaaagaaggaagauucuguguagaguguuuuuaugggcuagaccuugaagugaucauauuacugucucucucacucccuggucugaacuugaucacacagccacacuuaaaucuaagggaggcugggcaauaauacaggcauaccuuggagauauugcuggcuugguuccaggccacuggaaccgaugagucgcaggaauuuuuuuguuucccgguacauauaaaaguuauguuuauacuguagucuauuaagugugcaauagcauuaugucaaaaaaauacauacuuuaauuuaaaaaugcuuuauuacuaaaaaaugcuaacaacuauuugagccuucagugaguuguaguguuuuuacuguuauaggcuuuucuugccucaauguuuuguuucuuuuuacccagacagagucucacucuguugcccagguuggagugcaguggcgugaucucggcucacugcaaccucugccucccagguucaagcgauucucuuggcucagccuccugaguagcugagauuacaggugcagccaccaugccugguuuugcuuuuuguuuguuuguuuguuuguuuuuugaguuggaguuuugcucuuguugccgaggcuggagugcaauggcgugaucucggcucacuguaaccucugccuccuggguuuaagugauucugcugccucagccuccugaguagcugggauuacagacaugugccagcaugccuggcuaauuuuguauuuuuaguagagaugguguuucuccauguuggucaggcuggucucgaacucccugccucaggugauccacucgcuucggccucccaaagugcugagauuacaggcaugagccaccgugccuggccugguuuuguauuuuuaguagagacaggguuuccccauguuggccaggcuggucuugaacuccugaccucaagugauccgcccaccucggccucccaaagugcugggauuauaggcaugaaccaccauacccaaccucuugccucaauguugaugacuguugacugaucacgguggugauugcugaagguuaggaugacugacaauuucuuaaaauaagacaaugaacuuugcuguacaauggacucuugcuuucacaaaagauuucuuucuagcaagugaugcuauuugauagcauuuacucacagcagaacuucuuuugaaauuggagucaguccucucaaccccugccacugcuuuaacaacuaaguuuauguaauagucuaaauccuuuguugucauuucaacaguguucacaccaucuucaccaggaguagauuccaucucaagaaaccacuuucuuucucauccauaagaagcaacuccuuaucaguucaaguuugaucaugagauugcagcaauucagccauaucuucaggcuccacuucuaauucuaguucucuugccauaucucucuaccacaucugcaguuacuuccucuugaaccucuccaagucauccaugaggguuggaauccucuucuucuaaacuccuguuaauguugauauuucgaccuucuccccaugaagcacuaauguucuucaugguaucuagaaugauaaaucauuuccggaaaguuuucaauuaacuuagcccagauccaucacaggaaucgcuauauguggcagcuauggccuuccaaaauguauuucuuaaauaauuagacuugaaagucaaaauuacuucuugauccaugggcugcagaauggauguuguguuaacagucaugaaaacaacauucaucucuuuguacaguuccaccagagcucuugggugaccgagugcauugucaaugagcaguaaucuuuugaaagaagucuuuuuuucugagcaguagcucuuaaagggggcuuaaaauacguaguaaaccaugcuauaaaaagaugugcugucauccaggcuuuguuguuccauuuuuagggcacaggcagaguagauuuagcaucauucuuaagggcucuaggauuuucagaaugguaaaugagcauuggcuucaacuuaaagucaccagcugcauuagccccuagcaagagagucagucuauccuuuugaagcuuugaagccaggcauugacuucccucuagcuaugaaagucacagagggcaucuucuuucgauucaucugcauugaaaaucuguuguuuaguguagccaccuucauaaaugaucuuaacuagaucuugcugcagcuucuacaucagcacuugcuguuucaccuugaacuuucguuauggagauggcuucuuuucuuaaaccucaugaaccaaccucugcugguuuccgauuuuucuucugcagcuuccucaccucuuucaaucuucauguaauugaagagagucagggccuugcucuguguuaggcuuugccuuagggaagcauuguggcuggucugaucuucuaucuagaccacucagacuuucuccaaaucaacaauaaugcuuuuuuacuuucuuauaguuuguguguucacuggaguagcacuuuuuauuuccuucaagacauuuuccuuuucauucacaacuuggcuaacuguuuggcucaagaggccuagcuuuuggccugucuugacuuuugacaugccuuccccacuaagcauaaucauuucuagcuuuagcuuuuauaugagagauguacaacucuuccuuucacuugaacacagaggccacuguaauguuauuaauugaccuaauuuuaauguuguuguaucucagggaauagggaggccugaagagagggagaaagaugggggaacagccagugguggagcagucagaacacacaaaauguaucaaguccaccaucuuauaaggaugugguucguggcaccccaaagcaauuacaacaguaacauggaagaucacugaucccagaucaccauaccagauguaauaguaaugaaaaagugugacauauuguggcaguuaacaaaaugugacacagagacaugaagugagcacaugcuguuggaaaaaugucaccaacagacuugcuugaugcagaguugccacaaaucuucaauuuguaaacaaaacaaaaguaucuucagaaugcaguaaaaugaagcacaauaaaaugaagugugccuguagucuaucugugugcccagaaagaagagaaaaacauggauauugguaugcacuaagcaaucuuguuuucaaaaugaggugagcugagcuuacuuuuggcagccuuauuggguuagugggacaaaagucagagacuagggccauccaaggaugggaaccuauuuaacugccuguaucccccacuuuggauaagguccugaguggauuucauccugaaguccugaaggacugcacuuaggaauuaguguaaagcagaaauaagccagcccucucauggacuuuagccagauuuucagcugaauacuuagaaaaccucaagcccugagcuuggauuuuuuuuuuuucuuuuuucuuuuuuuuuuuuugagauggagucucacacugucacccaggcuggaguacaauggcacgaucucagcucccugcaaccuccgcgcccagguucaagcgauucuccugccucagccucccgaguagcugggauugcaggcgccugccgccgcacccggcuaauuuuuguauuuuuaguagagaugggguuucaccaucuuggccaggcuggucuugaacuccugaccucguguuccacucgccucggccucccaaaguucugggauuacaggcaugaaccacugcgcccagccagauuuuuuucuauauguauuuuuuuucaaagguaaaauccaggauguacaaagauaaccaggcauaugaggagacaagacauugugaaugagaacaaacaaaaacaacagacaauaaaauuaggaacuccagauauuagaaguaugaaucuauauuuuaaacagcuagacuuacauauucaaagaacuuuuuuuaaaaaaaagugggcuuggaacuacgcuucagaagggaucuagagauaauaaaaagagacaucucaaccuugaaaaagaaucaguggaaauucuagagcuacaaagugcaguaacaaaaauuaagggcucaagggaugagcuuaagagcagauuaaacacagcuaaggagaagcacaguggaucagaaaaacuauccaaaaugaaucauggagaaguaauaaagaaauauacaaaauaaaggauaaaaggagaguaugacguuuaaccuaggugcauuuaaaguaucagaaggagaagagaaagggaauggagcagaggcaauauacauauguagauguacuugauauugucugacauuuauggagaaaaauacugacaacacacuagucaucaugcuuacauggggaaaaauugcgaaaauuaagacaugcuauaaaugggagcauauugaccuggacuguggucacggguuuugacugguuuacuuuaaaguacagucaccccucuguauccauggguaauugguuccaggaccuuccacagacaccaaaucugcagauccugaagucccugauauaaaguggaguaguauuugcauauaacccaugcacauccucccauauuuuuuguuuguuuguuuuugagacaaggucucugucgaccaggcucgagugcaaugguggugaucucagcucacugcaaacucagacucccaggcucaaacgauccuccuaccucagccuccugaguagcugcaacuacaggcgcauaccaccacaccuggcuaacuuuguguaucuuuuguagagaugggguuucacuauguugcccaagcuggucuccaacuccugagcucaagugauccacccaccucagcuucucaaagugcugggauuacaggugugagccacugggccuggcuuccucccguauucuuuaauuaucuccagauuauuuauaauaccuagugcaauguaaaugcuauguaaauaguuguuauaaucuccaacuccugagcucgagugauccacccaccucagguucccaaagugcugagauuacaggcgugagccacugggccuggcuuccuuccauauucuuuaauuaucuccagauuauuuauaauaccuaguacaauguaaaugcuauguaaaugguuguuauaauguauugcuuuuuaauuuguacugguuuuuauguuauauuuuuuuccaaauauuuugauuggcaguugguuggaucugcagauguggaacccacagauauggggagccaacugaauuguuuuucuuguuuaucuuuccuauuuauuauucucuuuuuaauuuuugacuuuuuugaacuuuucuuuuuagaaauaugcuuacccaugaauuuauugaaaaccaaaaugucauuauuuuaaauuaguccuauucuuauuggaucugauuuuuuggggggaaaaaacuuccuucuuugauaaauacauuucauucuucuuucucauguuuuuaaagaaaaaaguaguauugcuaucucucguggccuaaauugagagagaugucuuuggcaaugaauaaccucuccuuguuugaaugacuuuuuuuuaauuguaguaaaauaccauauaacauaaaauugaccauuuuaacuaauuuuaaguguacaguucagugacauuaaguacauucauauuguugugcagugaucaacacugucuaccucuagaacuuuuuccucauccuagacugaauguauuaaacaacaauuccgcauucccccaaugacuguugucuugaaaggagaaagauaacucuacugagcuuuguuuucuuuaugugaaugagcauguaauuguuuuagggauaugaggggaaggaauaguugcuaauguaauggcaaaugcagaaccuacugacaaagguauguaauuuguaaaauagcugaaugggcaaaauucugauuuuucaguugcccuaggcacuucagugcacuucugauaaugauuuuccuugggcauguaguuauucugauagaaaucacauccaugcauaacgagugagcuuaauuauacauaacuacauacauaauaugagguuuuacauuuuuuuauguauacuuucugguuuacaaaagaugagacacuaaauccuaacugaucucaaaaaaaguaguguacccucagagcaugagagucuuaauguaugaguuuuccuuuuuacaacaagacauguauuuugcccuccccucucucgcuuucggggauuguuuucacuauuuggugauuccacagucucaucuggugccugcugugacucccaagacagacaagugcacaaaggcugauuuagggucuuggauuccucuugagaaugacauacucaauucauuuguacugaucccaaucauuugagcucaaaauaauaaaaauaaaaguagccaagaugguuugaauacuaauguaugccccaggcacugugcuaaacacuuugcauauauuacuuuguuuaauucucacgauucugucagauaggaaucaaauccccauuuuacaaaugggaaaacuaaggaacaggaagaugauguaauuugccaguggcacccaguugauaaguagcaacugaggagucagauccaggccuuccagagcccucacucccaccuucucuauuaacacgugcuccuggucuguauugggcucaacagcaggauucucuuggaacagaaguagguuuaaaccaaccccaccccacucccagaaaaacccacagcaugcuggaacccuccauggcugaggugaguggcuugucucagcuaaggccaggcacgaggucuggagguagaggcuuuccagccagggaaggaaaaugggaagggcggagcuugccuccuccuggcugccauuuguuaucugguuggugagaagagaugggaggaaggggcacugucagcacauuuccaaaggacucgggucauucuuggugcucuuugucucugguuuugugcccauugccuaggucccauaauugcugcauccuucuuagaacugcucucuauuuagggaaccacuucuccagaaccuaacucucuggauuuacuuguaccuccccacaccuccaugcaaauucuucuuuccugagcauaacugauuucagcugguugguaggagagugguaggcuuaagugaauggacaaaggugagaaugacucuccuccuccucacgguuuccuaauucucccaggaauaucgccauaucaacauuucugaaagaaguuucaugcaaaggacuucccaaaugagauagacauuucuggacagggaggaauauugauggauucugccagaaacugaggaggcucagccaccuguguccuagaggucgaucagggugacccaggagcuuccagagggacuucagagcagcuccugggccacucagucucugccuucucccgacuccagcagggccagaaacacucucccaacauuugcucaugguuugcugcucacagaguacagucauccacaggcagcuuaaaaugagcagagguaacauuuccugggaguguuccuaaccccaaagaauguguuugcagauuguguuccuaauguucaggaguuaaauucauguuucagaaacaagcacuuuacaucuguagguggcacuuuugugaauaauauuguggaccuugagucccauacucuccucguaucaggaggcaguguacugccuccaauuauucuggagcucucaucugcuccugcuuauuuaagcccuucaguauuuccuacagagguuagcaguguuggacuugaauaauuguaccuuaaauuaaacuaaaaauaauuucugaugauuuucauacugaagcacagucuuuauuucaaaaugguggcauaaucuucagcaugccauuaucaaauagcuccauugaccaauaguggcaguuugcaguugagucacgggaaggguuuauuaggacauguuuaaagugaugucauagaaauaaaaauauggacagggaccuaaagauuacaaacuaaggcuguggcuagagauauucuuuaacuccccaccgcacucuugucuucucucuugccccuuuuucacaucacuauuaaggcaacacaguguauguuaucuguguccuuagccuacucugaaaacacugcccuugguuucaccaaauagugaaaacaauccccaaaagggagagaggggagggcaaaauacagugucuuuuuguaaaaaggaaaacucauacauuaggacucucaugcucugaggguacacuacuuuuuuggagcucaguuaggauuuagugucucaucuuuuguaaaccggaaaguauauguaaaaaaauguaaaaccucauauuagguauguaguuauguauaauuaagcucacucguuaugcauggaugugauuucuaucagaauaacuacaugcucaaggaaaaucauuaucagaagugcacugaagugccuagggcaacugccuauggguaacuuggucaaguuacccacagcuaccaccuagaucacaccaugacaagaaagagguguuuuuacacuaaaccacuccaaaggcaaccagaauugguuuauuuuuaaguuuucuuuuauuucauuuuaucauagccacuuggagccagugacuauuuggaacuaucaaagaauuuugauacaauauuuuuacgaaacauuccgcaauuuacucuggcaaacaggacucaaggucgaagauucauaacucucaucgauaacuuuuaugaucucaagguaaggauguaguacauuuucuuaaaacuaaacacuuuguauugugaagccagauugccugggcuggaaauccugacuuaacauacuucuaucacuuacugcaccucuuugugccuccauucccucaugugugaauuggggaugauaauauuauuuacuucugaggguuguugcgaggacuaaaaaggcaaauccauguaaagcauuuaaaacauuuggcacaagcugaaugcuguauaagcacuaucaguagaagcagcaguaguacuauaguaaagcucccaucacaagacacucugcuauaugaaugauugcaucauucuaccagacagcuuaugcgcuucaucuaucacguucuaaaacacaaugucuugcauaaacugaaugcucaguaaguauuuguugcaugaauaaaugauugcacugauagaauaaugcaugagcaagccaggugugauggcucaugccuaucaucccagcacuuugggaggccaagggaggaucgcuugaggccaggcguucaagaccagccuggacaacauagcaaaauccuagcucuacaaaaaauaagaaaauuagcuggguguggugaugagggccugucauccugccuacuugggaggcuaaggugggaggauugcuuaagcccaggaguucaagguuacaguagugagucaugaucaccccacugcacugcagccuuccagccugggugacagagugaggcccuaucucucaaaaaaaaaaaaaaagaagaagaagaagaaguagaaggaggaggaggaggaggaggaggagggagguaggaggaaggaagaaggaagaaggaagagaaggagaaggaggagaaggagaaggagaagaaaacaaaugagugaaugacuagaggacccuucugaauauugaagcucucucucucccuaugacccagaaaccccaguagcuagcauuauaccaucuuguuguuuguuuguuuuuaauccgcauguuuuagugugaauugccaagucacugcccauucaucaaaggcagcauggccuacugguucaagagugggcccuggggucaggcugucuauccuaaaggccaucuuaaucucucugagcuucaacugccuuuucuagaaaaaacagauaauaaugguacuuauaaaguuguuguauuaaacaagcauguaaagcacaaagaauguugucuggccuaugguacgcucucaguaaaagugagcuauuaguagaauauaucuguaaauauagauucauagcaaaaguacaauuugaaauuagaguuaauuuaaauauuauuuuaccauuagauauacuuuuuucucccuauucuuugcacagaauuagauagaccagugauucuaaauugaaggggcuuugugggaagaagauaagcaacagaaucugcugggagggagaggugacaauuuaauguuucauuugcucauucauucuguaaacuucaucaugccaagcgcuagaaauucaguggcaagugaaacuagauggugcuugccuucaaagagcuuagauagccugauaucagagaaacgugaaucagauguccacagaacucgauguaaaaucaccacugugggaugaccuguuagacagagaaggaggcauauggugcugugagagucuagcaggggagagugcacugaucuauggggugggaaauccucugagggccaccuauggcagaaccauguggccuacuuaaaaauccagauuccagagcucacccauucccaccccagcaaaugaguaccaggcauggggccaggaacugcauguucucauguuucucaggugcuucuuauaaaugcugagaagagugagggcuaaacucuaugcacagaaugaaaauggguaaccagcauggggaguuugcagcaaccucucugggaugggccgaaugugaaaggcagcaaguguggcucugaugcagaagcugagggaagcccaccuaagggagugcuaucaaaagcugcugugcauccccgcggagcccacacacaugugauggguaaucuggagaggcagaaggcugaggacacagagcugggggauggaggcccaucagcugugagugguggccuuccacagacucgacucuacaguaaugguggggagggcagggguggaaugaagggcaggggccuggaggcugcuguuuuuacaggacuaggcuucaagaagaagacaacagaggggcaugaauaggauggcucauaguggaggauggagagacucguuauuuugauauuucagcuaggaaugccuuacagaaagcuuaugguccccaucccucagucccacccccuaacccuaccucacccccaccuuuucacuucuuaaucgaaggaaaaaagaauuuuucuggcaauaugauagaauauucaaacuacccuccuaacauucccuuuaacuaaaucacacauuuagagauuauacuuuuuauuaaaguguagucaaaaccauuuuauuucaaaaauugguagcauuaaacagacauuauucuagaauguauucauggagauuugugacagaaggauauacccauguaaauaaugaaaaauugucuuugauuaaaauaacuuauaagaggagguagaaggccauuuggauauggaaaaucuagugucgaaugucaacacaugauuuuuaaguacugguguauuauuauuuaaauaaugauuuuuaaagauagcuaugaauccugaagacaaauucaggacuuuuaaaacaucaagaagaauauguuuuguaugguggagccaagauggccaaauagggacagcuccagucuacagcucccagcaugagcgacgcagaagaugaaugauuucugcauuucuaacugagguacuggguucaucucacuggggauugucagacagugggugcaggacagugggugcagcgcaccgagcaugagcugaagcagggcgaggcaucgccucacccgggaagcacaaggcaucagggaauucccuuuccuagcgaaggaaaggggugacagauggcaccuggaaaaucggaucacucccacccuaauacugcgcuuuuccaacagucuuagcaaacggcacaccaggagauuauaucccgcgcauggcuuggaggguucuacacccacagagccucgcucauugcuagcauagcagucugagaucaaacugcaaggcggcagcgaggaugguggaggggcgccuaccacugccaaggcuugaguagguaaacaaagcggcugggaagcuccaacuggguggagcccacugcagcucaaggaggcuugccugucucaguagacuccaccucugggggcagggcauagccaaaaaaaaggcagcagaaaccucugcagaccuaaauguuccugucuaacagcuuugaagagaguagagguucuuccagcacacagcuugagaucugagaacggacagacugucuccucaagugggucccugacccccaaguagccuaacugggaggcacgccccaguaggggcagacugacaccucacauggccggguacuccucugagacaaaacuuccagaggaacgaucaggcagcaaaauuugcuguucaccaguaucugcuguucugcagccuccacugcugauacccaggcaaacagggucuggaguggaccuccagcaaacuccaacagaccugcagcugagaguccugacuguuagaaagaaaacugacaaacagaaaggacauccacaccaaaaccccaucuguacgucaccaucaucaaagaccaaaggcagauaaaaccacaaagacggggaaaaaacagagcagaaaaacucaaaauucuaaaaaucagagcgccucuccuccuccaaaggaaggcagcuccucgcuagcaacggaacaaagaucggguuauccacaaagggaagcccaucagacuaacaguggaucucuuggcagaaacuacaagccagaagagagugggggccaauauucaacauucuuaaagaaaagaauuuucaacccagaauuucauauccagccaaacuaagcuucauaagugaaggagaaauaaaauccuuuacagacaagcaaaugcugagagauuuugucaccaccaggccugcccuaaaagagcuccugaaggaagcacuaaacauggaaaggaacaaccgguaccagccacugcaaaaacaugucaaauuguaaagaccaucgagccuaggaagaaacugcauccacuaacgagcaaaauaaccagcuaacaucauaaugacaggaucaaauucacacauaacaauauuaaccuuaaauguaaaugggcuaaaugcuccaauuaaaagacacagacuggcaaauuggauaaagauucaagacccaucagugugcuguauucaggaaacccaucucacaugcagagacacacauggacucaaaauaaaaggauggaggaagaucuaccaagcaaauggaaaacaaaaaaaggcagggguugcaauccuagucucucauaaaacagacuuuaaaccaacaaagaucaaaagagacaaagaaggccauuacauaaugguaaagggaucaauucaacaagaagagcuaacucuucuaaauauauaugcacccaauacaggagcacccagauuaauaaagcaaguccuuagagaccuacaaagagacuuagacucccacacaauaauaaugggagacucuaacaccccacuguuaacauuagacagaucaacaagacagaaagucaacaaggauauccaggaauugaacucagcucugcaccaagcggaccuaauagacaucuacagaacucuccaccccagaucaacagaauauacauucuuuucagcaccacaccacaccaauccaaaauugaccacauaguuggaaguaaagcacuccucagcaaauguaaaagaacagaaauuauauaacaaacugucucucagaccacagugcaaucaaacuagaacucaggauuaagaaacucacucaaaaccacucaacuacauggaaacugaacagccugcuccugaaugaacuacuggguacauaacaaaaugaaggcagaaauaaagauguucuuugaaaccaacgagaacaaagacacagcauaccagaaucucugggacacauucaaagcaguguguagagggaaauguauagcacuaaaugcccacaagagaaagcaggaaagaucuaaaauugacacccuaacaucacaauuaaaagaacuagagaagcaagagcaaacacauucaaaagcuagcagaaggcaagaaguaacuaagaucagaauagaacggaagaaaauagagacacaaaaaacccuucaaaaaaucaaugaauccaggagcugguuuuuugaaaagaucaccaaaauugauagaccacuagcaagacuaauaaagaagaaaagagagaagaaucaaauagacacaauaaaaaaugauaaaggggauaucaccacugaucccacagaaauacaaacuaccaucagagaauacuauaaacaccucuaugcaaauaaacuagaaaaucuagaagaaauggauaaguuccuggacacauacacccucccaagacuaaaccaggaagaaguugaaucucugaauagaccaauaacaggcucugaaauugaggcaauaauuaauagcuugccaaccaaaacgaguccaggaccagauggauucacagccgaauucuaccagagguacaaggaggagcugguaccauuccuucugaaacuauuccaaucaauagaaaaagagggaauccucccuaacucauuuuaugaggccagcaucauccugauaccaaagacuggcagagacacaacaaaaaaacagaauuuuagaccaauaucccugaugaacaucaaugcaaaaauccucaauaaaauacuggcaaaccgaauccagcagcacaucaaaaagcuuauccaccaugaucaagugggcuucaucccugggaugcaaggcugguucaacauacacaaaucaauaaacguaauccagcauaucuacagaaccaaagacaaaaaccacaugauuaucucaauagaugcagaaaaggccuuugacaaaauucaacagcccuucaugcuaaaaacucucaauaaauuagguauugaugggauguaucucaaaauaauaagagcuaucuaugacaaacccacagccaauaucauacugaaugggcaaaaacuggaagcauucccuucgaaaacuggcaaaagacagggaugcccucucucaccacuccuauucaacauaguguuggaaguucuggccagggcaaucgggcaggagacagaaauaaaggguauucaauucggaaaagaggaagucaaauugucccuguuugcagaugacaugauuguauaucuagaaaaccccaucgucucagcccaaaaucuccuuaagccgauaagcaacuucagcaaagucucaggauacaaaaucaaugugcaaaaaugacaagcauucuuauacaccaauaacagagaaacagagagccaaaucaugagugaacucccauucacaauugcuucaaagagaaaaaaauaccuaggaauccaacuuacaagggaugugaaggaccucuucaaggagagcuacaaaccacugcucaaugaaauaaaagaggauacaaacaaauggaagaacauuccaugcucauggguaggaagaaucaauaucgugaaaauggccauacugcccaagguaauuuauaaauucaaugccauccccaucaagcuaccaaugauuuucuucacagaauuggcaaaaacuacuuuaaaguucauauggaaccaaaaaagagcccgcauugccaagacaauccuaagccaaaagaacaaagcuggaggcaucacacuaccugacuucaaacuauacuacaaggcugcaguaaccaaaacagcauguuacugguaccaaaacagagauauagaccaauggaacagaacagagcccucagaaguaaugccacauaucuacaacuaugugaucuuugacaaaccugacaaaaacaagaaauggggaaaggauucccuauuuaauaaauggugcugggaaaacuggcuagccauauguagaaagcugaaacuguauccuuuccuuacaccuuaugcaaaaauuaauucaagauggauuaaagacuuaaaugucagaccuaaaaccauaaaaaccuuagaagaaaaccuaggcaauaccauucaggacauaggcaugggcaaggacuucaugucuaaaacaccaaaagcaauggcaacaaaagccaaaauugacaaaugggaucuaauuaaacugaagagcuucugcccagcaaaagaaacuaccaucagagugaacaggcagccuacagaaugggagaaaaauuuugcaaucuacucaucugacaaagggcuaauauccagaaucuacaaugaacucaaacaaauuuacaagaaaaaaaacaacaaacccaucaaaaagugggugaaggauaugaacagacacuucucaaaagaagacauuuauucagccaaaagacacauggaaaaaugcucaucaucacuggccaucagagaaaugcaaaucaaaaccacaaugagauaccaucucacaccaguuagaauggcagucauuaaaaagucaggaaacaacaggugcuagagaggauguggagaaauaggaacacuuuacacuguuggugggacuguaaacuaguucaaccauuguggaagucaguguggcaauuccucagggaucuagaacuagaaauaccauuugacccaggcaucccauuacuggguauacacccaaaggaugauaaaucaugcugcuauaaagacacaugcacacguauguuuauuguggcacuauucacaauagcaaagacuuggaaccaacccaaauguccaacaaugauagacuggauuaagaaaauguggcacauguacaccauggaauacuaugcagccauaaaaaaugaguucauguccuuuguagggacauggaugaagcuggaaaccaucauucucagcaaacuauggcaaggacaaaaaaccaaacaccgcauguucucacucauagguggaaauugaacaaugagaacacauggacacaugaaggggaacuucacacaccggggcuuguugugggguggggggaggggggagggauagcauuaggagauauaccuaauguuaaaugaugaguuaaugggugcagcacacuaacauggcacauguauacauauguaacaaaccugcacguugugcacauguacccuaaaacuuaaaguauaauaauaaaaaaaagaauauguuuuguauuuaaacuaguggauauaaaaaauauaaaagcuguuuccaauauaugaucacauaugaacacucauucaaauacuuauguaaucaagagauauuaauguaaaucuuagucuuuuugaagaauguccuagcaggaugcuaagauaauaaauguagguucuggacacucacuggccuaauuagaauagcaaugcacugaacuuagcagucugcugugcagcaaaagcguaacuaaccucuuuacagugucccuggggagcgucuuaggugcacagaccagcuccaaacagccagguauaaaugucaacaucacaguguaaucaucuuagucaguauguggugcuauaacaaaauaccauggucuggguaauuuauaaauaauaggaauuuauuucuuccaguucugugaggucugagaucaaggagccagcagguuuggguguuuggugagggcuacuaucugcuuuguugccaccagagggcacaaauguuguucucgcaugguggaaggaauggaaggcaaaaaguggugaacucccuccaucaaauccuguauaaaggcaccgaaucccaugcaugaaggcagagccucaugacucaaucauauccuagaggccacaccucuuaauccuguugcauuguggaguaaguuucagcaugaauuuuggaugggacaaaaacauucaaaccagagcaguaauggcaaaagcauuggacuaagaacugaagaucugggcugacaucuugagcugaguccucuccagcccugaagucucccaauaaaccuuugugcccuacuucacagggugguaugaguuguguggaaauauucugaaaaguacuaugcaguuuuaaaacacugcuuuaaagagauaaacaauuagggaaaaaaaauggacgucuuaaaagcaaagauccaagcuccuguaugugaaaaacagacuuuuauuuugugagauuuuucuuaccuucaacuugugaaauguaaagaguaacacauuuacccauuuucuucuauuucaggugcguauaauuugcucugcgucgacuccuauaucaagcuuauuuuugcaucaacaucaugacagugaguuggagcaaagcagaauacugauggaugauuuggggcugagccagguaggcgauauuaacauaaucucuuuuuauuauaaaacagcuuaauuguuuuugguuugaugcauggcuacauuuugaagaagaaaugcaguguauaguuaaccauugauuggcgcuucuucuauaagcccauguagcaaauuuaucauucucaauaucacugaauauagaaaauuauaaacuuacaguggaaggaaccuuaguggucauguaguucagugcuccauuuugcaugugauaaaaaugaagcccacggagguggacuaaggugcccacagucacacugcugaauaauggcaggccagagcuggaugccaaaccaccugugcccgguucugggcuugcucugcuauaccaugcugcccuuucuggguaucuuucuaaaugauugcuggauuuguagagugcaugauacaguauccaagcauguaggcuggcuaguccaggaccauggagugccuagcaaggccccaggcuugaaaagaaaucccuaacuaaucucucaaccuccauucugcaaacauuuauggaguaccugugggugccaggcucugaggacacucuguagggaacaaacagaugcuaguccaguucuccuggagcuuggagucuggugauucaccccaggccaacuagaagugacuuugcguuuucuucuucuauaagaacguuaugagauguguuucucaacuaucgacaacugaaauauuagucaaaaguuuacaacuaucaacacucaccccaugaggggagcccaauucuuccagccccacaggugaaagaccucuggaacaaggaaacaauuccuuaucaaccugaauagaaaugaggcauuuucaggaguuugggagaacgaggccaauuuaaaaagugaacuuuccaauaugaugacuuaaaccuauguguaugucuuagucugcuauaacaaaacaccaugaacuggguagcuuacagacaacagaaauuuauuucuaacaguucuggaggcugggaaguccaagaucagggugccagauuuggcaucugaugaaggcccacuuccuaguuccuaagccucugucuuuucuguauaaaccucacaugguggaaggggugagggaucucucuggggcauguuuuauaaaggcauuaaucccauucaugagggcuccacccacaagaccuaaucaucucccaaaagcuccgccuccaauaccaucaccuuauggguuaggauuucagcauaugaauuuuggauguacauaaacauucagcucuaaccuagaacaguuucauccugaaaccaucccccugccccugguccauggaaaaauugucuuccacgaaacuggccccuggugccaaaagguugguaaaguuuacaucauuggcucuuaaaacuuuuuuccccuaggcuggugcaaugggucauuccuacaauccuagcacuuugggaggccgaggugggcagacugcuuugagcucaggaguucaagaccagccugggcaacauggugaaacacccauuucuacaaaaaauaaaaaauaaaauaaaaaaaauuagcugggugugguggcacacaccuguaauccuagcuacuggggaggcugaggcaggaagaucacuugaacccaaaaggcagagguugcagugaggcaagauggcaccacugcacuccagccugggugacagagugagacccuaucucaaauuccccuaggaucaagaaaaaauaagcucagcagacagagccaaucaugcaugaagaaaucagggaaugugaucucagggucaugaagguucacaauggaucaguggagaagauggacuuaggaaucuagaauuuuucucugaaaaagcauacuagcaaaccccuaaggaaagagaaaaauuccaagcccacuuaguggccaugagucuguguugguaucaccagucugggguuaccagccucacagagacagaguuucccaauuugguccuagauggugggaucaguugucccagcagcugaagacuaaaaacagcccugccuuucagcccuggcuuuuagaucccaggcacauucuccagaacccagacccacugcucauuugcauuugcucuccuuuagucauugguuggauuggaaaacgcucuccagagguuuguccuuagggccucccccuuaggcacugggacccugucuggaggccuacaccagccucuuucuagcuucucagaacuacugguuuuuuuuuugccauuacuuauuucugguguacacuuuuggagaaaguuuucccuuuuaaguuuucucucugauaauuugauguguuuacugccuaucaguuuaaauugguugacucucuagucucauuuaagagauuguauauggaaaaaaaaaguuauaaaaaaaggcauaaucuaaaccgguaagccuaaaaaguuuuuuuaaaccuauacuuagguucuguaaauuuucauuugugauagcuuuauuuuaauuucuuuguuuuauaaccaggauucagcagaaggacucuccauguuuaccggagaagaggaaaucuuugcauuucagcgcacaauuucccgacucacggaaaugcagacugaacaguacuggaaugaaggagacagaaccaagaaguaacugccacuuuugcauaaauaaaacucuagacaaaugguuaacgcaggcagaacuccuuauugugggacuugaaggaaucauuuucucaucauuaauuaugcacuuuguccucuggaccauuuuaaucuaaaauugcucucaaggaucuaguggauuaguaaguuaaacacuuaacauuuuuuaggucugcuuuuucuuauuuggccuuauuucugcaccaugaaauuaaaaucaucucauuccugaagaugaauguaggaccagacauuuuagcuucacauuaaaccaccugaaugaaccuugaaugcacaaguaaaugcaagacgucuggauaccuucaagcuuuggcugcauggugguggcauguuagaaauacaucuuuuauaaugggggaagaaugcccuauguuucaauucaaaacaaagacaguuuuccaaucugauauaaacuaaaagggauaauauuuuagaauaugggcuuauaugugguuuuuuuuuuugguuaugaauuacaguaaaucucccaggccuucagauuucuacauaauggaagaauauguuuuuaacccugagaucaaguuuaguaggcaggacuugaucucaaguggucacaaaguuuucuaa

SEQ ID NO: 192134 - RNA, 90523 nt, Homo sapiens
acgucucccuuagcgagcucgcuggggacacgcagggggagggaaaacugagcggggcgggaacuaucuccucucgcgagagcuggcgacggcggcggcagcggcagagguggcggcggcguguccgugagaguggcgugggggcggggaggagaggcggcggcggcaguguccaagcuacgccacucgggccggggcguugggagcgggagugcagagcguggucguggcggcggcggugagaagagcgaggcggaggagggggugccauggccgggcagcaguuccaguacgaugacagugggaacaccuucuucuacuuccucaccuccuucguggggcucaucgugaucccggcgacauacuaccucuggccccgagaucagaaugccggugagucccgccggccuuugcccgcgaacccgcgcaggccccgccagcgcccccaggcccugcggcgcccgcuugcccggccccagcccgcggcguccgggaugacagggacggugcggcccggccuguguccagcguccgccacuggcggggcccgggucagcagcguuucccucggcgcuucuccaccucccuucauuguccucaggaguuucgcucgcuccaucuucuccauuguuguggacgcuccuugcagccuccuccugccucuuugucuucucugccuuugcuuuuauuggggauuuuucuuuauggaggaagcgggauggggacuugggaggugagcaaagaguuggccaagaagagacugaacgugcgggcacaacucucaguccguccaguucgcggcccucaucccccgacuccgguuucccuguugcagcugcucuuaacagauguuuuagggcaucucugagccggguggcaugcuuaggacuccaauugagcuuuccaccgccuacccccgucacuuccucccguugcuuuuucauuuguucacucacuguggggguuggaagcaaugccguuauuccucuuagcaaaaauaggcuuuuuucuauuuccuuuucuucggaguuuccuguuugugacggaaaaagugcaaguaugaaggauuaagucucguuuaauuaaucuuguagggaauuuugagguagugggucgauuuacuuuugguucuaagucuuuucacauuaaacaacaucgaauuaaagcacagaauaacagauucuuuucauauuucacuugauguuuggguaauguuugcauccauuuguugcacucuacuaggacauauggcagaugguauucuuaaagcugauguaacugcgagggccuaauggguuauuuaugguaguguuaacaguaaggaguggguuuugaguauuaacaacuuagggaaagcuuucuauugcacaagagcugugcuaacuugcuuaaauaucuucucuucaauugggugugcuggaggucuagguuguccagguuauauacucuacuuggagaaguuguuaacagugaagccuugaaucagcucagaacuuguuauacuuucagauggauucaguguccuguaacauucuuuuucccccccgccccaugugaucugcaggaaacuaacauucuugacuuggaauagaacuaaaauaaauuuaggauaaauaguaacaaaggauugcaucauuuuguacguuugacaauaaguuuaaaaauccauuagaugcaaaaaucuguccaaaguuacuagucuuaauacuuuuuuuacucaauggguaguuuaugaaauuuggaucuuggacuguugugccuuauuuccuaagugcauuuaaauuguguagguucuuccucgauguugaaaaaggaaaaaaaauuggguagguucuuugggcagugauuguguauaagugaagucuuaaugcuguaauggcuuuucuuaucugcaaaccuaggccauucuugugguuguuguauuucaaguuaaaaggguacacuuuucaguaguuuauuuucaccuaacagccauuaugugugcaauugguaguguagaaaacaaaaagguauugggagaguagucgguggguuuggccagaauguguuuugaucaggcagaacaaagguauaaaaaaaaguguuuugagaaacugcccugauuucagaaauuagccaucauuuuuuaaucuacauuggauuuuuaaaguuguucuuuuuuucuuuuuaaagcggggagagucucauuuacccaggcuggucuugaacuugcuucaagucauccucccgcuucagccccccgaguagcuggccuuacagacuugagccacugugucaggauggauuuuugaaauuugaaagucauauuuucauggugaguuucguauuauaaaauucaccugauuucauagaagaaucauacuauuuauuuauuuauuuauuuauuuauuuauuuagagacagagucucacucuguugcccaggauggagugcaguggcuugaucuugacucauugcagccuccaccugcuggguucaagcaguucugccacagcuuccccaguagcugggauuacaggcgugcaccaccaggcuuggcuuauuuucguguuuuuaguaaagaugggguuucaccauguugaccaggcuggucuccaacuccugacaccaagugaucugcccuccucgggcucccaaagugcugggacuacaggcaugagccaccacgcccugccaacaagucauacuugacccccuucagcauguaagugucuuugaaaaaguggugguaguuuagguggagggaauuaauacuauuuguaaaucauggacuucaacuuuuacuuuauuuaaucuucuuaaaaaugcagugagguuggccgggcaugguggcucacgccugccguggcucacuuugggaggcccaggcgggcggaucaccuaaagucaggaguucaagaccagccuggccaacauggugaaaccccgucucuacaaaaauacaaaaaguuagcugggagugguggcggacgccuguaauuccagcuacccgggaggcugaggcagggagaauugcuugaacccgggagcuggagguugcaaugagccgagaucgugccaccacacuccagcaaugcagugagguagguucuauuauuaucuccauuuacagguaaagaaacugaggguagagcauguaaguaauuuuccuguaugguugaacugggauuagaacauuggucgcuuagcuucagagcccugugugguuuccauacugcuagauagaaaguuaggugaacuauuaugggugucaguuugcccguuuuacauccggcucucugcuucaggcuugccuuaguccauaugcauauuuugauguauuuguuugcucuugcucaaaauuguguuaugaaaauuaaggugaauacuuaaaugcuauucuaaucauuaugaaaauuguugggcaccacuuggacuuuuuucuuggauuuacccuaauaacuugaguuguuucuguggaauuacaguuguaguaaaaggauguuuucaucauagugacuuuuuuucugcagcccaguugcaguaucuugaauaugaaagagaaaucuugaauuacugccucauucaaagcucugaauaaggaacuuuuuucagaaguuugcugcaaaauaauuugccgacuuguacugacaggaggcuacugaauaaucuuuaucucacuuaauaaauaguuauguucugucuuggaauauuaauuuguuugguuauuggugcacuuuagaccccauagggucuguuugaguguaaacgcuguguuacuuuucuaaaaucugaaaaauucuuuuuuuuuuuuuuugauuuuuuuuuuuuuuuuaauugaucauucuuggguguuucucacagagggggauuuggcagggucauaggacaauaguggagggagggucagcagauaaacaagugaacagaggucucugguuuuccuaggcagaggacccugcggccuuccgcaguguuugugucccuggguacuugagauuagggaguggugaugacucuuaacgagcaugcugccuucaagcaucuguuuaacaaagcacaucuugcaccgcccuuaauccauuuaacccugaguggacacagcacauguuucagagagcacaggguuggggguagggucaccgaucaacaggaucccaaggcagaagaauuuuuccuaguacagaacaaaaugaaaagucucccgugucuaccucuuucuacacagacauggcaaccauccgauuucccaauccuuucccugccuuuccccucuuucuauuccacaaaaccgccauugucaucauggcccguucucaaugagcuguuggguacaccucccagacggggugguggccgggcagaggggcuccucacgucccaguaggggcggcugaggagaggcgccccucaccucccggaccgggcggcuggccgggcggggggcugacccccccaccucccucccggacggggcggcuggccgggcggggggcucacacccccaccucccucccggacggggcggcuggccgggcggggggcugaaccccccaccucccucccggacagggcggcuggccgggcagggggcugaccccccaccucccucccggacggggcggcuggccgggcagaggggcuccucacuugccaguaggggcggccgggcagaggcgccccucaccucccggacggggcggcuggccgggcggggggcugacccccccaccucccucccggacggggcggcuggccgggcggggggcugaccccccaccucccucccggacggggcggcuggccgggcagaggggcuccucacuucccaguaggggcggccgggcagaggugccccucaccucccggacggggcggcuggccgggcggggggcugacccccccaccuccuucccggacggggcaaaucugaaaaauucugaagcacauuuguucuuaaggauuuuaaguaaaagaugaggacccccguaguacaguuuuggggaaacacaacagcauauauaaguauuuuuauuuuuugagauggagccuugcucugucacccaggcugaagugcaguggcgugaucucggcucacugcaaccucugcuucccguguucaaacgauucucgugccucagccuccugaguagcuaggaaaacuggcgcgagccaccaugccuggcuuauuuuuguauuuuuaguagagaugggguuucaccauguuggccaggcuggucucgaacuucugaccucaauugauccaccugccucggcgucccaaaguccugggauuacaggcgugagccacuguucccuggccacagcagcauauuuuaauacuuguuuuugaggcuuaguuuauuuaguuuuccugugaaacaguuaaguagccaaauacaaaaauguaggcaugcguuugaauuucagacuucugacaguauuuucagagauagcaugugcaugaaagcaugaaaagguuugcucuggcaguuacacaaccuuaaaguucaguuuaaguaauuuuuuuuuuguuuguuuuggcaugaagucucgcucuguugcccaggcuccagugcaauagcaagaucuuggcucacugcaaccuccaccucccagauucaagcaguucucccaccucggccucccaaguagcugguauuacaggugccugccacuacgcccggcuaauuuuuguauuuuuaguagagacagaguuucaccauguuggccaggcugguuuccaacuccugaccucaagggaucugcccaccucggccucccaaagugcugggauuacagcugugagccacugugcccggcccaguuuaacuaaucuuuauugagguuuuuuuuuguguguuuucugcaacacauuugggacuuucaauuuuuaagguugacagucguuucagcauggcuguuuuggaauuagugggcucuugaauacaccagaaagcauagcaccauuucacagcuuguaaagucugcgguuugaaaaauggaaauaguucguuuauuggcauauuugacauguuaauugaacguaccuguuaucuaaaacauuauuaauggaauacuuuugccuugauuucugcuuaacauguuuagcuaagcguacuuauaauuaauaccccuuuuaguaguuauuuguuuuacucucuugguuugcaaauuggcugaauaaaaugaauauuucuucagacaauuaaggacaaaagcucuguaugcaaugauaacacggagggcuuagauuuccuuggcauagugauucuuaacccuggcuacacauuagaaucacuucgggaacuuuuuuuuuuuuuuuuugagauggagucucgcucugucacccaagcuggaguggaguggcgcggucucagcucacugcaaggucugccuccuggguucaccccauucuccugccucagccucccgaguaucugggaccacaggcgcccaccaccacgccuggcuaauuuuuuguauuuuuaguagagacgggguuagccaggauggucuugaucuccugaccucaugauccgccugccucagccucccaaagugcugggauuacaggcuugagccaccgcgcccggcccacuucgggaacuuuuuaaaacacuuguacccauccccagauacucugauuuauuuggucuggaguggguguuauguacugguauuuuuuaaauaucccuauaugauucuaaauuguagcuauguuugagaagugcugcuuggaggagagcuuccuuaguaauggucuuuugcuguaguugccauuuugggagguaguauauuuguuuugcuaugugcucuuugcuaacaacaacaacaaaauccaaaaaacuaauguguuagccuuuuuguuuuacauagcuaagaagcacuuacagaacaguaacguaaaguucugggaguuaaaagccagauauuuuugucaaacaacuuuaaugauacaaguuuacaaucaguuuaucauaguugucuauuaauggcuuccagaguauuuaccauugugcuaugauuggagccuuauguaauuuggauauccuuaacauuuugaaauaauugcacauaauuaccuuaacacuacccaucuuugguauugccaacaauacugugcugugaccuuuuguguguacugcccacuuugugcuuucuuguaauuguuaauguuugucuuuccuagugcuuuuaaaaugagaaguguucuuaauguuuauguggaauuucaauccaaccauuauuuguaagugcauaauuuuguuuacugcuuuuuugauuuacaauagaagaguuaucacuuuaaacauuuuauaucauuaggcuuucauugauauauuugacaagaguauuaucugacaagagaaaauaacugauugcuuguaauuauuagaauuucgaauaaucaaaagcaugcuuuuauucuuuccguagguuauggaaagaauuccuuuugaauugagauaaaauguaucauuuaaaaaaaguuuuuguugacuccuugaucuuacuuuuggggcuugaucuucccuuuucaaaacuuacuuaaccuuacuuuuucaaaaugccugguuuugaaauguggcucugcagccuacuguaauuuuaggcaaguuauuuaacuuccguguguuucaguauacucaucuguauugguuacugauuuaacuucuguguaucucaguauacucaucuuuauuggucauacucaucuguuacggucagagaagauacuuuguaugauaucugucuuucaaaauaaaauaucuuguggcuuaacauauagucuauccugcaaaacgucccauggcacuucugaacaauguaugugcugcugcuguaggguagugagcguuguauaugucuguuagaucuaguugguuuguguuaaguccucuauuuccuuaucuucuuuuugguuguucuauccauuuuuggggauggaggguguauugaagucugaaacuauuauuguagcacugucuguuucucucuucaguucuguugguuuuugcauuguacauuuugaugaucauuagauacguaaauguuuauaaauguuauaucuucuugcuguauugaaccucuuacuaauauguaaugucuuuuaucucuuguaaucuuuuuuguuuuaaagucuauuuugucuuauagucaccacccugcuaucuuuugguuacuguuuccauggaauauuuuuuccauccuuucaccuucaaucuguuugugucuuuggauauaaagugagucucuuguagauggacguaguuggaucaggugcuuuuaauccauucugccagucuuuugauuggaacauuuaaccauuuacauuuaaaguaauuacuguuaaggaaggagggccaggugcaguguuucauuccuguaaucccagcacuuugggaagcugaggugggaggaacacuugaguccaggaguuugaaccagccugggcaacauaaugagaccguguuccuacaaacaaacaaacaaaaaaauauuagccaggcaugguggcacgcaccuuuaguccuagcuacucaggaggcugaagcaggaggaucacuugagcccaggagaucgaggcugcagugagcuaugaucaugucacugcacuccaaccuggaugacagaaggagacccugucacacacaaaaaguaaaaagaaggaccucugucauuuugcuauuuguuuucuauaggcauauauccuuuuguuccuuauuuccugcauuacuauuuuuuuguuuagcugauuuuuuuuguagugaaauguuuacauuucuuugcauuuucuaauuuuuauuuuauuuuauuuuuaaauagagacuggguuuugccauguugcucaagcuugucucaaacuccugggcccaagugaucuaugucucggacucucaaagugcugggauuacaugugugagccacugcucacaucucauuuucuuuugaguauauucuguaguuacuuuuugugugguuaccauggggauuacauuaaacauccuaaauauuguaauuucaauuuauaccaguuuaacuuugacauauaaaaacucugcuccuuuauagcuccuuucccaccucuuucaguauuugauuuccccuaauuacaucuuuauacauugugugccccaaagcauaaacuaauaauucuuuuaaaugcauuaguuuauuguuuagaaaacaaaguguggauguaggggccaagggaaacuucccuuuugcccucugaagauuggcugaaaaaucaacucagacaagguggauuaauuggaggaaagacauacacauguauuuaaugugaacauggggcgaaccacagagugauuccccacaucccaauguaguucagaagcuuauauaccauccuggugaaacagguuaugggaagggggagaagaggaauucuguugauaggauugcuagggacaauggaucagagaacagagauuaacuuguacauuaucuugugaagggucuguuuaggugugguuaccuucuugguccuacaggaggagaagaaaagcaguuguucguuuuggugggucuggaucuuaggcagaugaaggcuuugggauaugguggggggcaucaggagggcagggaggaaagucagagagaccuugaggcuucuucauucagcaugucaaaaugccauauuuuggguaucacugagccccaacauggagguacaaaccaaggaacuaaaauugaccaacagccuucguaauuuacccuccaagccuuucccggaaaguugcaagccuucaguagacuccagaguuacaucuagacucagcucuguugcuguucagugagugagugcuagcuagccugaagguggguagugcggaaugcacucacgguagcacuuugagcuagauucauguauuaucucauuuuauucaugagaaaacugcguccuagaggagguuaccaacuuuccuaaagucauacagcuaccagguggaagacuguuuguuggacucaacucugucuuaugccagagcaucucuuguuagccacuacucucugcugccuccuguaauuaaguaaauauaacacauuacgauauguguuaaaauggcuaguggaaggugcuuugggagcacauaggaaggaguaaauaauuauauuuugggauuuggggaaguguuucaugcagaggaggugacacgagauaggucuuaaaagguaagugggagaagggcauuccauauauaggggaaaguauaugcaaaagcauggagguguuuaguaaaugguaaagauuugaaugugauuggcacuuacgaccaacucagguauuuuaagaggguuauacuuuauccuguaaguuauuugguaaacaauggagguuuuaaaguaugguaauaaaacauggucaguuuggcuuuuguggaauauuguguggagaaugguuugguggguggagggggagguuggugauggcugggugggaaacuagauggaggggguguccauuucagaggcucuuuccagugacagguggucagauuagaaagagaauucuaagaaagcuuggacuguuuauugaauauaaguacugaggagagaaugagaguggagugcagauuuugaauuuucacucauuucuaggauuacuuauuucuuguccucuugaaagcuuuuggugauuggcccaaugaucaguuuggggauuuaagugcagggaaaagaauggggaugaauuuuuuuuugagacuggaucucauguuguuacccagguuggagugcaguggcaccaucacugcuccacugcaaccucaaucuccugggcugagccauccuucugccucagccucccgaguagcuagaacugcacgugcacaccgucacucccuauagaguuguaauuacaguaggauggguuaucucagucuccuguugagugguuugguuuuuuuguucuuuuuuuugacaauaacuucuuguccgauagugaguguuuuuguuuuuuguuuuguuuuguuuuugagacagggucucacucugucacccaggcuggagugcaguagcacaaucuuggcucacugcaaccucugccucccaggcucaagugauccucccaccacagccuccaaguagcugggacuacaggugcgccaucauacccagcuaguuuuuauaauuuuuguagagauaggguuucaccaggucaccaaggcuguguuuuuuaacauuagaaaaaacuagcuuguaucagcuuuguauucaaagggauaugucuuaauguucauauuuagagcuuaugguugauguuugguuugagacagagucuugcccuguugcccaggcuggagugcaguggcaugaucucaacucacugcaaccucugccuccuggguucaagugauucuccugccucagccuccugaguagcugagauuacaggagcccaccaccacgccuggcuaauuuuuguauuuuuaguagagacgggguuuuuccauguuggccaggcuggucuugaacuccugaccucagaugauccgcccgccucagccucccaauguguagagcuuacaguuuucucaggcuuuagcucuugaaggaauauuagcgaucugauaaaacuuuaaauuguuuuaaaaaguuauuccuucuuuguucuauccugacagagggguguaucagacaugcagcauauacacacuuaaguccuauacagaggaaagcaguugggaacuuggcaguaggaauuacaggacaacaugaagguuuuauaaauguggugacaaacauuagauuaauaacugcauuauguuggccgggugugguggcucacaccuguaaucccagcacuuugggaggcugaaggcgggcagauuguuugagguaaagaguuugagaccagccuggccaacauggugaaacuccgucucuacuaaaaauaccuguaaucccagcuacucgagaggcugaggcaggagaauugcuuggacccgggagguggaggaugcagugagcagagauugugccacugcacucuggcccgggcgacagagugagacucuugucuaaaaaaauaaaaaauaggucaggugcgguggcuuaugccuguaaucccagcacuuugggaggccacgguaggcggaucaugaggucgggaguucgagaccagccuggccaauauggugaaaccccgucuuuacuaaaaauacaaaaauuagcugggcauggugguacacgcuuguagucccagcuacucgggaggcugaggcaggagaauggcuugaaccugggaggcagagguuacagugagcugagaucgcaccacugcacuccagccugggcgacagaguaagacuccgucucaaaaaauaaauaaauaaauaaacaaacaaacaaaauacaggaaaaaaaccgccugcauuauguaaaauugcuuuuauuuaaacaucuuguugcauaucugcuugaucuugggaggaccugauaaagauaggcuuauuuucuuuucuuagaugccuguucccuuaaucauacuuuuuauucagacauaaagaaggugauuacaaauguauucauaaauugcuuagacuuccuuuuaaaaauguuuuccuauuauuaccagacuuuauugaugacaaauguuguuacacuauuucaccaucacauuguuucuuugaaaggcgaugcuguucauucuuuuaaaaagauguucucggcugggcucgguggcucacgccuguaaucccagcacuuugggaggccgagggggguggaucacgaggucaagagaucgagaccauccuggccaacauagugagcccccucucuacuaaaaauacaaaaauuagcugggcguaguggugugcaccuuuagucccagcugcucgggaggcugaggcaggagaauugauugaacccgggagguggagguugcagugagccaagaucgcaccauugcacuccagccugggcgacagagugagacucugucucaaaacaaaaaaaaaaaaaagaaaagaaagauauucuuuacauuuuggaauucuguuuaugucaguaggaguuuucucguguagauuccaacucuuuuuuugcuuuagauuuuuuuuuuuuuuuuuugagacggagucucgcucuguugcccaggcuggagugcaguggcggguucuaggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuagauuuuuguuuaguuuuaguaguuacugauuaagcguucacuguuugaccguacagguacagcagaugauacaaugaugaaugcaguauaaacauagucuuauuuugguagaauuuguaacccagguggggugacaggcuuaggauuagacuaaugcacagacuccaaaauuucuauuuccaggcuagacuucuuuauuuuuauuuuuauuuuuauuuuggagacaagaguuuuacucugaucuagguuggaaugcaguggugugaucgcggcucacugcaaccgccacuucccggguuuaagugauucuccugccucagccuccugaguacuugggauuacaggcauacaccaccaccugcagcuaauuuuuguauuuuuaguacagacggguuucaccauguuggccaggcuagucuugaacuccugaccucaagugaugugcccaccucggccucccaaagugcugggauuacaggcaugagccgcugcaccuagcccagucugaacuucuuuccucagacuccagacuuguguguauaagugcuuaacccacauuuccacuuggauaucuaauagagaucuuucuaugaauaugcacaaaauugacaggauuacuuucuuccccuccccuccaaccuucuugacccauaaccuuuaucucaauuaaucacaacugucuuuucagcuguucaggaaagaagucuugggagucauucuuuauuuuuuauuuacauuuuuaccuuuaagcucugguggacuggauuagaaguuacucuugauucaucucuuucucauacuccacuuucagacuacuaguauguucuuuuggcucuaccuuugaaauacaucguguccgaccauuucucaucacuccaccaacaccacuguccugguuuauugccuagauuaucauuagcuuccuaacuagucuguuucuacccuggcugaguguagucuuuucucagaauauuagcaaggauccuuuauaacagaagucagcucauacaguucugcucagaacucuucagggaucugucucaaucugacuagaagcucaagucuuagcgaguauccuguaaaguccuucguggucucuuugaucacuuugcuguuuccauuccagccauacgugcuucacugcacuuuugaacacagugaaacacacucuuucagucuuuuacugguugcugcucccuuugccuggaauacuuuuccucuagauagucacauuaccucuucccucaucucuguugucuuugcucagaugccaucuucccugagcuuccuauuuuaaauuguaguguuucuuaccccuaccuuacuaauuuucucucaaaagaacccuucaacaacauggguuugaacuauguagguccacuuauacguggauuuuuuucaguaaauauauuggaaaacuuuuuggagacuuguaacaguuugaaaauguuuugcagaagaacuguagccuagaaauaucaaaaagaaauuaagaaaaagguauguuauaaaugcauaaaauguauguagauacuagucagcuuuaucauuugcuaccauaaaagaaacacauaucuauuguaaaagguaaaauuuaucaaaacuuauucacacaaacacuauagacaggacauggagccauuugcaguugagagaaauguaguauuaaaucauaacuguguaaaguuaacuaguguauacuacuguaauaauuuuauagccaucuucuuugcuauugcagugagcucagguguugcaagugucugcuuaaaacaucgugugacgcuaaucaucucugcgugagcaguuugucucuucaguaaauuccauaucaccauagaaagugaucucuugagguucucuuguauuuuucuuuguauucagugugauaccauaaaccuugcaacaccaugggacucauacagagugccacuagugaugcucuaagugcuccgaagaagaaaaaagucaugauaauaccagaaaaaguugaauugcuugauauauacuguagauugaggucugcaacuuguaaacaggugacauaaacuuaagguauuaauaacaguacuguaaauauauuuucucuuccuuaugauuuucuuaacauugucuuuuuucuagcuuuauuguaagcaugcaguauauaauacauacacaaaauauguguuaaucaacuguguauguuauccauaaggcuuccagucaacgguaggcuauuaguaguuaaguuuugggggagccaaaaguuauaugcagauuugugacugcacaggggguggggacagggccccuaaccccaacguuguucaaggguuaacuguacuauauaauuuacuuuguuuauugcuauggucuuugagagcaggguuuuuuguuuuguuuuuuuucuauauccucaguguccagaaaaguccggguacguaguggauauucaccaaauauuuguuaaauaaaggaguucaucauucucaagaaauauuuauauagugccuccucuauuccagggaacuggaaagaggaggggugaacacuguggguaagauacagucucugcccuugaacuucaguacagaggaaucaaaucggcuuuaauacuggcugcugaagaaugguggugccaacggggaaacugcugaaaaggauguauaguccuggcuuuuuuagaaaggaguuguaaaaguguuaaagcucuuaaaccuaguaauuauacuucuggggcuguguucuaaggauagaguguucugaauacuuacaggaccaaagagauccacaauaccaagaaauuagaaacauuuuauauaucuaauuauagaaugguagguauauugugguaccuuuauucauuugguuauuaguagucauuaagugauguuuauaaugaucuaaacacggggaaauguuuagaaauuuuaaaaauuaaaaauuacugcuaaugcgaccuuaacacaaacuucagcuuuuuauuuuugucucuuucaauuuguacacugauacaucauagaaaugcuauccuuaagugggcuuuuaugugucccguuuuucucuuugagaagcucacuugggcagcugcugcaguggagauaagcaccagguaucgucaacacugcaaaagggcccuuacaggcccugauugaagcagcagggcagcccucuaauugagugaagcucauuccuugggaagucaguugcuggagcuuccuucuucacagagcuguuucucuucugaggguguacguucaaccucgccaacucuccugucuccuuugcuuuuccagauauuuuccuaaauagaacuaaaaaggauacuacaaugguauuaaugauuacuaucuggguguuggauugguggauuuuuuucuuccacuguaugccaaauuuucuuucuuuuuccuucuuccuuuuuuuuuuuugagacacggucucacucuguuucccaaggcuguggauaguggcacagucauggcucauugcagccuggaucuccugggcucaaggagcugauuccucugccuucuugaggaagcuucuaaguaguaggacuauguagcuggacuauggguguguguggguagcuggacuaugggugugugugccaccacacccggcuaauuuuuaauuuuuuuuguagugaugaggucuugcuauguugcccaggcucaaauuuucuuuaugaauuuguauuaacacccaaaaucuuauuaaaacaaucucuggcuagcauugcgaucuugagcaagacacacucugcacuuaucuccagaggcccuuucagcucaaugaauuguuacuacuuugggguaugugguguuuaaaguucuggugggacauacauccuuguauguuaaguugccuuuccuucuuagcuagcauuuauuuacuuuccuaguacuugaguuucucuuccacuuucucuuuguuuuaccuguuuuugguuaaccuuuuacuuaggcuauggauuaucacuauaagauuaagacuaaaagaaaaauaggaggacagagcuaacagggugguuaguaaauuaauaaugaagcuucccagguccuccucucccuucuucccuccccgcgucccagguaaguacucaaagauacugcagcgagucuuuuuuuuuuuuuuuaagaauacuuuuaagggaaugggaaaagacaauuguugcguuuucauccauuuauucugccaacuuuuccuaucuuucuuuucccuguguuccugauauguaggucauaucguuuaacuugcuuuucauguaccgucuguagcugugugugugugccuguguauguguaugugugcgcgcacuuuaaaucaggggcaauuuugugucccagaggacauuugugaauuucugaagauuuuuuuuggucuccacuggggagcuguuccuggcaucuaguggguagagaucacgaugcugcuaaacauccuaaaaugcacagaaacauugaauuauaagaauuguauaguccaaaaugucaguagugcugauguugaaaagcccugcucuguaguacuuauuucaguaccauaaaaggaaaagaaaaagagauaauauaugauauaauuguaugcugcugucaaguaccugcuuaaggaagacaaagcucuugauuuauuugaacuacuugguuuguauugguuugcacuuagauuguucaggcauuccugagaauugugaacuuuggugguagaggggugguucugcugugauccaguguuuguuuuuuuuuuuaguucaagaacauuuucaguugccuucuagguucccuccuccauugccagaguauguguaguggauagguguaaguaggacccacguuucuguaacccuucugauuuagguaaucugugauuguguauccugggugguggugauggugaacaauauguaaucuuaugaagccuauauuccaaauccaaauaguucugaacuggccuugggaaugagacauauggcuaacuauucagauucaaguuaagagcauaaugauuaagauuacuggaugacuuuuauuuuuggucgucuagagcaguauuucccaauuuuucacuuccaaguuauuuucaugccuuuuauauucugaaacauucuggcaaacaaaccacgguuaaaggaaagauuguuuuuaaaaauuuuuuuuuuuaaauuauuuuuauuuuuaacuauuuuuuaguuuuugagacaaucucguacuuucacccgggcuggagugcaguggcgugaucuuggcucacugcagccucugccuccuaggguucuccugcuucagcauccccaguaacaggugcucaccacccacaccugucuaauuuuuguauuuuuaguagagaugggguuuugccauguuggccaggcuggucuugaacuccugaccucacgcgauccgucugccucggccucccaaagugcugggauuacaggcaugagccuuuuuuugauaguucaauuugguugguuaguuuaauaaugaaaacugccuuugccaauuagguuacaugguauauguuuucuauacaucgaauaagcuaaucugcagcuuuagguaaagcuguuuuggaaaagauugagccauacuggcagaaguguacuuuuuguuuucaaaaauaaguuuuaguuguuuuuuuuucuuugagacaccgucucaugccauugccaggcugaacugcagugaugugaucauggcucacuacagccucgaacugcugggcuccggugauccuccugccucagccuccugaauaccugggacuguagguguguaccaccacucccagguaauuuuuaaaguuucuguagggacaaggucucccuguguugcccaggcuagacuugcaccccugagcucaagugauccuccugccucagccuccuaaagugcugagauuaaaggcaugagcuacugugcccggccauuguaauauucuuucaacuuuuaugaugacuugaauauuuucaaaacaaaaaaauugggaaaaacuuuauagucacagggaauuaaaaaaauaauuuuaagaagcauauuucgguauuauaagaaaggauuuacuaggacuagcugggcgugggcgguggcucaugccuguaaucccagcacuuugggaggccaagguggguggaacuugaggucaggaguuugagaccagucuggccaacauggcggaaaccccaucucuacuaaaaauacaaaauuagcugggugugguggugcaugccuguaaucccagcuacucgggaggcugaggcauugcuugaaccugggaguuggagguugcagugagcugagaucacgccauugcacuccagccugggugacagagugagacuccgucuaaaaaaaaaaaaaaagaaaaaagaagugacuuacuggggccagauguggugucucacaacuguaauccuagcacuuugggaggcugcggagggaggauugcuugagcccaggaguuugaaaccagccugggcaacauagaccuccuugucucuaugaaaaaaaauuagucaggcauaguggcaucuuccuguagucccagcuacuccagaggcugaggugagaggaucccuugagccuggaagguugaggaugcagugaaccgugauggcaccacuguagucuaucuagccuggugacagagcaagacccugucucaaaaaaaaaaaaaaaaaauuaacucaccaggaugaaauauauuaaauuaggauaauauuaugugggagaaguagaaugaaggacuuuucauaaauuuuuguaaauggaugaugauggguaugaaauugcugugguuuuuagcuuucuuuggaugcauuuaaaagagauggaauuauuuuaaaauaucagcuuuacaguugcagcaaaagcaagaauugacaaauggaucuaauuaaacuaaaagauucugcacagcaaaagaaacuaucaacagaguaaacagacaaccuacagaauaagagaaaauauuuacaaauuaugcauccaacaaaggucuaauccagaauguauagggaacuuaaacaacucaacaagcaaaaaauauccccauuaagugggcaaaagucaugaacauuucuuaaaagaagaaauuuuuuuuuuaaguggccaagaaacaugaaaaaugcucaacaucacuaaucagauaaaugcaaaucaaaaccacagugagagaucaucucauaccagucagaauggcuauuauaaaaaagucaaaaaacagaugcuagggagguuacagggaaaaggaaacacuuauacgcugcuggugggaauguaaacuaguucagccacuguggaaagcaguuugcagauuucucaaagaacugagaauugugauuugacccaacaaucccauuacugaguauauaucuaaaagaaaauaaauuguucugccaaaaagacgugcacccauguucauugcagcacugcucacaauagcaaagacaugguaccaacccaggugucuaucaauagcggacuggauaaagaaaauguaguggccgggcgugguggcucaugccuguaaucccagcacuuugggaggccgaggcagguggaucaccugaggucaggaguucgagaccagccugaccaacauggagaaacccuaucucuacuaaaaauucaaaauuagcuagccgggugugguggcgcaugcccguaaucccagcuacuugagaggcugaggcaggagaaucacuugaacccgggagguggagguugcaaugagcugagauugcgccauugcacuccagccugggcaacaagagcaaaacucugucucaaaaaaaaaaaaaaaaugugguacauauacacuguagaauacuacacagccauuaaaaagaaugaaauguccuuuauagcacauaaaugcagcuggaggguauuauucuaagugaauuaaugcagaaacagaaaaccaaauacugcauguucugacuuauaagugggagcuaaacauugggcacacauggacauagugauggcaacaauugacacugaggucuaguagagggaggaaggagggaaggagacaaggguugaaaaacuguuggauacuaugugguaagcaggcaaacagguuugaagacuuuagaucuggcuaacguuccuucaccucuuuggguucuaugauuauggugcuaagaguucacucaguaauacuacugacuggcagaucaugcagcauggacagagugacuguuuuagcaaaggcacuaugugguuuaugaagcacagccauaacccaaaucuagauuaucccugcagcuuuacuauauaaaguucggcugcugacagcaauuaugacacauuauuuauauuguuuuaugaucuuaggauuuccuguuucuauaaauguggauaauuucuuuaaaaaaauacaaguuaaggauacuccuaacauaauuuuuagugcccaugaaaauaguaauucaauaagcaagaaguuuauaagugaacuucauuuuauucuguuaagugucuuauuaaaaaacugucuggaagaacuugacucauaauaguuacuuugacuugaggucauucauacagagauuuugaauguguaccacgaauauuuaguuuugcuggaaaucuaacugcuacuauguuaauguguaaacuguggccugugguacuuacugauugauugaaauagucuccuaaaagguuaagauuuaauuuuuagguuggaagaguggggcauacaagguccaugcacacauuguguggcccccaagaauaaggggcugaaaaccauauguacuuucucuuggccaggaacaguagaacaucauaccuuugaauagaucaaacugccugcuucauaaagagacuucagcauuguucuuauaaaaccucaucaaauguuuccuugauuuuauacuugaaagugggauacuguagaggcuuaauuuaauaaaauacauauuuaaaaaucacuagugguauuuucaaaaguguucucuaaaccaugaaaaucagaaaauuaacauuaccgccaucucaucgucugacuccauuuggguuuugucacuuucucagugauguucuuuauagcaaaauauccaauuuagaaucacauaacauuuaauugauguguuucuuuauuuuauuuuauuuuauuuuauuuuuuuuaauugaucauucuuggguguuucucgcagagggggaguuggcagggucauaggacaauaguggagggaaggucagcagauaaacaagugaacaaaggucucugguuuuccuaggcagaggacccugcggccuuccgcaguguuugugucccuggguacuugagauuagggagugugaugacucuuaacgagcaugcugccuucaagcaucuguuuaacaaagcacaucuugcaccacccuuaauccauuuaacccugaguggacacagcacauguuucagagagcacaggguuggggguaaggucaccgaucaacaggaucccaaggcagaagaauuuuucuuaguacagaacaaaaugaaaagucucccaugucuacuucuuucuacacagacacggcaaccauccgauuucccaaucuuuuccccaccuuuccccccuuucuauuccacaaaaccgccauugucaucccggcccguucucagugagcuguugggcacaccucccagacggggugguggccgggcagaggggcuccucacuucccaguaggggcggccgggcagaggcgccccucaucucccagacgggcggcuggccgggcggggggcugacccccccaccucccucccggacggggcagcuggcugggcggggggcugacccccccaccucccucccggacggggcagcuggccaggcagaggggcuccucacuucccaguaggggcggcugggcagaggcgccccucaccucccggacgggguggcuggccgggcggggggcugacccccccaccucccugccggacggggcggcuggccgggcagggggcugacccccccaccucccuccuggacgggguggcuggccuggcggggggcugacccccaccucccucccggacggggcagcuggcugggcggggggcugacccccccaccucccucccagacggggcagcuggccaggcagaggggcuccucacuucccaguaggggcggcugggcagaggcgccccucaccucccggacgggguggcuggccgggcggggggcugaccccccccaccucccugccggacggggcggcuggccgggcagggggcugacccccccaccucccuccuggacgggguggcuggccuggcggggggcugacccccaccucccucccggacgggguggcugccgggcggagacgcuccucacuucccagacgggguggcugccaggcguaggggcuccucacuucucagacggggcggcugccgggcggaggggcuccucacuucucagauggagcggccgggcagagacgcuccucaccucccagacggggucgcggccgggcacucucacaucccagacggggccgcggggcacagacgcuucccacaucucaggcgaugggcggccgggcagagacgcuccucacuuccuagaugggaugacggccgggaagaggcgcuccucacuuccuagaugggauggcggccgggcagagacgcuccucacuuccuagacgggauggcggcugggaagaggcgcuccucacuuuccagacugggcagccaggcagaggggcuccucacgucccagacgauggguggccaggcagagacgcuccucacuucccagacgggguggcggcggggcagaggcugcaaucucggcacuuugggaggccaaggcaggcggcugggagguggagguuguagcgagccaagaucacgccacugcacuccagccugggcaccauugagcacugagugaaccagacuccgucugcaaacccggcaccucgggaggccgaggcuggcggaucacucgcgguuaggagcuggagaccagcccggccaacacagcgaaaccccgucuccaccaaaaaaguacgaaaaccagucaggcguggcggcgcgcgccugcaaucgcaggcacucggcaggcugaggcaggagaaucaggcagggagguugcagugagccaagauggcagcaguacaguccagcuucggcuagacaucagagggagaccguggaaagagagggagagggagaccgugggccguggggagagggagaggcaggggcaggggcaggggcaggggcaggggcagaggcagaggcagguguuucuuuagucuccuuuagucugaaguaguuauucacuuuucccucugcuuuaaagauuagagaccaguuauuuaguaaaauggauuugaauuuggguuguacaguguuuucucauuauuagagucagguuguguaucuugggcaggaauuucacaaaacugauucuguguucuuguaugcugucagguggcauaugauuuuagguugucuuuuuuucuggcgaugcucaccgaucacuugauugagguggugucuguuuagguguuuuauauuuguuuccuguugcugcuguaacaaauuacuacaaacucauugguuuaaaacagcacaaauuuguucucuuaauaauucuggaggccagaaguccaaaaucaguuucuuugggccaaagucaugauguuggcagggcuacuuccuucuggaggcucuaggguagaaucuguuuucuugccuuuuccagcuucuguagauagccuguauuuuuuuagcuuguggcccuuccuucaucuuuaaaaagggcauuaguccagcaucugcuuccguugucacauuaccaucugucuuugacccuucugccucccuguuaaaaguaccccugugauuaugguccuucuaugauaaucuuccuauuucaagauccuuaacuuagucauaucuguaaagucccuuuugucauucgagauaguauauuuacugguuccagguauuaagauguggacaucuugggggacaguuauucagccuaccccacugcaaagucauucguuuccccuuuguaauuaguauuuugugggaggauacuuggauuccugguuccuguuaguggagaaugguauuuagaagccaagaucugcaugcuagaugugcucauugcuacuaggauuuuucugcuccuaggcccacuuaguagauagagcuagggaguauguauauauguauuuagaacugcauuuguauuucuuuauuaaaagacauucauucguagugauauuuuuaauuccaguccaacaguacaggguucauucuuguuuucuauuuuuucacuccuuuuucuugacaguggaaaacugacuccagguaucuuuaauauauuaacuuauucagucaguuccucugcauauuaucagucuccuuuucugcuaccauacucuccccuacauggaucucucccucuuccugauacuugguuucgguacuucuugcuggguaguccucccauguggaugacuucaucuaagcauggugguaacaagguaguuggacuucuuaccuggugguuuuggaaccuucuauaugccaaguccuuuuacuuaccuguuaccucauuuaagaacugcaguuuuguagauuuuuuuuuaauaugguaaaaaaaaauuauaauuagccagcuggacucauuuuagaucaucucaauuguguuggcagcauucaaaacaucguuaaguuacgagccaguugaacauacaccuucuucucuccaucagaccugaugaguauguuuaccuuggccaugccagugucauagagcuucuucacagccuguuugaucugguuggccuugacauccauaguaaacacaaaugugguugugucuucuucauggcugacuuaguggucaaggggaacuugauaauggcauaaugauaaagcuuguuuuuuguggggguguucuuccuaggacauuugaacugccuuuggagcugcguugucuuaggccacuggaagguggguggcaagucuuauuuugugugguuguggaugccuuucagcacugccuucuuguucuuucaaagccuuugcuuugacuuuggcuuuggggugggcaagggcuuccuccuuuguuuuuggugccaucuucuuaaaaaggcagauuuuuguuucaaaacuugauuuuuuuuuuuuuuguugagacggagucuugcucugucacccaggcuggagugcaguggcgugaucucggcucacugcaaccugccucccggauucaagugauucugcugccucagccucccgaguagcugggacuacaggcacgugccaccacgccuggcuaauuauuugucuuuuuaguagagagaggguuucacuguguuagcuaggauggucucuaucuccugaccucaugaucugccugccucggccucccaauacauuuuuuuuuuuuuuuaaacuugggagagucuuucaguccaagugcuuggggugaauuuaguaaaacaauacauacuauuuuugcuugggcuuaauuucuuuuuaauugagcugcaaguuuuucaugaggauuaaaauaauagcuuuuuuuguuguuguugagauggaguuucauucuuguuucccaggcuggagugcaauggcgugaucuuggcucacugcgaccuucgccucccagguucaacugauucuccugccucagccuccugaguaacugggauuacaggcacgcgccaccacaccuggcuaauuuuguauuuuuaguagagauggaguuucaccauguuggccaggcuggucuugaacuggcuggucucgaauuccugaccucgugauccgccugccucagccucccaaagugcugggauuacaggugugagccacugcacccagccuuaaaauaauagcuuuugucacaacucuuauguaaacuuaaguucuuuuuguuuguuugcuuugagauggaguuuuauucuguugcccaggcuggagggaucucagcucacugcaaccucugccuccuggguucaagugauucuugugccucagccuccugaguagcugggacuacaggugugcaccaccaugccuggcuaauuuuuguauuuuuaguagagaugggguuuugccauguuggccagguuggucuuuaacuucugaccucaggugaucugccugccucagccucccaaaguacugggauuauagaggugagccacggugccugaccccauaaaccuaaguuuuacggguuuaggagacuuuuccagcuuaacacaaaauaauuagaauuuaugauacugaauuuuacucuacuuuuuuuuuuuguuuguuugagacagaguuucacucuuguugccuaggcuggagugcaauggcaugaucucggcucacugcaaccuccaccucccagguucaagcaguucuccugccucagccucccaaguagcugggauuacaggcaugcaccaccacgccuggcuaauuuuguauuuuugguagagacaggguuucuccauguugaggcuggucucgaacuccugaccucaggugaucugcccgccucagccucccaaagugccgggauuacaggcgugagccaccgcgcccggcccccuuuuuuuuuuaaaauaaaaauuuuaaauggugcuuuuuuuggggacgggggugcucugaggcaggaggagugcuugaggccaggaguuugagaccagccuuggcaacauagcaagacccaguuucuacaaaaaaaaaaaaaaaaaaaaaaaagaauacuuugcaaauuugcgugucaucuuugggugagggccaugcuaaucuucucuguauugcuccgguuuuagcguauguccugcuccgguuuuaguguaugugcugcugaagcaagcacucuaccuuuguuuuaacugcaaguugauuuuauguuacagcucuaaaucuuacuaguuuuauaucuuaaauagaugagaucuaaacuuuguugauuagaagacauuuugauaggcauuuauuuuuguguuugaagaguauuauuucugcuuagcuuccuuaauaaaccauguuuuaacuauuuuauacuucuuguuccuucuauagcagaggggaaagagggagagaauuucccagaaauuacugauuauaucugacuaaauauuuugggugcaagucaguuuuuguguuuucauuaagucucauuuccaaaauggucacuugguaguugaaugaaauuuucuagauagguuguuuguucuaaauggcagacaauuuaaccuaucuuguaaguuuuuuaaaggcuauuugaauaggcaguaauuucauguuccauuaaacuauuagcgugguaaugaagguuaguuaaccaguuagcugguuuuaccuucacuugugaaaaaugguuuuuaauucaucuuauuuuucuuucuugacagagcaaauucgauuaaagaauaucagaaaaguauauggaagguguaugugguaucguuuacgguuauuaaaaccccagccaaauauuauuccuacaguaaaguaaguaauggauuucaagaaaaaaaccuacuuaaugcuuacucuuugcuaggucauacaacauauacguguaaugaugaauaagucauugugucuguaaagaaauuguaaucuauaguaaggguaagauaggagaaaaugugggaacagucugaacagauugguuuagaaguucaaaggaaggggaguauacuguugcuggaggucggggguagaaagagauaagucauaucuugagggaccuugugcaccuugugccaagauuugaauuuuaucuuaaagacuaugggggaaucuuuaaaagauuucagaaguggagaggugacaugaacaaguuagcauuucauggugauaauuaaaguuuauugagcacauacuguaugcuagaaucugugcuagggcuuuauauguuaucuaauuuaauucuguauuaacuucaaaguagaugguuuugcauuuucucagaugaggaaacaaaggcuaagaaugaugacauaacuugaccaaagucauguaguuagaaguguuggaucagggaccuaaucacccuuuauuuuaaacaggccauuaacauguuuaguuacagcagaccaguuuaauccugugaggcuaugggguguacugguuaaacacaaggcuuuggacauuuauccugcgucaucaguuuagagguaauagaugaaacugacaggaggugagagaguuaccauuauuggacuacuaugucuugugaauuaccuacauuuauccaguagauuggaagagaagauguagcaaaagaaauuagugagaguagaaacaguuauuuagaaaucuugguuuaaaugauaguuuuuuuucagcauaauuucagggcguuuaguuuuucuuuguaagguuuuacuuuaccuaauuuaguuuauuuuucuuuucuuuuuuuuuuuuuugagacagagucuugcucuguugcccaggcuggagugcaguggcacuaucuuggcucacugcagccucagccuccuugggcucaggcauccucccaccucagccuccugaguaggugggaguacaggugcaugccacuacaccugguuaacuuuuuuuuuuguauuuuuuauagggaugggguuucaccauguuccccaggcuggucucgaacucuugggcucaaguggucugccugccucggccuccaaaagugguaggaucacaggcgugagccaccuugcaugagccacccaguuuaguuucuuuguaggaggagggaaauucuagcuuugguguuaagaguucuuuaaugaugugaaacuaaaggcaaaguuagucuugaaaagaguaauuuucucuucacuguuuauucuuuacuguugguucucauuuugaauuaaauuuuccuaaagcagcaagacagaaaacaauccgccccucccccccauaucugcggguuccaagugggaagauucacccaacugugaaucgaaaauauuugggggaaaaaagcaauaaaaauaacaauacaacaauuaaaaguauaaaugaaaauacaguguaauaacuguuuccacaguguguauuauauuagguaauaucaguaauuuagagaugaucuaaugugcaugggaggauguauauagguuauaugcaaauacuacaucauuuuauacugcggacuugagcauccauggauuuuaguaucuguggggguccuggaaucaguccccugaggauaccaagggacgcauguauuuuuggccucccagucucuuaucuggcuuuguucaacacuuuguggguaucugaaccuguuuucaaggaaaaaaacuuuuaugaagcuuuuuuagugauuaauaaagugauuuaauuaaaguacagauuaagggaguuuagguaaggaagaauuaaauauauacugguaacaauuuagauaaggucauaaaccauuaaaacuuuuacuacuuaaucuugaagcauucuuucaaaguuaaacaauuggguaaugcuucuuuucugacacaugugcgaaacuaaggcauguaauuuuuggaaguugcuucuaaagaugacccuucaggcugggcgugguggcucaugccuguaauccgagcacuuugggaggccgaggugggcggauccccugaggucaggaguuggagaccagccuggccaacauagugaaacccugucucuacuaaaaaaauacaaaaaauuagccaggcaugguggugcgugccuguggucccagcuacuccggaggcugaggcaggagaauugcuugagcccaggagguggagguugcagugagccgagauugugccacugcacuccagccugggugacagaguaagacuccauuccccacccagaaaaaaagaugacacuugaaguuaauuacugaagccaaguauggggaaaaugcuuaucuuuucagaggaaccaaacagguuuuuuaaaaaaauugagcacagagcaugaugugauccguuauguuucuaucuuugcuuuggcucucaggaaacuguagagcauggcuuuauugguugugguaauuuucaucagccuuuggauucuguuaugagcuucuccuuuccucuucucauuccuuggcuuggagaacuggaugcuccauguaaaacauacgguuuagcauauccuagguguuuuguuccuuuugccuugcuugguuuuaaaucuugcuuuuuugguuuccaauuucauuuuaucuuuguuuugugagcuuuguuuguuagccuuuuggaugaguugggaaaacaaaaggggaguuaauucuugugggaauaaagcauauuuucaauuuuuguuuuguuuuguuuuuagcauauugaggcuauuaccaaauuuuggguuuaaaaaguguuaaaaaaaaguuugcuguuguaggcuggccgcgguggcucaugccuuaauuccagugcuuugggaggcugaggugggaggauugcuugagccugggaggucgaggcugcagugagccaugaucaugauuuaaaaacaaaucauuccaauuuuguuuaauuuggccucuuaagauucauuugaugucuuugucuaacaguucuugcucaguguaacaaauugucauacaaaggguauaagaaauaaaagucauucaguauaagaaauaaaagucauucaucaccuaaagcuaguuauuauuaagauaauuacuuuaugcacuuauuuauaauaaaacuuuuauauacauagaguuuugaaagcuguuuuguaaauuuaacaauauaagauagauagucauccacagcaaauauuuuuaguagccagaaaguauuucacuguagaggcugggcgcagucgcucaccccuguaauuccagcacuuugggaggcugaggcgagcggaucacuugaggucaggaguuugagaccagccuggccaacauggugaaaccccaucucuacuaaaaauacaaaaauuagccgggugugguggcaugugcuuguaguuucagcuacucaggaggcugaaguugcugugagccaagaucgugccauugcacuccagccugggcaacagagcgagacuccgucuaaaaaaaaaaguuaaucaaauguacaaaugaacuaaugauacaucucuacagugaaauacuuucucuuauuuacaucugugaccgccauuuuagacuuauucuuuccaaauuauuugaagugaaaugguuugauagaaaaacgguauguauuucuuuagggcuuuuaauaccuuacugccagauauuacuuuagaguguauaguguaugagaguuucucuuuuucuuuaaccucuccagugcugguaauguuaaucuuuuacauaauuuuacucacuagaacacauuggagggagcagaaauuaguuuauuuucaaaugauauguucuuuuauaccuuuauuuuaaccgauuaugaacauccuucuauaacuauuuauuggcuacaaaauguugcauuguguggcuguaucaugguuuauuuaauuauuucuuuguaaauaguuuauuuaaucaguuccugugagccguaauuuagguuguuuccaaaguuuuacuacuauaaacaaggcuauguauuuauuuuugcacaauugaccaauuguuuuuccuaguuuaucuuaauaaaaguguaauugcugggucagagcaauucuuuuuuacauuaaaugguuuacuuaguauuuauuuauuuugaucuaauuuaaugcguccaguaaguuaauaaguugaauucacuucuguauuuaaaauugugcaaauaguaacugagaaaaucuaugaauaguagacacuguacuagauuauaaagaaugcagagguaaaaaagacacugucguugcuguaacaggaguuuguaacccagugauuguagaauuugagucaguagcauagugauaugguacuacuguagaguuuuugccuugaccuugccauaaugucuuuagacucuaugcagauguauuuguuuaugauucacuuaccuuuuuccuaaacaggaaaauaguucugcuugcaggaugggcauuguucuuauuccuugcauauaaaguuuccaaaacagaccgagaauaccaagaauacaauccuuaugaaguauuaaauuuggauccuguaaguaguauuuuuauauaaugcauauuaguuuaauggucccaugaaaaugcuauagguccucauucuaaaagaaauugucuauuccuauagaaaucagacuuuggucaguuuguuuauuaaaauaagaugucuaauccucuguuauuauaauuuaagcuauaacuguugauuguuauguuauuaauaauugguuuucaauugcuaaaauauaagaauauuugaagaugagaggagagguuaacauuuuuuuuuacagagucucacucuguagcccaggcuggaguguaguggugugaucucggcucacugcaagcuccgccuccuggguucacgccauucuccuaccucagccucccagguaggcgcccgccaucacgccugucuaauuuuuuguauuuuuaguagaaacgggguuucaccauguuagccaggauggucucgaucuccugaccuugugaucugcccaccucggccucccaaagugcuaggauuacaggcgugagccaccgcgcccggccgguuaacauuuuuuaaaggcuuuuuuuuuuuuugagacggaguuuugcucuguugcccaggcuggagugcaguggcacgacgucggcucacugcaaacucugccuccuggguucaugccauucuccugccucagccucccaaguagcugggacuacaggcaccugccaucacgccuggcuaauuuuuuguauuuuuaguagagaugggguuucaccauguuagccaggauggucucaaucuccugaccucaugauccacccgccuuggccucccaaagugcugggauuacaggcgugagccaccgugcccagccuaaaggcauauuuuuaagagagaucuguaauauugguuaaugcaaaguuaaaacugggaggauaauuuguguuaguugaaugauaaaaaucuuaugaccuuguauucauugacacuuaagcaauguaaaaucuagguugggggucuuagaaagaacuaauaucagccaggaacgguggcuuacaccuguaauccuagcacuuugggaagcuaaggugggaggaucgcuugaggucaggaguuugggcaacauagugacacccaggcuguaucaaaaaaaaaaaaaaaaaauuaccugggugugauagcaacacaccuauaguccuagcuacuugggaggccaaagugagaggauaguuugagccaagaagguugagaugagugagccaugauccgcaccauugcacucuagccugggcagcagagugagacccugucucuuaaaacuaaagugaaacuaguaucauuaaugucauugucauggaaauuuagguuaaccuugagugugccccuuaggugauuuuuugauuaaaccugauuaauggguucuaaauagaaaacuagucuuuuggccagccgcaguggcucgugccuauaauaucaguacuuugggaggcugagguaggaggauugcuugaggccaagaguuugagaccagccugggcaacauagggaaacccucaucuguacaaaaaacuaacacaauuagcugaacguggugacacaccccugugguuccagccacuugggaagucaaggcugcagcgagcugugauugcaccacugcacuccagccugggcgacagagcaagacugucucaaaaaaaaaaucuuuuguguuuaucaguagaauguuagaacugaaauuaaugauagagaucaucuagccuuuuauaaaaauauauaauuuuuuaaaccugggagcauauauucaaguugcccugaauauauauguauguauucccuauuuauuaauuuuuuuuuuuuuaaagaaaaugaggccuggauaauuugugucuugucugggguuccaagcuucuuacuuaguagccaagcucaaucuagugcucuuucuauuuucucccccauggcacuuacuuuuacuuugagucuuugcucaguagauggcuugauccagacauucauauaauacaaacuaaggaggguguguaucaucuaguuuucuguuuuguagaagaaaaguuuacauaucaugugauuuuuuucuuauugcauugaucauagucauuaagagagauuuuaagauuagaagggcaauaaaaaacagugaaaaaauuauuaauagaaaucgagacuaagaaaccauuaaggucaacuugauagacaagcagcugaaaccagguauuccucagauuauuccuuagaaaguuaaccuuugauuugaggauucuuugagccagauuuaauuuauugugauuauuuuuugauauuuauuuauuuuuaucuucauuuuuugagagacgaagucucacucugucagcuaggcuggagugcaguggcguagucucagcucacugcagccucuaccuccugaguucaagugauucuccugcuucaccuucccaaguagcugggacuacaggugugcaucaccacacgagcuaauuuuuguauuuuuuaguagaguugggguuucacuauauguuggccaagcuggucuugaacuccugaccucaggugauccgcccaccuuggcuuccaaagugcugggauuacaggcugugccuggccuauuuuuugauauuuaaaugucaguauuauuuuauguaaauuugucaucuguuuucacuuucaaauuaucagugcuuaguuuacuauguggcacauaguaggugcucaauaaaauacauauauuggacaauauaaguguuuuuauuuaauauaugggaugaaauuuaugggaaaaauauauaggaugaaaaauggauuuugucuuucucaaaauacugaguaguucauauuuuaaguucaaaauaggauugauuauuucuuuacagaauugugcuuauuuuugcuaacagaaagcuuguuuuuuuuuuuuguuuuuccccagggagccacaguagcagaaauuaaaaaacaauaucguuugcugucacuuaaauaucauccagauaaaggaggugaugagguuauguucaugaggauagcaaaagcuuaugcugcguaaguaucaggauccauuacaaauuuuuaagaaugguacagauaagccaggugcagugguucaugccuguaaucccaguacuuugggaggcugaggcaggaggaucgcuugagcccaggaguuugagaccaucccuggcaacauaccaagaccccaucucuacaaaaaauaaaagaauuaacccugugugguggugugugccuguaguccuagcuacuugggaggcugaggugggagcguuguuugagccugggaggucaaggcugcagugagccgugaccaugccacugcagcccaacuucgaugacaguaauacuccaucucuaaagaaaaaaaaaaaaaggauaguuuucuguuuuaauaaaauauuaaaauaguugucauacacuuuuuccaagugcuuacuucauguugagucuaucauuuaggggcuacacagcagcacuaacgugguaauuuaauuuaauuaaacuguaauuuuugccauguaaacuugauuaaauuaaguggugaaugauaaguuaauugagcuauuuuauuagcauuuugauuagaggaggguauacuuagaucuuaccauuucuagauuuuuuuuuuuuaggcuugaucuguuucucuuguuuuggcaauguguagcuuaucucauuuaaacuauuuaaagacaaguuuaauuuggacuuuuaaguacuucauuuuuggugucuuuuucuuuuuagaauuucgucacacaagauuauucuuaguuaauaacaacuguacuuguugagauguggauuuuuaaggucuccuuuuucacugcucagaaacugucuucacaaaucuuuucagaacuuccaaauaauuuuccuuguuggucuuaugccuuagguaaggugcauuguuauuaugagauacauauauucacauaugcguuauaugcacacacauaugucuguguauuuauaaaguuugaggaacauuugugcacccuuuugggaagcagaauagaguguguaacauuagaugcagugaucucuugcguauuaaucuuccaagagauaaaacuuaacuagauucuucaggacucuucauaaguacauccccacauagcucuuacauugaaugaaagagugaaauaugagauugucugucuuuugaggacucagugauguauaauuuugugaacucaauuuaaacguguaaauaaauacaagcauacuuuggagauacuauagguucaguuccagucuccugcaauaaagcaaauauugcaauaaagugagucacaaauuuuuuuguuuccuacugcauauaaaaguuguuuauacuacaccauagucuauuaagcgugcaguagccuuaugucuuuuuuuuuuuuuuuuuuuuuuuuugagacggagucucgcucuuucgcccaggcuggacugcaguggcgcuaucucggcucacugcaagcuuugccucccagguucaugccauucuccugccucagucucccgaauagcugggacuacaggugccugccaccacgcccggcuaauguuuuuuuguauuuuuagcagagaugggguuuuaccauguuagccaggauggucucgauuuccugacgucgugauccucccgccucggccucccaaagugcugggauuacaggagugagccacugugcccagccagccuuaugucuuaaaaaacaauguacauaccuuaauuuaaaaauacuguauggcuaaaaaaugcuaguaaucugagccuuugacaaauuacauucuuuuugcugguggagggucuugccuugauguugauggcuguugacugaucaggauagugguuacugaagguugggcuggcugugacaauuucuuaaaauaagacgacaauuaaauugacuacaucauuuaaauucuuuucaugaaagauuucucuagcaugugaugcuauuugauaguauuuuauggacagaacuucuuuguuuucuuuuucuuuuuuuuuuuugagauggagucuugcucugucgcccaggcuggaguggaguggcgcgaucuuggcucacugcaacuuccgccucccggguucacgccauucuccugccucagccucccgaguagcugggacuacaggcacccgccaacaugcccggcuaauuuuuaauauuuuuaguagagaugggguuucaccacguuagccaggauggucuugauuuccugaccuugugauacgccugccuuggccucccaaagugcugggauuacaggugugaaccaccgugcucagccagaacuucuuucaaaauuggagucaauccucucacauucugccacugcuuuaucaacuaaguuuacguaauauuuuaaauccuuuauugugauuucaacaauguucacagcaucuucaucaggaauagauaccaucuuaagaagcuacuuugcucaacuauaagaagcaacucaucuguucaaguucgaucaugagauugcagcaauucagucacaucuucagguuccacuuguuuaguucuccugcuauuucuagcacaucuguagugacuuucucuacugaagucuugaacugcuccaagucauccaugaagguugaaaucaacuucuggccaggcgcgguagcucaugccuguaaucccagcacuuugggaggccgaggcagguggaucaccugaggugaggaguuugagaccagccugaccaacauggagaaaacucuaucucuacuaaaaauucaaacuuagccgggugugguggggcaugccuguaaucccagcuacuugagaggcugaggcaggagacucacuugaaccugggaggcggagguuggggugggccaagauugugccauugcacuccagccugggcgacagagugagacucugucucaaaaaaaaaaaaaaaaaaaaaaaaggaaaucagcuucuaccaaacuccucuugauguugacauuuuggccucuuccugugaaucacaaauguucuuaauggcauuuagaauagugaauccuuuccagaagguuuucaauuuacuuuacccagauccaucagagguaucacugugucuguagcagcuauagcuuuacaaaguguaugucuucuuuuuguuuuuuguuuuuuuuuuuuugagauggagucucacucuguugcccaggcuggagugcauugcugcgaucuuggcuuacugcuaccuuugccuccuggauucaagcaauucuucuuccucagccucccgaguagcucggacuacaggcaugcaccaccaugccuggcaaauuauuguauuuuuaguagagacaggguuuuauguuggucaggcuagucuugaacuccugaccucaggugaucugcccaccucggccucugaaauugcucagugcaagucuuacuauuucuuaaauaauaagacuuaaaagucaaaauuacuuuuugaucugugugcugcagaaugaauguuguguuagcaggugugaaaacauuaaucuguuuguacagcuccaucagaguucuugagugaccacgugcguugucaaugagcaguaaucuuuugaaaggaaucauuuuuuuuuuuuugagcaggucucaacagugggccuaaaauauucaguaauccaugcugucaacacaugcugucaucaaggauuuguuguucuauuuauagagcauggcagaauagauuuagcauagaucuuaagagcucuaggacuuuuggaauggcacaccagcauuggcuucaaguuaaagucgccagcaacguuagccccuaccaagaaagucagccugucuuuugaagcuuugaagucaggcauuuauuucucuccagcagugaaaguccuaaauggcauauuuuuccaguauaaggcuauuuugucuacauugaaaauuuguuguuuagccaccuucauugugaucuuagcuagaucuucuggauaacuugcugcagcuuccaaaucagcacuugcuacuucaccuugcacuucuguuguagagaugguuucuuuuggaaaaucuuguggaccaacaucugcuagcuucugcagcucccucaccucucucagccuucguuagggccuugcuuuggauuaggcuuugguuuaagggaacauuguggguaguuugaucuucugucgagaccacugaaacauucuucaaaucagcaacaaggcuguuucacuuucuuauuauuuguguguucacuuuuaaguuccuuuaagcgcuguugcucugaauucacaacuugacugucuggcacaagaggccuagcuuuuggcuuguuuuggcuuuugacaugccuucuucacuaagcuuagucauuucuagcuuuugauucagagugagagacgugugagucuuuuuucguuuaaacauuuagaggcccgccgagaccagcucggucagggagacccuaacccagcggcccuagaggaauuaaagacacacauacagaaauagagaggugugaagugggaaauuaggggucucacagccuucagagcugagcaccccaaacagagauuuacccacauaucuauuaacagcaaaccagucauuagcauuguuucuauagauacuaaauuaacuaaaaguaucccuuaugggaaaugaagggaugggccgaauuaaaggaauagguugggcuaguuaacugcagcaggagcauguccuuaagguacaaaucgcucaugcuguuguuuguggcuuaagaaugccuuuaagcaguuuucugcucugggugggccagguguucuugcccucauuccgguaaacccacaaccuuccagcgcguguguuagggccauuaugaacauguuacagugcugcagagauuucguuuauggccagucuuggggccaguuuauggccagauuuugugggggcuugcucccaacagaggccauuuuaggguuaguaauuugcccaauuugaaucuugugugucucagggaauagggaggcaugaggagugggagagagaugggggaauggccagugaguggagcauuugaaacacauauguauuaaguucuuuuucuucugcaggugcaguuugugugccagccccgcaaugauaauagaaaugucaaagaucacauaucacuauaacagauaaaauaauagugaaaacauuagauauauugugagacuuaccaaaaugugagagagggacaugaagugagcacaugcuguuggaaaaauggcacugauagaauugcuugaugcaggguuaacacaaauggcagaaaaacacgauuaucugcaaagugcaauaagaaguuugcuugcaauagcauacuaaguuauaauagcaaauugugaaaguggcauguaaaugacagaaguuugggagauaucaccuuacuuauuuuuguacuuaguagaggauauugacuaugucucuucucuccccuuguuuuguggcuugcuguuuaucuaugugaauuacuauaugauucuguaauaaagcagugccauuaggacuuuugaaguguguacuacauuuucugcguagcaguuguccuugagguuacugucuuucaguuagugucuccuucaagcauuuacucucuuuucacaaguauugguaugccuugauugcugucuucagguaauuuaaaaagacauuuccagaggaagucagguagccaagacuauuuaauuaguaguuuuuauuuuagugcuuuggugaaauccccccacccuauccccccagucuuuagguauuuuaacauuuucaaguuuauaauuuuguucucagauuucuggaaaucugacuaugauguguggucacuauucugaaaaaugcacaagaauaauauaagguguuuaguuuuaacucaguuaugugguuaaacuguagaauauuuuauguauaaaaugucuuaaauaguugacguucuguaagaccaaugaaaaagugaagugaucgugggaccuagaacuuugagauuauguaacuugcauaaauauaacuauauuagauaaagguauauauuuuaccaacuauaaguucuaagugcuugaguugaaguuccuaucucaugaauaacucuagcagccuuggaaugcaguuauauaggcuuugaugugcaaaguuuuuuagaacuugcuuagguuauuugagaucauuuuucucuccuuaguugccuauuauaauaaaccagcugggucauuucauuuuuuuuuuaaucagauuuucacucuuuccuuuaggaguuauaccauugaauucucugguucauuaucuagauagaauugagauuuugcucucagauguaaaaccugucuuuaaagcuauuguauagcaagugggcagcguuguugucaccuuaaagauauguuaauuuuuauaaaagcauaugguuuuuacagaugagcauguaacuuauaauaacugugcauagccaacucauggucacuuguuuacaguuuagugaaagcauucucuagaucaagauuuaugaucuggagucccugaaauuguauacaaaauuuaugugucuuuguaaugugcauuuuucccagggcaaaggggucauagauuuccuuagauucauaagagaaucuauaaucguccucuguuacccccaaaaaauuaagggauauaaucauguuuaggaaacuacacucacugaauuuucaaaaauucuguuagcaucauugaucuuguuuaagcuuguuaaaugugaauuauacuaaaauuacgcagcuuuuaaguacuuuaacucuuagaagugguauuauacugaaaugcuaaguaacaaaaauucauuugcuucuuaaacugacuuuaaguugcugacuuauuuuauuagauugaauguucaacaugguucccaucacacagcaguuguagaagucaguuuaaugagugaguuaauguaaucguaacucguaggucuguguagguugcaaaaucagagugucucugaugugagcuaugcuuuauuuggcaaaaucugggaguauuguauagaggacagagcaguuuguuuugcauaaucacaaaggcagaaggggacagagaugguuauuuugggcagaaggauccaauuagaagacaauagugaaagaaacaagcuaaaacucugaguuggguggacaguuguacaggggaucuaggacaaaauuuuugagaaacaucccucaauuuugaaaagaaaaucuuagcacuauuccuuauuaucuugcaaccugucuaguaaugcuuuuuauuggcuccuguauuuuucuguggccuuucaucaaauaguguaaguggaguuacaauuaaauaaggauuaaagacaucaaggcaccuguuugcauaaaugacuaaauugauaaauuuaaaaauauuuucaagucaucgaaaacuaaugaauguccuuuuugcuauuuuauaaagguauuucugcauugccuaucucagauuggaguuuuguuaaauagaaacuacauugccucuuaaguuuugagaaguagaaguacgguuaaaauuagauuugaccauauggaagaucuuuuaccaguuggucuccaagaaugucuuccuuauuauguuauuggucauuuuugagcguguguguugguggggugguuucugccuuauauuccuuaacuacauuguauauuuuuguaaggaauugggaauucauuuuaaugcuuuuuaacaucuucacugggaacuggaauaaaguuauucuugacucuguaccuugagccauugucaaagucagggguuacauuuuagguaucuaaaaauuacucuuuaacuuucacauucccuggguuaggaagcugcuguucaggagaaauuuuccugguucuucuggcaauuggcuuaggagaaaauugugaucuuagcacagugcaaauuaccuuacccacagcaauggaguuuuacaugugguggucaucuguuucuuucagaauguggugcuauuguuuuguggggaagcuaccauuaugaauuaaauuuauguuuuuaaaaaauguguauuuaucauuacuaauguauaaacaugcucauugaagaaauuuuggaaaauauaugagaguauaaggggaaaaaaaucgccuacaauucucccugccuucuuagaaaauguaguugccuuuaaaguuugaucugguugaacugagaaccaucugguugaacaugagaacugguuaagcuugagaaccaugggccaaccaggaauuaguaucaagacgcaauaguuagcauuuucuguuaaugcgcauuucuugcuccucccuuucccuuucuccugauuucagagaaacuuuucuugauucauggaaucaguaucuucuaagaaaugaguugguuggcuaauggaguuugucuauaugaguacuuguuuuucagauguggcuuucuaauuuugcaacuuuguucuuuugaugcuaguuuaacggaugaagagucccggaaaaauugggaagaauuuggaaauccagaugggccucaaggugugguaaaugaugauuuuaaaauauuggcgauaugguauauauuauaaaaauguuaaccagauuaaaggaauaauauuauuuucuuacuaaacuuauacucacauggaguuuaacauagauaaauugagcucucauuaauuuuugcuuuauuuuucuuucuaaagacuaguuugaaagauauaauuuaaguugauccauagagaagaauaaucacuaucauuuccaauuacuaguugauaaaaauuuggaggaaaaaaucuuauuuuucuuuacagacuucacauuuucucauguguucauaguguuuauguaaacucaggacauauaaaauaauuuauauuuucuugagagaaggaauuuguacuuacaggguuucuuuuuccuugaaaaauuugaaguuucagauauaaacuauaucccugaacuuuuguguaaugggggccuacuaauaagauaaucuuucucaaaguuuguuuuuguguugugggggagaguucugggauauauuauagaucccaaauauauuuaauguauuuauuaaaacugaaaguagagauucuucagaaacugauauuuuuucuauuucagccacaagcuuuggaauugcccugccagcuuggauaguugaccagaaaaacucaauucuggugagugcauuuaaauaagauacauuaugauguauuagacaaaauuuuuguuauguacaaucugucuugguaauacaagaagaacuauuacaaagaaaauacuggugugccauucauucauucauucauuugagacagagucuugcucuauugcccaggcaggagagcaguggcgugaucucggcucacugcaaccucugccuccuggguucaagcgauucuccugccucagcccccgcugaguagcugggauuacagguacccaccaccaugccuggcuaauuuuugcauuuuuaguagagaugggguuuugccaugcuggccaggcuggucucgaacucucaaacuccugaccucaaguuaucugccugccucagccucccaccauguugggauuacaagcaugagcacuaugccuaauuuuaauuuacaauaaauugaauuguauauauuccauaugguauuucaggaggagguaggauaucagacuucaaucacugcaacccuaaaaugucaagaauuaucuuacucagggauacauuccuacuucaacuuucuugaaaauaauugucuaaaggcugucuuugaggcaauaaaaacaaaauccacauagucuguaauuuguuuugaaaauggcuauuaaguuauuaucuggcagauuaaaauugguuaccuugaggggguauacaguugcugcauaagcuuguuugucaugcuucugguuaguaggaauagucgagaaggaauaaguuacuaccagauuuaggaucaaguaauaggagaaaaaucaguagguaaaaauugcuagucagcauuaugaagugacuccuugauauuuagcuaaaggaaccuuuggccaggggcuucuuaucucauuuguucccagagcacuaacuacugagagguuguggauauauaaauaccugccugacuggaagagaaauguaauuuacaaaacuguuuugcugguguuaaucuguauugugucaguaaauaaaaaauuaaaagguaauuuauuauaguggauaugaacauaggcucuagagcugaacuacuuggguucaaauccuggcugugcaauuugcuagcuguguccuaggacaaguuauguaacccauguguacugcagguuuucuaccuacaaaaggaggguaauaaugguaccuuccucuuggaguuugagaauaaggauuaaacaagauaauacaugaggaauccuuuuaauaguggcucccccauuguaagccucaaaauaaauucauggauguuguuuuaauuuaccugacgaaggccauaauucuuuuucucuucaauuuuagguuuuacuuguauauggauuggcauuuaugguuauccuuccaguuguugugguaaguuuuagcuuuuuaaguuaauguuuuuuuuggaaaggagauugacauguuuuggagucucccuauaacauuuuaaauguauguuagaauauaacccauugauccuugaauuuaagagucuugccacugaaggugaggugggaggaucgcuugagccuagguguuugagguugcggugagccaugaccccaccucugcacuccagccugggccacagagugagaccccaacugaaaaaaaaauuauauaacuauacuuuuaauggucuucuaaaugugacauuacuugagcaugauguguauauccucccaauucaaaaauuacccacaacugaccgggcaugguggcucacuccuguaaucccagcacauugggaggcugaggugggcagaucaauuuagggcaggaguuugagaccaacauggugaaacccugucuuuacuaaaaauacaaaauuagucagacaugcugguuugaacccaggaggcagagguugcaaugagccgagauugugccacuacacuccagccugggugacagagcgagacucugucucaaagaaaaaaacaaaaaucacaaaaguuacaacugaguuaacacagauacauauauacauauguauacauauguguguauguauauauguaugacauauguauauguguacauaugcaugacagauguguauaaauguaugacauguguauauaugcaugacacgugcauauauguaugacacguguguguaugacauacauguguaugacacguguauauguaugacaugcauauauguauauauguaugacaugcauauauguauauauauguuuuaaauacagggaaacuguccauuuuaauuuuauuuuuguuauuuauuuauuuuugagacaaggucuugcuguauaguaagguggugcaaacauggcucucugcagccucuaccuccuggguucaagcaaauccucccaccucagccucccaaguagcuaagaccacaaguguguaccaccaugcccugcuaauuuuuaaauuuuuuuguagagauggggucuugccacguugcccaggcuggucuuaaacuccugggcucaaacgauuauccugccucggccucucaaaguacuaggcuuacaggugugaaccaccaugccuggcugacacagauauauuuaaaguuucaaaugaaagucuucccgcacuaccacccucaacuucauuuauuuaggaaucauugggaaguuggguguuuuuucuuuaaaaucuuuuucuaugaauuuauguacacacauucauuuuaaaaaaaaccuuuaaugagauuuuacuguaugugugcauuauucuguuuuuuugcuuaauauaauggggaugcaacauauagaaaagccucauuuuuuaaaacagcuguauaauacuauaauacggagauaccauacaauuugauauucaccauuuguuacuuuugugacuuguguccuuucugauccuggaguuccuuuuagucacauagugagucuaauaauuaaguuguuuguuuugcuuucuucaaaggauuguugcaagaauccaaucauauuaaguaauaugaaugaaagugucaugucaacuuguaaaauuaugccuacauuuguuuaucaaguauuuauugaagacaugcugugugucaagaaccagcuuggugcuuauagcaguggguaguuuuaucccuuuuuggucuuuaagguauuucuauccaaaaugguaaauguuuugauuauauauaugcagugacuuagguugguguuuaggcuucagacaguauaaauauuugcuaaagaaaucacuugaaauaugcaagaaagagguccuuguuguaagacucagguauuuuuauuguuuuaugaauauuuagaagauuugaccauaaacauauucugccucaaacuuaacauuuaucaggguuuuguuuugcuuuuuuuuuuuuuuugagacagagucucccucugucaccuaggauggagugcaguaguaugaucauggcuacugcagcccugaccuccuggacucuagcaaucuucccaccucagcuuccugagcagcugggacuagaggcaugugccaccaugcccagcuaauguuugcauuuuucuuuuucuuuuguagagacagggucucacuauguugcccaggcuggucucaaacuccugggcucaagcaguccucucaccucagccucccaaagugcugggauuacaggaaugagccaucucgcccagccuaucguaguuuuuauacuuucuuucuuguuuaauuuuuuuuguguuuuagggcucuuggugguaucgcucaauacgcuauaguggagaccagauucuaauacgcacaacacagauuuauacauacuuuguuuauaaaacccgaaauauggauaugaaacguaaguaaacuuuaaguaacuuugcuauuaaucacauuguuuugugacuuaugugggguugauauauauuccuuaacucuauacuguugagauucuauuguacaguuuuauaaauaguuaauuuauauaauuaaagcuagagaaaaaugccagcacccuuugucacauuucuuaauuuauauuuucauuauucacauuuacucauauauuucaucagaaauuuuaccauaauccuuaugcgugcaaauuuuguaauucuagcuaacauuuauuauuuguuguaugccagacacugcuaguuacuguaugugucuugacucauuuaauuuuugcuguguucucguaagugagugcuguuuuacaguacaucuuauagaugaggaaacugaggcaccgaaaaguaacacucucaaggauacacaguaagugauauccaggauugaacccaggcagucugguucuugagccuuaaaccauuauguuauaguguauuaauuguaguaaaaauaaaaagucuuagguguguugaaagaaaacuagugcuagaguauuucauucccaguucuuauuuaaaaauuuaagaaaaaaaauacuauuuucacuuucuuugauuauauaaagcaaacuuugcaguuuauccuugggagauagaguguuaccuuucagaaugauggcucugcaaaaaucauagcugcuccuccaucccucuuuaaaaaaaaauaaaauaaaagaauguaaguuuugaauugugucuccgggaccaaaauggacuuuucugcauuuuggauuuggcaauuuuacuaauuuucuuaguaaugagagagacuucucauggucauauaugacugugugugaacagauuuuacauuucugaaugaguuaauacuacuuugccuuaucgaaaauauuacucuuccuaaagcuggauugaaauguuaauacagaaacuuacucccuuaugaaaauguuucauguuuauaauuuuaagugugcuuuuugccucaaucauuuugauuucuguuucuuuucugagggugguauccuuacacagcuuugucagagaagcauuguuuagcugguggauuucuuuacacauucuagguuauuuuagcuguuuuaggaacaguuguuauuaaguaaacauuugaggguaguaauaguaauagcucacacaaguacugugcuugcugugugucaggcacauaugaagaagcugagauacacagauaugaagaauauuguccuaggucauuuagcuaggaagugacaaaauaccaaggucugugcacuuaacuucuauacuauccugccuuuugugaguacauuacauggauuuuuuuuucucugaggcaaaguuucucucaucucccaggcuagaguacaauggcacaaucucagcucaccacaacgucugccuccugggugcaagcaauucuccugccucagccucccgaguagcugggauuacaggcgugcaccacuaugccuggcuaauuuuuguauuuuuaguagagaugggguuucaccauuuuggccagcuuggucucaaacuggcuggucucaaauuccugaucuugugauuugccugccuuagccucccaaagugcugggauuacaggcgugagccaccacuggccugaggguuuuaaucauguguauuuccacaaaauccucuuggguuccauaauaaaauuuuuuuggaaaauuauaaugcauauuagguuuacaaaaggccuugagaagucauguaguaaagaaaccuuuaacucuuguuuacauuauuuucagcuuuauuuaaucauagggcccccuuuuuucacgugaauuauuaauaccacacagaauacugauguucuauagaaaguuucuguggaacuuucagugauuuuaaugccuccaguugcuuuggugugcuuuauuugaucuauacuucuguucacuuguggugguugauacuguguacauuuuaaaaagcgagauguuacuuuuuuuauggaagaaauaaauacuugucaguggaguucagauaauuuuuagcauugugcauguuuagaaaagugcuucacuuucaagugaauuaaguaucucaggagggggaauuaaugaaugagcauauuuauuuaccuucauauuucuuuuguuuuguuaggucuuaucaugguuuuggcuggagcuucugaauuugauccucaguauaauaaagaugccacaagcagaccaacggauaauauucuaauaccacagguuaggcuaauuucccaaaucccccgaugagcaguuaaguauuaaagugaauacuuuuuuuaaaaaaagcguguuuuugaauaauuauuuuauuuauucuagcuaaucagagaaauuggcagcauuaauuuaaagaagaaugagccuccacuuaccugcccauauagccugaaggccagaguucuuuuacugucucaucuugcuagaaugaaaauuccugagacccuugaagaagguauuugugauuccgguaucuacagagguuuagugggaugaaagcagcagaauuaauuagacuuaaugguguguauuaguuuguucucgcauugcucuaaagaaauaccugaggcuggguaauauauaaacaaaagagguuuaauuggcucauuguucugauggcuguacaggaagcauggcuggggaggccucaggaaacuuuuauucauggcagaaggcaaagccagagcaggcaaaggcagagcaagugucuucacauggccagagcaggaggaagagagagaugggggagaugccacacguuuuuaaacaaccaggucuugugagaaguguaucucgagaacagcaccaaagggagaacuccaccccccugauccaaucaccuuccaccaggccccaccuccagcauuggggauuaccauucaacaugagauuuggguggggacacagacccaaaccauagcaugguggugcgguguguuuuguugcuguucuuuuuuggccaaauaauugcucaaggacuuuuuaaaaaagaaauguauaugcuacauaauuacuucacaaaugguuugaagaucuaaguaagucagacguuuuggcaaguguuaaaauuuaguguuucaaggugagagaaugcucuguauaagaaauguuuaguuaauugcagaucauacaaaaguuccuaauaauuuuuuuaaaggacuuuguaaguuuuuggagggagcaaaauggauuucacaacaaccaacaccucucaccuccccaucuacaagcuuccuccgacagugguuaccaauaaugucuguuuuauaguuauuuaaagcuucauaaguacuugaagccauguauucugcuuaaaagaaaaguaguugauggaggcaacaguguuuccagggaugucauuaauuaucucuuuuucaccgacauuauuucaguuaaaguuuuaaaagacaguuacuaccucuaggaaauaaauguucuuuuugaaugauauccuaccaucccccaccuccuuuaaggcaguaaugcaguuaaaugcuuccgaaaacaaggccaugugacgcuuaguaauuggugauaggacaggaugcuuaugguggaaugaaggagcacuauuuaggcaauaucauuggaguugcuuugaaauacucaauuaacuaguaauucuguugcuaauguucuguacagauacauaagcaucuccauuuuuacuuaccuguaagaagcaggaaacaaaucauuguugaguaccaaauccauagguuaauguggucuuaauaguuaacuauuauaugcaguauaaaugaaagagucuuucucuuucuguaaguugcccucuucuucucuucuacgucucuuaucucucccccuguauuuagcugacauauuuauuuugacauauuuaguugaucugccugccucagccucccaaagugcugggauuauaggcgugagccaccaugcccagcugggaguugguuuauuaagccuaacauuaugauauuaaaaauuugucuuugaaacgucuaaucugagcuaggguuuuauggcugauuuuugacauagugauacugaggagaaacucuuccauucaaucuguaaaauucugagaucaugugaaauauuuguggcauaacuuuaauauuaguuuugggccacagugauaaagaugcuuuaacuguaaaauuaaaaugaucuguuucagguuuuuuauuguuuugcagaucagcaauucaugcuaaaaaaguguccugcccuacuucaagaaaugguuaauguaaucugccaacuaauaguaauggcccggaaccgugaaggugaggaggaaauauaguuaauuauguuauacuuuuucuugcaagcauaugcagauuguacuucauauuuuaggauuuauggguacucagacuucugucggccaguucagugagcuucuucaauuuuacucaugucuuuucauauuucuuuccuauauuuucuauuauuuaaagucuauaucacagcucacuggguuuuuuuuguucuuuuuuuuuuuugagauggagucuugcuuugucgcccaggcuggagugcagugacaaaaucuuggcucucugcaaccucugccuccuggguucaagcgauucuccugccucagccuccugagcagcugggauuacaggcgcguaccaccacaccuggcuaauuuuuguauuuuugguagagacaggguuuuaccauguuggccaggauggucuccaucuccugaccucgugauccaccugccucagccucccaaagcccuggucacuguguuuuugauuuuaauucuuguuuuuuuuuuuuuuggagacagagucucacucugucgccuaggcuggagugcaguggcgcgaucuuggcucacugcaaccuccgccucccagggucaagugauucuccugccucagccuccugaguagcuggcauuacaggcgcaugccaccacgcccggcuaauuuuuguauuuuuaguagagacgggguuucaucagguuggucaggcuggucucaaacuccugaccuugugauccaccugccucagccucccaaagugcugugauuacaggcaugauaauuuaauuauuuuauuguucaauuguuugcaaagauuuaaaauuucucuuucuuugaauaauuuuugaguuaggucauuuuuucuaacagugaauuugaaaucuuuaacugauauaaaagugauucauaugucauguaauuuuuauuaauuaauuauagacagcaucuaccagggcuggaguccaguaggguaaucauagcucacugcagccucaaacuccugggcucaagcaguccuucuaccuuagcucuccgaguagcuggaacuacaggugcauaccacagcacggagcuaacuuuacauuuuguguagaggugggaucucacuuugucgcccagacuggucugguuuccaacuccuggcuuuaagcaauccucccacuucagcuucccaaagcccugggauuacagucaugagccacaugccuacaggcaccuagccauuuuuuuuuuuuugguauggaaggaaaagaaugagggaauuucuggucaguaauggaaaggaaugcccuuaaaaaaggauagugguuaugguuuguuguuacgggugauguugguucuugucauggugucauauguuggugauacugauaaugucugauaauuuacuauuauuugaggugaggcaaauaauuuuucuuuuaaaucaaugguuguugcuggaaaauguucauuagaucgaguuuguauauuuuuagugucuucucugguaacuuuuaaaggaaaaucuuacuaugauccucaaauuugagguguuauggauuuagugugaauuuuguuuuugugaugaauuguauacuccugaacauguaaaaaguccagcccuguuucuuuuuuuccuguucuuucuaagaaagggaguuucgugcuccaacuuuggcaucccuagaaaacugcaugaagcuuucucagauggccguucagggacuucagcaauuuaagucuccccuucugcagcucccucauauugaagaggacaaucuuagacggguuucuaaucauaagaagguaauucuuugcuacuuuaaagucaguuuucagcaguuuguccugucacuuaaagguaacaugaauaaaaguuuucuggaaaugguuacuaugcauuuuuuagauuuagaaugucuuaaauacucuaaaacuuucucucaggugguucuguuaacauuuucuugacuagguagcuguguuuuauaguauuuuacuacuguaaguaguuuuauuauuuuggggguuguugcauuuaaaaagucaacaguuaguuccuuauauuauguuaccaaaaauaaauguacugucuacuuuacagucauuuuauucuuggcuuaagguugggcaauuguuuacugguuaagcaugaacaacaaaaacauuuaauaaaucaaauaaagacaguucuuauuuagaauauauaaucuauaguauaaacaugauaaugaaucuuaagauauaacaaaaauuuguguaaaugaaaaacuugaggaaauauaagaaacugaaguuacaauucuaguaggagauuuuaaacauuauuuuguauaugauagauaaaacuagcagagaauagacauuggauuugauaguauauuaauguagaauuaauaaaugcauguuggaaauuaguaucagaguucucuguccuuuuaaguacucauguuccccuuauaaauuugauuguauguuaagucauaauuaaaaacuucagaaucuaaaagcagagauuuuacaugccucaugaucuaaucugugucuuugaaagugaaaaauaacuagcaccaaacaccuggaaaauuaaagaacacgcuccuaaguaaccauuuugccaagauggauauuacuguaguaauagcuauauuuuaagaauaacaaaaaugagaauauugcauaguaaaacuuugaaggugcgucuuuauugagguuuauuuuuacuuuuauuagguaaaaguaaacguuuauuauuaaagguuuguuaauaguaaaccuauuaauugcuaauuaaagguuuuuguuauuaaaauugaaaauaaacugaggacaucaauugacaaaguucuugguugagucaagauucuuauuuuuucccuccaacuuuguuuuuucuaauuuaaaaaaauaagccuguauuaacuuuauaauuuaaaaauucuuaauuuaaauuuucuuggagaaaaaggucaugaaaugccauaucguuauuuuguacuuugaaaugcacauuaaucaacacuuuucuaaaaguugcuggauuuuguugugguuaacaugugaguaauuuucuuuuuaugaaaagcuuugugaguuagggaauuauguauuuucuuuuuuuuuuuuauucaguauaaaauuaaaacuauccaggauuuggugaguuuaaaagaaucagaucgucacacucuacugcacuuccuugaagaugaaaaauaugaagagguuauggcuguccuugggaguuuuccauaugugaccauggauauaaaaucacaggguaagugggagguuucucuguugagcauugcuucccuuuugauagauugguucucauuuauuugacucaggauucucaaaacacuguacuuaauaacauaacuuguuauuagacuuugcagaacuguaguuuaccugucagauuuacuauguuggaaaaugauuuauaccuaauaguuugagaacacugauagaguccuacuuuuauuauccucauaaugggaugaagucugaacacucuguucuguaguucaacuuuuagcaauuucuuaacuuuccaaagaaugaugaagacuuccaggcauaauaaaagaaugagauauuugaaguauauuauuaguaugaaagaaauagcugccuaguucuaaaauuaaauuuuuaaaacccaacuuauuuauguuaauuaaauguugaaaauuacuguguuuuaugccacauuucauguguuuuucuugcccuaccucuauauuuucuuugagggaaaaaaauaaaggcuauuuuucuaccuauauaauugcucuguguuucuauuucaauaucugaauggucuuagaauacugagagaauuagagacuaucugcuccauucuuucauuguggugguggucugagcuuuaacauuugcuaaguuacuauuaugagaacauucuuuuaguuaccaagaauacagggauauauuaauaaugguuucugucuuuauuuuauuuauuuauaaauaauuuuugagacagggucucacucugucguccaggcuggagugcaguggugcgauuuuggcucacugcguccucugccucccgggcucaagcaauccuucuaccucagccuccugaguagcugggacuacaggugcacacuaccauaccuggcuaauuuuauuuuuuguaauuuuaguagagacagcguuucaccauguugcccaggcuggucacgagcuucugggcucaacugcuccaccugccuuggccucccgcagugcugugauuauaggugugagccaccgugccugguuugugucuuuaaagagagcuuauugucuaguugaagcaauaggcuuaaaaauaagauaagggcugggcccaguggugucaugccuuuaaucccaacacuuugggaggccaaggcagggggaucacuugaacccaggaguucgagaccagccugggcaacauagugagacccugucuuuauaaaauuaaaaaaaaaacacacacacaccaagauaacauaugcuaaguguuaacgugaaugacacagacauuguaccauuuauuuauacagcaaauauugaaugcugugcacuccucuaggugcuagggaagcagugguaagacauacccucugcuuauugagcuuguauucuaauaggaauucuaauugggaaaggaaggcaaacagugcaaucugguuucaguuuggcuggaguguagcauauguguugugaaaacuugguuugcuuuggugaggaguugggguugccuuguggggccaugaguuuucagacuuuaaaaauacuaauuuaaaagcuguauuuaggacugugcugauuuaauaaaacuguccaaauaaaaauuuugggacuuagagauacuuugugauauuaagaacuguuaaaaguauacccuuuucuuuucuuuucuuuucuuuuuuuuuuugagacagucuugcucuguugcccaggcugaagugcaguggcacuaucugggcuuacugcaaccuccaacucuagguucaagugauucuccugccucagcccucccaaguagcugggauuacaggcgugugccaccaccaugcccagcuaauuuuuguauuuuuaguagagacggaguuucaccauguuggccaggcuggucucgaacucccagccucaggugauucacccaccucagccucccagagugcugggauuauaggcgugagccaccaugccuggccaaaaguacaugcuucuuagaaaaaugaauauuagaagagauuuucuuauagaaaguagaaauuuaagaguguucggccucacugacaaauauuaccauggauccacuccauagcaucuuggauagacaguuuauuuauauuuuuacagugcugccuaauuauguaauaauagugcuauaguuggugaaggaggaguagaagaaauauagaagcaggaaaggggcaucugcaugauaauaaugcuggagaugguggaucuccuucccuaccuugcuagaaucuguaauagaaucuccuguaguccuuuucuucacuuuaaagcaccaaacagcaggucagcauucauguaguuauuucacaugaccugcuugugcacauacagcugugcaaaaugaaaaauguagaugaauauguggcccagauuugauuuuugauaauggagacuuccagggugaagaagggauaccauacccuuuguugauacccagcugcugcaccuuguagcggguaauggagauagcaauugcagauuauuggaggccauucuuuucaacugaugguauguuaguaaaugccagaccaguaugaaaaguaaacauaacaaacuuaaaacuguagguaaaaacauguaagaagaacuaucuuacauauaaaaucuguagaaaaaaugaauuaaugaucacauuugaauggaagguauauuugaguuauuuuauuuuuauuuauuuuguuuuauuaacuuuauaguagaguuuuuggggauaugugugggaaauaugguuuuaaaaauuaaauaauugcaaaaacacguauuuaguaccauuuauugaaaaaauacuuuuucaaaagugcuuuuuaguguaaagaggauauauuuguucuugccuuuaaaaaaauaagucucuuuagugugguuaggaauacuagcuuucauuauuuuuuucagacagacauugaucauacagguaaaaucuugugaauguaagguuugcacaguuuaauagggugacagaacccuauuuuuaugucacugugagagaacuguguuaugguaggucucacauuauacuguguuuucagaaaccuggguuugaagcuuagugugcgaaugcagguguuguguggguuuggguauuuuacuuuauuucugaaccucaguuucuuuuuuuuuuuuuuugagauggggucucacucuugcccugaagugcagugguacgaucugggcucacugcaaccuccggcucccagguucaagcuauccuccaccucagccucccgacuagcugagacuacaggcgggcaccaucacgccuggcuaauuuuuguauuuuuuauagagacaggguuuugucauguugcccugcuggucucgaauuccugagcucaugccauccgccuaccuuggccucccaaagugaugggauuacaggcaugagccaccaagccuggcuaaaccuuaguuucugaaaguggaaauacuuuguagagcuauuuuaaggauuaaaugaauuaauuguuaaaagcaucuacuggagagccuuauacagaguagucaaucaguuauuuuuuuaacaaauuuaaaauauaauaugcuugaaauacuaaagugccaaacuaauuuggguaagcuaaguuuugcuguuugcauuaacauagaacuugauuuuuauuuuuugcuguuuuuuuucuuccaucuuaacaguguuagaugaugaagauagcaacaacaucacaguaggauccuuaguuacaguguugguuaaguugacaaggcaaacaauggcuguaaguagucuaucuguauuuuuaugcuuuaagaguugugugucaaggcuuuuauauuuauuucccucauugucaaagucaaaacuguuguaauaccaagaucuaauuuugcaaauucuguuaacucuuuugaaauuuuaaauuaauuuucaugagacaguuuucacauacacuaaaaaaaccuggaaaauaauccuuugugugauaguuuaauucucuauaaaacauaaucauaacaaaguaauguggauauaguucuugagcugugaagugcuauacagaaguuguuacugaugagaauuucaucaccuauuccuuuuuagucaguucuauagagaauugacuuuuauuuuucauuucaaaaucuaagaauuacaauaaaaauaacauuuuuuuuccugauaaugugaaacauuuauguugucuggaaaaaauuuaaacaaugcagaaaaguauaggaacaaauuaaaacuaccuaaaaucccaccacuucgagaugauucguuuugaggcucaucccuguauguagccuaauguauguauaccuguagagcuaaaugauguuuuugucauggaucccuucucucucccauuuccuuccuuccuucccucccucccuccuucccuucuucucuccuucccucccuuccuucuuuuuuuuuucuuuuuugacggaguuucacccuuguuucccagacuggagugcaauggcgugaucuuggcucacugcaaccucccaucuccuggguucaagugauucuccugccucagccucccgaguagcugggauuacaggcacacgccaccacaccuggcuaauuuuuguguuuuuaguagagaugggguuucaccauguugaccaggcuggucuugaacuccucaacucaggugauccaccugccucggccucccaaaguucugggauuacaggcgugagcuaccgcacucagcccgucucucucauuuucuuuaggaaaaccccuugucagccucaaaugaucagagugcauaaucuuguugugugucgucuucugucuuucuccaugcucauauuuaccaucuggaucuuuauagugcauacguacauauaugcacuuaaauguagauugguacuugucucaugcuuuuuuguuaaauccaguccaaucauuuugcauauauuuccuucaucuuuuuuuugagauggagucuagcuagcucugucacccaggcuggaaugcaguggugcaaucuuggcucacugcaaccucugccucccagguucaagugauucuucugccucagucucucucuaguagcuggcauuacaggcaugugccaccacgcccggcuaauuuuuguauuuuuaguagagaugggguuucaccguguuggccaggcugguccugaaauccugaccucaagugauccacccaccuuggucucccaacgugcugggguugcaggcaugagcaacugcgcccagccuauuuuauuuuuuguugagacacggucucacuguguuaccuaggcuugagugcaguggugcagucucggcucacugcaacguccgccuccuaggcucaaaugauucucccaccucagccuccugaguagcugggaccacaggugugcaccaccauguccagccaauuuuuuguauuuuuaguagaaaugggguuucuccauguugcccaggcuggucucgaaugccuguccucaagugauauguaccccucagccucccaaagugcugggauuacaggcaugagccaccaugccuggccuaauuuuuuuuuuuuuuuuuuuaauagaggugcgggucucuguaggcugcccagcugaucucaaacuccuggguucaaaggaucuuccugccuuggccucacaaagugcugggauuacaggcaugagccaccaugccuggcuuucaguuucuauuauuuauauuuucuccugagucaacugguagagacuguaguauuuugacucaauuuauucaacuagugguagauuuuagcuucuuucucugagguuuuugagcaucugcaagaaauacaugccacauuuauaucccaugccuaaaauugcugguaggaaaaacauauauauauuuuuuucuuagagagauggaggucucacuguguuggccagguuggucuugaacuccugaccucaagugauccuaccauuucagccuccuaaagugcugggauuacaggugugagccaccaagccuggccugaaaaucauguuuuguaguaggauauauugaaucaaagauguuguuuuuauuauagcaagugauaaggaagcauuugucauggacucuaggugagagagcugccuccugggagaagaggaacugaaaccaaugcugaaauuggguuuagaauccaaaucuagacuacccauauccuuuggacuucccagccugaaaaaugagcaaaaauuuggucuugaacuauugacauuucuggaguaauugguagaaaaaagaauggaauggaacugcccuggaguaaagaaaagaauuguuuuuaucuucccauucuuguaugaacuguaccuuggaguaaucaaguaucagaacccagcuaauaagugaaaggaggaaguuaugauauaauuagacuagggaguggcaaccuuuuucuuuaaacauccagauaguaaauauuuuagguuuuauaagucauacaguguuuguagcaacugcugaacuuacagauggguguggucauguuccaguaaagcuuuguuuuaaaaagcagguggcagggcaggcacaguggcacagcuacuugggagguugaggugggaggauccuuugagcucaggaguucaagaccagccugggcaacauaacaagaccacugucuuuaaaaaaaaaaaaaaggcaagugguguggacuguucagaguugacuccugaauuaggcuguuuuuauuguauagagccuaaaaauuauaacuuuuuacuuguuagcuuuaauaauucuagggaguuuauuaaacacagccugcaugucaucuucuaguauagaugcuuacugggacuuaaauccuaaauuuacugguucuguacugauucuaaauggauuguaugguugguggauauagcuuuaggauauguagauuuucaugguguuuuuuuuuuauagauauggggucucgcucuguugcccauguuagucucaaacucuuggggucaagcaauccuccugccuuggccucccagggugcugagauuauaggcaugagccaccaugcuccaccugugaugauucaguucuuagucucaggucucagguccaauaagcaguaucacugacaauagugaauaaacuaauacuagucucaaggguuuuuuuguuguuguuauuucgcacaucacacugacauauugucaagguuuuaaugcagaaaauaguauauauucucauaacauuaaaauacucaacguuugcuugcuaagaauaaaagugaaauuuuaaacaaauauuuuuacuguauguauccuuacuguguuuguaaacuugaguagacuguacuuuucaaaacuuguucaagacagaugugagauacuuuagaagguaucuaccugcauaggcacacauucaucagcuaguaauugcuaaacgucuccuucuuugucaauuguagccaguuaaaaauacuuaauaaaaaugcaguuugaaagauugcuuuguuugucugaaagauaaauauagguugacagauuuuguauuucucuucuugccgccccccaggaaguauuugaaaaggagcaguccaucugugcugcagaggaacagccagcagaagaugggguaaaaacuuggguuuccgaaccuauuuuuccuagugaaagaaauauuuuauuuacuuuuccaauugacuuauauugcucugggagaguaauucaguuuagcuauuuccaccuaaaaauuacuacaaccuucaauugaaucuguugcuauaacuuaagagugugacguguuaugauucacagcagggugaaacuaacaagaacaggacaaaaggaggauggcaacagaagaguaaaggacccaagaaaacugcuaaaucaaaaaaaaagaaaccuuuaaaaaaaaaaccuacaccugugcuauuaccacagucaaagcaacagaaacaaaagcaggcaaauggagucguugggaauguaaguuuauuauuaucguuauuaucauuauuaagcuaaaauauacaaacuaaaauguucaagucuuacguguacagcuucaaaaguuuuacauaauuuaugcacccgugauacccuagaaagcucccuugugcucuucucagucagugagcccuucauccaucuccccaucccucuaccucccacuauucugucuauaaucgccauagauuaguuuugccuauuccuaaaggucauauaagugucauauuuuauguauggcuccuuucauucagcauuauguucaugauaaucccucuguauuguuuguagcaguaguucauucuguguguguguguguguguguguguguguguguguguguguguguguguauaguauuucauuguaugaauauaccacauuuaccuguuuuguggugguucgacguuuggauuguuuguaguucuuaaccuaauaugaauaaagggugcuaugcuuauucuuauacauggcauuuugugggcagucauuuuccaccuagcaguggaauugcuagauuauaaaguaggugcaugcuuaacucguuaaaagagccuguuuuccaaaguuguaccauuuuaugcucuuaccuacgugugagagucuuguucuacguacucaccaacacuugguuuuaccagucuuuuagcuauuuggcagaucuguagugauaucucuuuaugugguuuuuguuugcauuuaccuaauggcuaaugauguugaacaccguuucauaugcuugcuggccauuuggauaacuucuuuuucuauuggguuguuugucuuguuacugaaauuguaggaauucuguauauauucuggauaagaguccuuacauuuuuacucuuauugguagcuucuaauguuuauuauuuuaaugaggucaauuucauuagucucuuuuuuucgucagugaggucaucuuucaucgauggcuaaugcuucugugucuuaaaaauuaagacauccugacuguuccaaagucauagagguauuuuucuguuuucuucuggaaacauuauuaccguaguugauaaaccuaucuugaauuaacuuuucauuaauggugcaagguaggggauacgaaccacuuauaccaucaccauucauugaaaaggucauucuuuccucaguaaauuguaauggcacuuuguuguaaaauagaugaugcugagcucagcaaggcuacugcggccagacugccuccucucugggcagggcaucucugaaaaaaaggcagcagccccagucagggaauuauagauaaaaccccaccucccugggacagagcaccugggggaaggggaaguugugggcacagcuucagcagacuuaaacaucccuaccuggcagcucugaagacagcagcagaucuaccagcacagcauucgagcucugauaagggacagacugccuccucaagugggucccugacucccaugaauccugacugggagacaucucccacaagagacagcucauacaggagagcucuggcuggcaucuggcgagugccccucugggacgaagcuuccagaggaaggaacaggcagcaaucuuugcuggucugcagccuccgcuggugauacccaggcaaagagggucuggagcagaccuccagcaaacuccagcagaccugcagcagaggggccuguuagaaggaaaacuaacaaauagaaaggaauaguaucaacaccaacaaaaaggacguccacucagagaccccauccgaaggucacugacuucaaagaccaaagguagauaaauccacgcagauggggagaaaucagcccaaaaaggcugaaaauuccaaaaaccagaaugccucuucuccaaaggaucacagcuccucaccagcaagggaacaaaacuggauggagaaugaaugugacgaacugacagaagcagguuucagaagguggguaauaacaaacuccuccaagcuaaaggagcauguucuaacccaaugcaaggaagcuaagaaccuugaaaaagacgaauugcuaacuagaauaaccaguuuagagaagaacauaaaugaccugauggagcuggaaaacacagcacgagaacuucgugaagcauacacaaguaucaauagccauauugaucaagcagaagaaaggauaucagagauugaagaucaacucaaugaaauaaagcgagaaaacaagauuagagaaaaaagagugaaaaguaacgaacaaagccugcaagaagugugggacuaugugaaaagaccaaaucuauguuugauugguauaccugaaagugacggggagaauggaaccaaauuggaaaauacucuucaggacauuauccaggagaacuuccccaaccuagcaaggucaacauucaaauucaggaaauacagagaacaccacaaagauauuccucgagaagagcaacccugagacacauaaccgucagauucaccaaggcugaaaugaaggaaaaaauguuaaagggagccagagagaaagaucggguuacccacaaagggaagcccaucagacuaacagcagaucucuuggcagaaaccuuacaagccagaagagaguggggccugauauucaacauucuuaaagaaaagaauuuucaacccagaauuuaauauccagccaaacuaggcuucauaagcaaaggagaaauaaaguccuuuacagacaaggaaaugcggagggauuuugucaccaccaggccugcccuuugagagcuccugaaggaagcacuaaacauggaaaggaacaaccaguaccagccacugcaaaaacauaccaaauuguaaagacugucaaugcugugaagaaacugcauaaacuaaggggcagaauaacgagauagcaucauaauggcaggaucaaauucacacauaacaguauuaaccuuaaauguaaaugggcuaaaugccccaauuaaaagacacagacugccaaauuggauaaagagucaagacccauccguauacuguauucaggagacccaucucacgugaaaagacacacauagguuuaaaauaaagagauggaggaauauuuaccaagcaaauggaaagcaaaaaaaagcaggguuuauaauccuagucucugauaaaacagacuuuaaaccaacaaagaucaaaagagacaaugaagggcauuacauaaugguaaagggaucaaugcaacaagaagagcuaauuauccuaaauauauaugcacccaauacaggaguacccagauucauaaagcaaguucuuagagaucuacaaagaggcuuagacucccacacaauaauagugggagacuuuaacaccccacugucaauauuagacagaaaauuaacaaggauauccaggacuugaacucagcucuggaccaagcggaccuaauagacaucuacagaacucuccagcccaaaucgacagaauacacauucuucucagcaccacauugcacuuauuccaaaauugacagcauaauuggaaguaaaacacuccucagcaaaugugaaagaacagaaauuauaacagacugucucucagaccacagugcaaucaaacuagaacucaggauuaggaaacucgcucagaacugcacaacuacauggaaacugaacaaccugcuccugaaugacuacuggguaaauaacgaaaugaaggcagaaauaaagauguucuuugaaaccaaugagaacaaagacauaacguaccagaaucuccgggacacauuugaagcaguguguagagggaaauuuauaucacuaaaugccuacaagagaaagcaggaaagaucuaaaaucgacacccuaacaucacaaaagaacuagagaagcaagagcaaacaaauucaaaagcuagcagaagacaagaaauaacuaagagcagaacugaaggagauagagacacaaaaaacacuuaaaaaaaaaucaaugaauccaaggagcuaguuuuuugaaaagauaacaaaauagaucacuagccagacuaauaaagaauaaaagagagaagaaucaaauagaugcaauaaaaaaagauaaaggggaugucaccacugaucccacagaaauacaaacuaccaucagagaaugcuauaaacaccucuacauaaauaaacuagaaaaucuagaagaaauggauaaauuccugaacacauacacccucccaggacuaaaucauuaagaagucgaaucccugacuagaucaauaacaagcucugaaauugaggcagcaauuaauacccuaccaaccaaaaaaaaguccaggaccagaugguuucacggccaaauucuaccagagcuacaaagaggagcugguaccauuccuucugaaacuauuccaaacaacagaaaaagagggaauccucccuaacucauuuuaugaggccagcaucauccugauaccaaaaccuggcagagacacaacaaaaaaagaaaauuucaggcgaauaucccugaugaacauugaugcaaaaauccucaauaaaauacuggcaaacugaauccagcagcacaucagaaaguuuauccaccacgaucaaguuggcuucaucccugggaugcaaggcugguucaacauaugcaaaucaauaaauguaauccaucacauaaacagaaccaaugacaaaaaccacaugauuaucucaauagaugcagaaaaggccuucaacaaaauucagcagcccuucaugcuaaaaacucucaauaaacuaggcauugauggaacguaccucaaaauaagagcuauuuaugacaaacccacagccaguaucauacugaaugggcaaaaacuggaagccuucucuuugaaaaccagcacaagacaaggaugcccucucucaccacuccuauucaacauaguauuggaaguucuggccagggcagucaggcaagagaaagaaauaaagaguguucaguuaggaaaagaagaagucacauugucuuuguuugcagaugacaugauuauauauuuagaaaaccccaucgucucagcccaaaaucucauuaagcugauaagcaacuucagcuaagucuuaggauacaaaaucaaugugcaaaaaucacaagcauuccuauacaccaauaacauacaaacagagagccaaaucaugagugaauucccauucacaauugcugcaaagagaauaaaacacccaggaauacaacuuaaaagggaugugaaggaccucuucaaggagaacuacaaaccacugcucaaggaaaugagagaggacacaaacaaauggaaaacauuacaugcucauggauaggaagaaucaguauugucaaaauggccacacuccccaaaguaauuuauagauucaaugcuaucccaaucaagcuaccauugacuuucuucacagaauuggaaaaaacuacuuuaaauuucauauggaaccaaaaaagagcccgcauagccaagacaaucuuaagcaaaaagaacaaagcuggaggcaucacgcuaccugacuucaaacugugcuacaaggcuacaguaaccaaaacagcaugguacucguaccaaaacagauauauagaccaauggaacagagcagagcccucagaaauaaugccacacaucuacaaccaucugaucuuugacaaaccuguuaaaaacaagcaauggggaaaggauucccuauuuaauaaaugguauugggaaaacuggcuagccauaugcagaaagcaggaacuggauuccuuccuuacaucuuauacaaaaaaauuuuuuuuuuaguuauacuuuaaguuuuaggguacaugugcacauugugcggguuaguuacauauguauacgugugccaugcuggugcgcugcacccacuaacucgucaucuagcauuagguauauuucccaaugcuaucccuccccccuucccccaccccacaacaguccccagagugugauauuccccuuccuguguccaugugaucucauuguucaauucccaccuaugagugagaauaugcgguguuugguuuuuuguucuugcaauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugcggcaauaaacauacgugugcaugugucuuuauagcagcaugauuuauaguccuuuggguauauacccaguaaugggauggcugggucaaaugguauuuccaguucuagaucccugaggaauugccacacugacuuccacaaugguugaacuaguuuacagucccaccaacaguguaaaaguguuccuguuucuccacauccucuccagcagcuguuguuuccugacuuuugaaugauugccauucuaacuacaccuuauacaaaaauuaacucaagguggacuaaagacuuaagacuuaaaaccauaaaaacccuagaagaaaaccuaggcaauaccacucaggacauaggcaugggcaaagacuucuugacuaaaacacuaaaagcaauggcaacaaaagccaaaauagacagaugggaucugauugaacuaaagagcuucugcacagcaaaaaaaaaaaaaaaaacccaaaaaaacaaaaaacuaucaucagagugaacaggcaacccacagaaugggagaaaguuuuuauaaucuauccaucugacacagggcugauagccagaaucuacaaagaacauaaacagauuuacaggaaaaaaacaaacaauuccaucaaaaagugggcaaaguauaugaacaggcacuuuucaaaagaagacauuuaugcagccaacaaacauaugaagaaaagcucaucaucacuggucauuagagaaaugcaaaucaaaaccacaaugagauaccaucucacgccaguuagaacagcagucauuaaaaagucaggaaacaacagaugguggagaggauguggagaaauagaaacacuuuuacacuguuggugggacuguaaacuaguucaacccuuguggaagucaguguggcgauuccucaaggaucuagaacuaggaauacuugacccagcaaucccauuacuggguauauacccaaaggauuauaaaucauuuuacuauaaagacacauacagauguauguuuauugcggcacuguucacaauaacaaagacuuggaaccaacccaagugcccaucaaugauagacuggauaaagaaaauguggcacauauacaccauggaauacuaugcagccauaaaaaaggaugaguucauguccuuugcagggacauggaugacguuggaaaccaucauucucagcaaacuaacacaagaacagaaauccaaacaccgccauguucucacucauaagugggaguugaacaaugagaacacauggacacagggaggggaacaucacacaccggggcaugucgggugguggugggcuaggggagggauugcauuaguagaaauaccuaauguagaugauggguugaugggugcagcaaaccaccauggcauguguauaccuauguaacaaaccugcauguucugcacauguaccccagaacuuuaaguauaauuuuaaaaaaaaacaacagaugauacuguaggucuguuuauggacucuaguucauucuauugauuauuugucuauucuuaugccagugccauacaguuuuaauuguuguagcuuuauguuaagucuuaagauaugguaguguaagugcuccaacucuuuauuuuacugaucaaaauuuucuuaacuguuuuaauuccuuuacauuuccugccaauuuuuagaauaagcuuaacaauuuuccccccaaaaagcugcugaaauuuacauugguauugcauugaauccaugguucauuauggggagaauugacauguuaacaauacugagucuuguuauucaugauugugguuuaucuucauuaauuuggaucuucccuaauuuuucucagcaguguuuuguaauuuccaguggcagagguauggcacaucuuucguuagauuuacuccuauguauuugauccuuucugguauuacuguaaaugucauuaaaauuuuuauuugguguuuguugcugguguauagaaauaguugcuucuaaauauugaccuuguaucaaagagucuuauuggcaauaauucuaaccauuuguagacauuuuaauaaagauuuucuacauaugcaguguugccaucugugaauaaagacaguuuuacuuuuuucuuuuuaaucuuuauacccuuucuuucuuucuuccuuucugccucacugugcuggcuagaacugucaguguaauacugauucagagugaugauaguaggaaccuugucuuauuuuuggucuuaggaagaaagcaaacauuauuuuaccacuaaaugugauguuagguguaaguuuuuuguagcuauucuuuguccgguuaaggaaauguuuccuuuuauuuccaguuugcugacaauuuuuaucacuagcagauagugaauuucauuaaagguuuuuuuuuuuuuccacuuuuuuccuuucuguugaauuagauugauggauuuaaaaaauuugaaaccaucccugcauuccuggaacaaauaucauuuggucauagcuuaguauuccuuuuuauauuuaucuggauuuuacaguauuuucuuuggauucucacaucuauuuuuaagagcaaauauugguuugucauucuccuuuuuuguaauauccuugucagguuuuguaucagauuuaugcuggcauuauuaaucaagcuaggaaguauucccuuuuuugcucagaagaguuuguguaagcuuugauuuguuuuuuuagucucuggaagaauucuccagggaaaccaucugggccuggaguuuuuaaagggaguuauucgcagaguuuauuucuuuaauauauauucugcauuuuucuuauugauuuuagcaaauuauguuuuucaaggaguuugucuauuuccucuuaauuauuaaauuuguuggcguaacauuauucauaauuuucuuuuaaugucuguuggauauaguuacgccucuuguuccuaauauugguaauuuuuauucuuuuuuuuucuugaucauucuugccuagggguuuaaucaauuuuauuagccuuuucaaagaaccaacuuuuaguuuuaaguuucuuuuucuguaucucucucugcucuuuuuuuuuuuuuuuuugagacagagucaugcucuguuacccaggcaguggcucacugcaaccuccgccuaccaaguucaagcgauucuccugccugagccucccgaguagcugagauuacaggcaugugccaccaugcccagcuauuuuuuuguuuguuuguuuguuuuuuguauuuuuaguagggacgggguuucaccauguuggucaggcuggucucaaacuccugaccuuaaauuauccaccugccucggccucccagagugcugggauuauagcaugagccacugcgucccgccuguuucugcuuucuuugcauuuaauuugcuguucuugauucuuaaagugagcuaguauuuugcugaagauauugccuuuacuuacugcaucauaccuuguuaguuaaagaaagugauucuguacuuccaaaggaguacuuuucuuuauuucuuuuuuuuuuugagauagggucuugcucugucacccagacugaagugcuguggcauggucaugccuuacugcagccuuaaacuccugggcucaaaugauucucccaccucaaccucccaacuagcugggacuacagacguguaccaccaugccuagugauauauauauauauauaauuuuuuuuuuuuaagggaucaggucuugcuguguugcccaugcugguuugaacuccuggccucaagcagucuuccugccucugccuuccaaagugcuaagauuacaugcaugagucgcugugacuggccccaaaauuauacuuuucuauaaacuaccuguuuccuuaaauaaaauaugauugauguuuuugaaagcagaaccaucuuagccuuuguguuauugggcuuugcaaauagaaauacuuuuauuugacaaauuaugaagaaugaauaaaauaacuaacaauagacagacuagccagauauuaaacucuuuagucugacucccacaucuuuauaaguaggaauguuuauaauuuuaaaaaauuguauaugaauagugaaauugucaucgagucaguuuaguuaaauugacaauaaguuaacuucagggauucagauugauauguucucauugagauaugcagaaucuuuguguuugccuuucccuuuuaggaagcugcaguaaaggaagaugaagaagaaguuucagauaagggcagugauucugaagaagaagaaaccaauagagauucccaaagugagaaagaugaugguagugacagagacucugauagagagcaagaugaaaaacaaaacaaagaugaugaagcaguaagccuuauagguuuaaauaauuuaaauaauuggaauuauaucucugaugauagcuuuggguuuuguuguuguuguucauuuguuugcuugcucgcuugcuuucuuuaaauaauaucuguauauuuuauaauuuuauuacuuugaagaacguuuuuaaggaaugguagucaagguuauacagaaaaaugauuucuaacaaggauuggaaauccucguuuucuuaaauauuaaauuguuagguagaguaggaccuggguuugagguuaggucaguuggucucauaaggggauuuucaguguuggggauaucucugggaauaugaguaaggaaagguguuugugaaaugcauagugcuuacuuggaaggcugugucacaagcuccaguucauguuuacuguagagaaacaguacuguggacccugaugucaagagguugguuaagggaaaagcuaacauuuauagaauaccaccuuguuucauggguguauauaagauauauuaaggacaggggaagucuuuacagaauuuauuaauaugguguaaaaguauagcguauaggagaaaaaucucauggcauuaaguugcacauaauuuaugggagaauuauagagaagaaugggguccuuagaggcucacugcaaauaaacugcucggccauuucuuuuagguuuguuagcguuguucuuuuugaguggccauugaucuaaaaguaacacuguaguuugggagauaaaaagggauugccugaauagccucagaggcaaaaggagaggccaaaaaaagaggaagagguaaagggcaaaggauaaaaguauaagggguuaauaacacacuuguccuugggaaugguagaaaacaaagaugucuauuguuagcauuugcagggccuuggcuguuuuuguacuuggagaauuaaauugauugccaggaaacuaaaaucugucaaauacauuauaucccuggccugacuuugagaaagaauugacauauuccuaaguauauuaggguaaguagcagugacucuuaggguuuugacagacuaauuucuucauaugaccaaaaauacauucauuaaaucaacaaaucauuauuuauuaccugucacaucccaaggcugucuaagauuaaagauaauacaaagccaaaugugaaacagcuucaggucuugaaugauaauguaggcuaguggggcaggcagauuuguaaauaaauacuauaguacauaugaaauuacacacaucuuaugcaagguacauaaggagggagugaucaguucaguccugagguagaaggaaauuuaugggaggcuuuacucaggaguucauacuuugggcuuuaguugguccuaaauaauaaugaguaggcagagaaagggagaaaucaaaguccaaacaggguuuaggaggagugaaauaguuugguaaguucagagaaguguagguaguuugaaaugacuagaauaaaaagcacaaggagggaggcagugacaggagaccaaagagaggcaggcuagggucagauaaugaacggcuauguaguugauacuacagugguuagauuuaauauauuuaaaaaggcauuguaaggaugagcagggagaugaucagauuugugagacugaacuuguucuaauccuaaguaguuaauuagcauugucaggaauaauaccuggaaauccuuaaagugauaaaacacauacuagauuuuaaauauuuuaauuuuuuuguuuacuaggaguggcaagaauuacaacaaagcauacagcgaaaagagagagcucuauuggaaaccaaaucaaaaauaacacauccuguguauagccuuuacuuuccugaggugaguuauauacaggcuacuguguuccuuauuccauucacuuucuccucagggauuugucaguugacuuuuagcccucugucguguguauuaguucauaugugcuaaauguggucuauccugagaggccauauuuuuaaaagggaauauuacaauagguauuauacuuagugaacguguugcuuauaaaagagauuguuagcuucuuaaguauuucugugguuuucuuugcuucugucuuuucugugcccugauuacugaguguuauguguaauggugauuucucauuagcagauuaggcagucuucaucagacaaaugcauauuuugccuuugaauacuuaacuauuaugaaucucucaccucugccaaguuuuaaaucggaugaaaaaauucuuaaauuuucucucugaggauccugcuggcgacauggaaccauuagaauugcucugacccuggucauuguugucccaguccauggaaaugugugagcccauggcugugggaccaacuguguucuuggcucuaauaaauaaaguuccauaagagcuugaucauaacugagccccgggcucaggacaggucauuauagugcuauuuguugccuuguccuuguuuacuuuguaauugcagccugcucaacuuucgaucuccuugauagccuguguuguucaucuuucaaauuaccuugggauucccuugacauuuugcauuagaguaugauucugucuggaguagaggucaagaacugguucccccaguucgggaaacuguuccacagacugccucacagcuuugccacagaaccuucugcucaccacuuguguuuggcaggugauuucauguauaaaucugcuuucugcucgaggaugucaaucuagaguuucuggggacugcuuaaggcaaauucguaaauaauuuggcucucuuaguaauaaaugaguggcucugcacagacuguuguuuugacuuggagagaagucugcccaggauuccaucuuaaugcacgugcugaucuucuggcauguccugagcuuuaguccaucuguuaggggcauugugcccauugcagagguagccugccaacaccaagcauccugaaaugaagcaaguaaauuccauucauugauugguauaaaaagugccauggggugcucaaagcugccuaguguguacccauguaacagacaguuucauuuuagaccaugcuuaguuaauaagagaaacauucauucacucccucagaacauuuuauuaguggccaagugcuguggcucaugccugugguccuaggcuacuugggaagcugagguuggaggaucacuugagcccaggagauugaggcugcauugaacugugauugugccacugaacuccagcuuggaugacacagugagacccugucucaaaaaaaaaaaaaaaaaagauaaaaaucauuuuaucagcaaaaugccuuuuucaaauuuaaucugcaucugcaugguaaacauuucagaucauuauuuaucagauaaaauguauuuagggccgagugcaguggcucaugccuguaaucccagcacuuuguggggacgagguggguggaucaccugaggucaggaguuugagaccagccuggccaacauggcaaaaccccgucucuacuaaaaauacaaaauuggcugggcauggugucacaugccuguaaucccaccacucaggaggcugaggcaggagaauugcuugaacccaggaggcggagguugcgguaagcugagauugugccauugcacuccagccugggcaacaagagugaaacucugucucaaaaauaaaaacauuagccgggcgugguggcgggugccuauaaucccagcuacuugggaggcugaggcaggagaauugcuugaaccugggaggcggagguugcagugagccaagauugugccauugcauuccagccuuggugacagagugagacugucucaaacaaaacaaaacaaaugaacaaacaaaauuuauuuaggaucuuucuaaccucucuaccugucuacauuuccguguuucuuaccuaaguaaccuaacuaccaaacuacccacuuaguaauauuugacuuacauguuagugaaauucgucuauuguauuuaaugcguuaagaaugguuaggaaucucacaaaagaaaaacaauuuugucuaaaauacagguaacucauagaaaucuguuucacuuuuaacaugugcaucacuaggcacagguguagugcuguugauugauauucacuggcuucuuaauaaauauucuuuuuuuuuuuugagcuggaauuuugcucuuguugcccaggcuggacugcaguggcgcaaucuuggcucacugcaaccuccaccuccugggugcaagugauucucccaccucagccucucgaguagcugggauugcaggcaugugccaacacacccagcugauguuguauuuuuaguagagacaggguuucuccauguuggucaggcuggucuuaaacucccgacuucaagugauccacccgccuuggccucccaaagugcugggauuacaggugugagccaccauggcuggcccuaauaaauauucuugagugaaucucauuguaauuaaauaggcugagagguuggagggaaaggcauucucuaaguggggagguaaagaagugcauaaucuuuaacauaauccugugcugcuuacauucccuacuuguuguaaugauguuucugacaaaugucaaaaugacuuaaaaaagaggugauauuguaccucaugucacuaauaaucauaacugccaccuauuauacugcaugugcuaggcuuuguaacauauauuuuuauuuguauucucucagaucaucuuuacaacauggccagaaguaggcacugauuguugagaagaaaaugagauuuuagggaagugaaauaacccagguuucugugucuuuaaaacagauauugucaaacugcagucugcaggccagaucuggcugccuuccuguuuuuguaaaugaggcuuuauuguaaauaaaguuuuauuagaacacagccacacuuauuuuuuucaugcugcaagggcagauuugaguggccgcaacagagguguuauuccacuuugaggcuguuauguauuuacacacauauguuauguauacaaauaugccuacagugguaguccuaacccucgguuuaagcagaauuuaauuuucuuguuaagugccacucaugucaccguguacuugucauuuauuuauuagacuuuuuaauguugcagugcuuuaucuccgaagguauuuaaacagaagaguuuuuaguugugcuuaguagcguuugaaagauaaaccaaauuuuaaucuauuuuuauaguuaaaauuuuagcagcaauuuuaguuuaaaaacauaaauaugggccaggcguggugacucaugccuguaauccuagcacuuugggaggccuaaaugggaggaucgcuugagcccaggaguucaagaccagccagggcaacauaaaugaaaucuuguuucuacaaaaaaugcaaaaauuagccagacguggugcaugccuguagucucagcuacuugggaagcugaggugggaggaucacuugagccccagaggcagagguugcagugaggugagcugagauggugccacugcacuccagccugggugacagagugagacccugucucaacaaaaaacaaaaccaaaaaaacccacguuuucucaaagaaacuuucaguaagaugauuuuuuaaccauuucggacaauugagaguuuagaauagucuaguacuauuuugguuaaauaaauauuuagaacauccuagaguuuauuuuguuuuaagcuguaaaacauuuuucuuuaaacuguuuuagaaagauacuucccuacccaacucuuaaaacagguguuaauaagcaggugacuaaauagugaacugaggugugcuguaauagagcaguuguugcugaaugcacggagguuucgugcuuucagacuucuuggccuucuaaaauauauauauacacacacacauauauguauauguauauauguguauauauauauauauacacacacauauauauauguuccuuccacuccaacuuuguggcuuuugcuuauuacuagguaagaguacuaagauuauuugcuacaugcuauuguaauaguuguauauauuuagaauaaugcuuguuacuuaagguuagucaggguuuuuaauaugaaggccaaucaauagguuuuaaggagcuauugaaauccccaaaauugcauacaaaaugcuuuuaggcaauggaucuacaaauguuaagaacagcuuauucuuucaguaaauauucauuugaauaccuauuuuguaccaagcaguuugucagugcagaggaucucuaagauaagagaggccaaaauuauauucuuucuaguucuuucugauuauuuauaccccucuucuuuuuuuuuuuuuuuuuuuguuuccaggaaaaacaagaauggugguggcuuuacauugcagauaggaaggagcagacauuaauauccaugccauaucauguguguacgcugaaagauacagaggagguaacuaucaagcaacaugauuucaguguuuaacaaggcacagcugucaccaucaugcugcuucauauaucuuuuuuuuaaaaaguuuaucauauuuagcauauuguauucuauucguugccugcauuuuguaacuguucucuauuuuggggugagcucauuggaaauuuauaaauaauuguuaaagguaggcaacuuagucaauguuuuaaaaauuuguucucagcuuguuuugggaguuuucacuguuagugucuaagaacauacaccuuuccuccuccucuccagaauuuagugauagaauuuuuguucuuauuggauuaguguugaguauuagaucuuuugucuugaaaaaucuaagaacugaugauguggauuucuugaguggaauuuuugauuacgugguauucacuguuaaugacaucaguaaagcagcauugugaugaacauauuuacccuugggaacugcauuuuuguuguuguuuuucauguuuuuuuuguguguguguuuuuuuucuaggaagaagguucugucugccuguacuugguggacaaaagcuuuucaagauagcccuaugauguugauuuuuaguacauauuuuuuaacccuuuauaaucaagugguaaaugcaugaaauagguuaauaauaaauuuauagaggucgaauugaugggcuggaggcucuguauguuuguaauuuuggucuauauugcuagauauuuauuucucuauagaaagaaugaaugucuaaauaugccuaauaccucucagcaugucagacauuuugaauaucauugcuaguuggaaaggugaaaaauagcaucuuagaucuucauguuauuuuuuccucugaucuuuuuuuugagacagggucuggcugugucacccaggcuggagugcagugguacaauaucggcucacugcaaccuccgccucccgggcucucccaccucagccucccaaauagcugggacuacauacgugcaccccguaaaaauuagccacgcccggcuaauuuuuguauuuuuuguagagacaggguuuacccauguugccuaggcuggucucaaacuccugagcucaagagauccgccugcuuuggccucccaaagugccgggauuacaggcaugagccacugugccuggccucucugaucuuuuaaguuuuaaaaccuauugaaaaguuaacaagcaugguaucaugaaaccucccuagauccccacccguauucaccaguuguuuacauuuagcuguuacuuguuuuaucuuucacuguauauguauguacaaaacaugcacgcguguguauuuuccccugaaccauuugagguacuuguagacaucaugacaugacaccccuaacuacuugacauguaucccuuaagaaccagggccuugggcugggugcaguggcuuacaccuguaauuccagcauuuugggaggccaaggcgggcagaucaguugagcccaggaauucagcagcagucugggcaacguggugagacccugucucuuaaaaaaaacaaaaacaaaaacaaaauccaggaccuucuccauaggccuacuacaaugauuauacucaggaaauuuaacauugauguggcauaauuaucuaauacgcagucuguauucagauuuccucaacgauuccacuaaugucuguuacaguuuuugguuuuauuuuuaaacucaggaucuaaucaaggaucacacauuguagcuggguguggugacuugugccuguagucccagccuaacucaggaggcugaggcaggaggaucacuugagcccaugagguugaagcugcaaugagccaugaucaugccccuguacuucagccugggcaacagagugacaugucucgaaagaaagaaaaaaagagauuuuuacauuguauuugguugucaugccucuuuaguguugaauacuuucuuguucuuguucuuuuuuuuuuuuuuuuuuuugagacagagucucacugugucgcccaggcuggagugcaguggcaugaucucggcucacugcaagcuccgccucccggguucacgccauucuccugccucagccuccugaguagcugggauuacagacgcccgccacugcacccagcuaauuuuuuauauuuuuuuaguagagacgggguuucacuguguuagccaugauggucucaaucuccugaccuugugauccgcccgccuuggccucccaaagugcugggauuacaggcgugagccaccgugcccggcuuccuuguucuuuuuuaaucuuugcaugccgcugacauuuuucaagaauccaggcaagguguuuuguagaauaucauuuaauacgaauuugucucguugguuacucauuauucaucuuuguguuuuuggcaagcaaacuauguuggugauguaguucuuaggucagaaguacaguauaugacuuugcccuauguuggugauauuaauuaagguugcucauuuaguuaugguuuuucucuauuguaaagguauuuuucucccccucuaaucuguggggugauauuuaggcccugugugaauguccuauucuccaacaguguuuuacccaaucguuuuaaacauauguugaugauucuuuucugaaucaauuuuuacucugcucauucuauucaguguaguuuuuauuucucugaagagugaaacuuaaccuucaguguguuugaguugucuuuuuaaugugucuguuugugaccauuguucacuuuuguugagucuuaaaaaguuguuuugggaucuuuuuuuaauguuaagaaaucagcccuuugugauauguguugcaaguauuucuccccaguuuguuguacuauucugguuguuucuaccagauagaaauauaaauaccuauuuguuuauccauuuucuuacuuauuuuuuguaguaugauuuaaagaauuuuuuuuuaauaguuucuagguuuguguuauaguuaggccaaacugagauuaauuuaagaaaaaaagauuccuucaugauuuuuucuaguuuuuuuaaaacuggcauauuuuaauauuuaaucuugacuguaaaaucuggauuuuggagauuggagcagaucacuagagcagaucaccagagaauacaaaugucauuuuuaaaaaauuguucuuuuguccaaguggaauagaaacuuuuuaagaguuuguuacuauuuguauuugaaguuuaugauuugaugauaaauaaaauaucuucuugaccuuuggcauugggcguuuauucuagaaauaagaaaauuuggcaggaaguaucuccuaucuagugaagucuguuguuuuauuccaacauuucauuuacuuaugcuuuuauaccugcuuaauuucuucaagaugauagcauagaauuugguugcuuuaaguacugcuuucuugaauuguggagagacaaauuaaccucaucaguucugcauaauuugauuuccucuuugggagguauuuauaauauguaacauacauuucgcuuuuuuuuauuauuguuuauaaggacuuuaguaacauuuauuaggacuuucuguaucaucugcagaaaaaaccuggcuguuaaauacuguggucuaggaauuuuagggagugagcuguuuccuccccauaauacagauuuuuaagugcugauuuuaucuucuagguagagcugaaguuuccugcaccaggcaagccuggaaauuaucaguauacuguguuucugagaucagacuccuauauggguuuggaucagauuaaaccauugaagguaagaauagugacucuucaauaaauaagaguuuucuguauaaauguuuaauauacuaggaaaacauuucuaguuuugaaauguagaguuauggaaggaaaaagaagucaucucaugcuuuauauaugauauacuugauggacuacucuuucaauaauaaacuuaagguuuuagguuuuuaaggaguguaacaguuuagaacauugaauauaaauuacuuuagggaugcauuuuaaugugcuguaacuuuauaaggccucagcaaauggguucuuuuuucuuuagaaaggcacuuuuuuuuuuuaaaccacagauucuauuuggaguguauauuaauuucugaaacuaauuuauuuuugucaucuuagagcauacacuucuguaaguaucauuugcagcacacucugaucuuuguuuaccaauucacuugagcuuuuuauaaaagguguccuauuguauuagagagauggugcuaaaaguauuauugcauuauaaaggguaaaaguagccaguaaaugcgaaccucuuuuuuguuccaugaggguuccauauuucuuuuauuaacuguagaauuuuacaucacaagucuagagacugcaaaaugucucggguuuuucuuccuuaaagcagaaggcuucuguuaagauaugacucaguguucuugcucaagaaucacaauuauuuuaugccauagaaauacauucauaaauaguauaacauacagaaucaaaauaucaaacuguauuagaaauuuaacuacauuuacauauuguuaaauuuacuuguuuuauuucugggaugaagugucuguucuaaaugaaugaguugaauuuagaauuguguccauaaaaaacuauuucuuuguaauugcuguggucaaagaaaaccuuuuguuuaccaagauuucuuccauuauuucuccccaaauuucugaugucuacauuuaauucuucuuucuaguuggaaguucaugaggcuaagccugugccagaaaaucacccacagugggauacagcaauagagggggaugaagaccaggaggacagugagggcuuugaagauagcuuugaggaagaagaggaggaagaagaagaugaugacuaagcaguacucugaauggaccacaguguuugcacauauuugcaauuuuuugcuguuuuggaaguguaucauaaaccagaaacaguacagaacugauguugagggagguguaguuuuuuuacucuugaaaugggugcauaauauaacuaggcaguggcggugccuugguacaaccugaaaaauguuaaggcuuauugaaaccuuucaaguaggggaugguacauuuauuucaucugcaaaugauaauaaauccuuuguuauuauaacuguccagaagugugggcuauguauuaucugaucagucuauggucccaguaaaaguaaagaugcaggaaacacagucuguaaaugagcgacuuuucuuuguucagcuuuaguuuuagcaaacaccacaaauauguuuuaaguaacaucgcucaaguuuaaguaacaucgcucaaguugauaaucucuugauaagcucuguuguugacauuuugcagugauacaacagcuccacucauagauuuaaacuuuuauuuuuacuuaucuuggucauaaguuggcauucucucacauuccacaugauauagagggcuacguuuuggaauuuuccuuuucuuaauugcccagaguuaucagacagauuauaaaaauggcuuuuaauggcuuaaaccauuucuaaaccucuaucuuagcagaucaaugcaggaucuaauucuuuugauaaguucuagcucuaaaagugauagugggacuguauguuuucugauacugguggcuuauguuauuaaaccuuuuuuaaaaaagguucacucuaaaagcugaacuacauccuuaguuuucagucuacuugacucuaucaggagcuuuuuaaggaaaguaaguauaacaugcaaaggaagcuuuuuuuguauucauuuuggacuccugucaauaaaaauagaaguuuguugacucguuuuauguuucaauggugugugucuuuuuacuaucaggacauaaauagggcaauccacuucuuuauuuuucaacuaaagauugaauaguauuguacauuacugcuaaagugacugcuauuucuguauacuguagaaaaacccaggagugagagggauuuccccucauaguacaacuggaaggauagugcuuguaaagaguagagauguguacaugaugaaucauugagggaggguggauauuuuuauuccuagauauggaggaaacauaagucuguaguauuauaaaacugauuguaauaauucuuuccuaucaaaaucuccauaggucaaaauauuguuggaauacuaaaauuugcaaccuuguuuacuuuaaaagguugccacuuucagugcagaauacuaccggcaucuuguuacugcaauaguuggaaauaaaaugugaaaauuagcaaaaccaugaaugguuuuuuugguucuaaauuuaagauguaauauuuccuauaaaagggugaaagcaguuucuuucucuauaaccucaaucaccaguuuagugagagccuuucuuggcaggcaggaggcagugucacugaggauuuuuuucauuuacuucauuguacaaguaggaggguggguuuaauuuucaaaucagguucugcugugaagcaccagugucuugaggcagcuacugauuaccuaagugugguggcaggggguaagccagcuggugucaagugaaaggagggauuagagaaaacagguguggcacgaaggcaaggaaacugagcagacaagacagaacaauguguagaaugcauauuuccuaguuuucuugaaagauuucaagaaaaguuguuuuuuuuuuucuaguggcuacuuugccuuaaagaggcuuuauaaguucauucacacagcuggcuucucugguuuuaagauucuggagaggaugauaaccuaguaacaccacagugcuuaaaaaaaaaaaaaaaaaaaaaacuaccaucaccagaaaauuccaccaguuuguuuuccuuuucucuuugugugauguguauguacuucccaacuaaguaaaauaaaauuuccucuagugagugcuuuagguaaccucuuuccauauggcaguagugaaagaacugagccuucaguugauaguucuucucucuccagcaagucgcuaaacuccacaucccuucguuuuuccucuggaaugagaauaacaaacuauccuaguuugcauuuaaucuaauggaaacuugagcaaaguuucaauuuucuuccuauaaagaaacugacauuuugucaacaauugaugagccuauagaucauacaguguauaggaagugaaauugaaacaguuaaauuaugugauauuuuucucuaauugguaaaguaccuauuaaaauacagcuguucaugaggagacuuaccacaauucaaaguguagcaguuguguauuuuagcauuauaauauuugauugaggcccugagguguuaauaucucaaucucagaguuagauguucauguccuuuuugaauuuuuuaaacauuuuucauaauuuuuuuuuuaaguuagggagcacauugagugaaguucucuguguagaacaauaccuucugcucugcuucucccagcuuucacugagggcuggaaaaggacaggccuguccagcuguacugucccacuguguauggggaagcucaggcucugguggaagcagggggcguggaugucaaacaacugauguggaaacagggagggagagauauaaugaggcucucuaggcauguuauuuuugaccacaaguuuuguucaguuugcuucagccaauccaaaccauauacuagaguguucuguagucacaauucuuauuucaaauguaauucagcaccuuacauaauuuuugagagguugucauucaucacauauuuacugaguuucuaugugccaggcucugugacuggauacuggagcuaucaaaaugaaaaaaauaguguuaagaacucacucgcugguguuagagcagguagaugaguggcaauccauuuaaauccauuugccuuggcuauuauuuggaaugccuuuuuuuuuuuuuagucuaucuacuguaggcagaagaauuauuucuuuaggggcuagcuguuuauuuugcuggccuuuuuuucucucuuucucuuuuucuucuuaagacggagucucgcucuguccuccaggcuggaggagugcaguggcacgaucucagcucacugcaaccuccgccucccagcuucaagcgauucuucugccucagccuccugaguagcugggacugcaggugcaugccaccacacccagcuaauuuuuuaauuuuuaguagagaugggauuuugccacguuguccagccuggucucgaacuccuggccucaagugaucagcccuccucagccucccaaagugcuggcauuacaggcaugagccacugcgcccagccuguuggguuuuuuuggaaaaaaaacaaaaacaacaaaucaucauccuuuccuuuaaaauguuuuuuuuuuuuuaagaaacaauuuucccacaaacggucugauuuaacuccaugaaauccucuauuuagacugccuuaaagugaaauaacuguuggugaaccauaacauuuugccagcuguguagugauuaguccaaauaugucucaagaaguuagcaccaagcauucucauccauuuaaacuugaugcuagggcuauuuugcaaaacuuaaaaagaugcgaucuuguacauauuucuguaaccugagcugaaaacccaaauaacaaucauugacauacuuuagggcuauuguuucagguggggguguauacaucccaggggcguggagaugaucaauccauugaggaaguauuaagaugauuauuuguauuuaaucucauccuuuuaaauuucuauuuuuguguguuuuauaauguacauaauauauuguacaauuguacacuucuauuauuuauaaauaaacauuuauuggugcauuaa

SEQ ID NO: 192135 - RNA, 131827 nt, Homo sapiens
agaaggccacgcgagcccgggagggacgcggcggcgggggcugcaggaaaggcgcgagcagaggcggcggcggguguacuguagguggucgguccggcagcagcccggcccccggacgcaggacguggccccaggcagcccucgcagcucagugcucuagccggggcaagcccgcgucuccgccugcuggacgggcccaggcgagauguagggcucugggcgcggaggccgccgguggggcggcugaucgcggaggaucgcggagggcgcgccgaggauggagagagcgauggagcaacucaaccgccugacgcgcucgcugcgccgcgcgcgcaccguggaguugcccgagggugagccgggucgcggggccaggcuggccgcggggcugggggcggccaguggggcaggagcuccggccgcgucaaggucggguggaaaaacuaacugaaagcugagaaaacgcccacuuuuacuuuccagagcugagaggcggccccgggccccgaacuccccuggcccgacgcucccaccccggcaggugggaguuuucgggaggaaacuggguugguggggguuccgcugcugggaggagcgagacaaaggucucgcaacgucugucgauuaggggucuuggcaaaggggcaggaauaccagccggaggcccgagacccggagucagaaaacaucauaauugcgggucauuuaacaguagcuggggauagagaugauccaaagauacuguuuacuuuaagcugcaucggggggccaggcgggcuuuuauuuuuguuauuuuuuaaaauguggggcacugccuuguuuugauaacaggcaaacaaaggguugucaaacaucaaacagguacucuuaaaguacuguauggguaaacacaauauauuuuucuuuaauaugcaugccugccuucauucuucauuuauucaucagacuaguauugagugggcuagcugguaacuaggacgcaucugcaaagaggaauaaggcauggucccugaggaucaggacuuuuaguucagcgugccaggguucccucaggacagguaaaacucugcuaauaacaaggagagaaaauaagcaguuuuguuugcagcgucaggaauucagacauuuuaguggugaugggagacagcagugcugcuucuaagaagcuuuuggcucuuuaugcccaagugagagaaggguugggaggagguuguagcuggugaauagcuuuuuucuuaauuguaguaguuuaucuuacuuuuucaaaacucucuuugaauugcugcugggugguuuguaggauagggaaggagaccuuggcagacggucaugaaagaaaugugggauuggguacuuuggcgauaauuuucuuuccuuucuuuuauagagaugaggucucacuauguuccccaggcuggucuugaacuccugggcucaagugauccgcacccugcuccccccaaaguguugggauuacagaugugagccaccgcgccuggccuggggauaaucuucuugaaaaaauggucucuagucucuauuuagaauucagauuuugguaacuagauucuagcuucaacuuuuucuauauuuucuuuccaacuuccaccuuugaauccauuucuuaagugcuacucuuacuuauuuuucguagucgaauuauugguauagcuuuaugaagacuacauguauaauuuauauugucuaguuugaaucccgauauuuuuuacauaaaugugauuuagaagacuuugauaauguuacuugguuuuaaaaguaauauaguuucauuguagaaaauuuggaaaauaaagaaaaauagaaaaaaauaugucauuucaccauccaguuauaaacaguguuaccauuguuauuucuuuuucccucccuaacaaguuaaaaucauguugcauauagucuuuuauuuuguguuuagaaaacauccuuuuuuuuuuuuuuuuuugagacggagucucacucugucgcccaggcuggagugcaguggcgccaucucgacucacugcaagcucugccuccgggguucacgcuauucuccugccucagccuucccaguaguugggacuacaggccccugccaccaggcccggcuaauuuuuuguauuuuuaguagagacgggguuucaccguguuagcuaggauggucucgaucgccugaccucgugaucugcccgccucggccucccaaagugcugggggauuacaggcgugagccaccgugccccgccccaaauguuuuuuuuuuuuuguauucuucaauaggcuuaaugacuucagaauuucauaggaugcauguaacaaauguugaaucuaaauacuguuuuuaaacugauuuuaugagaaacagcuuuguauuuaagacauagucugccucuaaauacuuccuuaggguuaauucuuacaagaagaauaucuacaauacauuucuaaggcucaacauaucaguuucucaacuuacuccuuggaaaguuccaccagcaguccgagagugcccagaaacuagaguauuauuaguaaaaguaaaacuuuuccacauaggcaaaaauggcaucguuugcauuugcuuuucuuugauuauaauguucauuuuguuccuugaauuuaauuuaucuuugucucuaagcucugaugagucuuugaauucucugagcuuggcucuuuaaaguauaucauacauauaggaauauauauauauauauguaaauauauauguaaauauauauguaaauaaauauauauauguaaauauauauauaacauuccuacugauacaaauccacauuugugcuuacauuuuaagagcugaauggaaacucugagaucucucuaaauuuagaaaauaaucagauuuuuuuugcuuuguuagaauucaguaaucaauaagcaucuaauuacaacaaacuauuaaacuuguaaacuuuuuagucagcuuguacucuaaaauuaauuuuguugcaaagguugaaacuauagauguuugauaaacugaguuggaugcuauguuuccuugagaugaugaaaaccugaguauuacccuaaguaauggagugcagguaguugaguccuccuaggcaggccuaacacaggaauauucuugagagaaaaagaggugaagaguaagaaauuacuuuagggauauggauucuuaguaguguuuaaaaguuggaggccgggcgcaguggcucacaccuguaaucccagcacuuugggaggccgacguggguggaucaccugaggucaggagugugagaccagcuggcuaacauggugaacccccggcucuacuaaaaauacaaaaaauuagcuggaugugguggcgggugccuguaaucccagcuacuugggaggcugaggcaggagaauugcuugaaccugggaggcggagguugcagugagccaagaucgcgccacugcauuccagccuggacaucaagagcgaaacucagucucaaaaaaaaaacacauaaauaaaaggaagguguauguuguuaguguauguaaaguuugaacuacuauauagugaaugcaguuuguuuaauaaaauaauaaaauuugagcccauuuuagcauaugugauugggauaauuguguuuaaaaaaauuacuccaugugaugguuugaagagaaauuguauauaauuaauuacucugagcaccuuuuuuuuguuaacaguuggguuuugaaacuguagugauaaaaauggcaaacaugucuaauaaagugauagauuaaacuuuucuugucacccuggagacuuuaauuauauaccuaauccugaaggugucuucaagaguagacaaggaaguaucuggcaacaaauuguauucuguccuuucuuaguauaguauuucuuggauagucuucuucuagcaccacaguugugguuagauuuauuucuucauacuuaccuguuaauguaugugaccuacuuuuuucuuuagguuagaugugacuuaagauguaaaucuaauuuuuaucuaaaaaauaaaaaccuuacaaguacaaccauugugaaccuuauuaugcucacuaacgcucacuuaaaauuaugcacuaucuugauuuaaaguuuaucuugauuuaaguuuaaacccacaaauaacaguguuuuuuaugacuuuauuauggggugacuuaauggaaauucucaugguuuagaaguucagauuuuuauugggacauguauuauuauaugaacgauaaagaauguugucaugccaagggaggcuuaguguaguauuuucaacuccugguggugacucauugguaguuucugagagcaauuaguggguugcagucagcauuuaaaaaaagaaauauaagaggauaaaacagagucuauuuuacauauuaagaauaguauucuauuguagaccuucugguuaugugguauauacugggugcauuguaggauauauuaucuuuuuauuuuuuaucuuuauuuuuuauuuuuuuuuccgagauggagucucgcucuguugcccaggcuagagugcaguggcaugaucucggcucauugcaagcucugccuccuggguucacgccauucuccuaccucgaccucccgaguagcuggaacuacaggugccugccaccauacccggcuaauuuuuguauuuuuaguagagaugggguuucaccuuguuagccaggauggucuugaucuccugaccuugugaucugccugacuuggccucccaaagugcugggauuacaggcgugagccacugcacccagccaggauauauuauuuguagaggcucuggaaucagccacauaaugccacuguuacacagcuuguuacuuaacuaguacuucaguuuucucauuuguaaaaugaggauaauaguaccuacuucauagggugguugugaggagaaaagcaaugauacaugcaaaguguuuagaaaagugccuuuaagauaaugguucuuaaauguuauuaauaggauuuauuaguauuuuacuuuuauagugaaaaaguuguugcaucugcauacugaacuugugaauguugccaaggacuaaauuguuuuucauguauacacucacaguaaaauaaugaacaaauaugugaaggaauauugauaacuuuuuuccauuuccccuauaaauagcucaguuuauauuucuaaacauaugaauuauguuuuucaaacacaauuauaauaccauuacuagagccaauacaauuaacaguaauauuguauuaucuugaaauaaaauaccaaguccauauacaguuuguccucaucucaaaaauugucucaaaaauguccuuuuacaguuuuuuuuuuugaaucacuauccagauaaggacuacauauuacguaugguugaugugucucuuaagacucuuaauguaugacaguuccuccuccuuuuaaaauaaguauuuuuuaaaguaauuuuaaacuuacagaaaacuuacaugaauagcccagaguuccucccauguaacuuccacucaccuuucccuaagguuaacaucuuguacaaccacaguacaguugucaaaaauaagaaauuaacauuuguguauacuauuaacuauacuacagaguuuguuaaaauuucaccagcuuucccacuaaugucauuuacggauccaauucaggauaccacauugccuuuaguuauguuucuuuagucuccuccaaacugugauaguucuuuaguuuuucuuuguguuuaacggucgugagacuuuuaaagaggacugaucagguguuuuguggaauucccuuuaauuugggcuuuucugacauuuucucaugauuagauugaaguuaugcauuuuuggcaagaacaguaguccacccucaucugcagcuuugcuuuccgagguuucaguugcgggaggcacagcacaauauuuugagagagagggagagagaccacauucacauaacuuuuauuacaguauaguauuauaauuguccuaauuuauuauuuauuguuguuaaucucuuacugugcccaauuuauaaauuaaacuuuaucauguagggaaaaaaaucauauacauaggguuugguacuauccaugguuuuaggcauugacucggggucuuggaauguauccccugcggauaaguggggacugcuguacugcaaaagugauguguccccuuucaguggaucauaucaguaacuauaugauauugagcauauauuauuuuuggugauguuacccuuugucaguugauuaagauagugucugcuggguucuucacuauaaauuuucuuuuuccuuuguaauuagucaguauuuuugagagguacuugauacuguguaaauaucuuguuucuccuuaaacuuuaaccuauuaacugagcaucagcauuaacuuuuaaagggcugaguggggguugucaggguuucaucuuuguaaauaauuuauuaaaaaacauaaaccuccaaaauacauugaauugagaaaugacccuuaguaauauauaaaaaucaauucaaaacacuagcuaaaauguacauaaguauaauauggcaucauagauguugauuuuuaaccuuuugggucauguuuuugugaauuuauuguguaaagggucucucuuagccuguuuucugcugauacaacaauaccacagacuggauaauuuguaaagaaaacaaauguauuucucacaguucuggaagcugggaaguccaacaguguggcaccagcaucgaguaagagucaucccaugguggaaggcagaacggugagagaggaagggugcugaacuucauuauaacuaacccacuccuggauuaacagaauuaauccauucaugaaagaggagcccucauggcucaauugccuccccaaagccucaccucuucacacugccauaauagcaaccaaauuuccaacacaugaacuuuugguagaugcauucaaaccauagcacauaugaauaaaaauguugugaguaaagugguaaguacaaugaagacuucagugcucuuucauaaaagcuucuaaacuaauuucuuuuguaauaauauugacaagaagccaguauuguguauauuuaagguuuuaaaauuauuuuagcauauauauauuuaauauccauauauauuuaaaauucccccaaacuacauguaaguaugauaaaacaugaugccuauaaauaccucuuuggaaguaaaagaaauuucaauuguuaaagcuacagaaagguuuuuggaugaugaugcgcgggcuaccauacuacacuuagagaauuguuuuuugguggauaaugggacaaaaccuucugaagaaucagucuuuaauuguccuuuuacauccagaagcuaagcucuuuuguaaugauguaaaagggauaagcaguggaggggaugaaagauucuucacuaucguaaauucugaaauaccucugguauucugcauuauucuuuccuccuucuuccucuccuuuucgcuuuuuguauagaguuaggaaaauucuaaacuaaucuuaaguaucaccccuugcacaaaguaggggauaaaugaacucuuuguuuuuuuuuacucagauaaugaaacugcuguuuauacauuaaugccaaugguuauggcugaucaacacaggugagugcuuguuccaaaaauuuuugcuuuuuaagaagcauacauuguucuaaauguguacugcaugcccgugcacgcgcacgcgcgcacacacacacacacacacacacacacacagacaguuuggacauagauguucuggggcaaguuauuuaacuuuucuguuauaauuuugugugugugaaauaaggaauaagauuuuccaagaucuauaugagcuguaacauuuuaugauagauuuucuuaaugaauauugaaauacuaaguauuugguuggucacucacauagaaaaauacauugucaugauuucuuuuagaggucacuacugaucuuuauaguaaaagauuauggcugagggacaacuuauuucccuuaugugcuacuuauuuuuguguuccuuuuauugauguaguguugacauucuuuuacagggccauauaugaaauacaauuauuuggcuuugugagggggucuuuacacuuacaccagucagcucugccauggcuagccauugaauuuuuugauauaagaagaagaauguaaagagaaacuauuuugaaacaaguuaaaaaaauuuuuuuuuuuguuuuaaauuuccuaccugguauaauuaaaaaauguuuuuugucugauuuucuuuauuuggccaaaauuaauauagcuaggcucaacuuuuggcaaggggagcagccaggccuacacccuuuguuucucaagaaucuaaggaaagcuaaagccagcuuagucuguuguguguccuaagagcagguaacauaggauuauccaaguggcagaugaggaaaccuucagcaccagcuuauuggucaaggcguuugguuuuuggaugauacugagcuggcuaacauacuaagagaauagugcaguauuuuguggugggugugggacaaaaccugaagaaucagaagaauagcuaggccgggugggguggcucacgccuguaaucccagcacuucgggaggccgaggcaggcagaucacgaggucaagagauugagaucaucuuggccaacuuggugaaacccccucucuacuaaaaauacaaaaauuagccggguguaguggcaugcgccuguaguccuggcuacucgggaggcugaggcaggagaauugcuugaaccagggagguggagguugcagugagccaagaucucgccacuguacuccagccuggugacagagcaagacucuugucucaacaaacaaacaaacaaacagagcagcuaaagaguuguuaacuugauuuauuauguuuuuaaaaacuuuuuuuacacuugauuccucauuuuuauuuuggcauaggucuguuucugaacuacuaucaaauucaaaauuugaugucaauuaugcauucggacgugugaaaagaagcuugcuucacauugcagcaaaguaagacuaaagauauuuugaguuaaacucugaucuagggcaaggaucaguaagcuuugaacagcauuaucacacaauauuucuggggagagaugagaacagacagcugaguaguucuuuauccuguuugagcgcguggugugcuauccguucugucucuaaacuguuaacuuugggauuguauguaaaucucaugucccucuugucuuuguuuuauaucagaugagaguagguuagacauggagauugucuuuccuggauguacuuacugguacaguucaccaaaauuuucuuuuuaucccagcaauaugagauuuuauaugcugucugcagaugaagucauuggcuuuauauuuuuuacauagguggagaaugauuuuuaucuacagucuccugguauguaaucaaucaguuaacuaauugguaccuauccucuuuucaggauuuagguagauguguugaaauuaauuuuucaugaauaauuuggcuuacgaaaggccagaagguugaaaguaucauaugguuucuuugaaguauuugaauuucucaaauacuuuauaauuuucauaguagaauggaccaucuugaaaguagagaauguuuacuauuugugucagaaguuaaaucaaauuauagguaaaaauaauguguuuaaaaggccaugcacaggggcucacaccuguaaucccagcacuuuuggaggcugagguggguagaucacuugaggucaggaguucgagaccagccucgccaacauggugaaaccccaucucuacuaaaaauacaaaaaucagcucggcgugauggcgugcgccuguaaucccagcuacuugggaggcugaggcaggagaauugcuugaacccuggaggcugagguugcagugagccaagauugugccacugcuuuccagccugggugacacagcaagacucugucucaaaaaaaaaaaaaaaaaaggacgggcgugguggcuuacgccuguaauccuagcacuuugggaggccgaggcgggcggaucuugaggucaggagauugagaccauccuggcuaacauggugaaaccccgucucugcuaaaaauacaaaaaaaaguagccuggcaugguggcaggugccuguagucccagcuacucgggaggcugaggcaggagaauggcgugaacccgggaggcggagcuugcagugagcugacaucgcaccacugcacuccagccugggugacaugcgagacucugucucaagaaaaaaaaaaaaauguguuuaaggccaggcauggcggcucacaccuguaaucccagcacuuugggaggcugagguaggaggauugccugaguucaggaguuugaaaucagccugggcaacauaaugaggucucuucucuacagaaaaaaaaaaaaaaaaauuacccaauugugguggcucaugccuguaagucccagcuacuugggaggcugaggugggaggauugcuugagcccaggaggucaaggcuacagugaacugugauggugccacugcacuccagcaugggcgacagagcaagacugucugaaaaacaaaaagaaaauuguguuuaauagaauauuuuguuuuuuaauugaacuacaucaaguauggcuguauguugaauguaucugaacugucuuuuaauauuguuuuaguuguggaucgguggaaugcuugguuuugcuguuaaagaaaggagcaaauccuaacuaucaagauauuucaggcuguacaccccuucauuuggcagcaagaaauggguaacuauuuaguuuucuuaaguggcuuaaguuguauuaucaguuauucaaggcacuuugccuucguuugaugauuccucccgcaucccugauauuuaccuugggaaaaacuaaaauaauggugcauauuuuauuuucuauauuuuuuuugucucucaaagauauuauugaugauauuguucuucuuuauaguggaucuggggucauuauauucaauuuaaaaauagcuaucauauuuauuaauuuauuagauucucacuaauuuucuucuugaaaauauuauauguggaaguucauuauuacuuguauuauagugacauuguauuuucugaaaagcauaauuuucaucucuauuuuagugugcuuuuuuucugcuaaucuuuugccacuccuaacuccauggcucauuuugcaaauugcuuguuuagcuaauuuuauuaauggaauuauacacagacuuaauauauuguacacaguuuauuuguaauuauugugaaugagcuguaccagaguaaucuucuuagauacuaggguaguuuacuccuuuuagugcuaacauuaguuuuuauuuagucugagaaaucagaccaaaaugauuggaauuauguuuaaaaugaaaauaaguauuuuuugauucaggacuugaagaacuuauauuuuauaaacucuuucuuuuuuuuuuuuuuugagauggggucucacuccgucaccaggcuggagugcaguggcacagucucggcucgcugcaaccucuaucucccgaguucaagugauucuccugccucagccuccugaguagcugggauuacaggcacgugccaccacguccagcuaauuuuuguauuuuuaguagagacgggguuucaccauguuggccaggauggucucgauuuccugaccucaggugauccgcccaccucggccucccaaagugcugggauuacaggcgugagccaccgcacccggccuaaacacuuucaaacacuguaaaacuucuuuauggaguccaggccuguaaucccagccuuuugggaggccaaggcgggcggaucaucugaggucaggaguuugagaccagucugaccaacguggugaaacccugucucuacuaaaaauacaaaaauaauccaggcaugguggcacaugccuguaaucuuagcuacuuaggaggcugaggcaugaaaauugcuugagccugggaggcugaggcaugacagucgcuugagugcccgggagagcuagguugcagugaguggagauugcgccauugcauuccagccuggacaacagagggaaacucugucucaaaacaucaaaaacaacaaaaaaaaccccaaaaaacuucucuauggacacgguauacaaaugcguugugucuuuuuuuuuaauuacucuugaagauguuuuuguuuccuauucucaacugugcuucuagauauuugaguuggcugccuaauaagauggauauggagcuaaaaauuguccauuacaucaauccgaggccaaauuuuugcguauaaagauuaaaacagagcaaaaaagacagcaauaguguugccuagguuggacaggggaagggcauaguccuuugacucuugcugaucugcuccauuuccugauuuagcaugugagccaguuuaauuguccacuguucucauagguaacaaugugcugauuaaacaguuguuuuuauaauuagccauguuagauaucuuguaaugugucacacccaaggucauagaguaaaucauucauucccuugcugaauugaucucaggucuagguacauuauuccacguguugauaggguaucgacaaaggucuugaaaagguuacauguagaaaaauaucauaguacucuguuucaacaacuauguuaaugaaaggagagauuagugcagagcagggauaaacacucugcugucauuucaguaggcgacuuagucauaagacuucagugugaggagcaagaaauaagucuuagacuugaaaggcaggauguucuuggucugcugaaaagaauuuucauguaccguuuuuuagaaacaaauaaaguggcacagagaaaagaaauaguuuugaucacucuuucugucaacagugauugaagaccauuacauuuuaaaggugaagaaauauggcagauauuacaugauucacauagcuauucagcaagaagaaaaggaauaaaaagaauucaugacccucucuuuaauuuggaugccuuucuguuucuauaaagauuacucuugauauucaauacuuaaauauuuugguuuuuauuauuuauugaguggaagccuuguacaacuuagaggugcucaauguuugcuaagugacuugaguacuuccuguaguggcugauguuuucagaaauagcuuuuuacuguaauuucuuuaugaguucacauuuauccacacugaaguagaagucauaguagaguucuucccauuuuguuggucagucugcguuuuggggccagcuuuuuguuuuguucccucagcugucaucagauggcugcuauauuucucuuggcuugcuuuagcauuuuucucuuugccauuagugcuguauuggauuguccuccuuuccaaaagaagccccauuaagcuuccacagagcacuugggugacuggucccuguguaauuuggguugccauaagcucccuauaauuggugcaauaucugagcaggaauauaguugcuuccuuguacagggggauucagcauugcucaugcuuauaugagaauguuaaaaggagaggcuuuaaaauuauuguguguucuuagguuguguuuuggucaguuuugaaagaagaguuuuucuuuauuuuuuaggugauuaugagcucauaaaggguagggcccauguguuacauaauauuuuaguucuguuagcaaaauagcuacuuauuuauuggguugauuugacuuauucagacccuggaaaauaguaauaaugguuguucaauagaaagauaggauauauuucucuccuacauucccuguaccuuuugcaauucauuuuuggaaggggaagcauuauagauuacugcuuuucuucaacaaccccuaccauaaacacuuuuuugggccuauuucccuggcucauuccuaccuaaugauuuauuuugccauuauuggcuuaggccagugguccauaauaggcuucugaaagguuuuagaaauccacccauauagguauagacacacgaucacacauuuaaacaauguauuuauuuuaaugggacuaucugguuuguggucucaugauuauugaauauuuauuucuuaagguuuuccuaacaguguguuagauaaaggaacuuuguaaauguuuuaucuuaaaaguuuacccagaguuggcugggugugguggcuuaagccuguaaucccagcacuuugggaggccgaggugggcagauuaugagguuaggagaucgagaccauccuggcuaacacggugaaaccccuucucuacuaaaaauacagaaaauuagccaggcaugguggcgggugccuguagucccagcuacucaggaggcugaggcaggagaauggcgugaaccugggaggaggagcuugcagugagccgagaucgugccacuguacuccagccugggcgacagagugagacucuugucucaaaaaaaaaaaaaaaaaaguuuacccagagcuuuauuuucuucaguuucuuugauuauaaugcuaauuuuaagugauauuuaacuucauuacaaguacaaaaagcaagaaaaguaacuugucaguuguuuuuuucuaaaaaguuuuauucaaucaaugagaauuuuagcuauugacuuacaagauugaauauuaauaaucaaaguuuuauugagagcuacuaugagccuggcuaugcuuacuacugaguugauuaaagaaauaugauauaauccaugguaugaagauauuuaugaucuaguugaauaaauaguaauauauucauguauaguauauacucugccauucaaaguaauggcaaaaaccaccauuacuuuugcaccaaccucauauuacauuacuacuauauuuauuauauaauauguauacaauacauauguauuuaacauauacacacuguauuguauguauuacuguuuacucacuggacuauuuaccagugaacuauacacuuaaaaaugguugugaugggggccgggugugguggcucacgccuguaaucccagcacuuagggaggcugaggcaggcggauugccugagaucaggaguucaagaugagccuggccaacguggugaaacccagucucuacuaaaaauacgaaaaauuagcugggcaugguggcgggcgccuguaaucccagcuacuugggaggcuaaggcaggagaauugcuugaacccaggaggcagagguugcagugagccuaaauugugccauugcacuccagccugggcaacaaaagugaaacucugucucaaaaaaaaaaaaaaaaagguugugauggaggcugggugcaguggcucacgccuguaaucccagcacuuugggaggcuuggggggguggggguggaucaccugaugucaggaguucaagaccagccuguccaacauggugaaaccgugucuuuacuaaaauacacaaaaauuagccuggcgugguggugcaugucuguaaucccagcuacucgagaggcugagacagaagaauugcuugaaccugggaggcggagguugcagugagccgagaucgcaucacugcacuccagccugggcaacaaagagugaaacuccgucucaaaaaaaaaaaaaaauguuuaugaugggccaccguggugacucacgccuguaaucccugcacuuugggagaccuaggcgggcagaucacgaggucaagagaucaagaccauccuggccaacauggugaaaccccguuucuacuaaaaauacaaaauuagcugggcaugguggcaugcgccugaaauccuagcugcuugggaggcugaggcaagagaaucacuugaaccugggaggcggagguugcagugagugagcaaagauccgccacugcacuccagccugggcaacaagagcacagcuccaucacagaaaaaaaaaaaaaaacccauacaaaaauuagcuggcgugguggcacacgccuguagucccagcuacucggaaggcugaggcaggagaaucacuugaacccgggaggcagauguuguagugaaccaagcgugccacugcauuccagccuggcaagacucugucucaaaaaaaaaaaaaaguuaugauggcaaauuuuauauguauuuuaccacaauacaaauaacuuaaaaaaaaaagaaucucuacaucccccuccucacccuccagugaguagagggaugcauagacaugcauuuuauugauauucugaguaugguuuuguaacaucuuaguguuauguuuuaaauguuuugcugucaagaauguaggauacaauguugagacaucauuuuucucuauccauuccccuuccauuagacuuguauuuuguuauauuucuaaugaauauuacuauuucaugaacuuagucaauacuagaaacuucucuacaguuugaaugugauuugucccaaugauaugaaaaccugacugugucauuguuuuauccuguuaucuuugagucauagaagcaguuuuguaucuugcgucaaguaguguuuguuuaaauauugcagauauggcuugauauuacagauaaagauguuaugaugucaucagcuguuauugauuguugcuaauauuucaguaaauuaauugucauuugcauauauuuuuuaaguaccaguuauccaugacucuuuuuucuuuucaggcagaagaaauguaugaguaaauuauuagaauauagcgcugaugucaacauuuguaauaaugaaggccuuacagcaguaagugcuaucaauuucaucugauguuuuaaaaguauguuuuagaaaaugauauugaaugugacaguuaggcaaaguguaguacaaguguuucugcaaguuacuuuuuuuugagacagagucucgcucugucacucaggcuagagugagguggucuaaucugugcucacugcaaucucugccuccugguucaagcgauucuugugccucagccacccaaguaucugggauuacagguaugcgccaccauguccagauaauuuuuauguuuuuaguagaggugggguuucaccauguuggccaggcugguuucuaacuucuggccucaagugauucaccugucucagccucccaaagugcugggauuauaggcgugagccaccgcaccuggccuguguuacuucuuuauagggauuaagaagguguagaaugauuugagauaaaguuuuaagcuauauuaagauaaguuauggcuuaccauauuucucucuucuccuuuuuaaguuuaugacuuuuguuuauuuugaagcuuauuccccuagccuuugucacugacuuuuaagggacuuccuaggagcaucucugcugagguguguuauguguucauucuuggagagcuguuuuucguuauguucuuuuaaauacuuuuaauauguucauuguagaauuagauagcuagucagaaaggaauaaaaaagguaacagagggaaugagcacucccuguauuccuugcacucugagauaaucacgguuaaaaaaaaaaaaaacuuuuguauuuucaguagagacgggguuucaccacguuggccaggcuggucuugaacuccugaccucaggugauccacccgccggccucccaaagugcuaggauuacaggugugagcugcugugcccggccaauaaaaccuuuuuuuagagacagggucucacugucacccaggcugcaguguaguggcaugaucauagcucacugcaaccucaaacucuugggcucaagaaaucauccagcaucauccuuccaaguagcugggacuauaggugugucucacuacccuuggcuaguauauuuuauauuuuuuuguagaggugggguccugcuuugaugcccaggcuagucuugaacucuuggccucaagcaauccuuucacuucugcaucccaaagauaaaauuacuguuaacauuuuguccuguuauuagacuuauauuuuauauaaaguaguauuggccauuuugccauaccacuuucuuugcaaaaauaaguuuauguauuuuugaaucacauggaggugguaugggauauugcugaagagauuguugaaaucccaaaguuuuaaccaaauugucauuauuuaauggagcauuauuaauuuuagaaguagagauaacauagaauuauguuacuguugaguaguuguuuugaaaucauggcagaaaauguuaaguuuuauuuauuaaauuauacauuccuuugauaguauuuauauuuugaaucuuuuaauuuuugaauaaagaauaauauugaauauuuacuuaccaugcugguuuucaaggccuuuaugauuaaaaauuggggaaugagguauagaaaaacaacuuuccuaaaauuuugaauggcuuauuauagaauaaacucaaucaugauuauuauauggaaucuacaauuccuguaaaaauucagauuuuguuauguauuaauaauauaauaccaccuauucuguaaggaaagacuguauucugaauauccguaggaugcuuagugacacgguacgugcaacagaggguuaugaaacccuagaaaugacauagaucuuuccuuaggacacuaaccaguuuaggcaugaugguugaauguuaauauaaucuguuuuaauugcauaagauguuuucuguuaauuucuucccuuccuuccuguacuuuaagggagguggaauagaaaauuuguaaaaauaaaauuuuuauuuaacaaaauuauucauguauguauuuaaagaaucaaauauucuaccuggcuuguagaaaacagucucuuggccuuccuccccaaccuccaaacuucccacucccuaaacaacuucucucagcuauuuuuuuuuuuuuuuuugagacagagucucacuguugcccaggcuggagugcaauggcgcaaucccagcucacugcaacuuccaccucccggguucaagugauucuccugccucagccucccgaguagcugggaauauaggcgccugcuaccaugcccagcuaauauuuuuugagacagaguuucacucuuguugcccaggcuggagugcaauggugcugucuuggcucacugcacccuccacuuaccggguucaagcaauucuccugcuucagccuccugaguagcugggauuucaggcaugugccaccacgcccagcuaauuuuguauuuuuaguagagacgggguuucuccauguuggucaggcuggucuugaacuccugaccucaggugaucugcccgccuuggccucccaaagugcugggauuacaggugugagccaccgcgcccagccuuuuuuuguauuuuuaauagagacgggguuuuaccagguuagcuaggcugaucucgaacuccugaccucaggugauccacccgccuuggcuacccaaagugcucggauuacaggugugagccaccgcgacgggccucucucagcuauuuuaauggauuuuaaaauguugucucuauaucuaaauagcaugcuaaaugcuacuuccugguuuuuugguuuuagguaucaccuguugacuuucuggaagaugaggcuauuguucucuuuuucagccccuccucccgcccugugguguauaagcacauuagccuuguaucccuccaauacaauuauuguaauuuuaguuagaucauuuuuguguguuauuauuuuuuugaguacacgaaaacuauucauaguuaagccaaauaguugguuauaguugcuuuccuuucuugcauaacauuuuauuuucccuguaguuaaugauugucuuuuuuuagaaauuaagauaauuguagauucacaugcagugcuaagaaauaauagagagagagaguugcccugcacuuuuugccgaguuuccuccagugguaacauuuugcaaaacuauacuauaauauuacaguaaggacauggacauugauacaaucugucuuacugagauuuccucaguuuuauuuuauuuuauuuuuuugagacagagucucgcucuguugcccaggcuagagugcaguagugcaaucucagcucacugcaaccuccgccuccuggguucaagcaauucuccugccucagucucccgaguagcugggaccacaggugugcgucaccaugcccagcuaauuuuugcauuuuuaguagagaugggguuucacgauguuggccaggcuggucuugagcuccugaccucaggugaucuacccgccuuggccuuccaaaaugcugggauuacaggugugagccaccaugccuggccuuccucaguuuuaauuguauguguguguguauguuuauguauuuuaaguucuauucauuuuuauuacuuguguagguuaccuguguaguuuuauuaccuguguacaugguagguuuucaccaccauagucaauauucugaacauuucuaacaccacagagauaugucauguugcccuuuuauaaccauaccuuucccuuuguccuucacaucccauggcuaaccuauagcaaccauuaauuuguucuccauuagucauuucaagaauguuacagagauagaacuauauuguauggaaccuuuggggauuggcuuuuuuuguuugucacauuccuuggagacuuaucuagguuauacuuaucaauaguuuguuccuuuauaaugcugaauaguauuccauccaguaguggauauaccaccauuuguuggacuguucaccuguuaaaagacauuugguucacuucugguuugaggcuauuaugaguaaagcuguuaaaaacagcaggguacacauugggauaaauguccaggaaugcaguuguuuuccguaguggcuauacuaauucacauucccaccaacaacauaugauaguuccuguuucuugacauccuugccagcauuucuuauugcuugucuuuuggauauaagccauuuuaauaggggugagaugauaccucauuguaguuuugguuugcauuucuuugaugaucagugauguugagcaccuuuuuauauaccuguuuuccaguuguaugucuacuuuugagaagugucuacucagaucuuucauucuuuuuuuaaucaaaauuuuuuuuuuuuuuuuuuuuuuuuuuacuauggaguuguuugaguuccuuauauauucugguuauuaaucccuugucagauggauaguuugcaguuauuuucucccauucuauggguuguuucuuuacuuuguugauuuuuuccuuuccugugcaaaaguguuuuaacuugaagugauccuauuuguccguuuuugcuuugguuacuuuugcuuuuacuuaaaagcaaauuuacucaagaaauuugcucaagggguauuacucaagaaagcuuugcccaaaccaauguccuggagaguuuccccaguguuuuauuuuaguaguuucaugucuuagauuuaaguuuuuaauuaauuuuuguuugauuuuuguauauggcaagagauauaggagccuaguuucauuuuuuguguauggauauccaguuuucccgcaccauuuauugaagagauggucccuaccuccaauguguguucuuggcaccuuuguagaaaaugaguucacuguagauguguggauuuauuucuggguucucuguucugucccauuggucugugugucuguuuuuauaccaguaacaugcuguuuugguuacuauagcucuguaguaugauuugaagucagguaaugauauuccuccaguuuugaucuuuuuacucaggauggcuuuugcuauucuagaucuuuugugauuccauauaaauuuuagaauuaucuuuucuguuucugugaagaaugucauugguauuuugauagagauuacauugaaucuauagauugcuuugaguaguauggacauuuugacaguauugauucuuccaacccuuaggaauauuuuuccauuuugugugugugucuucuucaguuucuugcaucuuuuucuauaguuuucuuuuagacaucuuucacuucuuugguuaaguugauuccuagguauuuuauuuuauuuguagcugucauaaaugggauuacuuucuuuacuucuuuuucagguuguuugcugcugacaucagaaugcuacugauuuuugcauguugauuucauauuuugcaacguacuuauuuaccaguucuaacaguuuuuugguggagucuaaguuuuuccaaauacaagaucauaucaucugcagacaagaauaauuugacaucuuucuuucuaauaugaauguccguuauuucuuucuuuugccugauugcucuagcuaggucuuccaguacuguuucuaauagugguguuaagagggucuuuugaagagcaaaaguuuuuuaacuuugaagucaaauugaucaguuuuuugcauuauggaucaugcuuuugguaucaagaacucuuugccuagcacucacuccugaagauugucucauauauuuuuuucuacaaguuuuauguuucuguguuuuacauuuaagucuaugaucucuuuugaguuacuguuugcauaaguuaugaggcuuaggucaagguuuacucuuuuuuuucugccuaugaauguccaguacuagcacuguuuguugaaaaggcuguccuuccuacaugaauuugcuuuugcaucuguuucaaaaaucaguugggcauauuuguguggacccacuuguggacuuuauauucauuccacugaucugugugucucugcuaaucucucugcuaauaccacacugucucgauuacuguagcuguaagucuuaauaccagguagaauaauuccucucacuuugucaagauuguguuagccauucugauuccuuugccuuuccauauaaauuuuagaauaaacuugucugugucuacaaaaaaaccuugcugggauuuugauuggaguugcuuuaaacugauaggucaauuuggggagaauuguuaucuuuacuguguugauugagucuuuuaauccauaaacacaguauaucuccacacuuacuuaggucuuugauuuuauucauuagaauuuuguacagcacaguggggauuuugugcauguuuugguaagcauauaacuguuucauuuucuuuggcauaauuauaaauggccuuguguuuuuaauuugaguuuaugcauguucagauggaaaugcaauugguuuuugguuuugcaaucuugcugaacucacuuauuaguucugggggacuuugggcaaauugcuugagauuuucuacauagacagucauguugucugcacguagagacaguaauuuguuuauuuauuuauuuagacagagucucacucugucacccaggcuacagugcaguggcgcaaucucagcucacugcaaccucugccuccuggauucaagcaauucuccugccuuagccacccuaguagcugggauuacaggugugugccaccaugcccagcugauuuuuguauuuuuaauagagacgggguuacaccuuguuggccaggcuggucuugaacuccugaccuccggugauucacccgccucggccucccaaaaugcugggauuacaggugugagccaccgcgccaggccuuuauuucuuucuucgcaguuuguaugucuuuuguauuuguuucuugcccuacugcaacuuuauuacuuuaaaguuuucuuauaacuuuuuacuaauucaauuccaaggucucucucagcuuuguaaauauccucuuaauauguauucaguaccuuucaugugcuugauuaugucuugaaggagucucuuacggagacuucugugcucucuuggcuggauugguugauaccuaggucugcugcacaguuguuuggaaugucucaucaucuggggauuccuuuugcuuuuuucuugcuuuggguucucuuguuauaugggucucauauccaucuuuucugauaacuauucugucacucugauggagcacaacccugagaguuuccugagagugugcaugggagauguguugccaccuugcauguuugauaugacuugagucuuugagucugauuauguaauugacaguuuagcugacaaucuagacaagacaucauuuuuccuuagaauuuugaaagcauugcuuuguuguguucuagcuuuguuuugaaguuuagugcuauuuggauucuugauucuuuauaugaaaccuguuuugauuuuucucucuagaaacuuauagaaucuacuuuguccuuaguguucuaaaauccugugauuauuaugucuugcuuuggauuuauuuuauccauuucgauggauaauauugagacccuaucaaccuggaaacucauguaauaggaacuuaugagaaauauucauaaauuauuacuuucaugauuucuuuuucugucuuuucucuguuuuauuuuuuccccaacuccuauuauuuaaauguuagaccuauucacacuagcccuuuaauuuuccuacuuuuucucauuucuuuucuuuguacuuuuagggagacuuccucaauauuaucuccuaauucuuguuuugaguuugcacgucucuaucauaguauuaauuuccaagaguuuuuuuuccuugucucuuucaaaaaauaguauccuuuucucauuucagggaugcaaucaguauguucucccucugacaguauuaaauauaguuuuuucuugaauauucaugguuccuuuuucccccuacuuuuugcuuuaaaaaaauuuguaguuugucuuucaaauuagaugcguuuaucagauguuugguggaaauggaaaaagcuauuugaaggcugucagcaugagugaggcuuuguucacuagaggcuucaguguaggaugaucuccuuggacauuugccucuuagaccuuuccagugucgauuucuuuaggcauuuacucuugaacuggucauauuccucagagaagacucuuccaacugcccggaagauguuaacagucugcgugcuggauagagaagaaugcuuuguaaaaucaauauucaauauuuaaacuugcacuuaaucuccccuuuuuagugugguauucuuuguucaaugugccuguugucucuuaucuagagacuguuuucaagccucuugcauucuaucugguugagugggggccauuacuggccuugcacaguuggggagggguagagauaugaggcucuaaaucuuauuaaauaaacuuucaaccucuuuucaagaggugcaugguacuuacuauugauucuugagccuuuugggaguccugugaucugaaucacauuuuuugggggguuucucuaauacugguguagcauucugacaagucaacaaguauaaucugacaagauaaaaagcaucaucuacuuucuuugcuuccaaaacuugcuguucucuccucuguaucuuuauggaucuagucuuuuaaggaaauacucuuuacucucauuuccgugggguuuagggaagaaguagagacugaugcauggauuaaaccugccauuuuaaaacagggauuucaugauuuucuuuuuaaugaaaaaaaaucaugugaaaaauuaauggauagcauaguccagaguuuuaacauugauuaucuuugagugguagacuuauagguguuuuauauauuuuuuacccuccuuuauuuauguaagauacauguguuacuuguaaaauacaggaaguaaggaauauagcauugcuauguuaauuacuuuuuaacuuauguuugcuucugggaaaagaaaaauaucuaacaccuuuucuccagagacaaacuaugcauagaguccaggauuaucugagaagcagaguauuugaugauugggagcuuaguauacuuacuguuuugaaccauuaugaguuauuuuaaaacgauuuuuuuuuuuuuggaaauagguugucauucugucacacagguaggaggagugcagugucaccaucauagcucauuauagccucaaacuccugggcucaagggauccucccaccuuagcauccugagaagcuaggaccauagguguaugccaccauggccagcuaauuuuuuuuuuugagacggagucuuacuguguugacaggcuggagugcaguggcacgaucucagcucaccgcaacugccgccuccuggguucaagugauuccccugccucagccucccaaguagcugggauuacaggcacgcaccaccacguccagcuaauuuuuuguauuuuaguagagacaagguuucaccaugucggccaagauggucuugaucuccugaccuugugauccgccugccucagccucccaaaguuccgggauuagaggcuugagcuaccgugcccggcugcccagcuaauuuuugaauuuuuuguagagacagguucuugcuacauugcccaggcugaucuugaacucguugcuucaagcaauccucuugccucaacuucccaaagugcugggauuacaaacgugagucaccacuuggagccccacugaguucuugauuuugaaaucugugguaauguaaucugcaucuugauaccgaaguuuuccucauauaaaaccuaauuucagcuauuuaggaggcugaggcaagaggaucacuugagcccaggaguuugaguccaaccugaacaacauagcaagaccccaacucuaaaaaacccccaaaccuguaaauaaaacuuaaacaaauuuaaaaaaggaaaaaaaugacauggacuuaaaauaccuuuaguuuuaaaccauuacauggacuuaaaacaccuuuagauuugcaugugcaaaucacgcccagcugagaaauaacauuauuuaucugcuguuuuuauauaaaacacuauuacacaaauguuaaguaacuaaauggcuucacagauacauuggcuggcugugaaugggcggacagaacuacuccaugaccuugugcagcaugucagugauguugauguugaggaugccauggggcagacagcacugcauguugccugccagaacggucacaagacgguaaguugagccaugaggacuuuaagcugcauguguuuguuuuuuaaaauugauuucaugaaaaguuuuucauugugcauauuugggaacaugaagcauuauagcaaaaucuuauuuucugcaucauauggacuuuuuuuuuugagacagggccucacuuuguugcccaggcuggagugcaguggugggauccuagcucacugcagccuuacacuccugggcucaaaugauccuuccaccucagccucacgaguagcugggauuacaugcgugaaccacugcaccuggcccauauggacuucugauaaauauauucuguaugguuagaagaaauagaaaauagugcuuuugggcugggagccguggcucacagcuguaaucccagcacuuugggaggcugagauggguggaucucuugagcucaggaguucagccugggcaacauggcgaaaccccaucucuacuaaaaauacaaaaaaauuuagcuggguaugguggcaugcauccguagucccagcuguuccggaggcugaagugggagaauugcuugagcucagcagucagcgguugcagugagcugagauugugccacuauacuccagccugggugacagagugagagccuguaucaaacaacaacaacaacaacaacaacaacaaaaaacaggaaaauagugcuuuuauaucuguucaaaauauuuguaauuugcauuuugauuuuauuucuaauucauagguuuuaauagccaaacauacuaaauuuuuaaauguaguauauucacauuuaauuuuaacauuuauaauguucauucuguucucaguuuuagcaaauaaaacuucauauuuuauuuuaucuuuugcuguuaagccucaauuuuggagauuagauagugaggaaagugagcaaugacacugguuaauaguaugagucagguuauccuauuuuucuacuugcauuguguaugguacaaguaacaguucuuucuuuucuuucuuuuucuuuucuuucuccuuccuuccuuccuuccuuccuuccuuccuuccuuccuuccuuccuuccucucuucucuucucuucucuucucuucucuucucuucucuucucuucucuucucuucucuucuuucucuuuucuuucucucucuuuuuuuugauggagucucacucuguuccccaggcuggagugcaguggcgccaucucggcucacugcaagcuccgccucccggguucaugccauucuccugccucagccucccgaguggcugggacuacagggaccggccaccacgcccggcuaauuuuuuguauuuuuaguagagaugggguuucacugcguuagccaggauggucucaaucucccgaccucaugauccgccugccucggccuccuaaaaugcugggauuacaggcgugagccaccgugcccggccucuuucuuuucuuuucuuuuuuuuuuugagacggaggcucgcucugucacccaggcuggagugcaguggcauaaucucagcuuacugcaaccucugccucccagguuuaagugauccuugugccucagccuccuaaguagcugggauuacaggugugugccaccacacccagcuacuuuuuguauuuuuaguagagaugggguuuugccaugguggccaggcugaucuugaauuccuggucucaagugaucugccugccucagccucccaaagugcugggauuacaggugugagccaccgugccuggcuauuuucuuucuuacucuagguuucuaaaaucaugcauuuguuuuaugacaaugcuuuccuguuauuccuguguccagacauuuggcuuuugaaauugcuauuucucucucauuaagagacuuuacugccuuauauaaagauggagggcuuaagauuuuagauugaauuucugcuuugcuguaauuuucuaccuuguuuauguuuuuaaguuuuuucuuuuuuuaacauuuaacauuauugguaauagaauguacaggugugugccaguagucucagcuguuugggaggcugagguggagaggucaagauuagguggagagaucccuuugcccaggaguuguggguuguagugcacuaugcugcuuggauguccacacuaaguuuggcaugaauauggugaccucucaggaugccagauagcuuaaggagaggugaaccagaacaggucagaaacagcaagucacaacccccaugcuggucuguuugugggaucaugcuagugaauuaccacugcaccucgucucuucaaaaaaaaaaaaaaaaagaauguaauuuauuuucuugcugaccauaauaacaacaacaaaaccaacucaaagucaguaccauuaacuacaaggauacaaaguuuguuuauuuuuuugguuacaaacuuucugagucuuaucucuuguugggagaagggagaauuccuaguggaaucuggauuuuuaucucuucaaacacuuuuuccuuaaccugguuucaggauguaugaucacaauucacagaauauuggacuucuucaagauaguaggcaaaggugacauugucuuauguuuaauaugguguuggaaaaauggaggguuauaggauccuuuuucuguuuccuggaauuuuuucuggacaccauuguucauuugcauuuuuugucuuuuaucaucugaaaaccaaugcaguguuuucaaguauauucuucucauuaguuuuuacuuagagucaauauuauuaaauuuaaaacguauucuaugugggaaaaaaagaugugaaauguccuaaucuugagugacccagguuuuuaaggcacuauugcauauuagagaaugagucuagccgauagcucucagaggacagaagagcaccugcuuuaauauaaacacccuuugcuauaacaggugagcagagugucauuuacuaagacuugcacacccuaccuguugcccaggaacuuggauaggaaaauacugggauucagauuagaaaaagauuuauaaaagcuaauuuuagcugcuuugaaccaguauagaagcaagaauuacuaagaaaaccuuguucaaaacaugugcauuacaggcugcauuaaaaauuuagaauugccuucugaaguuacugaaaauuaggugguauaaguauaauauacuccauaugguuuacaaccuaaagcaagugugguaaaauaauggagaauuccucauagucagaugccuuugaacaauuguauucucagaagauuuauagggagucugacuucauuguggugaugaguuucacagaaugagauuuugcagacagaguagaggaggagggguacaaaaagucauguugacuugugguugauuauguaauggccaacaggauuuauucugucauaguuggucaauuauaguuaccugcaaugaucauauacagguaaagggaaugcuuagcacugauuauuuucuggaucguuaccuaugaugaucauauaaacauaaagggaaugcuuagcacugauuauuuucugaaucauuguauguaucuuuauuccuuuuucaauuaggacaagagggaaucuugaaaaauuagucuauuucuuuuccuccuggcugaaguauaguucuacaaaucuguguucauaguugugcuaauacugccuguuucagaauuacucauguauuucugggacacauucacaucucaguguauaaguguauuguuuuaucuugaguugcaugugauuuacugggcuaugaaauaugauguuauaggauaaagguuacugauuuauuaaaaaccauuuguauaucuuuccauaaguugaacacugaguguauaaugcuuugucagguauccuagugacucaguggcaagucagaauggccuuuuuguuguucagaacugguguccauguagacauauaccagugcauguaaguuucaauauuuuauuuuuaagcuuaggagcuuacauaauucugauuauauauauuuuauagaauaaaauagaaaacuuuaaauggggaaaaaauuccauuaagaaauaaagcacaugagcucuuuucaaagaggcauggaugauaaauccucugaaauucgccuucuaaucucauuuuagaguaaaucugaggagugcaugaaaacauuuugagcaacuagcuaagcacccuaaaacuuuguagaauauauagcuaaaugcuauauucuugcuucaaugacaagaagugcuuuuucaaauuuauauuacauuuuuuaaggauaaaagauucagaagauucauuuuugucauaacuaagaacuugaguaaucuuaaauaugauuucauauagaugcagcuguugcauuagagguaaacaugauaaaggucucauuuuccucuuggaaggaagugguuugggcaguugaagagugcacucuguuuuuugucauuguagcauaauagcaccaugauuuuaaacuacuucuauccguauuuaauaaugaucagaugaaaggaaucauaacaacuucuuaauaauuuuauuuuuauauaacuuuucuuagaucaacuguuaaacuccauucuuagcuguaucauaccagaauucugguaugucuuuggauacugauuucaaaaaaucauuucaaaguuugguuauucaacuggagauauaauuuuacuggugauauaauuaaggaaaaugugaacacuuuggaaggcauuuaacagcaauaauaccuacugcuauuaugauuguuauuaauaugugugaugugauucuguaaaaguacacagaucagugucuagacccuuuauuuauuuaugcuuauacaagaagcugggcccaguguguuguuuuuuaauuucaguuuuagcaaguugaguaaaaccuaacacuauucucuguagguauaauuuauuaacgcuuuuuggaccauaaauuaaaccuaguuuuugguaacuuuuucuuuaagauuuauaaauguguugaauugccaaaaauguuaauuacagucuucucagaauaacguggauuuagaaaccguagagaacugucaaauaguucagucuaaauuucuguaaguuagauuacauggcaggauuaguuagggacuaauuuguaauuuauuuaaaaauaaauuucacuuuuaucagaauaaaccuuauuaaguuuauguaacuaaauacaaagcuucacaaacaacauaaaaugauaguugaacccuuaguauaauagacuauauuagacagaacugacugcauuuuuuuacuaaaaucauagacuuguuaaggaacagugcucaacuauguucagucagcucucuugguaucuuuagccagcuuccaaguuuuucauccaguuacggacagccauguaaacuuaauugaaaacauuuuccagacauuaauuagauucagccuugaggcacaaagguagguagacuaacauuucagaguauauuccuagggucagaguaauuguauuuauucuaaugcuagaauucuccuuuaaucauuucuaagaaguugaaacaaauaguagaaaguucucuuaccacuguuacuuuuauaacacaaccagaugauaaugauuuuugccggauacuauguaagaauucaaaguucucaauaggugaagguggacagguuuuuagagaagacauguguaaaccagucacugauuagugaguugggaguuuuacuuaguguauaaguuauuugugcauugccauaacucaugucaucagaauuauuuuuaauaaaaaaaguaaggacacuuuuuuuguuguuuggucuccuuuuagcuagugauaauaccacaacuuugauuuuuacuuagaguuuuaucauugaauaucuauuccuuuuuacuuugaucaguguuuugagaguugacauugauaaaguagggcugccuuggauuucuugcuuuguaauuuaucaguguauugggcacagguggucuugguuagucaccgccuucaauuaaaugacuugagauugaccuacacauuagguuuguauguucguuuuccacucaggauauuguuuugucacuugaaagguuaugaagucuguugaaauauguuauuucuucuuaaggaucucuugaaggccauaugaaaauccccuaugcuuuucuuuugcgguuccuccgcaauaguuucuuauucuguaaggaggagggaaccccauucuagauaaucaaugacuaggggaauagauaguuuuuuuugguggggagagaagggguggaauugggcagggaauuugcaauucuaaauuuuuuuaaaagucuguuuugucgauccaguuuuaggcauauagcucuuaaaauuauguauaaauguagcguagcucuuaaaauuauguauauuaacuugaaaaauacauagguaaucauuuaucagucaccuauuuauguuggcaugcuuuuacguguuugcauuuaguaaauuguaagccacugcgcuuaauuuuagcaaguaaaugagaagccauauaauuuuaaaaauagaagguaugaccaucauuguaaaucacaauuguuagguuuuuuggacuucauggcuuauagaucagugcauuuuucacagaaguauuugugggauuuuaggggcaagaaauuugcuaaaauaaauugaauccaaaucauagaaaauccugguuuauuuuucuggauagcacugaucaccaucuaguacacuacagauuuuguuuauuuacaucuugucacuuuaucuucccuuucuacuauaaacuucuugaaggcagguuuuuuugucuguuuuguucauuguuguaacucgaguaucuagagucgugcauagcacauaauuuagagcaguggucucuaaccuuuuuggcacuagggcccaguuucauggaagacaaguuuuccacagucagaaaucgaggggaugguuuugggaugaaacuguuccacuucagaucaucaggcauuagauucucacaaggaacuugugccuagaucccuuucaugggcagcuuacaacagaguucaugcuccuaugagaaucaaauguugcugcugauccgacaggaggcagagcucagauagugauguucacuugccugccacucaccuccugcuguguggccugguuccugauuuagaguagugcauaacacauuaucuagaggagggcauagcacauaauggguauagauuuuuguugaaagauggaagaaacugguggaggguguccagauucuuggcauuuugaacaaagaauuggacaaaauacacaaacaaguaaugaagcagcaaaagcagauauuuauugaaaacaaaaguauacuccacagggugggaauuggccccagcagcugcucaagguucuggauacagaaucuucuggggucuaaauaccccauauauguuucccauuggccacuugguguucgccucauguaaaugaagugguggccugcaaucaaucagaggcugaaguuacaaaggucacaccccuaugcaaacaucugauugguugugggaagcaacuaaucagaggcuaaagugaaguuacaaaguugcacuucugugcauuugaagacuuggcccucaguccgauugcuugcacauaacuaccuucaguuagucugauugguugcuaugugcagccaaucagagguugguugcugugugcaaccaauccgaggcugaagugaaguuacagaguuagacuccuaugcaaacgucugauugguugcuuuuuacaaccaaucagugguacuuucaauuucccaucugccucgcaaagagguggggguuugcaaaggucgcugguccuuuuguuacuuaggcguggaaaguuaggguuuuccuuccaauuuauuucuaggaagucagggugaaguggccuuagguucccugacugcagacccuauucuccugccucaaaaccacucaaaugcaggaucauuuugauccauauauucugccauuuucuuugcauuucuuucuuucuuuuuuuuuuuuuuuugagacggagucuugcucugucccccaggcuggagugcaguggcgcaucucagcucacugcaagcuccaccucccggguucacuccauucuccugccucagccucccgcguagcugggacuacaggcgcccgccaccacgcccggcuaauuuuuuguauuuuuuuuuuuuuuuaguagagacgggguuucaccguguuagccaggauggucucaaucuccugacgucgugaucugcccgccucggccucccuaaguguugggauuacaggugugagccaccgugcccggccuucuuugcauuucuaaauguuugucacuuuuuuuccuuuuguaucuuuaaguggaguguauauugauagugcugauucuuacaaaagguuguaucuguuuguaucuauugcugaaaauuucuccuuuugagaauccuuagggauuuuaaaaguuuaauccagaauuuauucucuugaauuauguugugccuuaugcuuugaugcuuugauacaauuuaaaacucucagguaguguuguuucuucaagagccuuuauguauuuauuuuaacuuaauaaaugcucagaguacauuuucaucuaucuaaguuuuaaccuuugggcacacaugaacaguuuucacauaguugaaaacauugauuaucuuguagcacuuuggaagaauguauguggagucuugaaacuccguuguuaaauuccaguuguuaagaccaggcaauaaauacaucauuauaguucuacauagcuauuuaucauucaugauaucucaauaucguauguguguauugucaacaagaaaauaauuuguuauugugguuagaccuuuugcuuuaccacugaaauauuguuacucuggauuauuugagaaugagacuccauuuugcacacuacuguauguccaauuaaggaguaguaagagacuugggagggcucaccuuccgaacaaggcucaguagaaacagccagacuaguaaugggauggguuggauaaguguuaacagccucuguccccucgccuaacacuaaguagaccuuccuuauuauccuuacuacucaucacugugcagucugcuaauuguugaggugaguacauuuaagguuucuucuguacuugaauuaucuuuacuugcuguccucagagaaaugacuggagaguuucuuaaaacugugauucagguugucugugacuuccuagcagcuuuucuuauuaggccauuuaaucaauaauugacugaauucugcauuuuccuuucccuuccuauuuuagagcuuuuacaaaaagaaaaccgccagcaaacaucuuuuuuuuuuuuuaauucacaaagauagaugacuuugcacucauuucagugcugcaaggcaauuuuuuauucuuuaaaauuccuuuauacauuuuuauccuaauucuaagggaaguagguuuuucucuguuuuuuuauuuuugguuuuuauugggggauuggagcaacauuuuaucugcaagugcgcuauugaaaacuuuaaaaauauguuucuuuuaauaguugcauauuuugaggaucuucaucgggcuguuuuuuuuaaaaaaauagaaaaguagaaagauuuaugaauggaaaauaaaaugcuggaacaaguaauuuccaauuuuuuuuuuuuuuugagacagagucucgcuguguugcccagucuggagcaguggcaugaucuuggcucacugcaaccucugccucccagguucaagcgauucuccugcgucagccuccgaaguagcugggauuacaggugcccacugccaugcccaacuaauuuuuguauuuuuaguagagacaguguuucaccauguuggccaggcugaucuugaacuccugaccucaggugauccaccuggccucccagagugcugggauugcaggugugaaccauugugcccagccuccgauuuuuuaaucaaguguuuuucucucuuaaaaaaaaauuaaugucuuuguaggauauauuaaaagugauagcaaaaaccacaauuacuuuuucaccaaccaaauacaaggcuaugacaguuuauauuguaaaucauguuuuuuuucuaugauuugcuucaaguuugucucaccaguuugaugagaacaguagaggaguauguuagucuaaugaauaaauuguuuuuauauuguaagcgcuacaguauaaauagaaauacgaagcaguauaaaaaauacaugguuuaaaauaccauuacuuuuuuuuuuggagacacgguacaggcuggagugcaguggcgcgaucuccgcucacugcaaccuccgccuccugaguccaagcaauucuccugccucggccuccugaguagcugggauuacagacauguaccaccacgccaggcuaauuuuuguauuuuuaguagagacgggguuucauuauguuggccaggcuggucuugaacucccgaccucuagugauccgacugccucggccucccaaagugcuaggauuacaggugugagccaccgcgcucggccuacuuuuuuuauuuuuuauuuagagacaggguuucacucuguugaaccggccggagcguaguggugugaucauagcucacuguaaccuugaacuccugggcucaagugauucuucugccucagccucccaaguagcuagggcuacaggcacacaccaccacaccuggcuaauuuuuuuuuuuuuuuuuuucugagauggaguccugcucugccucccaggcuggggugcaguggcguggucgcggcucacugcaagcucugccuccuggguucaugccauucuccugccucagccuccugaguagcugggacuagaggcuccugccaccacgccuggauaauuuuuuuguauuuuuuuuuuuuuuuuuuuuaguagagacgggguuucaccguguugaucuccuggucuugaucuccugaccuugugaucuaccugccucagccucccaaagugcugggauuacaggugugagccaccgcgcccggcccacgccuggauaauuuaaaaaaaaaauuaugacuuucuuuuguagaaaugguggucucacuauguugcccagauuggucuugaacuccuggccucaagcacuccucccacuuuggucucccaaagcccugugguuacaggcaugaaaauagcauuacuuuaaaaccauacacaaguagcugucuagguacuuaagcuugacucuguaauaguuauuuaguagggaguuacuagauuaucugugauuaauguaguuuaugaagaugugucagauuagccguuaguacuaaauaaauacuauuuaguaaucugaauucagaagaauuauaaugccuacuuuuugauaaauagaauagugauuaugaacauggacuuggguuuuaaucccugcuucaauguuuacuuauguguugggguacaaauuacaugaucucuuugacacucaauuuccugcuuauaaaagugaagagaauaucaccuuccucgaaagaugcauuaaaugaaaugauaaaugcuuauuagcacacugucuggguacauauuaguguuauuuacguuauaucauuacauaguuuuaacaguauaguuuuuauaaauaguauauuuuguuaaaauuucuuuauuacaguuucuggauuguuagguuuuaauugcaugcuaauauauauuuucaguguauuggcuuucaucucuccugagccaguugagaguugaagacuuauuuucuauaauuucuuuuuuuuuaacuuuuauuuugaguucagggguacaaauacagguuugauacauagguaaacuugugucacggggcuuuguuguacagauuauuucaucacauagguagccuaguauacauuaguuauuuugccucauccuuucccuccucccauccuccaccccuuugaaaggccucaguguauauuguuccccucuguauccauguguucucaucacugagcucccacuuauuagagagaacgugugguauuugguuuucuguuccuguguuaguuugcuaaggauaaugaccugcagcuccauucaugucccugaaaaggacauugucacguucuuuuuuauggcugcauaguauuccgugguguauauguaccucauuuucuuuauccagucuaccaucgaugggcauuuagguugauuccaugucuuugcuauugugaauagugcagcagugaacauaugugugcauguaucuuuauaauagaaugauuuauauuucuuuuggguauauacccaguaaugggauugcugggucaaaugguauuucugucuuuaggucuuugaggaaucaccacacugucuucuacaauggcugaaauaauuuacucccaccaacgguguuuaagccuuccuuuuucucugcaaccuugccagcaucuguuguuuuuugacuuuuuaauaauauccauucugacuggugugagaugguaucucauugugguuuugauuugcauuucucuaaugaucagugauguugagcuuuucuuucauaugauuguuggccaccuauaugucuucuuuugagaagugucuguucauguccuuugcccacuuuuuaaugggguuguuguuuuuuuguaaauuuguuuaaguuccuuauagaugcuggauauuagacuuuugucagaugcauaguuugcaaaaauuuucucuuguucuguagguuuucuguucauucugaugauaguuuuuuucgcuaugcagaaacucuuuaguuuaauuagaucccaacuuccaauuuuuacucuuguuccaauugcuuuuagcaucuuugucaggaaaucuuugccugugccuaaguccugaaugguauugccuacauuguuuuccaggguuuuaugguuuuggguuuuacuuuuuuuuuuuuuuuuuuuugagacggagucucacucuguugcccaggcuggagugcaguggcacaaucucggcucacugcaaacuccaccucccggguucaagcgauuuuucugccccagccuccugaguagcugggauuacaggcaugugccaccauucccggcuaauuuuuguauuuuuaguagagaugggguuuugccauguuggucaggguggucucgaacucuugaccuagugauccaccagcauuggccucccaaagugcugggauuacaggcgugagcugcugcaccuggccuggguuuuacauuuaagucuuuaauccauuuugaguuaauuuuuguauaugguguaaggaaggguuucaguuguuuuccuauagcuaaccaguuauuacaacaccauuuauugaauagggaauccuuuccccauugcuuguuuuugucagguuuguggaagaucagauaguugucagagugcggucuuauuuguggguuuuagauucuguuucauuggucuaugugucuguuuuuguaccaguaccauacuguuuugcucacuauaucccuguaguauaguuuuaaguuggguagcgugaugccuccaacuuuucuuucugcuuaggauugccgugucuguuugggcucuuuuuugguuccauaugaauuuuaaaauaguuuucucuaguucugugaagaacaucaauuguaguuuaauaggaauagcauugaaucuauauaaauugcuuugguuaguguagccguuuuauugauacugauucuuccuguccaugagaaugggauguuuuuccauuuguuugugucaucucugauaucuuugaucagugguuuguaguucuccuuguagagaucuuucgccucccuacuuaguuguauuccuagguuuuuaauucuuuuuguggcaguugugaaugggaguucauucuugacuuggcucucagcuugacucuugguguauaggaaugcuagugauuuuuccacguugguuuuguauucugagacuuuguugagguuguuaauuggcuuaagaagcuuuugggcugagacugugguauuuuccaaauauaguguuaugucaucugcaaacagggauaguuugacuucuuuucuugcuauuuguuuggccuuuuguuuuuuucucuugccugauggcccuggccagaaccuccaauacuguguugaauagggguggugagagauggcauccuugucuuauguugguuuucaagguaaugcuuacagguuuugcccauucauuaugauacuggcugugaguuugucauagaugguucauauuauuuugagguauguuccuucaauaccuaguuuuuuaagaguuuuuuuuuuuaaacauaaaucgauguugaauuuuaucaaaagccuuuucugcaucuguugagauaaucaugugguuuuugucuuuaguucugcuuaugugcugaauuacauuuauugauuuguguauguugaaccaaccuugcauccuuagguugaagccuacuugauuaugguguaugagcuuuuugaugugcugcuggauucugcuugccaguguuuuuguuagggauuuuugcaucaauuucaucaaggauauuggucugacauuuuuuuuuauuguaucucugccagguuuuggugucaggaugaugcuggcuuuauagaaugaguuagggaauagucccuucucaauuuuuuggaauaguuugaaugggaaugguagcagcuuuucuuuguauaucugguggaauucagcugugaauucaucugguccugggcuuuuuuugguuggcaggcuuauuuucuguaauuucuauaacaguagugaacaccguugcuacuuuccaucucauuccuauuuugggaccuuacagacaccacuucuaggucaaugaucagaggaaagccaugauuagaaggcccacguaguccuucucuuauaaaauagugacugaaauacuuguuuuucuuauauuugaaagcuauaguugacuacuuguuuucaguuuagaggaauuacauagauuauaauauaguuuuauauaacaguguuuuuauuacauagauuauagaauucauguugggguagaaguaaauuuaaauagacaugugaauacuaugucuuaaaaauauuuuauuaguauuaaaaucuucugauaagaaugcuagucccuuaaaccacccuuccucuuuguuaagucaugaucaccagaggcaacaauuuucaacuuucuaaacuuuuccuuuaauauguauuuccaaauaacaagcuuccauggcucuuucucaguuuaugacuuuuagauauuauuuaaucauuucuuguuaugguaaaugaugauuuauaaguuuugauuagacaguauugguuauauauaguuaagaagguauuguuuacugcucagucaaguagugaacuguaauaacguucuuuuuugaggauggcuguuuuucuugaaguuaauaauuggguuugcucaguuuucuuuguaugaaucagcguuucuucaucuauaugcuccuauaaaauaucucuuccuacucucuucuacaaagacagauucauuggauaguuuaucaguuccaucuuucuuucuccucuauauuaauucauuuuaccugauauaaagaacuaccugaggcuggguaauuuaugaagaaaagaguuuuaauugacucacaguucugcaggcuuaacaggaaacaugacuggaaggccucaggaaacuuacaaucaugguggaagguuaaggggaaucagacagcuucuucacauggcagcaggagagagagagugugugcaagggggaagugccacacacuuuuaaaccuacaggacuugugagaacucauucacuaucacaagagcagcaagggagaaauuugccccuaugauccagucaccuccccccagaccucucuuccaauuugacgugagauuuggcggggacacaaauccaaaccauaucauuccaccccuaaccccucccaaaucucauguucuucucguauuggaaaauacaauuaucccuucucaacaguccuccagucuuaacuaauuucagcauuaacucagaaguccacaguucaaagucucaucugagacagauaagucccuucugccuaugagccuguaaaaucaaaaacaaguuaguuacuuccaagauacaguggggguacaggcauugagugaaugcuccaagugggagaaauuggccaaaacacaaaggcuacaggccccaugcaagucugaaaccuagcagggcugucauuaaaucuuaaagcucuaaaauaauuuccguugacuccgugucucauauccagggcacacugaugcauggguugggauccugaggccuuggguagcuccaccccuguggcucagcaggguacagcccccuagacugcuuccacaggcugacauugaguacguguggcuuuuucaggugcacuaugcaagcugucagugggucuccuauuguugggucuggggggugguggcccucuucucacagcucuacuagacagugcccuguaugggguucuaacuccacauuuccugucugcacugcccuaguagagguucuccaugaaggcucuacuccugcagcagacuucuuccuggacagccaggcauuuccauacauucucugaaaucuaggcagagguuucaaaaccucaucucuugccuucugcacaccugcaggcccaacaccacguggaagcuucaaggcuugggcuugcacccucuaaagcaguggccugagcuguaccuuugccccuuuuagccauggcuggagcuggagcuggagcaucugggacacagagcacuaagucccgaagcugcacagagcaguggggcccuggguccggccugugaagccauuuuccccuccuaggccuccaggccucugacauguggggcugcagugaaggucucugacaugcccuggagacauuuuuccuguugucuugguuauuaacauucagcuccuuguuacuuauguacacuucugcagcuggcuugaauuucuccccagaaaauggguuuuuguuuucuacugcauggucaggcugcacauuuuccaaacuuuguguucuguuuccucuuuuuuuuuuuuugaguuguaguuuugcucuugucgcccaggcuggagugcaaugcagugaucucggcucacugcaaucuccgccuccuggguucaagcaauucuccugccucagccccccgaguagcuggaauuacaggucccugccaccacgccuggcuaauuuuuauauuuauaguagagauggggauucaccauauuggccaagcuggucucaaacuccugaccucaggugaucugcccgccucagccucccaaagugcugggauuacaggcgugagccacugugccuggcccucuguuucccuuuuaaacauauuccaauuucaaaccaucucuuugugaaugcauguaagugaaugcuuucagaauaagccaggucacaucuugaaugcuuugcugguuagaaauuucuuccaccauagucugggugugcugggucaggccuguaaucccagcacuuuaggaggccaagguggguggaucacuugagaucaggacuuaaggaccagccuggccaacagggugagaccccaucucuacuaaaaacagaaaaaauuagcugggugugguggcgcacgccuauaaucccagcuaccugggaggcgggagaaucacuggaaccugggagguggagguugcagugaguugagaucaugccauuacacuccagccuaggagacagagugagacuuugugucaaaaaaaaaaaaaaauuucuuccaccagauacccuaauucaucucuuucaaguuuaaaguuucacagaucucuagggcaggggcaaaaugcuuccaguuucuuuuugcuaaagcauagcaagagugaucuuuacuccaguugccaauaaguuccucaucuccaucugagaucaccucagccuggacgucauuguccauaucacuaucagcaguuugaucaaaaccauucaacaagucucugggaaguuccaaacuuucccacaucuuacugucuucuucagagcccuccaaacuguuccaaccucugccccuuacccaguuccaaagucgcuuccacauuuucaagugucuuuauaggagugucccacuccugguacugauuuucuauauuagucaauuuuucacacugauauaaagaacuacuugagacugaguaauuugugaagaaaagauguuuaauugacucagaguucugcuggcuuaacaggaagcaugacugugaggccucaggaaacuuacaaucaugguggaaggcaaagggggaagcaagcaucuucuucagaugguggcaggagagagggagaaagagcgugaggggggaugugccacacacuuuuaaaccaugagcucucaugagagcagcaagggggaaaucugcucccaugcucuggucaccucucaccaggucccuccuccaauucaacaggagauuuuggcagggacacaaauccaacccauaucacccucuaaaccuagaaauaaucuuagugucucucccauguuugaucuccauauucuagauuccauaucuucuauuaugguuuauucucuuucuuuggaggaggauaugcuucaguagcuucuugagaaaaggugcauugaagauaauuuaaaaaaucuuauaaaauaguuaaacauguuuuuuauuuauaaccaucuauuugaauaauaguguaguuggcuauagaauucugcauauaauuuaucuuacaauuuugaaggcuuuuuaccuuuuagauuucuguguugcuguugagaaguuuuaaugcccacaugauuucuguuuaucucuggaaucucuuaucccugauguuaucaugaaauuucacuuugacaugccucguugaaggucuuuugauuuaauagacuagacacguguugagccuuuuaaaccuggcaccugaugucuuucaguucugggaacuuuuuugguauuauuucuugguuauuccccuuuggucccucacccccuuucuuuucuuuauucuuauuuucugcaguaugucucccuugauugauucacaaauuuucucaucuuuccuauuuucuacuuugucuuuuuauucuacuuuguagaauuccugaacauuuucuuuuuaaacuucuguugaauuuuuauuuauugcauuguauuuuugauuucucauuuccuaaauauuuucuacccaacauccuuuuaucauuccaugguauaauuucuuuucuguucgagguuaucaguuacuuuucuaauuuuuguuguuuucuuugguucccuuuacugucuuuguuauucugaguuucauuuuucaguuguaauuuuuguuuuucagguuagaggccugcuucaguuguauuuuuaauauugucuguucauucauguguaauggugaggcacucaaauguuggcuggaagcguuguguacaugaguugaguuuguugacuacuugguuugacuguacaccaauguuucuuggucucaacacuguugauauuuuggaucugauaauucuuuguugugggggcugucaucugaauuuuaggauauuuagcugcaucccugaccucuacccacuagcugccaauagcauuuucccuucccuggucaugaaaauaaaaaaguugccucauguucccaggggaaaauuuaaccuugguuggggaugacugcuauagacccauugucccgaauugggcuguuucuuuauuuuuaauuuuuguuucuuuuuagagauagggucuugcuuuacagauagcgucuugcaugcagcaccaugcauggcuaauuuuaaaauuuuguuguggaaaugggaucucucuaaauugccuaggcuggucuugaacuccuggccuuaaaugaucuuuccaccuugguuuuccaaagucuuagaauuacaggcaugagccaccaugucuggaugaacugagcuguuucacuggggacuuucuaaugccaauaucuguaagauucuuuucugaugcaagucuugagaggaagcuuuuaauuccuucuacuugagauuuuuaagccugccugcuggauuucugggagccuaguuggaacauggaggcuggagguuuucacuuaauuuguuguuuucacgauggcuccucaucuuugcucuaccugugugucuugucucccaguccagagccucccuguucacuuugugcagagaauaaacuucccaucuucugagacaguguaaagagggauaguaacuaacuggauaggaugggaagaaagguccuagggggagagucuguuucuucuauugacuuucaacuauuccuccuauuuuuagcucuacauaaccauuccuauauuccaagguaccugguacuuccaauuccucuauuccuuuuuuguuuucuuaauguguguguucuguaguaagaauugaguugcuuauuguuggaauccccauuugugggcaguuagacuucagcuuucuuugaucugcuaagucaguuacuauuucuccauuugcuugcuaucuuuccaaaacuuacugacuuauccaguaugcuguuguuuucuuucuuguucuuccuuuggguguuuaguuuuauuauuuuacugacauuguacuuuguuuaaaagcggcaaaaaagaugaacagauguguucaauccagaaguaauaagcgucuaauuucaaacuauuuuguuuuuuuuuaaggcauggggucuuucucuguugcccaagcuggagugcagugguguaauauaauucauaguagccuugaacuccugggcucaaaugauccucccaccucagccuccugaguagcuaggccuacuacuaugaugugcugccaugacuagcucauuuuuuaauguuuuuguaaaaauggggucucacuauguagacuaaacuggucucaaacuacuggccucaagccaccuauugccucauguuuuauguuuuuacauuuucuuccuuuuugcaggaaaaacucaaaugaggauuuuaggaauaaaaccaugaaaguuuuuuuuuuuaaagguuuucaacugggcccuguccuguccuuaaucaacagauauguauuuuuaagauuuuauaguagcguacucucucuuaguaugagucaaaugauuagaggaguagagcuuagggggcuaaguauauauuaauggcaaucagugaaauugagccuguauaugcuacuguuaauagcaaaagggcuucuuagcuuuuuaaaauuuuauauuuuaauaauuaugcucuugacuuugggaaaguuauuauucuggugcuuaguuuuuuagaggugaaaaauucugguauuuaaagcaauuuaaauucaaguaucuaaagcaauaggguccaauucacuagccacauguggcuauuuagauucaaaugagcuauaauuaaauacaauuaaaauuuuaguuccuuagcuguacuagccacauuucaaguacuugguagccaauauguaacuacugacuacuuuugauacagugcugcucuaaagacucccagauuaacacaguuucuauuacacugauaauuccacauauauguguguugugccugagacacuuagagcuuacaaaaaguugaauuugcucagccauaguaauugucacgugcccacucaguuccuauguaaagcuucaaguugugggaagaacuucccuuauauggauuaaaauugugguaauuguaucuuuuguuugauuccucuggcuuuacuuuuaauuauuuuuucccccucagacagugcagugcuugcuagacaguggugcugauauuaacaggccaaauguaucaggagcaacuccauuguacuuugcuugcagguaugauauuuuauauuuccagaugcuauauaugcucauauauauauauauauauauauauauguauaaauaaagaaauauauauauuuccagauguauauaauacucuauuucuagacacacacguuucuguguauuuucuaaagcucucuuguuuucccacaaauaugcugucuuuuaagaggaaguacaaucucuuuuuuaagaugaaguguuaugguucuauuacuuaacuguaugaggaaaaguauuuucuguuauauuuaauugccauugcuuuuauguuacauguggagcuuuugauuugcuugauuacuucaauuuuagacuaaguacuuauuaacaaaagauaaaucaguaaucugguaauucccaucguuuacuguguuauguaaccaggucauuuccagugggauaagcuguuggaauauaucuugauccagagccaugucuuuucuuucucuguaucuauaaccaaaaaaaaaucuugagucagucuuguuagauauuguuauacauuaaguuauuuuuguauuucuuuauugguucauuuucuugacguguacauuuuguucacuuauucauguauucggcaaauguuuaguuaacgcucacugugucaugcauuguuguagguguguaauacaguaauaaauaaacucuauucccuaaggagcuaucaguauaauuauacacaugccgucacacccacacccacacacauauguaaaaauauauacacaccuacauauuauguauuauguaaauguaguuauagaauacuauaguaauucuucuuuuugauuuaaauuauaugaauuguaauauuuauuuaggccuucauauuccgauauagagcucuccagaaagcuccucucuucuucuuuuuuucuguuuuauaucauuuuauuggaaguugguuuuagguugaaagaccugcuuuuuuucuuguuuagcuucuuguuggggucucugaugugccuuugaugagaccaauucagaucaucuauuuaacaacccuguauuagaauucaggggcuucuggguuucuagacuuccagaucuuucugauuccagccauuuucuugcauuauauuuaugauuugguugcuuggcuagaaaaccaguucuuuccauaguguccugaauuuaugaauaauaucaucauuugauucccuguaaucauguuguaucuugaaggguuaucuuuagaucagaccuuuuuugaaccuccagauuugaauguccaucugccuguuuaacaucaucacuuagaaguaccacagaaucucacauauuaacaugucaaaauacagcuucagauuuucuuccucaaaccuuucccccaguuuuuccucaucuuaaucaauagaaaccuuauugucucaguuguuuaaauuagaaauaauuagguuauuuuuuauuucucucucucucucuuugugaacuuggaauuuauuaguaaguucuguaaauucuaccuucagaauauguucggaaucugaacuucuaacucaaccaaaaccaccuuaauguuguuaccuuuugccuagaguacugcaguaaucucuucacuggucucccugauuccuauguuguuucccuccaaucucuucuuuccucagcaaagugaucuuaaaaaaaaaaaaaaaaaagaaucugcucuuguuacuuuguguuuaagccuuguauauaaaacuuuucagugccucguuguuacauuuuaaauauaauucaaguucuaccuuggccugugagaccuccaugauuucacuccuguuuagcucacuguacuugaaccacagugauucucuuugcguuccuuaaaugcaaccaacucuuucagcaggcuuuucuacaugguauuuguuuugccugaaauguucuuccuuaggcuuuuuacagggcuauuucuuauucauguuacugcuuaauuaaguaacuuuuuaggaaggcaguuccugaccaaucuaagcaggucguuccccagauuuuugaucgcaguaucacagucauuuccuucauagcacuuccuauucuguaguuguuuauuuacuuucuuauagucugucuccccuacaugccuaaaaauucagugaaagcaagaauaguguuuauuuuaccacuuuauguccaaaguguaguacaguguuuugcacuuagaugcauaguagauguuuuugaaugaaugcaucacuaugaaaaauaucuuauaaaaaacaaugccauuuauaauaguuaaaauagagacauguuaguguugugcagaacugggauaucccuaugguuagucugagcuuagggauauggcagaaggauuuuuaagaaauacuuucuccuaguacuguauucccaucauuuaguuuuaaucuagcaaauauuagaucuuuuugaacaaagaugguuaagcaagucugugaugaaaugugaaaccaaaaaaucauuguuguagaagaauaauagauauggaacaugguucuucugcaggcacacuuuuaauuuuacuugugauaucuugauacagguauaaauuaaaaauauaaguuauucccaauguguuauuucugauaaaugaaagggaaaggaauauaggaaauagaacaaguuaaccccaggacaaauuauagggcucuaagauaaagguuaaauggaauguauaguuuuuauugguugauaaguauuacuagauauaauauauuauaucauauucaagggucaacuacugaaacuguuuucuuuguauuugaauuuugcaauuaaauuuagaaugguauuaagauacaggggaaagaaccuaguuuguguaggcagguucaaaucccagcaccagagcuauacaacauuagucaaaauucuugaucccugaagcuuuguuuguuugugaaauggaagugcugauaucugccuggugagauuauugugaagauuaaaugugauggcuucuauaaagcaugcugcagaguauucaacacuuaguaguugauaggugcucacuaaguucugacauacuucuuucacucuucagugagcauaaagucguguuguccucauuuaauuuaauugcucuacaggguuuucuuuuguuucuugucuaauucuaagcacuuuuuuuuuuuuuaauuuuugagacagagccucaaucuguugcccaggguggagugcaguggcgugaucuuggcucacugcaaucucugccuccuggcuucaagcgauucuccugccucugccucccgaguagcuggcauuacaggcaugcgccaccacacccagcuaauuuuuauauuuuaguagagauggcguuuugccauguugccugggcuggucucgaacucccgaccucaggugaucuggcugucucauccucccaaagugcugggauuacagacgugagccaccgugccuggcccugggcacuguuuuauaauguaguguuucugugagucuuuuucagauggauuuugaccuaaaauuaugauagaaaggguuuuccagccaguuuucuucucuggauacucuggacaggacauuauaacucauguaaacuauauaacuaauuaacucauuccuucugucauguaaaauauaggcacacauugauuuuuuuuucccccugccaucuuuacacaccuuuaagucuuuuauaugacuucuaccaauauuucaaauccugaaauuauuagauugguuuuauauucaauccuuauguucucaguuccuucaacugaguucuucaaauaaagguugggauguauaaugguuuucagguauuuucuguuuguagauaacuuuuauucuauuaggaaaagcaagguuuaguuagaguuguauagauacaguaaauuaguaagauguuaauggaguuuuagaggucucuacuagagacagaaagggcuaagauuuagaacauggauuuguagcuacugcgaagcaacucguuucaguuagaguauucaaaaucaaaguagccauauaaaagaguucuuagacuuggccaggcacaguggcucacaccuguaaucccagcacuuugggaggcugaggcggguggaucacgaggucaagagauugagaccauccuggccaacauggugaaaccccgucucuacuaaaaauacaaaaauuagcugggcauuguggcgcacgccuguagucucagcuacuccagaggcugaggcaggagaaucacuugaaucugaaaggcggagguugcagugagccgagauugcaccacugcacuccagccugggcaacagagugagacuccaucucaagaaaaaaaaaaaaaaaaaaagaauucuuacacuuaaaauuguaaacuuucagcauaggaacggaccuuuagaaaauaugaucuguuucauacgccauucccaauaauauuacaacugucuggacuauuuauacuuaugccaaauucucaaauuuauaaggaugaaagaguccaaaguuagggggccgaaaguguuugagaaaucaggucuaagugcuuuagaagccaccacaaguuucuuauuaguuaaauuuuuguugacuucuuaguuuucauaaaauacauuggcaauuucuugaagagaguauuaucucaaucaauauuaaaaaauugagacuaucucaaaaacaacuucauuuauaaagaaugauuauuuguugaguaauuuuuuuuaguuauuuaaacugaaaaaucuuuuaugcaacacucugagcagucugaaagaggaucguuguaauugaauuacaggugaggcacuugagccccuaacugcguugugcagauuuuguauguuauuagcuauuuauuguuuuuaaaucuauuuaaaaaauuauucuuauuuuaaauuauuaguuuuuagagacagggucuuguucugccacccaggcuggagugcaguggcgugaucauaacucacugcaaccuccaacuccuugggucaagcaauucucucaucucagccucccaaguagcugggacuauagaugugcaccaccauacugaacuaauuuuucaauuuuuauuuuuaauaaagucaagguaugucauccaagcgggucuucaacgccuggccucaagugauucuccagucuaagccucccaaagugcugagauuacagaugugagccacgacaccuggcccuuaaucuguuuuugaaaugaaaugccaacugaacauaaaugagauuucugugugguuuuagaaauuacuccagcuuucuaaaaauguuauaguaguauuucuuuuucuucaugcugauuauccuuuuuuguuauauaugguacagaguuauuuugaggcuuuauuauuuaccuuguguauugaacauuguccugcuuauacauggugaucuugucuguucauccugucugauccccaguccauuguucucauagcacauauccuccuguguaugauaccauaauuuuuuugaguacuaaauuguuuuuuuuuguuuuauuauuauuauacuuuuaaguuccaggguacaugugcacaacgugcggguuuguuacauagguauacaugugccauguugguuugcugcacccaucaacucgucauuuacauuagguguuucuccuaaugcuaucccucccccagcccccugacuucccgacaagcccuggugugugauguucgcugcccuguguccaaguguucucauuguucaauucccaccuaugagugagaacaugcgguguuuaguuuucuguccuugggaugguuugcugagaaugaugguuuccagcuucauuugugucccugcaaaggacaugaacuccuccuuuuuuauggcugcauaguauuccaugguguaucugugccacauuuucuuaauccagucuaucacggauggacauuuggguugguugcaagucuuugcuauugugaauaguacugcaauaaacauauguauccaugugucuuuauaguagcaugauuuauaauccauuggguauauacccaguaaugggauggcugggucaaauguauuucuaguuauagauccuggaggaaucaccacacugucuuccacaaugauugaacuaauuuacacucccaccaacaguguaaaagcauuccuauuucuccacauccucuccagcacuuguuguuucuugacuucuuaaugaucgccauucuaacuggcgugagaugguaucucacugugguuuugauuugcauuucucuaaugaccagugacgaugagcauuuuuucaugucuguugguugcauaauugucuucuuuugagaagugucuguucauauccuuugcccaauuuugaugggguuguuuguuuuuucuuguaaauuuguuugaauucauuguagauucuggauauuagcccuuugucagaugaguagauugcaaaaauucucucccauucuguagguugccuguucacucugaugguaguuucuuuugcugugcagaagcucuuuaguuuaauuagaucccauuugucuguuuuggcuuuuguugccauugcauuugguguuuuagucaugaagucuuuacacaugccuaugucuugaaugguacugccuagguuuucuucuaggguuuuuauggcuuuaggucuuacauuuaaguuuuuaauccauccugaauuaauuuuuguauaagguguaaggaagggauccaguuucagcuuucuacauauggcuagccaguuuucccagcaccauuuaucaaauagggaauccuuucccuauuucuuguugucagguuugucaaagaucagaugguuauagaugugugguguuacuucugagggcucuauucuguuccauuggucuauaucucuugguaccaguaccaugcuguuuugguuacuguagccuuguaguauaguuugaagucagguagcaugaugcugccagcuuuguucuuuuugcuuaggauugucuuggcaaugagggcacuuuuuugguuccauaugaacuuuaaaguaguuuuuuccaauucugugaagaaagucauugguugcuugauggggauggcauugaaucuguaaauuaccuugggcaguauggccauuuucacgauauugauucuuccuauccaugagcauagaauguucuuccauuuguuuguguccucuuuuauuugguugagcagugguuuguaguucuccuugaagagguccuucacaucccuuguaaguuggauuccuagguauuuuauucucuuugaagcaauugugaaugggaguucacucaugauuuggcucucuguuugucuguuauugguguauaagaaugcuugugauuuuugcccauugauuuuguauccugagacuuugcugaaguugcuuaucagcuuaaggagauuuugggcugagacgaugugguuuucuaaauauacaaucaugucaucugcaaacagggacaguuugacuuccucuuuuccuaauugaauacuguuauuucuuucucuugccugauugcccuggcuagaacuuccaacacuacauugaauaggaguggugagagacggcauccuucucuugugucgguuuucaaagggaaugcuuccaguuuuugcccauucaguaugauauuggcuguggguuugucauaaauagcucuuauuauuuugagauacguuccaucaauaccuaguuuauugagaguuucuagcaugaagggcuguugaauuuugucgaaggccuuuucugcaucuauugagauaaucaugugguuuuugccguugguucuuuuuaugugauggauugcguuuauugauuugcauauguugagccagccuugcaucccagggaugaagccgacuugaucgugguggauaagcuuuuugauaugcugcugcauuugguuuucugguauuuuauugaggauuuuugcaucaauguucaucaaggauauuggucuaaaauucucuuuuuuuguugugucucugccaggcuuugguaucaggaugaugcuguccucauaaaaugaguuagggaggauucccucuuuuucuauugauuggaauaguuucagaaggaaugguaucagccauucagaggaaugguaccagcuccuuuuuguaccucugguagaauucggcugugaauccgucuguuccuggacuuuuuuugguugguaggcuauuaauuauugccucaauuucagagccuauuauugguguguucagagauucaacuucuuccugguuuaguccaauuuauucguuucuucuggauuuucuaguuuauuugcauagagguguuuauaguauucucugaugguaguuuguauuucuguaggauugguggugauacccccuuuaucacuucuuauugugucuguuugauucuucucucucuucuucuuuauuagucuugcuagcaguguagccauuuuguugcuguguucaaaaaaccagcuccuggauucauugauuuuuugaaggguuuuuugugucucuauuuccuucaguucugcucugaucuuaguuauuucuugccuucugcuagcuuuugaauguguuugcucuugcuucucuaguucuuuuaauugugcuguuagggugucgauuuuagaucuuucugcuuucucuugugggcauuuagugcuauaaauuucccucuacacacugcuuuaaaugugucccagagauucugguauguugugucuuuguucucauugguuucaaagaacaucuuuauuucugccuucauuucguuauuuacccaauagucauucaggagcagguuguucaguuuccauguaguugugcagucuugaaugaguuuguuaauccugaguucuaguuugauugcacugugcucugagagacaguuugugauuucuguucuuuuacauuugcugaggagugcuuuacuucgaauuauguggucaauuuuagaauaagugugaugucgugcugagaagaauguauauucuguugauuugggguggagaguucuguagaugucuauuagguccacuugguccagagcugaguucaauuccuggauauccuuguuagccuucugucauguugaucugucuauuauugacagugggguguuuaagucucccauuauuauugugugggagucuaagucucuuuguaugucucuaaggacuugcuuuaugagucugcgugcuccuguguugagugcauauauauuuaggauaguuagcucuucuuguugcauugauuccuuuaccauuauguaauguccuuccuugucuguuuugaucuuccuucgucuaacgucuguuuuaucagagaccuggauugcaaccccugcuuuuuuuuuuuuuuuuuuggcuuuucguuugcuugguagaucuuccucuaucccuuuauuuugagccuauguguguuucugcaggugagaugggucuccugaauacagcacacugaugggucuugacucuuuauccaguuuaccagucugucuuuuaauuggggcauuuagcccauuuacauuuaagguuaauauuguuaugugugaauuugauccugucauuauguuagcugguuaucuugcccguuaauugaugcaguuucuucauagcauugauggucuucacaauuuggcauguuuuugccauggcugguaccuuuccauguuuagugcuuccuucaggaggagcucuuguaaggcaggccugguggugacaaaaucucucggcauuugcaugucuguaaaggauuuuauuucuccuucacuugugaagcuuaguuuggcuggauaugaaauucugaguugaaaauuauuuucuuuaagaaugucaaauauuagcccccacucucuucuggcuuguagaguuucugccgagagauccgcuguuagucugaugggcuucccuuuguggguaacugaccuuucucucugacugcccuuaauauuuuuuccuucauuucaaccuugauaaaucugacaguuaugugucuugggguugcucuucuugaggagcaucuuuguggcguucucuguauuuccugaauuugaauguuggcuugccuugcuagguuggggaaguccuccuggauaauauccuaaagaguguuuuccaacuugguuccauucucccugacacuuucagguacaccaaucaaacauagauuggucuuuucacauagucccauauuucuuggaggcuuuguucauuucuuuuugcucuuuuuuucucuaaucuugucuuuucacuuuaugucauuaauuugaucuucaaucacugauauccuuucuuccacuugaucgaaucggcuauugaagcuugugcaugcauuaugaaguucucuagccaugguuuucagcuccaucaggucauuuaagaucuucucuacacuauuuauuccaguuagccauucgucuaaccuuuuuucaagguuuuuagcuuccuugugauggguuagaacauccuccuuuagcucggagaaguuguuauuaccagccuucugaagccuacuucugugaacucgucaaagucauucuccauccaacuuuguuccauugcuggcaaggagcugugagcaguuggaggagaagaggugcucugguuuuuagaauuuucggcuuuucugcucugguuucucuccaucuuugugguuuugucuaccuuuggucuuugauguugguuaccuacagauuaaguuuuguuguggauguccuuuuuguugauguugaugcuacuccuuucuuaguuuuccuucuaacagucaggucccucagcugcaggucuguuggaguuuccuggagguccauuccagacccuguuugccuggguaucaccagcagaggcugcagaacagcaaauauugcugccuguuccuuccucuggaagcuucaucccagaggggcacccgccuauaugaggugucuguugccccuacuaggaggugucuccuaguuaggcuacacaggggucagggacccacuugaggaggcagucuguccguucucagagcucaaaggcuguggugggagaaccacugcucucuucugagcugucagacagugacauuucagucugcagaaguuaucugcugccuuuuuuucagcuaugcccugcccacagaaguggagucuauggaggcaguaggccuugcugagcugcagugggcuccgccuaguuugagcuucccugucgcuuuguuuaccuacucaagccccaguaauggcagaugccccuacccccgccaggcugcaugcagccuggcaggacuaucucagacugcugcgcuagcagugaggaaggcucugugggcaugggacccgcugagccaggcacgggauggaaucuccuggugugucguuuacuaagaccuugggaaaagcgccguauuuuggcaggagugucccguuuuuccagguagucugucacggcuucccuuggcuaggaaagggaaauccccugaccccuugagcuucccaagugaggugcucacccuccgugggcugcaccuacuguccaaccagucccaaugagaucgaccagguaccucauuuggaaaugcagaaaucacccgucuucugugucagucaugcuaggagcugcagaccggagcuguucauauucggccaucuuggaaugggagucuugagacuaaauuguuuacuuuuaaagguuauaaaacauaaagggcaaucucuguuuaucuugcuagagcagcaugauauuguugaaggauuuuggagucagacugaugcagauucaaauucuggucugccauguaacuguucaucucgagcaacuccauuauacucuugagccaugguuuucucaucugaaaaauugggugaauacuguuaaaauaaaaaucuuagaaaaaauaaauuuaaaguuuauuuaaaugaaaaacaauucaugaaucaggcagcacucagaaucagaagcgggugagagagcucuucccagcaauuuguaaguaaugagcuuuuguaggcugaauauggaagcaaaguagagaaaucacccaacugacuacccuuauguguguguuugccuaauuuggucauggugugaagaauuggcugucugauucauugaaacugcucuuuguugcaaaauauauacucccaaguuagguugaaguuuguuacagaggaacucaaaaguauagugacagucucaggcuaauggccuccuguuugcuuaauuuaacaaugcuuauaacagugucaccguuaagucagacuuugcacagaggauugagcauaaugcuuguuaccuaguauauccuaaauaaauuguguuucaggucucuuguuauuuucuagagugcagcguugucuuuaauacuuauuugucaaaugaauggugucugaaauuaaagccuauaauacaauucauugaauguauugaguacaugcuauaagacaacugccaugcuuggugcuauggaacaagccuacugucaggaaguuuacaauuuaauuggaaaaaauuggacacauggauauuaaagaacuguaaaagagauaucauuaaaauugaacucagcaguuuuauaagauggauuccucagaaccuuggcuacuagcaaaaguaucacuauaucccuaaauaaauuaagcucaaguuaguugcuuuucacuuggccucuauuuuuaggcguguuaaagaauggaacaguguaaaugaaacauuaaccacuguuagcuauuguuuauaacaucuugaccaacacuuugagcuuaaugacaagugaugcuugaugaggacuucuugcuugaugccgguaaagcugauuauuguugcuuucaaagggauugcuaauuuauuuuuugauuuuucuagaauaaauuagauauuauucuuaaguuagggcuuauugguauuaaggaagauaaucaguauaauaauaaaguaucaagagagugauagaccuauaauaacguugcagaguuuucuggcacuagauucguaguaggauacuauuaaguuuuuuuuaaaaaaacuuuaauuccaauugguuuuaaauuauucuucauacagugccguuuugugaaagagaaugaauaguguuuuguuuuuuaaguuucugagaaaucuguguaguguuuuucuuugugaaaugacaugccucuuuagguaauguuauuguggaaagaguauaggucuagaagcccagguaccugaguucuaguuucaccugugcuuagauuacuugcuuuucucaucuacagaguucuuuuuggauucaugcucuuccaaacuguacaacuuauuugggcauuucuuuucuucucuuuucuuucuuucuuucuuuuuuuuuuuuuucgagacgggguuuugcucuuguuacccaggcuggagugcaguggggcauucuuggcucacugcaacuucugccucccggguucaagugauucuccugccuuagccucccaaguagcugggauuacaggcaccggcuaccaugcccagcuaauuuuguauuuuuaauagagacaggguuucaccauguuggccaggcuggucuggaacuccugaccucaggugauccaccuaccccggccucucaaagugcugggauuacaggugugagccaccaugccuggcccugggcauuucuuaagaaucagcuguuaacauuaauuucccuggagugauaguuacacaauucuacuucuacaagaaggagggcaaucagggaaugaggcauauggauaggagaguucauucuagggcagauugaauaccuaucugcagaagccaaacugaguggguugauaaaaugaagaucgaaagcuagauaguauuuuuggcuaauaaccccacuucauguucccuuuuuccccagauucucuuacauugguuuuacuuuucuccuuccuuccuuuuaauuuuuuuuuuuuuuacaaaguauuacaagugugccauaaaauguacuuuuguucugacucuugagguucuuuuggauuaagaagccuagagacuuggaugugugugguaggaagaaggucaggcuaaaguugcaaauggucaaguuaagguggagagagggauuaggaagugaauguaagaaaaaaaaaaaaagcagaagccugacuaguaguuacuuauccccaaaauauuaugacuuauuuuaggaaaugugacacaaauucaguucuaaaauuuaauaggucacauucuggucuacguagugaaagcauggcuuaacauugagaaaguuuuugugauuaugaagauguauuucauauucucuugucuuaauuuuuaaaagugauacucuuccauugacucauauuaacuauccauaauucauagagaaagacuuuaaaaagauuguauuuuuaacuuguuucuauuuccacacagucauggucagagagauacagcacagauccuacuauuacgaggagccaaauaucugccagauaaaaauggaguaacuccucuggauuuauguguacagguguguuuuucauuuauauucugagccccuuaucuuuauaauagaaacuggaaugguaaaaauuauuauuuuuucaaugaaaggguaggugcaaagauuuuuauugugugaagaauaugaacuuuaaaagggacuguuuuuaaaccuggauaauuuuagaucuuguuuuuaggguggauauggagagacuugugaaguauuaauucaauaucacccgaggcuuuuucagacuauuauucaaaugacacagaaugaagaccuccgagaaaacaugguauuguauuugugauaguagcuuguaaaugaagaagcuuuauuccugcucagcauauaugacauuuuacaaaugugcuuagcuuaguaauuuugcuuauugucacaaauaucuuaauaauuagcuuaucugcauuauaggauaagugugaauuagauaauaauuaauauaguuuuugcuaauauuuggccauauaaaucuucugcccucugggucuuuggucucuccuuaagauaacuagaauaggcugggcgugguaucucacgccuguaauuccagcacuuugggaggcugagguggguggauugcuugagcccaggaguuugagacuagcuugggcaacaaagacccagucucuuaaaaacaaauuacaaaaauuagcuaaguguaguggcaugcaucuguagucugagcuacuugggaggcugagcugggaggagggauugagcccaggagguugagccugcagugagccgagaucaugucacugcccacuacacucuagccugggcgauacagugaugcucuaucuuuaaaaaaauaaaaauaaaaauaaaauaauaauauucccauggcaagaggaaaagacucuguggaggaauaucauuaugauugguaaucacuaguuuacucagcuauguguuugugauaguuuuagucuuagaaaaauugcggaauuuaaauuucucuuucguuuuagagguuuagaauuaaauuuccaaaacuauacuuggugauuuuuaaauucuaucuauauuuacuauuguuuuguaacugggugauuuucaacaaagauuuuauuauguaucaucauaucucuauauuagcuuuuaaacuuaugcaagacaaaauaacuaaaggacuugauuuagacuaauuggcuuuaagauacuuaauagguacuuaauuguuugauaagauuuaauggauuacuauguaaucacauuuuuuuauuuguaaaaaauuuaguuacggcaaguucuggagcauuugucucagcaaagugaaagccaguaccuaaagauucuaacaagccuugcugaaguugcuacaacaaauggucauaaacugcuuagguaaguguuucgcaauaagaggaaaucaauagguagcagugucuguuggcuucaccuccugaguaguuuauucugugggauaccuuuugucagugauaacgauguuauaaaaauuugcugacuucugguuuguuuuguuugaaaggaccaggguaaucaacuauugcuaaagagauuuuagucucucuaaagagacuaaaaauagagcauacuucagugaauuugggcauaugugucuagaauuuugugaaaugauuacuuaccuagacauauaaguaaauguacaugaagaagaauugagaaaguucaggaaucuugaccacuaauuaauaaaauaaaauuagguacaagcuacuguuuaaccuuucauuguacuuucaugacuccuuauaaaguuuuuuucucugaccugucccccucaguuaaguucuuuauuauuucuaaaagauccugugguuuuaucaucacuaaguucguggaguuaaugccuuauauuacuugaauuuauauaugaaguguuuuccuguagcuacacuucuuucuauguggcuggcuaccccaauuaggaauaagcagccacugagaaaugauuauugucuuauuauuucuuagccugcaagaaauuguauauauguauacacacacacacacacauauauacaauuauuuuuuuuuuuuugagacagagucucgcucucacucuguuacccaggcagcacaaucuuggcucacugcaaccuccaccucccagguucaagcaauucuccugccucagccucccaaguagcugggauuacaggcacacaccaccacgcccggcuaauuuuuuguauuuucaguagagaugggguuuugccauguugcccaggcuggucuugaacuccugagcucuggcaauccgcucaucucggccucccaaagugcugggauuacaggcgugcgccaaugcgccuggccaaauacauauuuuugagggcguaccauccauuaggccaucugugaggugaucaugaauaaaacagacaagaucucuauguugaaauuacagucuaaucaggauuuuauuggauuuuauuccauuuuguuggaaacuggcaauaucuuuaugaguugugagagugaaauaagauaauucuguaaaaugcaaaacaguggguccaguauauaguagaggugaugaugguuauaauuuuaaguacccuauaauaccauuuaaccuguuuuccuacauuagaaaacuuauuuuuucuucuuaaauauuugucauauuauauauacuuccacaguaauuauaaagcauuuauguuuugauguaucuauguuuuuaaguuuaccuucaucacuuauuaagcagguaccaagcuaaggagcauucgaauauauuauuucauuuauaccuuacaguaacuuuauaauuuagauguuaucuccauuuuacauguaaaaaaauugaaguuaaaugauuugccaagcuaauaaauaaaccuggauuuauauccucauuaguaaauagcggauucuagguucuaaucuagcuucuaaaaaugacaggggugguuggugggacaggagaaacaggguaggaaaaaggaacccaugaccaaaacaauaguaguuuuuaaaaaauuacucugcuaaacugugcucucucaccacuuauggugcuaccuuccaagugcuuuauagaaucuuauuuuuauggccauuuuuggccuguaaauaucucauuguugggguugguagugaguauugguuauuaguuagaauuuauuguacuguaaaaagguaauucuuaagaugauuucaaauacaaauuguuucccccugcugauuuauguuuaaugguauuuuuguagaguaucucauuuguguuuauuugugaaucauuuuauguuucuuaacccauuaugugaaguaauguugacccuuguuuuaauagaaauuuucauuaagaaaauaacugauucaaauauauguuaauuagugacaacuaagguguuauccagcacacuuuuggaaaaauuuguagccuauuaucuaacugauuucaggaauauuugcuaaagauaauaaacauuuacugaggcguuugcacauaaugcuauguuuauauugaaaugaaauuuuaucguccuuucuauauauuuaugauugaaaguaaagguaguuaacaauguggaaaugaacagagaaaucauagcuauaugcuaaguaagacacugaauaagaauauacccauauaaaccaaaggcgaggauuuuacaaugauagggguuugaguuaggaaauuaauuuuuuuuuuuuuuuuuuuugagauguagucucgcucuaucgcccaggcuggagugcaguggcgcgaucucggcuuacugcgagcuccaccucccggguucaugccauccuccugccucagccucccaaguagcugggacuacaugggccugccaccacgcccggcuaauuuuuuguauuuuuaguagagacgggguuucacuguguagccaggauggucucgaucuccugaccucgugaucugccugccucggccucccaaagugcugggauuacaggcgugagccaccacgcccggcaaaagcaacuauuuuaaaggaaggggccggggaagaagagagcuccgugcuucuaaugagcaaaggcagcaacaaccuugagcuucugcagcccuugguauuuauuggguagaaagagcagggaggaggagcaaaugauuggucagcugcuugauugaucacagcuucauauuauugcuaacaggcuucagauguaccuaaucacaagaaauacuuaugccugggucgugacugcccucagcauuccuucuggguggcagaugcaguuuuucaguuugccagcauccugcauuuaugagaacaguuggcuguuuacucauauagccuccagugguauacugaguugaucaugaccuucacccuuuuggccuccaacauacaaaguuaauccugcuguucugcgcagaaguucaugcaacucuuugcuuugcuccgacauuugugauacaagauaacugauguuagagauuucaaaauaaaaccaccaucaaccaacaaaaauacuguguuuaaagauauauuauuagauucaauacaaauuuagccuaacucguacaguuuuucuguggaaagguaauuauugguauucaugauguugaccaauaccaagguaacugugggauucugaagggcuuucugaucaguaaaagugaguuuauguuaauuuaauaugauuuaguguuaauugaauuuuagucuuuucuuuuuucaugguaggcaaauauuuccuauauuuguguauagucauaaggcagcccguuacguagagaacaaaccuaaugcagauagcaacuuuuaaauuuuucaauuugugaauguucuauaugugaauaauuuguuacuauucuguggugggaaggggauaugggauuauggauauaguggcagaguuuaguuuagcuucuucguuaaaacaguuguggguuggccuaagaauaugaugauuuauaccauugcuucucugugaaauacagacuucuaaaguauaaauuuaauuuacaaauauacuucugaaaguaaaaauuuaggaguugccuugaaguuguugccacaagaaaccaacuauucuaaaggagugauuuucuucauguuuuaugcuuugaucauugguuauauucugggugcuuaagaaauaguaauuuauuuauaugcaaguuaaauaauguaacuuccuguuaaacuguucuaucuccuaucaugauaggaaaggaauuguacuccaguuacauuauaauaugaaacagauggucagugggaugaaaauguuuuaaaauaaguauuuuaauauguaauuuguuuuacucuaaucucauauuuuaauuuuuauuuucagccucucuagcaauuaugaugcucaaaugaagagccuuuuaaggauugugagaauguuuugucacgucuuucgaauugguccauccucccccaguaauggaauugauaugggcuacaaugggaauaaaacuccaagaagccagguguucaaggugagaaaaguauauggcauuguuaggaagauagacguaaaagagaugaauuugacaaagcaugcauucauuaaucagaaagcucaugaacagguuguaaguuugguuuauacccauaucacuuucaaaauuaggcacaccuuucuccucucaacucugucuaaucaacagcaaguuggugagcuuucuguauuuuucuuacaaauaaaauuuuuuauuccauugguguuuuauucuaaggguagagauauuuaguguuuaaaauuaauuuuauuaaauuauagguuuuuaauguaauaugcagccaccaugcuuuugaaagaaauguauuucuuauuaguaaggaaauaaaaugcacaguuuuuauuuagauuuuaauaugauauguguguuagaugugugucuguauguguuuucaaaguaagguacuuucauuuacuggguuugcugacaguuaauuccugagauaacugcaaggaagaguuguugagauauuuucuuaaaauauuuuguauugcuucagcugccuuucuaagcacauauggaugaaguccuuggaagauucauguaaaaaccaagggaguuuugcuacucauguuaaauuauaauuuuaugaaguaaacaaaaugaauaggacuauaauugcucuuguuaauguuuuuuugggugacauuuuaaaguaacagauuuuagaaaaauguguaauuuaauaacuuuguguuuuuuauuucuucauguauuuauuuuuugaaacggagccucacucuguugccuaggcuggaaugcaguggcacaaucaugguugacugcagccucuaccucccugggcucaggugaugcucccaccucaaccuccccaguagcugggacuagaggugcaugccaccauaccuggcuaauuuuuguauuuuuuguuagagauggggcuuugccauguugcccaggcuagucucgaacuccugggcucaagcagucugucugccucugccucccaaagugcugggauugcaggcgugagccacugcacccagccaacuuacauuucuuuaaacaaugguuugaguauaaaauauagguuauuuaucaaaaaagugauauaaauguuuuuaugugccacuuccuugaaaacuaguuaggauugaaagcuuugcugucucuaaaauucaaagcuaaacuaguguucuauacuaaaugauucuuuccuuacauggaaaauuuuugcaaaaagguaaaaauaaaguuugcaagaacuuugacacuaguagauuaauacuuagaauagauaugguagucuuuuagaaagguuauguaugaaugucuguccaucuguuuuacucucuuuaaaaaaaucagucuaggaaggacaguuuuuagccauauauguaugugugugugugcacguugaguguguauuuuuguuuucuuuuuuuuuuuucuuauugugccaccuccuggaagaaugaaguuaugcauucuuguaauucauguggcuuuucacguaccacuuccuugagcucuaguuaggagugacgacuuacugucuuuguaaaauuuugaucuacauuauugaccuacucuuuuugucagggcuguuuuaagcaagcuuuacugcuucaaacauucauaucacacaaaguuguuuuuaauguguucuggcguggcucacuuuguuagugacggaaucuacccaugauuugacuuugacucauacuuucuacucaucaguaaugaugaauauaaaaucaaaucagguauagauguggucaauauuauucaaauuggguuagauuauauuuaauuuugucugauuucuuugguuaaaauuucgaucugcuaccuguuagcuaauaucagaaaauauguguuaaguagccucucuauaggugauuuaaaugauuuaaauauugauuuaaauguuaguuuucuaccuacacagucaauacagacauaauagaguagaaaaggauaucuguuuuuccuuuuuagcuuauguuuaaaaaauagaacccagacuuuauguuuugucaugugucuaugauauauauaauauauaaauacuuucuuauuucaagaauuuuguugguaucuuuguuucauuuuuuaagguacugcuuucuacagcauugacaacuacuauuucuucucaucacuuauuuucucuuaaauuuugaacuuccauuuuguaaaacacuaauuguaaaacucagcuaguuuuuaaacacauuaauaaguauuaacuguuaaagaauuuauuagucucuuuucauucaguuuuaugaaugaaacauggaaucuuuggggauuggcaaaaugaucugcccuuccauuuacaaggauaaaaauagaaacuguacauugucauccaugggaaucagaucuccuguucauugugggggugauuucaaguaaaaaucuuugcuaguuacugaguugcugugauguuagacuggaaauaccauuuuaauucuuaccacauuuugucugagguagcaauugaucccuaauuuccauuucauuaacaagguacucuaaugcuacuuuauuguucaaauuaacuaauggguuuuccauuaagaaugaguggguuuauaggccauguguuuuuaguaggugaaauuguuuaacauccuguuauuaguuuucugauuuauuuuagaaguucuucaaguuagucuuaacacauagccauucuuucagcauuaagagauguuuaucuagugccuugggaaauuuggagcauuugaaggagaagaucauuuuuauuuuugaagcacagugaacauggggaagacaauuuaggcuuccugagucuugcuguguucuuuuuuugugaauaguaagcugugacuauuaaugguuucauagacuuacaauuuggaaauuuugguaaccaagaaagauugugaaacuuuuaacuucaagaucuuaucuuguggguuguggcauuugacauuagguuaagaauagucagacuaacaggauaucaauguacuaugaaugaacauuaaguuaauaauacuuuucugccaaauucauuccucauuucagcacuucuugaaauuuuaaaaaaucguucaguaagcucgagauuguauauuuugaaauaugacuuaaaaugcuuauaaaucauguaugauuggcauaucauuguuacuauauguagaauauaauucuucaguaaggaucacucaauaauaaugaaugaagcaguauuuucacaguaccaagaaaccugcuaauauuuucaguaguaauuaacucauuguucgguaacaaaugguauguaugguguuucuuauuuaauguauuuuauuauuuaugaauauagaaaguaucagauauaguaugcaaugguuuauuuuuaauuuuaaaauuuauuugaauccuuuuuguugguggcugcuaccauaguuagaaauuaaaguuauuuucauaguauucuuuuuugugauugaagaaugaauuuucugaauagaucuucaaagagaaaacuuccuagguaaacucaccucaagguugggauuuaguuuuaauguauguaugauugaagaaauaaaagguaagaaaagagagaaaaguaaagaaagguccaaugugguuuauuacuuaucuuauuuuuuuucucauucuucuaauuauuugcuguguuccuuuauuaaaaacucuggcuuuucgacaucuuuguugucacuuuuacacauauccauuuuuuucuuugguguuauuucugcaccacugaaaauuugucuuucauuuuuuacacauugucaauauuugaaaauaggaucacuguugguuuagacucagugcucaucugcaugaucagccugugucauuucuugcguuaggccuuaccuccuuucaguguguugauuuucuagguuuuaucuuuucucauuuagaggccaauuauucuuuuuucuuuuuguuucaagcaguuuuauaucaccaccuguucuuuccauuucagaaguucauuuucugauauaaagcuaaauaguuuugcugacauaaguucuuuucaucuucuacagcagguucaguguuuugcucauaaagagaaacuauaguuucaacuuggaucaugauuagaauuuucagugaagguaucugucaguauuuauggcagcugggugcuucuugcccuucuuuaagcaguucagggacuccaaaucugucaaccguugugaguauggaagagcccucauuacgggugagagggaugcuuacuuuaacuucgaaggaggguauaauuucucuuaaaaaaggaaacauuguacuuaacccgacuaccuagugcauaguacugguugagugagugaacuagguuuuuguugauuguaguaguggugguuuuguugguuuuguuguguuuuucugcuuuuugguugaacguguaaaugaaggccugaggugauuuaauuauuugcaaauucaguaaguaaaauauuuucaaaaagagaauauuacagaaaucugaagaaaggcugaaaguggcagugaagguauuuguuagauaauaauugggaagaauuuccuggcagaauaguucaaacauuuucuaagguuccaaauaugguuguauaaucuccuuccauggcggucuuuaaaagaaagauuauuucuuuccuugaaauauuuuaaaggugagucuuucuguagcacaugguguaguuuguagcauucuguaaucaugucagauucaaaaagugagauaaacuuuuauauuuauuugcagaaggauagcuaaucauucucaauaagaauauuuaaaauaguguaggaugaagggauuguuuaaccacuguaccacuuauaaacuauuaaucuuuauuugggauuaaaaauauccuagcagguuuuuuuuuuuguuuguuuguuuguuuuuuuuuuuuuuuuggagacaguaucucacucuuucacccaggcuggaguauagugacaugaucacagcucacuguagccuugacuuccgagacucaagcaauccucccccuucaaccuccucaguaacugggacuacaagugcaugccuguguacccagcuagaauaauaauaggaaauaguuuauucucuccucaucuuuuuuuuuuuuaauagaaagguguuaaucuuuacuuggaauuaagaauuugcuacucaguauuuuuuuuuuuuuuuuugagauggagucucgcccugucacccaggcuggagugcaguggugugaucuuagcucacugcaaccucugccuccuggguucaagugaucguccugccucagccucccgaguagcuggaauuauaggugugugccaccaugucuggcuaauuuuuuguauuuuuaguagagaugggauuucaauucaccauguuggccaggcugaucucgaauuccugaccucaagugaucuacccaccucggccucccaaagugcugggauuacaggcgugagccaccaucuccggccugcuagucaguauuuuaauagaaguuugguaauuguaucucuuguuuuaaaaaaacacuaauuauuagaaauggauugugucuguaaguauauguauauacauaaauaugccacauuuuguaauuucuugucaaaaauuauccaaauucuaggaauuauauguaaugaaaggagcacaguaaaaaagcuguucauuagguucuuuagggauucucauuuuuuaauugaaaaaagacauuuguuuaauugaaaguuguugacauugaucauauuaauacagaaaauguugagugauuauacuuagggguucucauuuuuuaacugaaaaaaucuuauuuguuuaauugaaagugguugacauugaucauauuaauacaguaaauguuaagggugauuauauauaguaguaaugugugcuuuuaaaacuaaacauuugaaaauuaaaagaagaaagauugugaauuuuuuguuagauuuaguuuuuccuuuuuauuacaaggaauacauacauacaaauuaaauuauugccauaaaugaagaaauugucauuuauguagcauuuguauaauuuuauuacuuaccuuuaggcauuacuaucacguuaacuugggaagauagaaaugacuagaguaaauuuucucuucuauaauauuugucuaguuguguuuuguuuuuuuuuuuuuaauccuguaguuuaagaaugauguuuaaaaaacacuuuuguuucucucagccucuggaauugcuuuggcacucguuagaugaauggcuaguuuuaauagccacagaauugaugaaaaacaaaagagacucaacagagaucacuucuauuuuacugaaacaaaaaggccaagaucaagaugcugcuuccauuccuccauuugaaccuccaggaccugggagcuaugaaaaucuguccacuggcacaagggaaucuaaaccagaugcucuugcagggagacaggaagccagugcagauugucaggauguuauuucuaugacagcuaaccggcuaagugcugucauucaagcuuuuuacaugugcuguucuugucagaugccuccgggguaagaaaguuuuggcuuauuauuuuuuuuuucucugauagaugaugaaaagcagugauacuuuuguaauuucaaaaacaacaaauaauaauuuguugauuuaaaguuuucuccuuguuuuaagauacucauacuaaucuagaucuaguagggaauauuuaaauauuaagcaguauauauuauuacuuuguagaauggugaaugucaccuuguauaggaucucuuaauuauguauuugaaauguguagagcagaaaugcaccaaauuucaagauuuuuaaaaagucacuuguugauaucgucugcugaugagaaguuagaaucauuuuacaaauuggcuaggcauacuucaguuuccuaaacuuacaaagaagauucaaaaccaaauucuuuuuuuuuugguuuagaagccaguccaguucaguauauauuuaucaaguucgcuauauuauaucacaaacuuuugccuguguauucugauugauguuuuccccccacagaaugacuucaccucguuucauugaauuugucugcaaacaugaugaaguuuuaaaaugcuuuguuaauagguaagcuuucuggguuuguggaguacccugcuagccuuuccucucuuuacuuacaguuucaucuaaacagaaaaaauacuauuucucguacuauucaaaauaugcucaauaacaaaugaaacuuuaauagauauggauuauuauguguuuuucuucuguuucagugucaguguaucugaauuugcauuucacuuaaugcuacucauucuuccuguccauuuaaacaaaauauuuuucuuuuagaaaucccaaaauuauauuugaccacuuucacuuucuccuugaauguccugaguugaugucaagauucaugcauaucauaaaagcacagguagaaauuuuucuucaucuuuuuauucuaucuaaugaaauuaauuucuaaaauucuaauacuguuuaguggaauaauuauuacacuucagacauucuguuguaagaggaaugauugcauguuacuuuaauaugaggaguaaguuuucuucaagaaauauguacugagugccuacuauguacagaggucuguacaaaaacaacagaacacauugccacauuuccugaaaggagcuuaaugaaacucuuuaguucuauaaggcugauuguccuuuugaaaaggauuuuagcccccaaauacauuugggaaauuacauaacauaugcccuuuggaaauuuauaaaucacauuggcagcauguuaaaaggcuuugagaagcccuucaguaaaaauagugauuuagcuuuguuaauccuccuaacuuauuugaccugaccaccuuuccccuaccagauguguaccuguucauuccauacaucucauguuacaugaagcuagcuggaggaaagcuuguuuugcuccuuaccagcuaugugaacuuugggcacguuuccuaauauccuugagcccuugguuucuucaucuacaaaauggagauaaugacagcagccucauagaacuauuguccagaauaaauugucaggaaugacugugauauaugcucaauaaaugguaguuguuuuggagauagaaaacuuacuucccuucucuaagaggauucuaauucagucuggcuggggagauaauaaacauauguauaaaauaguaacuacaacauaaccuggaucuuuaggaguuuaagggaggaagagcuggcucuggcaucuguagucaggggaaauuucagaggaggcagauuuuaaguuaccuugagaaagcuugaaaaaauaugcaacauuuugaugggaguaaacaaagagggagaacuuucuagccaccaugugggcuggagcauguagaccgaaaaguauguaaaacugcaguauugcagcagaaauuuuguguugauaggagcaagauagaguuauggaaagguagauugaggucauccaaugaugagccuugauuuccagauugaagaauuuucuuuguuugcuaggcuguuaggagccacugauacccuugcuuuaggagaauggcauaauucuggcaaaguuuuagaaaauaauuugccagauauguaggacagacuguaggcaaugguuugguuaguaguuguaagauaauaaauaggauaagugguuuuuaaugucuuuagggacacuuguccuuucagaaguuaagcuaugaacuaauuuuuauaaaauuauacauaacuauauagagggaucuuuugacaucuguuuaauaaugauaaugugaaagagaaggcaguaauaaugacuuacauuuacugauuuuaggucagguacuauguauuugcuuccaugaaugauuuuauuuucuuaaccauuguauaagauggcuacucuuuuuuuuguaagcugaagugguuaaguaacuuguuuaagucauucugcuacuaaaugggagaaccagaauuuaaaagucugucugguucucaaguucaauuucuuucuuuauuuuauuuauuuauuuuuuuugacacaggguuuuaccugucacucaggcuggaguauaguugaucugagcucacugcaacgucugccuccugggcugaagcgauccucccagcucagucuuucaaguagcugggacuacaggugcauaccaccacaccuggcuaauuuuuguguuuuuuguagagacgggauuuugccaugcugcgcagacuggccuugaacuccugagcucaagugauccaccugccuuagccucccaaaguguugggauuaugggcaugagccaccacacccggacaaguucaauuucuuaaccuacacuguaugauacuguucuggggcaaaugagauaauaggugaaagaagauuuuaguuuuugagagauagucugcuguuuuuaauauagguuggugcaaaaguaauugcgguuuuuggcaguuacuuuuaauugccaaauuaaaauugucaaauuaaaauagcaaaaaccgcaauuacuuuugcaccaaccuaauacugucucugcuuuuuacuuucuauuccuuuuucccuuccuggacaauuuagucaaaaaacaucuguauuagguauccacuuuguugacccagagagggagguguuuguugccugacuagggugaggagggugucuacauguguagugguggccuagugugggguuuuggaguuuggaugugauuaagaagugugucuguguagaagagggucccagugugagucauguggguuagaguggcauaaggaggauguccauguuggcggugguugcagcugaucagugcugucugauggagccucagugggaugcaggggccaugucagugauuggagauugguuacauaccaagggagugggguugcagguugaucaaauaagcaaguaugagagucuaacuucucguuguuggagaaaggaguuacaaaauggaggaaauuagaaggaaccuuguguugaauuggaguuaccaguuugaauuuaguuuuaaauuuacauagauacauguagcaaaccuggcacccagcucuuggucucucagugccauucucaaugaaccagggcuccuuggagaaauggcuaauuccagggcuagaucagggaaaguauaaaauaagccugcaacaucuuauuguguaagaaaguaaggaaguguucaaagacugaugggguuauguuaacaugacucggaagacagcuugaauggacucccacuaccaaauuuggaagaauuugagcaucaaaauaaauaaugauggcaacauaaacaggaaucuaugagucuguacugaaaaaaguuaaugaauaaauggaaagucugaugaaggguaggaugauuacacagucucagauuaucucccagcagaauaauugcaaagagaaaaagggugccuuacaguagagaagcuuagcagugaucaaagcagacauagcagugugccagcugauaggaugcucugaggacaucauggcaucacuucugugguauucuugccaaggauacacaccuuaaaucuaaucaggaggaaucaucagacuaaauacaguugagggacauucuacaaaauuaacugaccugcagucaguuuuaaagaccugcagucuuuaaaacuaucaagguuaugaaaauuaagaaaacauugaagaaauguaccagagugaaggagacaggacaggacaauuaaaggcaguucaugaaucauuuugcaauaagaggacauuauuagaaaauuggcaagacuugaaaugggaucugauguaguaguguuaucagaguuaauuucugauuuugaugguuguuaucuaguuauagaggaaaauucccuuguuuguaggaaauaaaugccuaaguguuuauaggggacuggacauuauauuggcaaguugcucucacauuagaggaaaaaaaaauacuuuguacucuacuguacuuagaaguuuucuguaacuuggagauuguccuccucuagaaaguuaaaaagaacaacuaccucugcuaagggauugacuucuucuucuguuggugguuuucagguggccaguaguuaaagggagaaacauuuuguauugcuguacaaaugcuauuaagaggagccucuauaaucaguccuguuuugugaauuauuuauggaaaugcagguacucuagaaaguuuacauacaaaaauguaccauuuggcuguguagguguuuguauguguguguguguguuugaucugagcuuuugaagguagcaguuuguaccuuuuaauguuccacuugaauuacuugaaaagguuccauuuguuuuuauuucuugguucacauuucauagauaaaugauauaguuuaauaucuuauaaugggcaguaaguuuucuuuuaaauaguuauugacaauaauuuuaacauugcugugaaugauaauaagaacaguaucuauuuauugagcauucuagguauugaguauuagagcauuaguauaaaugcuuuuaauguauuuuucucuuugguaaaauggggacaaaaguuccuuuuucucauaguguugugaggauuguaugugguaaugcauuguaaagugcuucaaaaaguaccuggcuuauaggugcuuaauaaaugauugcuaauuuauuauuaugauuauuauaauuaucauaauuauguucuuuauuugaauuauuuaauccuaacagcucuugaaguagguauauucuuuucucuguuuuacagaugagaaaacuaaaguucugugaggauuaauaauuuccuuaagauaagucuaguaagucacagagugaggauuucaaaccauguuuaucugacuucaaagcccauacuuaaauaauugcuucuguguaauguuuuuucucuccucuuaaaccaaaguuuuagaaauagucagcauuagaauuucaaguacuuuauauuccagcuuguuaacugaaaaugagauauuuaauuuauaugcacaguaaugcauauaacaccagugcuuuauaaaaaauguggaagacuguuacaaguauggacaaaauuacacauuuaacuuuaaaaagguagcauuuauucuuuucuuacugaaagcaaauauuaaaaggcagaaguucaucucucaucgaucauauuguuuuuauuaagaauuaauaacaagugauauuugaaucuuuuaaaacaaaccuauuuaauuuagcucagaugaagaaauuuauugguguccuaaaagccaccuggaagauaaccuuuuugugguguuggaugguauucaucauauuuaucucuugaaacucuuagcuuuugugaugguauugcaccaccuugcuucuccuuugacuuuucuugccgucuguaucauuugcuaagcaaauucucagucaugacuugugaucauaaacuucuuuguucuugguauuuauucucuguaucuuucaucucuugaaccuuauccugucuccaacuuuaccuuuguucauguuuuuauuuucagugucucagcugcaucacuguccaguaucuccuccuaaaucccuaauaguuacaccccacuauaucuuuaaacucacgauacauaaaaucuuacucauauuuccaccaguaccuucuaggaguguggggguagguuauggggaaagggcuuuuccacuuuaaguuauuucuauucauaaguucuaucuugcagagaucuuaccuuacuuuuuuuuuuguagagauaaggucucaguuugucacucaggcuggagugacaaagugagcacacuacaauuauagcucauugcagccuugaacuccuggguuaaaguuuucucccaccucagccuucugagcagccaggacuguaggcgcauaccacuacgcuuggcuaauuaaaacauuuuuuuuuuuuugguagagacagggucucacuguugcccaggcuggucucaaacuccugggcucaagcgauccuccugccuuggccucccaaagugcugggauuacaggcaugagccaccauacccagccucuucucuuacuuuuaaugcuuauucaaagaaguaguaucucucggauuggcuucauuguuccucuuugcuaccaugaccaggacuucuauagcucaugcuucauuguugagaaauugauauuauauauauauauauuguguuacucuguguuagucacaucucuuuaacucuauuaaacaguuuuuagcaaguucuuggaguuuuuacugcucuuacauuacaugcaguguugguacauaguaaguacucaguacuuucugauuaaucaaaaauuguagauaacucacaguuugcuuaccuggcagaugaacaaaagggagagacucucuuugcuauucaagagaucuuauucuucaauuuuuaggguggagaaugggaagggauaacaaauuacguuccaauuucugcauguauucuaaaggauagaaguaagaauaaaguuaggaguaagaggccgggcgcaguggcucaugccuguaaucccagcacuuugggaggcugagauggguggaucaccugaggucaggaguucgaaaccagccuggcuaacauggugaaaccucucucuacuaaaaauacaaaaauuagccaggcgugguggugcgugccugcaaucccagcuacuugagaggcugaggcaggagaaucacuugaauucaggaggcagagguugcagugagcagagaucgugccacugcacuccagccuggacaacagagugagacuuugucucaaaaugacaacaacaacuacaacaauaaaccaaaauaaauaaauaagauuagguguaagagauuauuuucaugaaaaauuaaauggaacacgcaacguaauuuuucugggugugaaaauucauuguaauaaggcuuggauuuaaaagaauugagaauaaauauauucaauuacaugucugauauuaaguucugagacauaaccaaauuuaucaagucuuuuguguugaaaauguaggaauuuaaaaaaauacauuucucuagguagucaaacuauuucagcuaaguucugucuuuuuguaaauaguuauugaaauguucaaacauuauccaguaacuccuuauuguaaauaaagaucuaagaaugauuauuuguagaaaaggcauuuagcaagcuaguaaaucugauaauuagaugacugauacacugcuaacauauuuuacucuuauuuuuugagcuagccuuuuaaagaucgcugugaaugguucuaugaacauuugcauucaggacagccagauucagauauggugcacaggccagugaaugaaaaugauauccugcugguucacagagguaugcuuaacaaagaaacugauauaugugugaagcacaaagugcuuuuuauuauaaauuuuaauauguaaaauuaaccaaugcuacauauuuagauucuauuuuuaggaguagcugugaaguugugucaaaagcaaauugugcaaagcuaaagcaagggauugcuguacgguuccauggagaagaaggcaugguggguauaaaagaagaugauguagaaaucacuguauguaaagaaagauugaaaugccuuuugaauaaaguuuaauauuuaguugauaaaggaagaaacuuuauauuuaaauuuuguuauuuagaaaaaaauuucccaauauaacauauuucuguugaugcuuaauuuuauuucuugaauucagggucaagguguugugcgugagugguuugauauucuguccaaugagauagucaauccugauuaugcauuguuuacccagucagcugaugguaaguuguacagucuagaugacuuuuucugcaacuugucacauuuuucacacuauuucaguacauuuuauuuuugauuuccacagcagaccugugagcuaggugggauauucuuauuuuauagaugagaaaacugaaauucagaguuuuuaucugcauucacacaguuaauaaguaguagaaucauaaguggaaccugacucagucuaacauuuguuccucuaaacaguugguucccaaaugcuugucucaaggacuaguguuggcccaaagagguuucuuaucaguccuuuguaaaauaaaacuaaauugguucaauuuaaggauuauccuugagucuacauuuuuugaauuaaauguuuuauuucauaaauuaauggugcuuguagauggccuuaaacaaauaaaagucccuauuuggaaaaauaaaaauuugcuaacucuauuugaguuuccaaguuuuaaaauauauugguuaggaaaacccaagucuagaaaucaugauauaaaauuucaacucuuaaucuauuuauguauacuaacuuuauuuucagucauuuugagagaucaagaccuggcuacuauaaagcucuuauugaaccauauaaaacagauaauuaacucuccuuguugaaauggugcuugugcccuauagagucguaauuugcuguuguagacuaaauggaauuaguuaucaccucauuugugugaggcauauuugagagcucucuaacuuaauaaagacauauuccaagugaaggugggauuucaguuuucaaaugcuuugcacagucgcuuguuuuuccuaaaaaucuuuucucuccccaaauguuuacauucuuuuaucaggagagaaugcuucauuaauuguagcuucugauugcuuccaaccaaacuagcagcaaaucccuauuugaucagaaggaugauuuuaggggaggcaagugggaguaggcugcaguagagcuaggcagcugcaggcauucaucccugugauggguuucguggauacacuuugaguauuugaaauuauguaggaacauggaacugccugcuuuaacucuguaaccuuuaauucuuugcucugaggugaauuuggugucuuugugaaugacgaguucagugaagucaugaguuuaauuauuuaggccuaaucuuugaagcuagaucuagcauuauauuuuagacuuauuucuucucuuuauauccuuuauucuaagucuacuuagcuuaauaucugaaaaacagauuugguguggaaucauuaguugagguacuuccuuaauguuacagauuuauagcagagcaaauguugaaguacauagacccauaaaguuuuuuguuuuuuuuuuucuuugagacagagucucgcucugucacccaggcuagagggcaguggcgcaaucuuggaucacugcagccuugaccucccgggcucaagggacccuccaccucagccucccgaguagcugguauggcugaggugggaggaucacuugagcugggagaccagccauggcgccuggcuaguuuuuguauuuuguaauuucucuauucuuuuuguggagaugagguuucgccaugcugccgaggcuggccucaaacucuugagcucagguuaucuacccgccucggccucccaaaguucugggauuacagguguaagcuacuacgucuggccaaacauuuugauuuaucuuuuuuguaagccauaucagucuccucuuuggugucauaguauuaauaaauuaaaaucaagcugaaauauuuucacguucucagguuuaguugacaaagagaauuacauauaggaaucaagaauuucuaaauguggggaauguuuggguagacccgauaucuauaauaauuuuuuaaagaacuuguuuucuaaugaaauuaagaugcuuacuguagugaaauaguauauuuguuaugaauuuguccuuuggguuuauacauggugagaaucuugacugcuauucuuuugauacaaucuuggggccaguaaacuuaacuauucugcgccuuuguguccucauuuaaaaaugaugauaccugcuugggcgcgguggcucaugccuguaaucccagcacuuugggaggccgaggcgggcagaucacgaggucaaaagaucaagaccauccuggucaacaugguaaaaccccaucucuaacugaaaauacaaaaauuaacugggcaugguggcaugugcuuguagucccagcuacuugguaggcugagggaggagaaucucuugaacccaggagguggagguuguagugagcugagguugugccacugcacuccagccuggugacagggcgagacuccgucucaaaaaaaaaagagaggccgggcgcgguggcucacgccuguaaucccagcacuuugggaggccgaggcgggcggaucacgaggucaggagaucgagaccaucccggcuaaaacggugaaaccccgucucuacuaaaaauacaaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaaaaaaagagaaaagaugauaaccuauuuuuuguaaugugguaagaacucaguuagcugauaugugaaaaugcuuaguuggugccuggcauauagaaaguauaaauauuauaugcuauuauuauuacaugaaaaugauauuauuguauacuaggauuuuucugagagcaugaaaauaguugggggaaucacagcuauauauauuuuuugaacuuaaaauuuaucauaaacuuuuaauucuauuuaaaauuuucaaguuaaaaacuguuacuccuuuucugaagauuuucucccuauauguuuccuuuuuuuuuuuuaaaaaagucuccuuaucuauucuuuuuaagcaucuagauuucucagaaaguaauuagagaaggaauuaaacacagagcuaggggaggaaaguagaaucaucagaaaucuuuguugguccauagcuguaaucauucauuauuuuaacagguaaaaaauauuugugauuauucucagaauauuauauuuuugggauuaugauuauauuugucuuugaagucugccuuuaucucacaaagcuuugcuuuggcuuuuaauaccaggucuugcuucaugacagugaauuauucuccaaagguccuuaacagugaaugaugagacucacaugacuuauuuagguuauucccauaggcuugcaaauuuauaccuuauaucuaaauaaacuagucagcagguuaaccuggugucagcaccgagaaaucaaagaccagugaaacacagagugaauuauugucaaaaugacuaaagauuucacuuuccaauacauuucuaccuuuuguuuuucuuugaugcuauuucauuagguuuauccguuguuucuuuuagcccaggcauuuacaauaguaguauauagcaugagcucauuauguguuuguugaauggaugaguaaauuuguaauaugaauuagugaccaucacagaaaaauaggaaaaauaggaaaagaaaguuauuuaaaguugagguuuuggcauuagguuuuaacuuuuaacuaguaguauuuuuuuuuugagacuuuuuuuuuacgguggugaaauacacauauaaauuuaccauuuauauuauugaaaguguacaauucaguggcauuuaaguacauucacaguguugugcaaccaucggccacuaucuauuuucagagcuuuuucaucaccccaagcagaaauucuguacccguuaagcaauaucucccauauccccuuuccucagccuuagguaacuacuaaucuacuuuaccuaucuauaaauuugccuauucuagauauuuuauaaaaguggauucauauuccauugcacuggauuuucauaguaauugguaacuuauugcccuugccauuuuuacuuucaccucagagguaauuguuuaaacuuaauuguuugccauuagaaagacuugguuaccuuguggacugaggugauuuucuaaucauuguuaacaggcaucaaguucauugacuaggccugucacuuaagagcaguuguacauuuacaguuuuuaguuauucucauaguguucuacuccugaagcagcaaaaacuagcaaauacuuacugcacuggcacauacagaugaaugggauaaugucuguccuagcgaacagccuauugccauacugccuaggaaacuguguauaugugcguguguguguguguauguguauguguauaugauccucugcuguauuauuuccagagugucucugaugaucuuccaacuaauuucagucaaaaguacucuaaaauuuucucucugccauagauuacugugacaaauauguaugaauaaaugauuaucaucuauacuuccaauucuacuuaccacuuguuauauuuuccacaaagaacauuucucuggaaguuuauacauaauguaaccuuagcuuugcugaaguuguaugugaauuaguuuaucugcaucgaaguaaucuuucuucugcauauagauucuuaauaauauauuauuuuguauuuauuucaauaggaacaacuuuucagccuaauagcaacucuuauguaaauccugaucacuugaacuauuuucgguuugcugggcagaucuugggauuagcguugaaccacaggcagcuggucaauauuuacuucacacgauccuucuacaagcacauucuugguauggcucuauuauuauuucugcagacauuuauuuauauuguuuuuuuuucaguuugaggaaaacuagauaagcaguaguauuuuggaugagauaauuuuuauuuugauuggagcccaucuguauauguaagccauucgggguuugaaggagaaaaaaaugaccuaccuuuuuuuuuuccaaacaccucuaguuaaguuagccuuuuuuuuuuuuuuucaauuuuuguguguguauuuuuaugcuaagaauacauuucagugugaguauacuuaagauaauuggcauuuuugaaguuuauaauaacuuccugaauaguuauuucaaagaaagauuacauuguaacaaugugaaagaaacacagaauuaauuuaacagacuuucaaauucaggaauccauuuaaaauaugcuguguguaggauuguauuauauuuugcaguuuuucagaauaucuguagagggcaguauuuuaccauuaaauagauaagggaaggcaaaaccagacuauaacugcuguauguuugcauuuuuuagguauuccuguaaauuaccaagauguggcauccauugauccagaauaugcgaaaaauuugcaauggauuuuagauaaugauauaagugaucugggucuagaacuaacuuuuucuguugagacugauguguuuggagcaauggaagaggugccuuugaaaccugggggugggaguauucuugugacacaaaauaauaaagugaguauuucaguuuuuaccuuaaccauuguuuguaacuuggcccugauaguuugcuaguuacucuaaauucuucuggcacuuguagaaaaacuuuuacuauuacaguaucauagcagauaaaacguuuaaguuaauaaaacaaucaaauguuaaauuuugaauuagaaaggauuauuuugauaauugugcuagcugugcugaguugguuccuaaaaaaucgagagcacuucagcugauaguauaaauugggcauaugcauuuugagaaauuugauuagaaauauaagcuuaaaugaagauauuugcaaaaauugcucuuucauguuuuuaaaguguaauauuaaagaauucuaauagagaaaagaaaugccaguguuuaagcuuuccacauacuuuugggauccaguaaguuuguucgaccuuuugauauuuuuuugacuguauaacuugauuauuuauuuauuuauuuauugagacgaagucucacucugucacccaggcuggagcgcagugguaugaucucggcucacugcaaccucugccuccuggguucgagcaauucuccugccuuggccuccucaguagcugggauuacaggggugcgccaccaugcccagauaauuuuuguauuuuuaguagagacgggguuucaccauguuggccaggauggucucaaacuccugaccucaggugaucugucugccucggccucccaaagugcugggauuacagguaugagccaccacucucggccuuauuuuuauuuauuauuaccucuccucuauauguauuauuuaaaaaucuuugcauauguuuuaaauuucacuguucaaagucauaauaugacuuuaagauuuaauauggcuugguguuuuaauauguuauaugagguauuuggaguuagaaaauaucauaugaauucuaguucuguugcuuacaaguagcagcuucugguugaacaauacuaaacugccccccucccuuuuuguuuagcugaauuauaauuccaagacaucuucagaaucaauuuaacuauaagaaacaauguucacugagccauuuuuuaaacuauagauuuaguaaaauguggauuauuuuaaaaaggguuauguuuaacaauucuucgaacucaguuuucuguagaauuggaauaauaauaccucccauacagaauuguuauuagcauuuuguaaaaugaaaagcacagcacaaaaguuaguuguauuggguaguuuucuauaaaaauagguucuuaguuucagauauauaaagggaauuggaaacuuauuagcaagcgacauaauuuuaccuuuugaaacuuaagauacuauaguguacaaaaaaaagagauugaauucuuggaaauaaagucaggaguugaguucuuacauauucauacuuagaaauuuuaaauucuacccucucauuuuacaugaaaugacacuaauccuaaagaguuaauggcaaaacuggggccaaaacccaagccuccuaauuucaagucuaauguucuucauacuauaugcaaaauuaauugugucgaggaagaacuuacuugauuuuuaauguaagucauguuaagcucuagaagauuauaauaguuaaacacuuaauuuuuaaaccuauaugauuugccagugagugaaaauauuuuuagaaucuuuuuuuagauuguucaccuuguagcauguuuauuauuuuauuuuacacuggaggccuacccucaauuaaggguaaugaagucauagaaucuuuauuaagcaaugauugccuuugauaagagaaccauaaacaugauucuuaucugugaauacuauaucuggugagguuugucacuccuuucagauauauaugacaaaguggaaagaucuaguaacaauuguauuccagugcuuugggagacuaaggcagggggauugcuugaggccaggaguucgagacaagccugggcaacauagugagaccucaucucuauaaaaaauaaaaaaauuagccaggccuaguuuuguguggcuacaguccuagcuauucuggaggcugaggugggaggaucacuugagcucuggagguugaggcuacagugagccaagaugacauuacugcccucuagccugagugacagagcaagauccuaucacuuaaaaaagaaaaaaaaauguguaugagguauaucuauauuuaugcuugcaucuccuagcagcacccccccuuacuaugacaugauuuuuguuuagauuuuuaaaauauuauuaauuuuuuuguauuuguguauuuuaaugaaaucuagaaagauggaaaauauugaauaaauaagaauaaguaagaauaugcucacauugaggauauacccuucauugugcaucucaccagaggugggaauacuauuuuaauauuaaagagcuugaaacuuuuguuucucaguuuaauacuauauauauuuacauuuuguuuaauugcuugguugauuagaggcuaacuuuuuuaaguaauuaggaguguuaauagcagggucuugauuauuaauguuauacauucucagcuuucauuuuuuuuauauaaacauuucucacaauaaauugagccuuuuuuuucuaauguuaccaguauaguaauuguguaucaaauuguugagguuucaacauauaaugcuuauuuaauaaauaaccugauucauauaaaacucuuaaaaaucuuuagaaacacaucacauuuuaccuugcuuaaaauuguuaagauauucaguuuacaaaauguuacuuuaaaauuuucaaacccuguuucuuggaaauacuauugauuuuugguuuguucuuuuuuuuugcuuauacauucuguuaugaacuuuucuguuacuuuagagucagcuuuuuacuuuauagguagaaaguuuuuuugucauguuuagaguucgacuuuauaauuuugaacuauugaaacuuaaaugacuugcuaaacuuguuagagggccuuuguaaacugaucuccacaugggggagucccuuauucccaaguuuuauuaaaaggcuuuggugauuauaaagugaaaccaaauagaugaaaauaccuuuaauuuaaaaagcaauauguuaaauaaauacaagcaauauaggcagauguauauauauuaguuccacauuugaaauauaauacucuuaaauuaguuagauauggccucuuuugcucauauuuucaguucuagcauuuagaauugaagcuguagggguuuaaauguuagcaucacuuuuauaauauuagucauaaaguucauccaggcuuggagaaaaaaaagaagauaagaguaagauggggcagguaucagggaauggaugaagugguauggaaguugaauuauagaggugaagcauuaaguggucgaguaggaguaaggaugggaagaaggaaauguucugggcuuacaggaaggcacagaggugacagagcaugcuuugggaaaccacaaguagaucagaguuguggagcuuagcuuagauggaaaaguaagcaaguagaaaaagaugauguggggaagggagaaaguggccaaauucugaaagacuuugcauccacaaauaguacuuugaaaauuauucugaagucuguggagaugauugcagauguuaaagagggaaaugacaugaucaaauuucaguuaagaaaacaaaaagaaacaaccaaacucagcuuggagugugaaaaauggguugaaauggggcgguacuagagucaggacaacugagaggaggcuguggcauuuugguuuggggaagcaugcaugaagaauuauguaaggcaaguggcagugaagauggagaaaauggaauagcuuuuaagcuuuugaggauaauagaauuuauagaacuugguaauugggaagaugagaaagaggaaggacucaaggauaacugccacuguuguggauugggccaccuaaugucugauaguguugccaucauacucuucaucaaccucauuaucauuaauucuguuuuuuagugauaauaauuacuacuuauugagugcuuuguguuucauguaucugaaccauguucuuuauguuucucauuuccuguaacagccucuugagauagcuauuucucuuuauuuaguguggaaacagccuuaauauuaaaacauuugacauuuauuagguuuuuauaaugugcuaggcacuguuugaugugccuuauggguauuauacuuaacucugugagguggagauaccccuuucuacaggugaggaaacagaagcauauaggagcuaaguagcuuucuccaugcagucuguaaauuucaagccugcuugugcaggggccauccagucuucucuguaugguuccaauauuaguauacgugcugcugagacaagcacuugagccugcuuguaacuacaacacugcauuucuuuagacguuaaauaacugcccgagggcacaaaacuuguaacugauguuuucuuauuuuaaauggaugucuauaagacaguguaacugcuaggcuucucauuuacuaaggcagugaaugugaacaaaguagcaaauacaaauuuaguauguuuuaacgauuucauuuuaauaugguuuuauugcuagucuuauaugauuaaauuuuuagugcuagcuuugcaugauuuauuuaacauacacauuuaaugcacauacaagcacaaaauacagacuuuuauccauagauuauugacuuaaaguggauucuuuauaugcaucuuuagaaaaguauacagguugagcauccauaauucagaguaccccagagucugaaacuuuucgaguacugacaugaagccauaagugguaaaucccauaccugaucucauaugaccagggggcacucagaacacaagcauacaacauacaguuguuucagcauccccaaaggaaaaaagacccucccagcccccuucugcugcauauauauuuuuucuucaacacaccaagauuccaucaugcaagcaugcccacaaggguaauaaaugacaugugcaggacgcauaugccaagagcagguuccccacugugccccacguggggccaaggccgaugugcauuugugcauuacucaugucuuuucuuuucuuuugcuuauuuucugcucuguggugcagagguauuguugggaaugucaaaaaggccugcagauaccccuguggguaacagugacagggaaaagagggagcauuugucuuuauccguagcacagaaagucaagcuguuggagaaacuggacagcaauauaaaugugaaauguccuacagaagaguaugguguuggaaugaccacacuauauaacuugaagaaacaaaagaauaaacuguugacguucugugccaaaacugaugaaaagaaguuaaugaaaaauagaauaacacugcauaaagcuaaaacugaagaucucaauuguguauuuaaagaguggauuugucagccuaacagugaacacuugccacuuaaugguaugccgaucauaaacaagcaaagaucuaucauaaugaagugaaaauugaagggaacucugacuuuucaacaggcugguugcagaaauuuaagaagagacaugauauucauuuuuuaaagauuuguggcaauagagcaucugcugaucacaaaacaguggugaaauucagugaggaauuugccaaggucauugcugaugaaaaucugaugcuagaacaagucuauauugcuguuaaaauaucacuauuuuguuguuguugccucagaaagacacugacuacagcugaugagacagccccugugguaggcuaccaaggacagaauaaaugugcagggauguccuagugcaacaggcaaguguaaguguaaauuugccaugauaggcaaaagccuguguucucaaucucuucaaggagugaauuucuuaccaguccauuauuaugcuagcaaaaaggcauggaucaccagggaaaauauuuuauaccaguggcuuguguuuacugcauggugacugcaagacuuuguuauucccuaacaacugcucugcucaucauccagcugaaauucucaucaaaaauaauguguuugccauguauuuucccucaaaugugacuucauuaauucagccaugugacugaauuaaucagucacauuagaucagugaagaauaaauauaacacuuuguugcauagacugcuagcaucagugaacagaauuguaauuguggaagguuuucaaagggaguuuaauaugaaggauguuguguaugcuguugccagugcuuggaacacagugaguaaagacacaauugugcaugccuggcacaaccucuggccugcaacuauguucagugauggugacgagcaaaugugugacuuugaaggauucuguaugucaagugaaagaaaugauguuugacugccuuacauaugcaaaaaaauauaccuucagaguuuguuagugaacugaaagaaguggauauugaaaaggucuguaacacugguuauaaggcuccaauugcucauucauugaugaugaaguagccaaaaugguucugaguguaggugauggugauaauagugaugaugaagauaacauuaaaacugaagaagaagugccuauagaugacauggugaaaauauggcauucacaacagaacaagaaaucauguuaguuuauaaaaucaaagagagauuucuaaggcaaacaccauuguuaaugaggcagauaacccuggaggaaacauuuaaaaauccauccagcagaaugacuccucauuccuagaagacccacuugcuguccucucaacugcuucuucucaccuuaaaacauaaaauaauguacaggccgggcauaguggcucacaccuguaaucccagcacuuugggaggccgaggugaguggaucaccugaggucaggaguuucagaccagucuggccaauauggugaaaccccgucucuacuaaaaauacaaaaauuagcugggcaugguagugcgugccuguaaucccagcuacuugggaggcugaggcaggagaauugcuugaaccugggaaguggagguugcagugaaccaagaucacagugccacugcacuccagccugagcaacagagugagacucugucucacaaaaaauaaaaagugugcaguacuuuuuuuuuguuuguuuguuugagauaaaaucuugcucugucacccaggcuggagugcaguggugggaucucggcccacuacaaccuuugccucucagguucaagcaguucugccuuagccucucaaguaguuaggauuacaggcgccuaccaccacaccuggcuaauuuuuguauuuuuaguaggaaugagguuucaccauguuggccaggcuggucucgauauccugaccccaagugaucugcccaccucggccucccaaagugcugggauuauaggcgugagccacugagccuggccuacaguaccuuuuaaucaaaacaaagcauuccagauggaaacagaaagccugcuguuuguugcuucuguuuaacagcuggcacagauauucuggugaugccucugugcugcuguagcuacccugaacaugugauuuuuuucacuguauuaaugguaugccccuuuuuuuuuuuuaaccauuaaguaguuagguguaaguguaagaaaaugguugcuuauugguaacauguaaauuuggucaggaauaauggugaugucaaacaaccacagauugugucuacacggguggcugagauagugaucccuuuacuuucugaugguucaaugaaacaaauucauguugagacuugggugucauugccaagauaacucauuuuguauauacagauauuccaaaaucuaaaacacuuugaaauuugaaacgcuucuggucccaagcauuuuggauaagggauacucaaucuguacuaugagauuuguuuuuuuacuacucugaaaacuuuuaaaacagguaguguaagucuacaguuuuuucauguugaguauacguguguguuauuagguggguuugaaugaucuuuuugguaucuuccugucaacaaugaaaacaugaaaacacacuucuccuugcauuuuagauaguauauucuagaaauuaacuuuaaaaauuaccaaaccuauaaaaugguaaccugaaugaccaguauuuucuuuuuauuugcugggaaauuuguuuauuucuuauuugacugauucuuuuuuuuuuuuuuuuuuuuuugagauggagucuuacucuguugcccaggcucgaguucaguggcgcgaucucagcucacugcaagcuccaccucccagguucacaccauuuuccugccucagccucccgaguagcugggacuacagguguccaccaucaugccaggcuaauuuuuuguacuuuuaguagagacgggguuucacuguguuagccaggauggucucgaucuccugaccucgugaucugccugccucggccucccaaagugcuaggauuacaggugugagcuaccgcgcccggccuuuuuuuaaaauuauacuuuaaguucuggguuacaugugcagaauguguggguuuguuacauagguauacacgugccauggugguuuguggcacccaugaaaccgucagcuacauuagguauuucuccuaauguuaucccuccucuagccccccacccucagcaggcccuggugcgugauguuccccuccuuguguccauguguuucucauuguucaacucucacuugugagugagaacaugcaguguuugguuuucuguccuugugauaguuugcugagaaugaugguuucccacuucauccaugucccugcaaaggacaugaacucaccauuuuuuauggcugcauaguauuucaugguguauaugugccacauuuccuuaauccagucuaucauugauggacauuuggguugguuccaagucuuugcuauugugaacagugcugcaguaaacauacgugugcgugugucuuuauaguagcgugauuuauaauccuuuggguauauacccaguaaugggaucacugggucaaaugguauuucuaguucuagauccuugaggaaucgccacacugucuuccacaaugguugaacuaauuuacacucccaccaacaguguaaaaguguuccucuuucuccacaaccucuccagcaucuguuguuuccugacuuuuuaaugaucgccauucuaaauggugugagacaguaucuuauugugguuuugauuugcauuucucuaaugaccagugaugaugagcauuuuuucaugugucuguugggugcauaaaugucuucuuuugagaagugucuguucauauccuuugcccauuuuuugaugggguuguuuguuuuuuucuuguaaauuuguuuaaguucuuuguagauucuggauauuaacccuuugucagauggauagauugcagaaauuuucucccauucuguaggcugccuguucacucugaugauaguuucuuuugcuguacagaagcucuuuaguuuaauuagaucccauuugucaauuuugucuuuuguugccauugcuuuugguguuuuagacaugaagucuuugcccaugccuauguccugaaugguauugcccagguuuucuugcaggauuuuuaugguccuaggucuuacguuuaagucuuucauccgucuugaguugauuuuuguauaaaguauaaggaagggguccaguuucaguuuucugcauauggcuagccaguuuucccaaaaccauuuauuuaaaaaggaaucuuuucccuauugcuuaugugugucggauuugucaaagagcagauggugguagaugugugguguuacuucugagggcucuguucuguuccauuguucuauauaucguuuugguaccaguaccauucuguuuugguuacuguagccuuguaguauaguuugaagucugguagcaugaugccuccagcuuuguucuucuugcccaggauugucauggcuaugcgggcucuuuuuugguuccauaugaagauuaaauuaguuuuuuccauuucugugaaaaaagugaaugguagcuugauggagauagcauugaaucuauaaaugacuuugggcaguaaggccauuuuuaugauauugcuucuuccuauccauaagcauggaauguuuuuccauuuguucguguccugucuuauuuccuuaaagcagcgguuuguaguucuccuugaagggguucuucacaucccuuguaaguuguauuccuagguauuuuauucucuuaauaguaauugugaauuuaaguucacucaugauuugucucucuguuugucucuuauugguguauaggaaugcuugugauuuuugcacauugauuuuguauccugagacuuugcugaaguugcuuaucagcuuaaggagauuuugcgcugagacaaugggguguucuaaauacacaaucaugccaucugcaaacagggacaauuugacuuccucucuuccuauuugaauacacuuuauugcuuucucuugccugauugcccuggccagaauuuccaauacuauguugaauaggaguggugagagaggacauccuuaucuugugccaguuuucaaagagaaugcuucccguuuuuuucccuauucaguaugauauuggcuguggguuugucauaaauagcucuuauuacuuugagaugcauuccaucaauuccuaguuuacugagaguuuuuagcaugaaaggcuguugaauuuugucaaaggccuuuuuugcaucuauugagauaauugugguuuuugcuguugguucuguuuauuugauggauuacauuuauugauuguguauguugaaccagccuugcaucccagggaugaagccgacuugaucgugguggauaagcuuuuuaugugcugcuggauuugguuugccgguauuuuauugaguauuuuugcauugauuuucaucagggauauuggucuaaaauucucuuuuuuuguugugucucugccaggcuuugguaucaggaugauguuggccucauaaaauaaguuagagaggauucccucuuuuucuauugauuggaauaguuucagaaggaaugguaccagcuccucuuuguaccucugguagaauuuggcugugaauccacugguccuggacuuuuuuuaguugguaggcuauuaauuauugccucaauuucagaaccucuuauugauauauucagagauucaacugcuuccugguuuagucuugggaugguguaugugucuaggaauuuauccauuucuucuggauuuucuaguuuauuugcauagagauguuuauaguauucucugaugguaguuuguauuucuguaggauuaguggugauauccccuuuauaauuuuauugcauguauuuuauucuucucucuuuucaucuuuauuagucuugcuagcuguguaucuauuuuguugaucuuuucaaaaaacuaguuccuggauuuauugauuuguuugaaggguuuuucauguuccugucuccuucaauucugcucugaucuuaguuauuucuuguauucugcuagcuuuugaauuuguuugcucuugcuucucuaguucuuucaauugugauguuaggguguugauuuuagaucucuccugcuuucucuugugggcguuuagugcuaaaaauuuccuucuacacauugcuuuaaaugugucccagagauucugguacguugugucuuuguucucauugguuucagauaacauuuuuauuucugacuuacuuucguuauuuacccuguagucauucaggagcgcguuguucaguuuccauuuaguugagcaguuuugagugaguuucuuaauccugaguucuaauuugauugcacugugcucugagagacaguuuguugugauuucuuuucuuuuacauuuccugaggaguguuuuacuuccaauuauauggucaguuuuagaauaagugcgauguggugcugagaagaaucuauauucuguugauuugggguggagaguucuguagaugucuauuaggucugcuuuguccagagcugaguucaaguccuggauaaccuuguuaaccuucugucucacugaucugucuaauauugacaguuagguguuaaagucucccauuauugugugggagucuaagucucuuuguagaucucuaaggacuugcuuuaugauucuggguucuccuguauugggugcauacauauuuaggucauuuagcucuucuuguugcauugauccuuuuaccauuauguaauguccuuccuugucuguuuugaucuucuuuggucuaacgucuguuuuaucagagaccaggauugcaaccccugcuuuuuuuuuuuugcuuuccauuugcuugguagaucuuccucuaucccuuuauguugagccuaugugugucuuugcacgugagaugggucuccugaauacagcacacugaugggucuugacucuauccaauuugccagucugugucuuuuaauugggucauuuagcccauuuacauuuaagguuuguauuguuaugugugaauuugaugcugucauuaugaugcuagcugguuauuuugcccauuuauugaugcaguuucuucauagcgucgauggucuuuacaguuuggcuuguuuuugcaguggcugguaccgguuguuacuuuccauguuuagugcuuccuucaggagcucuugcaagucaggccugguggugacaaagucucucagcauuugcuugucuggaaaggauuuuauuucucuuucacuuaugaagcuuaguuuggcuggauaugaaauucuggguugaaaauucuuuucuuuaagaauacugaauauuggcccccauucucuucugguuuguaggguuucugcagagagaucugcugauagucugaugggcuucccuuuguggguaacccgaccuuucucucuggcugcccuuaacauuuuuuccuucauuucaaccuuggugaaucugacauuuuauaugucuugggguugcucuucucgaggaguaucuuugugguguucucuguauuuccugaauuugaauguuggccucccuugcuagguuggggaaguucuccuggauaauauccugaagaguguuuucuaacuugguuccauucuccccgucacucucaggcacaccaaucaaauguauauuuggucuuuucacauagucccauauuucuuggaggcuuuguuaguuucuuuucauucuuuuuuucucuaaucuugucuuuucacuuuauuucauugauuugaucuucagucauugacauccuuucuuccacuugaucgaaucggcuauuggagcuuauguaugcuucaugaaguuuucauacugugguuuucagcuccaucaggucauuuaagcucuucucuacacugguuauucuaguuagccauucguuuaaccuuuuuucaagguuuuuagcuuccuggugauggguuagaacaugcuccuuuaauuuggagaaguuuguuauuaccaaccuucugaagccuacuucugucaguucaucaaacucauucuccauccaguuuuguuccauugcuggccaggaguuguguuccuuuggaggugaagagguguucugguuuuugguauuuucagccuuucugcucugguuucuccccaucuuugugguuuuaucuaccuuuggcuuugauguuugugaccuauagaugggguuuugguguggauguccuuuuuguugauguugaugcucuuccuuucuguguguuaguuuuccuucuaacaaacaggccccuuagcugcaggucuguuggaguuugcuggagguccacuccagaccccauuugccuggguaucaccagcggaggcugcagaacagcaaauauugcugccuguaccuucuucuggaagcuucgucccagaggggcacccgccuguaugagguguccagucaggcuacacgggagucagggacccacuugaggagguagucugucuguucucauagcucaaacacugugcugggagaaccacugcucucuucagagcugucaggcagggauguuuaagucuggagaagcugucugcugccuuuuguucagguacguccugccccuagagguggaaucuagagaggcaguaggccuugcugagcuccaguggccaccgcccaguucaagcuucccugccucuuuguuuauacugugagcagagaaccuccuacucaagccucagcaaugguggacgccccucuccccgccaagguccagcgacccaggucaaucucagacuccugugcuggcagcaagcaaggcuccaugggcaugcgacccucugagccaggcacagaagggaaucuccuggucugccaguugcgaagacugugggaaaagugcauuauuugggcaggaguguaccauuccuccagggacagucagucacggcuucccuuggcuaggaaggggaaaaccccugaccccuugcgcuucccgggugaaacgacacccugcccugcuuuggcucgcccuccgugggcugcacccacuguccaaccagucccaaugaguugaaccagucaccucaguuggaaaugcagacaucacccaucuucugugucagucucgcugggagcuguagaccagagcuguuccuauucggccaucuuggaaacgacucuucgaucacuauuuucaaugacugaauuugucucaaggaagcugaaguaauaggauuuuuaucagacuaucaauucuuauaacuaguuugugacuuuaauaauaaguguguguguguguguauauauauauauauauauauuuuuuuuuuuuuuuugagauggaaucuggcucugucacucaggcuggggugcaguggugugaucucagcucacugcaaccucugccuacuggguucaagaaauucuccugccucagccuccugaguagcugagacuacaggcaugcaccaccaugccuggcuaauuuuuuguguuuuuaguaaagaugacguuucaccaugcuggcccagcuggucuagaacuccugaccuugugauccacccaccucagccucucaaagugcugggauuacaggcaugagccaccgugccuggcagguuguuuauauuucuuuggggucaguggugauaucuaccuuaucauuucugauuguguuuacuucauucuucucacuuuucuucauuagucuagcuagaggucuaucuauuuuauuaauauuuucaaaaaaucagcuccuggauucauugaauuuuuugaaggguuguuuugugucucugucuucuucaauucaccucugaucuugguuauuucuugucuucugccagcauuggaguuuguucgcucuuggcucucuaguuauuuuaguugagaugucagauuguuaacuugagaucuuucuagcuuuuugaugugggcauuuagugcuauaaauuucccucuuaacacugcuuuagcugcaucccagagauucugguacauugucucuuuguucucauuaguuucagauaaauucuugauuucucccauaauuuuguuguuuacccaagagucauucaggagcagguuguucaauuucuauguaguugugugguuuugagugaauuucuuaaucuugaguucuaauuugauugugcuguggucugagagacuguuuguuaugauuucauuucuuuugcauuugccaaggaaaguuuuacuucugauuaugugaucaauuucagaauaagugucauguggugaugagaagaauguauauucuguugaauuucggugggaaguucuguagauaucuaucagguccacuugauacagagcugaguucagguccagaauaucuuuguuaaauuucugucuugaugaucugucuaauauuguuagugggcuguuaaagccucucacuauuauugugugggagucucagucucuuugcaguucucuaagcacuuguuuuuugaauuuggugcuccuauguugguuguauauauauuuaugauagcacuucuuguugaauugaaccuuuuaccauuauguaaugcccuugucuuuuuuuaaucuuuguugguuuaaagucucuuuugucagaaucuaggguugcaacuccugcuuuuuucuguuuuccauuugcuugguaaaauuuccuccaucccuuuauuuagagccugugugugucuuugcaugugagaugggucucuugaggacagcauacugaugggucuuggcucuucauccagcuugccauucuuggucuuuuaauuggggcauuuaacccauuuacauuuaauguuaguauuguuauguaugaauuugauccugucaugacgaugcuagcugguuauuuugcaggcuugguuuaugugguugcuucauagugucacuggucaguguacuucaguguauuuuuguaguggcugguaacaauuuuuucuuuccauauuuaguucuuucuucaggagcucugguaaggcaggacugguaguaacaaauucccucagcauuugcuuuucugaaaaggaucuuauuucuccuuugcuuauaaagcuuaguuuguccagauaugaaauucucaguuggaaauucuuuucuuuaagaauguugaauauuggccaccagucucuucuggcuugcaggguuuuuacugagagguuugcuauuagucugaaggguuucccuuuguaggugaccuggccuuuaucucuggcugcccuuaacagcuuuucuuucauuuggaccuuggggaaucugauggcuuuggggaaucugaugugaagacacaucugauuauaugucuugggguugaucuuuuuguggaguguauuacugggguucucugcauuuccugaauuugaauguuggccuguccugauaaucugggggaguucuccuauaugauauccugaaguauguuuuccaacuugguuccauucuccucgucucuuucagguaccucagucagucauagguuuggucucuuuacauaaccccauaucucuuggagguuuuauucauuccuuuuuguuccuuuuucucuauuauugucugccugucuuauuuuggacagucuucaagcucugagguucuuuccucugcuuggucuauucugcuauugauacuugugauugcauugugaaguucucauguuguguuuuucagcuccauuagaucuguuauguuccucucuaaacugacuguuguggcugucagcuccuguauuguuuuauugugauucuuagcuucuuugcauuggguuaaaacaugcuccuuuaucucagugaaguuuauuauuacccaccuucugaagacuauuucugucaauucagccaucucagccucagaccaguucugugcuuuugcuggagagguguugcggucauuuggaggagaagaggcacucuggcuuuuugaguuuucagcauuuuuguguugauucuuucucaucuuuuuggccuuaaucuaccuuuguucuuugagguugcugaccuuugacugagguuuuuguggggucuuuuuguugauauuguuguuguuuucuguugauuuguuuuucuuuuaguaaucuggccacuuuacuguauauagggcugcugugguuugccagggguccucuccagaccccaguugccuugguuucucccauaccuggagguaucagcagagaaggccaugaagcagcaaagauggcaggcagguccuuccucuggaagcucugucccaggggguagguacuuaccuguuguuggccugcaugcaccuauaagagguggcuggagaccccugcugggagaucuuaacaagucacaaggaaugggaucagggacuugccuaaagaagcagucuggcugcuuuuugguagagcacaugugcuguguugaaggggacccuaccuuuucuggaccgccuguauucuccaaagccagcaggugggagcagcugaguugacugaaccccagacauggcagucaccccuuguccccggagcucggucccagugagauaccaaagcgcuguccuuagaacccuuagccaguguauuucuacacaacaugaacacuugaaauguuacugggcaacaguaguggguguucauaguaaaauuuguauugucaagauaauauuaauuuguuuuauuauguuugaagguguacuguuuagcgaggcagggaaacauuuuagaagcaguucgacuuagauuuuuccauuaaacacagcucuuucaaguauuugaaaaacucuuauauuacugaaaaauuaaguguuuaugauagcuaggauuucauuauuuuauugaaaaauaauuuaguucaacugccauccacauuugaauuacuuaauuggcaugaagacugggaugugaaggagcugauuuucaaaaauugguaucaauaacuaugaacuggguuacugaaauacauguggaaaauaauaaauauuaaaauaaauggaaggaaaagugugauaaagaguauuauauuuguaaaaauuaauuaaaaaauaaaauguaggaggaaauaauaggaauuaauugguaaaaaauagaguauauacuauucugauagauauggaaugcaauuaaaauagguaacguucacaugagcaagucauaaaucuuuuauuuucaugcuucaugacuuguuaaggucuuccacagagauuauugagucacacuuuaagaugguaaagccaaaaccucuugggaaaaagucucuuuagggaagaauagggucuuuccuggcaucuuaaaaaauauaauauauaauuaauuaauuauaugaauggggcagaaaacuuuuaguacauccagugaacaauuuuagugagaguagacauaaacugaaauauagucaugugcuaaugcagguaucacugcuguaaucacuaugaaauauuuuauauauguuauuucccggguuggacuccagaaauuuaguguauguuucuguuugacuguuggguacacauuucugucucccucucuauaauaaguaccuguaugugacuuguagcugauuaauuccuauauaguagagaaaaacuugcaccuuugguuggugggaaguggaauuuggggugagacuagauugaauagcagagaugguagcuuuccuuguguuaaauuauaaaaggagccacacaggguuucgggagagcuguauggaaucuacugugacacuucuguagcucugagagcugugaagaauucauagcuagcagucauauagaacuugcuggcucagugccuuuuuuuggucuuuuuuuccccuguuuuuuuuuuuuguuugguuuuuuuuguuuguuuguuuuugaacagagcaucagauuagugccaaaaaaagaaaaauaaaggaagagggcuaaaacagaguuucuucccuguuagaguauuaauuccuaguagguaggagcuauauaccugcuauagcauauuguuuuuaacucacaaaguuucacuuauaacuaauuaaaaaauauauaaaugauaaccuaauaguuuauauguguauacaggcacauacucuuucucucucuguauauaauucauuuuguucuaagccaaaauacauuuuuaaauuaccaguuauuauuauuauuuuuuucuuuaagagacaggaucuugcccuguugcccggguuggagugugguggcacggucauaguucacugcagacucgaacuccugggcucaagcaaugcuuccaccucagccuccccuaguaacuaggaguacaggcaugugccaccaugcccucugcuuauuaccaguuaaauuuuaaguaacaauauuuucuaugauuaucacguauuuuaaaauaaaaugggugaauauguagauuaccuuaacucagaauugaauugacuaugcuacaaagaaugauuuuaccaaguucuaaguauguguuaagugaauuugaugaugguaugcauucauucuucacauauuuuuugaauacuuucaaaguggcagccacuuuuuagaaguugguauauauccugguaaaacaaaguuccugucugcagagagauuacauucuaaugagacauuucagugagaaugaucuagaaguauaaacacauuggggcccggacaagcuuguguuuugggaauagccagaaagccagugaaacuagaauugagugaaugaaugaacuagggggagaauggaaagaagugagaucagagagcaaggcagaggccagaucauuuagggccuuagagaccaggaaaggaauuuggauguuacuccagaugucaugagaagucauuauaggguuuugagcaagagagcugccggaucugaguuauuuacauguacauacacacacauguauaucuauguguauauacacauauauauauuuuuaaaucacucuggcuaagauguggagaagcaucaguacaggggcaaaaauggaaacagggacaccagauguugcaguaauccagaugagaagugaugauagcuuggacuggggugcugaaauggagguagugagacaagguaagauugagaauauuuuuuuaaagguagaucugauaguaucagcugaaauagggugugagagaagucauggaugauugagucccuggaauuuuuuccucaacagcuuagugaauaguggcuugcugauuugcugagauguaugaguguuggugucaauuuuauuuuaaaccuuuaccucuuaaauaagaaauaauuauauuaacauuaaguauguaaaagguuuuugaaaagucaucaugaaaacuucuuuuucaacaggcggaguacguccagcuuguuacugaacuucgaaugacaagagccauucagccucagaucaaugcuuuuuuacagggcuuucauauguucauuccacccucccucauacagcuuuuugaugaauaugaauugguaaggaaaaacaucaguucuuauguuguaacacaacaacaaaaaacucuaguugauguaauucagaaauaauuguggaguauuaugaugaaugaaauaauguauaaaugagacaaaaugguuuaauguccauuuuuagagauuugauauaaaauuuauggaugagcaucucuuaagcuuaauaaccagauaagcagcuccuuaaugugaagugaggugagguggugacaaacuaaaauggaauauauuccuguuucuucuauaugggagauguugaaggccagucuuccuauauacacaguauucuacauuauuucugaauuuuuuauuugaccacaugauguaaagggcgcugauacuaacuucuuaaacuucuaaaaagaauuaagaagguuuuucuuauuguauaguauugucuucuccaguuucuuauauugccauauauauaauuuuauaauucuuuauuucaaaccuauggaguccaucgucuuugccauccucuagucccuaaugaauguuugguuuugcuacuuuaauuugccuuuauuguacugugauccaacaggauuucuaauuuuauaugauuuaugucugcauuuuucucuauuuucuuuuucucuuuaguuuugguaauuuggagaauuauuuuuaaacucuuugaguugucuaaaucuuaauaaagcacaguauuuuaaauagcauauagcugcuuucuuaccuaaaaguauauaauuuggaauaguaaguuccagaucaguggaaauguuuuauuuaguuuuuauucugucucagaaaauuaguuuuaccccaugccuuucauuuuaguauauggauacagauacggauauauaccuuuaauuuuacauauguaucaguauuuuuaauuuaucauucauaguauaucuuaguauaauagugaauaaaauuugcuaauuaauuuugaaguccauugugauuuaguuucauuaaauguaaguuuugagguuuuuuugauuguuuuuaagcuguacaguuaauggcuucaguuagcauagauuugucuaguuuuuauguaacaauagaagugauuuucagcauuuaaaaauggaggacuauuugagcuauuauauuauuagaccugacugcaauauggcuuuuccuguacugugcuuggauuaaauuagccuuuugaaauucaaaacagagcauuaguuauuugcuggaccuauauguauguaaaaaacaaauagcaacaacaaaaauaauugaugaaaacuuugccuuguaauuuacugauaucaauaaguuuauaaaacuuuggguuaugauauacaugcagaaaaggacacacaucauaaauguauagcuugauaaguuuuaacaaacugaacauacccaugaaacuaacacccagaugaagaaacagaaauucuagcaccccauaugucacucugucaucucccuccagucauucucccaccuuaaggguaaccauucuccugacuucuaaaaucauagacgagauucgccuauuuuagaauuauguaaauagaauguaucuggcuuucuuagcucaaguuuuuguuugugggaaucauacauauuguugcaugcaguugguaauuuguucauuuuaauugcuguauagcauuucaguuuccuuuagucuuuucuacucuugaugaacauuuaguggguacuuuucaguuucaggcucuuucaaguacugcugcuauaaacaugccuuuaggaaaacauaaguuugcauucuguagguuauaugccuuggaguggaauugcugggacauaggcugugcauguaccccauuucaguagauaggagcagauaguuucucaagugaugcaucaguuuacacucccauuaggaggugugagaguucuggguguucugcauucucacuagcauuugauaauuuuccaucuuuuucauuuccauucugguaauucaguaguggucuuuccuugagauuuuaauuuguauuuaccugauagcuaaugaaguuacacaccuuuuaugauuauagccauuuguguacuguuuucaaagugucuauuuaaguaauuugcccacuuuucuauuguguuuuuuuuucuuuuuacugauuuguaggacucuuuaugaauucuuuuauaagagucuuuuaucagauauauguauuaugaauauuuucuacucaggucuuuucagugaauaaaaauuuugggguuuaacauaguucaguuuaucaguuuuuuuuguuuuguuuuguuuuuuuugauggaagaagcuuuuuguguccuguuuuagaaacuguuucuuacuccaaggcugugaagauauuuuucuguguuuucuuuuaaaagcuuuauuccuuuaucuuucacauuuaggucuguuacugguaaguuuuuaauuguggcucuuacauuaaaauuuagaucagguuccuaguuugucuuggacucugacuuuacuaaguugagcugauucacauuugggaagagcaacauuguaggcauggucuugauuuauacagugauaauaauaauuauuaagcauuuaguauuugccagguauuuuauauguauuaacuuuaaaaacgcucacaaaaaaucucuugaggugaguacuauuguccccauuuuacagaugagaaaacuaggccaaagaagauauggaacuuguucauggucauagagcauguguuagugauaggcuaugaacucauguucccugaccccagauaccaucacuguugccagucugcugcuugguggcaugaguaaucagagggacuuggcuuuagaacuuuuugugugacuuugugucuuucauaggggagggcuaugcugcacugagaaaggaaacuuuuaaaaaauuugguacaaacgucuaaacuagaugugcaucugaguuaaaggauucagguuaaauucuagaguuuuagugaggagaagguaucgaguagcuccaguguacugaacuggagguguagucauccauuguagacagaaggcaucaagagaugacuguggacuguucuuccauacugugcugcuugugaauuuauccaugauagaaccagaauauaaaaacacugaaucgugugaugcuagguaagcugaugccuaugaauacuuucaugauucaguuucuaacuauuaguaugaguuauauaccuuacacauaguuccaacagaugaauucaauuauuuuguuguauuaaaaaaauugauuggggcuuaaaauauuuuucuuaauauguacauuuuauucuggaauucucauuucaucuguuuguuuuuggucaguuuaguaaccagaugggauaauaaagauccuuucuuuuucuucuucuugaaaaaaaaucguaacaauuaaugugauauucaugaagugcuucaaauuucuugagagaauauaauguuagucauuuuuauucauaauuaugaauaaugaaagcauacuuaauauuauugaaagcuuaucuucagccuagaagggaaaaggauuaaacucaugaauuguaagacaugcguaaagccugucccacucccuuuuagcaaaccuauaucagaguccugucagggaacagaauuucuccagaugguucaaauaucgaaacuuuaacaaagggacuaugacagagguaugggcaguguuaagaauaaacaaugucuagugagacauccacagacuggcaacagggaaagccuuuaucaucccuaggacugaagagacagguagaggaauuacugugaagagccccgugggagccugaaccaccaaggaggggccaccugaugguagccauacuugaggagccauagcuacugcaaagagaugcugaagcagugggggagcagagaguacccucaccuccagacuaacugccuauguuucccaggcuccaaacccaaaccaaagccagcuggcaagacagccagcaggcaaagcagccagucugcagugcaaaggaagcuagagaauguauuuggggguggucaauguagacuagacugucuucaucuaggaaaaggauucuauaacacugugacuaggacuaaaacacacccuauacuagcaguucuaaaacuuuuuggucuuaggaccccuuaaaacaaaagaguuuuuguuuauguggguuaugucaauggauauuuacuugaaauuaaaacagaaauguaaaauauuuuauucacauaaaauaauccauuauuauauuaacauagagaacauuugaaaaacuaaaauugcauuuuccagaacaaaacagaaacagugggaagacugguacuguuuaacaguuuugcaaauuucuuuaaugucuagcuuaguagaagacaaaugggcccuuacaacugcuuuuguguauaaucuguuuugguauguuguuugguugaaauauaugaagaaaacucaaccucauacagauaaguuggaaaagggagaaccucauggacccacugaguagaucucggaaacccucaagaguucucagauguugccuuauaucaaucuuauuuaagguacaaggucagguauauguuaugaguaguuuacuauaggagacaugauuuugaaucacagggcaucuacaucccuguaauaagaaauccuggccgggcacggugguucacgccuguaaucccagcacuuuuggaggcugagguggguggaucacaaggucaggagauugagaccauccuggcuaacacggugaaaccucaucucuacuaaaacuacaaaaaaauuagccgggcaugguggcaggcgccuguaguccuagcuacuugggaggcugaggugggagaauggcgugaacccgggagguggagcuugcagugagccgcgccacugcacuccagccugggugacagagccagacucggucucaaaaaaaaaggaaauccugauauucugaaucaucaguguaaaguguaggccaaucauugccuccccugacuauguaagcaucucuaacugugauauauggacugauucagagaaguggacaagcucuuuucauguccucuuuucccuuggaaaacaaaaagguaaauacuuugccauucuuaauuucauuuuuacuuauacgauugagauuuugugucuuugaugaucuuccuggauaaaauaaaccuaucaagucauuaggaaaauugcauuuuuuuugacuuuggagaaaauugacuuuacaggauccaaauuauuccagaauugaauuccuaaaaggccuaaaucuuuuuuaaaaaucguaacuauuuuuauauuaccuccuuuuuccucaugauaaugauuucuugaugacuuuccccuuguuuagucaaguauuuauucgggucuuuguugucacuuucauguugagaauacugucuccuuacagaaguuaacaaaauugcaaagaauuguaaaaauauaaaguaaaccaaagauaauguucauaaaacuuuugcacauauaaacuguuguugcauauguucacacauaaacauauaaacuauaaucucuuauguuuuaaugaaauuguaucaauguggaaacaucuccacaucuuauaauauuugagauuaucagcgucaaggauucucucucauguaaugcuuguuguugaugacaugcaggaacugucacaaaaauauaucaguuuuacaugggauuaguuucuaauuauggcaaauuuaccacuuaaauauaauaacuuuuuucccuaaagaaaauuauugaaauauuuuucuucuucccccaaggagcuacugcuuucuggcaugccagaaauugaugugagugauuggauaaaaaauacagaauacacaaguggcuaugaaagagaagauccaguuauucagguaaaauuucucuagagcuuagaaugaaguuaaguuuugccguuuaauuuuguaagcuuuucagcacuauuggaugaaaacuuacauuaauuaacaaaguaaaguguuuacccaaauuauucuugugggaauagugcauaugaaagcuuugcaugaaaucauuuuugguaaacgaguuuuguagaauaaaaugugcuuuaugaauauugcauauuucucugguauugagaagucuacaauugcucugaaauaugagcuaaguuuuuuguucuuguuguuagugguucugggaaguuguagaagacauuacucaagaggagagaguucuucucuuacaguuuguuacgggcagguaagcaguauuuuuaugauaauauggaaauaauuuaauguauucugcuuuuaauggcuuagagauaacuaaaauaaggaauuauuacucugaauugucaguaacuuaccacccuuuccacuguuuuagguauuaaagaaagauuuauuuugguauuaaagauaagacauuuauaguagugagcaaucauguuuacuuaauauauuaaaaagcaucuccaguuaggauuaucaguauauuguacuuuauaauuuggaaaucuuuuugcucugcagguaggucaaugauaguagccaaauuuuuaauauuuguauauuauuuuaauauuuuaauauuuguauauugcugguuugguuuaauaguaaggcaauucaguuuauccugguuaacucuguauuacccauacacaacaguuuuucuguaauucaaaguaaacuuuaaagugucaagauucauggccuaaaaaauaauuugugguacuacacuucucugaaaaguucacuuuuggaaccaguuaaauauaauagauauuagaaaacuagaugauuuaaccaucuuuuagcuuguauuucugaaagauguaaaaaaagucugauuuucauuuuggauaacagaauuuuaucuucuauuuaugaaaauguaguuugguuuuuuucauuauaaauguacauauuucuccuaggaaaguuagaaaauagaaaauuagaauaagaaaaaccauagcccaucagccauaaccacuauaaacaauuuaauauauuuucuucuauguuuuuucugcauauuuaaaaagcauaauagugaauauauaucuacauaaaauacauauauauaauuuuuuuuuauuauuauacuuuaaguuuuaggguacaugugcacauugugcagguuaguuacauauguauacaugugccaugcuggugcgcugcacccacuaacucgucaucuagcauuagguauaucucccaaugcuaucccuccccccuccccccaccccacaacaguccccagagugugauauuccccuuccuguguccaugugaucucauuguucaauucccaccuaugaaugagaauacgcgguguuugguuuuuuguucuugcgauaguuuacugagaacgaugauuuccaauuucauccaugucccuacgaagaacaugaacucaucauuuuuuauggcugcauaguauuccaugguguuuaugugccacauuuucuuaauccagucuaucauuguuggacauuuggguugguuccaagucuuugcuauugugaauaaugccgcaauaaacauaugugugcaugugucuuuauagcagcauaauuuauaguccuuuggguauauacccaguaaugggauggcugggucaaaugguauuuccaguucuagaucccugaggaaucgccacacugacuuccacaaugguugaacuaguuuacagucccaccaacaguguaaaaguguuccuguuucuccacauccucuccagcaccuguuguuuccugacuuuuuaaugaucgccauucuaacuggugugagacgguaucucauugugguuuugauuugcauuucucugauggccagugaugaugagcauuguuucauguguuuuuuggcugcauaaaugucuucuuuugagaagugucuguuccuguccuuugcccacuuuuugaugggguuguuuguuuuuuucuuguaaauuuguuugaguucauucuagauucuggauauuagcccuuugucagaugaguagguugugaaaauuuucucccauuuuguagguugccuguucacucugaugguaguuucuuuugcugugcagaagcucuuuaguuuaauuagaucccauuugucaauuuugucuuuuguugccauugcuuuugguguuuuagacaugaaguccuugcccaugccuauguccugaaugguaaugccuagguuuucuucuaguguuuuuaugguuuuaggucuaacguuuaagucuuuaauccaucuugaauugauuuuuguauaagguguaaggaagagauccaguuucagcuuucuacauauggcuagccaguuuucccagcaccauuuauuaaauagggaauccuuuccccauugcuuguuuuucucagguuugucaaagaucagauaguuguagauacguggcguuauuucugagggcucuguucuguuccauugaucuauauuucuguuuuggucccaguaccaugcuguuuugguuacuguagccuugucguauaguuugaagucagguagugugaugccuccagcuuuguucuuuuggcuuaagauugacuuggugaugugggcucuuuuuugguuccauaugaacuuuaaaguaguuuuuuccaguucugugaagaaagucauugguagcuugauggggauggcauugaaucuguaaauuaccuugggcaguauggccauuuucacgauaaugauucuuccuacccaugagcauggaauguucuuccauuuguuuguauccucuuuuauuuccuugagcagugguuuguaguucuccuugaagagguccuucacaucccuuguaaguuggauuccuagguauuuuauucucuuugaagcaauugugaaugggaguucacucaugauuuggcucucuguuugucuguuguugguguauaagaaugcuugugauuuuugcacauugauuuuguauccugagacuuugcugaaguugcuuaucagcuuaaggagauuuggggcugauacaaugggguuuucuaaauauacaaucaugucaucugcaaacagggacaauuugacuuccucuuuuccuaauugaauacccuuuauauccuucuccugccuaauugcccuggccagaacuuccaacacuauguugaauaggaguggugagagagggcgucccugucuugugccaguuuucaaagggaaugcuuccaguuuuugcccauucaguaugauauuggcuguggguuugucauagauaacucuuauuauuuugagauacaucccaucaauaccuaauuuauugggaguuuuuagcaugaagguuguugaauuuugucaaaggccuuuucugcaucuauugagauaaucaugugguuuuugucuuugguucuguuuaugugcuggauuacauuuauugauuugcguauauugaaccagccuugcaucccagggaugaagcccacuugaucaugguggauaagcuuuuugaugugcugcuggauucguuuugccaguauuuuauugaggauuuuugcaucaauguucaucaaggauauuggucuaaaauucucuuuuuuuguugugucucugccuggcuuugguaucagaaugaugcuggccucauaaaaugaguuagggaggauucccucuuuuucuauugauuggaauaguuucagaaggaaugguaccaguuccuccuuguaccucugguagaauuuggcugugaauccaucugguccuggacucuuuuugguugguaagcuauugauuauugccacaauuucagauccuguuauuggucuauucagagauucaacuucuuccuaguuuagucuugggagaguguaugugucgaggaauuuauccauuucuucuagauuuucuaguuuauuugcauagagguguuuguaguauucucugaugguaguuuguauuucuguagcauuaauggugauauccccuuuaucauuuuuuagugcaucuauuugauucuucucucuuuuuuagucuugcuagcggucuaucaauuuuguugauccuuucaaaaaaccaccuccuggauucauuaauuuuuugaaggguuuuuugugucucuauuuccuucaguucugcucugauuuuaguuauuucuugccuucugcuagcuuuugaauguguuugcucuugcuuuucuaguucuuuuaauugugauguuagggugucaauuuuggaucuuuccugcuuucucuugugggcauuuagugcuauaaauuucccucuacacacugcuuugaaugcaucccagagauucugguauguugugucguuguucucauugguuucaaagaacaucuuuauuucugccuucauuucauuauguacccaguagucauucaggagcagcuuguucaguuuccauguaguugagugguuuugagugaguuucuuaauccugaguucuaguuugauugcacuguggucugagagauaguuuguuauaauuucuguucuuuuacauuugcugaggagagcuuuacuuccaaguauguggucaauuuuggaauagguguaguguggugcugaaaaaaauguauauucuguugauuugggguggagaguucuguagaugucuauuagguccgcuuggugcagagcugaguucaauuccuggguauccuuguugacuuucugucucguugaucugucuaauguugacagugggguguuaaagucucccauuauuaaugugugggagucuaagucucuuuguaggucacucaggacuugcuuuaugaaucuugguguuccuguauugggugcauauauauuuaggauaguuagcucuucuuguugaauugaucccuuuaucauuauguaauggccuucuuugucucuuuugaucuuuguugguuuaaagucuguuuuaucagagacuaggauugcaaccccugccuuuuuuuguuuuccauuugcuugguagaucauccuccauccuuuuauuuugagccuaugugugucucugcacgugagauggguuuccugaauacagcacacugaugggucuugccucuuuauccaauuugccagucugugucuuuuaauuggagcauuuaguccauuuacauuuaugguuaauauuguuaugugugaauuugauccugucaguaugauguuagcugguuauuuuguucguuaguugauauaguuucuuccuagucuugauggucuuuacauuuuggcaugauuuugcaguggcugguaccaguuguuccuuuccauguuuagcgcuuccuucaggcucuuuuagggcaggccugguggugacaaaaucucucagcauuugcuugucuguaaaguauuuuauuucuccuucgcuuaugaagcuuaguuuggcuggauaugaaauucuggguugaaaauucuuuucuuuaagaauguugaauauuggcccccacucuuuucuggcuuguaggguuucugccgagagauccgcuguuagucugaugggcuucccuuugaggguaacccgaccuuucucucuggcugcccuuaacauuuuuuccuucauuucagcuuuggugaaucugacaguuaugugucuuggaguugcucuucucgaggaguaucuuuguggcauucucuguauuuccugaaucugaacguuggccugccuugcuagacuggggaaguucuccuggauaauauccugcagaguguuuuccaacuugguuccauucuccccaucacuuucagguccaccaaucagacauagauuuggucuuuucacauagucccauauuucuuggaggcuuugcucauuucuuuuuauucuuuuuucucuaaacuucccuucucgcuucauuucauucauuucaucuuccaucgcugauacccuuucuuccuguugaucacaucagcuccugaggcuucugcauucuucacguaguucucgagccuugguuuucagcuccaucagcuccuuuaagcacuucucuguauugguuauucuaguuauacauucuucuaaauuuuuuucaaaguuuucaacuucuuugccuuugguuugaauguccucccguagcucagaguaauuugaucgucugaagccuucuucucucagcucaucaaagucauucuccauccagcuuuguuccguugcuggugaggaacugcguuccuuuggaggaggagaggcacucugcuuuuuagaguuuccgguuuuucuguucuguuuuuuccccaucuuugugguuuuaucuacuuauggucuuugaugauggugauguacagauggguuuuugguguggauguccuuucuguuuguuaguuuuccuucuaacagacaggacccucagcugcaggucuguuggaauacccugccgugugaggugucagugugccccugcuggggggugccucccaguuaggcugcucgggggucagggacccacuugaggcagucugcccguucucagaucuccagcugcgugaugggagaaccacugcucuccucaaagcugugagacagggacauuuaagucugcagagguuacugcugucuuuuuguuugucugugcccugcccccagagguggagccuacagaggcaggcaggccuccuugagcuguggugggcuccacccaguucgggcuuccccgcugcuuuguuuaccuaaucaagccuggaaaauggcgggcgccccucccccagccucgcugcugccuugcaguuuggucucagacugcugugcuagcaaucagcgagacuccgugggguaggacccuccgagccaggugcaggauauaaucucguggugcgccguuuuuuaagcccaucggaaaagcgcaguauucgggugggagugacccgauuuucuaggugccgucugucaccccuuucuuugacucagaaagggaacucccugaccccuugcgcuucccaagugaggcaaugccucgcccugcuucggcucgcgcacggugcgcacacccacugaccugcgcccacugucugccacucccuaaugagaugaacccgguaccucagauggaaaugcagaaaucaccaucuuuugcguggcucacgcugggagcuguagaccggagcuguuccuauuuggccaucuuggcuccucccccaaauuuucuuuuuuuuuuuuuuuuuuuuuuuuugagagagagucucacucugucccccaggcuggagugcaguggcucgaucugcaaccuccgcccccuggguucaagugauucuccugccucagccucccaaguaguugggaguacaggugccugccaccacguccagcuaauuuuuguauuuuuuuuuuuuuaguagagaugagguuucaccaucguggccaagcuggucuugaacuccugaccucaggugauccacccgccucggccucccaaagugcuaggauuacaggugugagccaccgugccuggccuauaauuuuuaaaaacuguguuuuuuauuuuaaaaguaguguuuaaucauuguagaaaauuuggaaaauggagaaaauagaagaaaauuaaaauccuuaauguuaagugaucccacuauucagagauacauacaauuaacauuuugcuuauuuuuuuuagucuuuuuacuguauaguuagaaaaauaguuggacucacacuauaaaucuaauuuuaaagaauaaauaggcugggcaagguacuucucuugcaguuuguuacugccaaguaagcaguauuuuuaugauaauauggaaauaauuuaauauauuguuuuuguggcuuagagauaacuaaaacgaggaauuauuacucugaauugucaauaacuuaccacccuucccacuguuuuagguauuaaagauuuguuuugguauuaaagauaagacauuuauaguagugccuguaauccuagcacuuugagaggcugaggugggcagaucacuugagcucaggaguuugggaccagccugggcaacauggcgaaaccgucucuacaaaaauacaaaaauuaucugggcaugguggcgcaugccuguggucccagcuacucaggguucugaggugggaggaucacuugagccugggagguggagauugcagugagccgagauugcaccacugcacucuagcuggggugacagugugagacccugucucaaaaaauaauaauaauaauaaaaaauaauaaauaaauaagacauaacuauuaacagguuauagacuaaaaauauaaaagaaaaacuuuuuuuuguuuuuguuuuuugccucugaaugccaagaaauacucagaggcuugaauaacuuaauaaaaaggaugaaaaaauaauuauauuuuuuauguaagaaaguugauaauuugacaauucagauaggagaaaaaaaaccacuuccaaucuguauuccuaaaaauaaucacugauaacauuuuuguuauucuucuagaauuuuuaacacauauacaauuuuuacuuuuaaaacuauuguuauuuuauaacuuuuugaauuuagcaauauguuacuaaauuuauagaucuauguaauuuuuaauggcuaucuaguuuuauuuuuagggacuuccuuuaauugauucuuuauugcuaaauuuuccuauuuaugaauaaggaauauuuugugcuucuauccuugugggacagucugauuauagaggauaaauucuuaggauauuuuuguguaugagaauauauaaauuuuuauaaucuugauauauauucauuuaucuucuagaaggguauugaugucaguagagaaugagagaauguacuccuuuuaucagcacaggguauagucauuuuuacuuuuuuuuuuuuugagacggagucucgcucugucguccaggcuggagugcacuggcgccaucucggcucacuguaagcugcgccuccuggguucacgccauucuccugccucagccucccaaguagcugggacuauaggcacccgccaccaugcauggcuaauuuuuguauuuuuaguagaggcgggguuucaccuuguuagccaggguggucucgaucuccugaccuugugaucugcccgccucggccucccaaaaugcugggauuacauguaggcgugagccaccgcacccggcccauuuuuacuuucauauaauuuauuuuauauaguuuuuugugugugguaugaauuaccuaucuuuauuauuugguauuccacaaucauuuuuaaaaauucaguuuuaaguguuguuuauauauuagggguauuaacucugcaaauaguuuucuugguguaucaaaguuaaauauagagauuuccauguaauuuaaauuuauaacuugaaaguuuuaaauuacgguauugccaaauugauuaucauugcuuuccuuugugguuuuuguaaauccuucccuacuccuaagauuuuauauauauguuuauauaaauuuuuuaauguaaguuuuuauaauuucuguuuuuacauuccaauuuuuaaaccauccggaccuuauuuugauuuauguugucaaguauauuuuucuaaaugguuuauacuucaacaccaucuagugaauuacuauauuuuccccaugauuuggucaguaugagucuuuaagaugcagaaaucaguuauucaaguuuuuuaguacuaaguugucucuuagguggcugcuccuauagaguaaaacacuagaauuaguaauaugcaagccuucuccacuuuaaauaguacagucauucuuagcaaugcugaaaaagaggugugcuauuuauuauuuaguuaugaaguguggcaaauccacacuugaauggaggugaaagaugugggugaagaguagaagccaaggaagcugaggggaaacaacacggagcuagcuucacccuuggauugaagaauucaccuuucaacauugaguguaauuagagcucuauauuuugaguucaaacugagaaaguuuuaagcuuuuuaaaaucuuaaauuuuaccucgaacucccagucauuaguauagguauaguacuugucauucaaaaccaaaaguauaaauuuuuuuucuuuuuuaauuuuuggauucuguauucuguauucuguauuaguuuauauuuagauacugaaguaucuuucuacaggucuguaguauaauuuagcgcaaccuuacugaaaaaucaaacguguuccaauuguugaaccaagaauuaauacaaaaagugauuuuuaaauauuuuuauaguauugacauuaauauuuuguugcucuauaaggccaucuuaaauguuuuacuguuucauuaucccuuaagaaucagacuugaugauuucuuuuuuuuuuuuuuuuuuuugaggaagagucuugcucuguuucucaggcuggaucucacucggcucacugcaacccccgccucccagguugaagugauucuccugccuaagcccucccgagucgcugggauuacaggcgcuuaccaccaugcccagcuaauuuuguauuuuuaguaaagauggaguuucaccauguuggccaggcuggucucgaucuccugaccucaagugauccaccugccuuggcuucccaaagugcugggauuacaggcgcgaaucacuguguccggcugauuucuuuuuuuucucuuuucuuuuuuuuuugagaugaagucuugcucuauugcccaggcuggagugcagugguugaucucagcucacugcaacuuccaccuucuggguucaagcgauucuccuuccuuagccuccaauuacaggugcacacaucacuucgccuggcuaauuuuuguauuuuuaguagagacgggguuucaccauguuggccagucuggucccuacugaucucaagugauccaccagccucgaccucccaaagugcugggauuacaggcgugagccaccgcgccuggccaauuacuuuuuaaauaaaauagaaauaugccauuuuuguuuacuguaauuuuauacuguauaaucuaagugucauaauauucaaccaaagacuguuuuauuuauuuuucucauauauacuuaugccugaugaauuaugaucuuaacaugaucagaucugauuauauaaguauggggccagccauauuuauucauaguguaggaaaagaauaagguuucaggaaugguuuaucagcuuauagaauaauuuuaauuaagauguuaaaacuagaggaucuucugaauuuuuaacuuaccguucaaaauuuacuuguguggaggacauuagauugaucauauugauauugaaauacugugcuauaauuuguauaaaaaucaaugucaacauuuauuuucucaucuugccuugauaaaauaguuacauuuaauuugaaauucgacaucauaggaaauucagaacgacuugauuuuuaucccuuuuuauguuuggucacguuauuaauuuuuuaggcaaaaguuaaaucuauaaauuaacuaauguugaauuuuauuucaacuuacaaggagauauagccaggucuucuguauauauucucuugcuguuaauaggaauuguuuaugcauuagugucuuauaagcaagauucaggcauacuuuuaauguugccuugguuuauuaaaguaagcucaagaauuucaucaguaaaccaaaccagacgacuucccagauagaagagaaaauugcuguuuuuagggauucuuucauauuggauuguuaaauguuuuuuucccuguggauguauacauaucagugauuucaaauagacaauccuggugcauauuuucaaccauuuguguguguguguaaaugcauaucauaaaauguaucauuuaaacaauuuuuaaguguacacuuuuguggcauuaagugcauucacauuaaugugugacuaucaccaccauccaucuucugaauuuuuucaucuuucccaacugaaacuguacuuuaaacacuaacucccccuccuccuuucccacccgccucuaacaaccaccaauuuuaugucuacgaauuugacuacucuaagaacuucguauacauggaaucauacaauauuuguccuuuugugauugcuuuauuucacuuagcauaaggucuucuagauucauccauuuuguagcacauaucaaaauuugcuuccuuuuuaaggcuaaauaauacucccuuggcuaaauaauaauccagccaucuguugauggacacuuggguugcuucuaccauuuggcuauugugaauaaugcugcuguaugcgcagauacuucuuugaguccgugcuuucaguucuuuuggauauauacccagaaguggaauugccugaucauaugauaauucuguauuguaauucuguuaauuuuguugaggaacuugcauacuguuuuccacagaggcugcaucauuuuacauucccagcagcaauuucuccacauccuugccaauacuuguaauuuucugucuuuuguuuuuuugauuuuuugccgauagucaucuuaaugagugugaagugguuuugauuggcauuucccuaguaaauggugauguugagcaucuuuucaugugcuuauugggcauuuguuuaucuuuuuuuuggagaaaugucuuuuucaauuguuugcccauuuuuaaucgggauuuuuuuuuuuuucuaugggaauucuuuguauguucuggauaucaauuuggugucauauucaauaaaucguugccaaauccaguauuaugaaacuuuucccuuauauuuucuucuaagaguuuuauaguauuagcucuuagauuuaggucuucaauccauuuugaguuaguuuuuaaguaacuuaguguaaaguaaggguccaacuucauuuucguuguagugaauauccgguuuucccaacacacuucguugaaaagacugucuuuuccccuuugaauguuguuggcacucuaguugaaaaucauuucauuauguaugugagggguuauuucuggccucuauucuguucuacugguucauaugucucuuuucuuggcaguaucacacuguuuugauuaccacagcuuuguaauaaguuuucaaaucaggauaugugagucugccaccuuuguucuuuuuuuucuagacuguuuaggcuauuugagguucaacuuuuuuuuucagugaccuaaacuaugcuuuauguuauaaaucauauuuuuaagaaaguauuuuaaauuuuauucagauguuugcaaguauguauuuaguaaccuauacauuaaacguuccuuugucauuuuucuaauuuauccaaaaagcacuacagcaccucauuuuaaaagcaauagaauuuuuuuuuuguaucaguuuaaucaugauaugauacacgggcaaacuuuagaagaaauauuaauuuucuuuuugauguguauagaacuugagaaguuguaauuacauccucuacagccauguacccaagauuaaauuuucuacugauguguuaugcauuauauguuagccuuccuguggccucauuauguuagaugauguuugaaaaauauauuugauauucugaauaucaaaucaaagaggaacauaaagaauuuuucaguuuuuccacuauaaaaaacaaaacaaaucuuuagggccuagauauuuuucacaaacaaggaaaucauuuggauuacaugucagagcauuuauugcuugaauuagucaaucgaauauuaaucuauucaacaaacauuuaaugaaugucuacuccaggcauuuugcuagccccagggauauagauguaaauaugacuuguuugggcccucaaaucagccccacuucaauagagagccacaugaaagcaaauaauuguaaauguagcauacuaaaugcaauauugagguaugugcuguggccaguugcaagcauaguauagcuuauggaaauguggaggggugucuccauggaagcuugcuaacuaaucacaaagcaacuuacaguaaugaauuggaguuuuguagacuaaaaagugucguguugucauuguccuagaguuggauauauuccuacccuaacuuagaacuugaaauuuaucugucacaaauaucuuucuuucaugauuacaauguauuaagauauaaacucuuaguuccagggucccacaugguggguuugcuaauaucauggguggaaguggauugcaaaacuuuacaaucgcugcugugccauauacuccaaaucuuuuaccaacuucaagcacaugguauguugacuugguuuauuuaaaugcuuuacaaauuguuuugauuaauuuugaaugaucagagaucuaacuguugcugcauugggaggaaaaccucagcugugaucucucuccaggauuuuggaaucacugaugaguaauuauguaguuuuuugugccccuguuuuugguagggaaaauguuugaggaagcccuaacucccuacaauuuaauugacuauaguucaaguaucacuaaaguuacacuaccguaaguagcacugaguuacacaccaucacuucaaacuaaauugcccuauugcuuauuuauuuuaagcugaaaggaacguauuuucuuccacugcauuugcaugcugaaagaaacugcaaugcagcagauuuuuucuucuuuuuaaauaccacuuuaggguuuuucaaucugaaugcaaauuugggaggaugauuuuauguuaauuaugaguaguguuuucacugcuaggcaaaacaaucagaaauuuuauagauuuccuguuuaauggugguauauuuuucuuuuaaagcaucaacaugcucaaguuaccugaauacccaaguaaagaaauacucaaggacagacuucuuguggcacuacauuguggcagcuaugguuacacaauggcauaaugaagucuggaaaacuccucugacuacugaugcacaauucagaauggcagaaguaauuugggaaaaugucaacaaaaaagcagccuaaaugcaacccauaggcagggcugaugcuuccaauuuauaaaggaucaucagguuuucuguuucucucuuuucccuuuuauguuuucucuguuugugauacaauuagaaaauauaaaaucacaguagauuuuauuuuuuaaaaugcuaacugaaaguaauagagacuguccuuuuucauaauuaauuuuauccaagauuguauuaaggcaaaaucugauucuacauuccaccucugcuauguaacugucuuguuaaaaggguguuuucuccuaauuucugauauauuauaugaggucauccagcugguguguucuuuugcauguaaacugccauuuauauuuuagaaaacuauuguauagaauggauuuagauugucuauaaagccacaaauacguauuuugccacaguguauucuauauugcaaugauuuuuuuagcauuuuaauauuuuaauauauauuguaaaauuuagacugaugauacuaacaguugaugaaaugacauauaauuuauauaugaaagcuuacgcuauauuguaugaauuauuugcaucuuucaguggccaguuuuccauauguauauauuauggucucaauguuuuucuuacgccucauuuuaauuuauaaugaagguaaaauuaaaauguauuuuaccacguuucuuuucauuacuuuuaucugugagcucugacacaucugaaaaaguaaucugaugugcaaauuauaauuuaaauauguuaauuuuuuugcuucuuaaauuugcuuuucaucauuaaaaugucaaguucaagugauaugugccuaauaucacuuggauguugguggguuuuugaauuuuugggugguuaaucaguuuuauuuugaaaagacguacuugaauaguuacagcauauguuugaacaggaaguaggaacaugcauacacgaagaaaugcuaacggaaggauuuguuauguuuaggaucuucccuuggaaacuaaaaauagaauauuaaugacauuacuguuuguagaaugacauaugcagauuuucucauaagcagucauuguguuugccaguaauguuugagagacauguaaguugaaaguuuugcuaaauuauaaagcuccuuuaauucguugguuuugauucucuuauucucuugucuuuucuaaauguuaacaaaauauaucuuaacagauuacaugaaauuuaggaauuauuuaaaaguuaccauuagcucuaaaauuaagauucggaugcuuuauuuauaguaacugaagcuaauaauguuuuauguuuugauuuuuugaaauuuaauuguagaagucacugccuucugaguuuucaaauagauaaccaccuuuaauauuacacugcuuauaauacuaauguuuacagauauguuucuguuuauaaccauauaauacauuggcuuugucauauuaguuuuuuuugcaaguaguuauguaaaagagauagauaauaaaauauuaaauaacugag

SEQ ID NO: 192136 - RNA, 189363 nt, Homo sapiens
uugauucuaacaaaauuuauuaugcaguaauuacaaagguuaaagacucuuccaucucaaauaaaaauaacaguuauaauuacacacauaauauaguaccuuauagaaugauuccaauaaauaucacaggaaauacagugcauuuucaaguuggagagacaaauacuuucucauucacaguguuugacauaggaaagccuauuuacauaacaaucuguauaaagucaugcucuuaguaacagucuauacagagcugugccaacacaauucuuucagaaugugaaguaccgggcaaaccacuccuggcgcuggggaucuggagaagccacuggagaagcuucacucugagcaggacugaauucauaaaaagagagacauguaacccagcauuaagucauuuugcaaaaugaaggcaaaagcacauaaaacaucagcauagauuaccacaacggguuccccauguuguaagucguguuuuaaagauuugcuacccccucuauacuagaaucgguucuccacuccaugagagcauaagagugcaucagcagcucaaaugaagucaguuaaggaggagccacaucacaacaaucacaaagaacaaaaaacaacugcaaaaaugucaccuucuuugaauaaaaaauucaguaagaauugugggaaacgagagaauaaaauaaugguccucucuuucagcaccuuuucucuuuuagcugaucguacagauguguccuuaaauauaacuaaaguaacuacuaguauuuuuuacuauaugcauuuuacauuaaauuuucauuucauaauucccuaugcaaauacuccaggaaagggagaacacuaaaaauauaauuucccccguuauugauguuauauaguuuauacuuuucuuaauucuaacuaaagauucuuugggcuacuuaagaaaacaaaagaaucccuaccgucuuuggggaaaauuacaaggcacgcaacaauguguaauggaaacuccaguagucauguuccuugagcucaugcacaugcaucuuacugauaccugaacauacccaugcacaagggaaaauaagcaacacaaaauauuuagcaggagacaaauucagagguguaucugacuaauuuucauucuugcuauuuuuuuuguuaaucauuaacuaugucacuaaucacuuagccuaaaaaaaccugccuacuuuguaagacuauuacuagugacacugcuaagauuuaguaagaauaagaaaaaaaacauaaagcagcaaaaaaucaguaauaguaagaugagcauaaaacaacaguacuuucugacuuuaucuaauggcuaaauuucuaaugaaauuugcauuucauucaaaauuugcuaauacauuuaaucaacaacugcaagguaaaaaauuggaauggaaauuuuuaaaauuauuuauuuuuucuaaauuuaguuuuugcauaaguauauuuaaguucccagaguuuacguauguuucuauuuugacaauaagcauauauauauauauauuuauaaauaaucuugguaaacaagaaagggaaaaaaauaaacauauauaaaaaacaaaaaccacuuaguaaacaaaaaauuauuuuaaaguucuacaauaaggauggauuguuaauuuaaaaauuggugacaauacuaaaaauaaaguaauugugcauaauauuaaaauucuaaugauauaaauuacauuaacaccucuucaaguacuuagaaaauugacugaugaccacaaauuagaaaaaaucuuuuuaacacagucaaaaggaaguucucuagagaggggauaaauauacuuugaagaaaauauuucauaguaauuuuucuuagguuguucuuaaaguagugauuucugcaauguaagaagguaaauuucucaaguuaaaaaagaaaagaaaaaaacauuggugagacgggucucaccucaaaaaugucuugggcccuuuagguggcacuggcuguggaagugguuugcugcuguugaacucaauaucguggacuggagaauuaggaaugggauccaggcgguuaggauguccauugcccacuccaccagauuccagagcacuuagauugggaacacucacaaaccuguuuguuggugauuuaucauucuucuucuuuugcugcauuaaaaauaauacaugugaggauagucccugcaugaggacaaaugagaaaauaggaaugguagaagauagaaauuuggcaugggaaaauuuuggaagcuuuauguuaaauuaaaauguuaauuaaccaguguuacccaaacuguggucugggaauccuuggagguauuuuuuaucuacauggaauccucaaagacagacaugcuaccagggcagaaagaaugaggaagaaacauuuaggagucauucacgaggaaugagagagaagguaaaaagagugccaagggguaaagaauacccuuuugggaagaaaagggaaaaaggauuaggggagagagcaagucuugcagauagaagguuaaauggauuuaggcuaaaauuaggagaagggguaaaguuaaacauaauuuuaaaagagaguccaugaaauuuagccaucugucaaagggaggcaguucuugccuggaaaaaaaaaaaggaaugagaaaaugcuuggcaauguaguuugaaacaaauugcacauuucuacuaaagaccuaaagcugacuuaagagaaauaaucugguuuuaaauucacugugacaucuaucuuucugaagagagaaaguuauaucugcauaauuaagucuaauuuccauauuacuuggcaguaucauuaauuggcucauauuuuuuaaacuuuaaagguuacaaaacaauaguaaucagcugauuuuuuaaugugucuuuaaaauuaagagauaaaaagacaaauuccacugcagauuaucaaaaucuaucagcuugcaauucacuaacuuuagucucaaaguauuuuauucacaucucuagaaucaaugaucaucaucuugcuaugagaaauaaaaauuaacauguuacuagauauuuagaauauucucauauuuuacuaauuagauguauaccaauuaaauuuguaagcuuuuuagggaaauaacucgaguuugggaaaaaaugcaauuaauauacaagauggaacuuuuauuuuuauuuaucucauugucuaaacauuuuccucugucauauucugugacuuguagagucucugaugaaaauccuauuuuagcauaaccagaaaaagaaaauaauaauaauaccuuccucagaacuauuugugaaaacuaaagucacuauuaggagucaaaaguaguuugaaaguucuuacaaagauguaucuuuugcauuuucuuauucuagucaccagagggcauaauuaaaccuacuuaagguuucuauuuuaagaaaucaaaagaauacugguaaaguucuacaguaaucauuuugcagcuaaaaaauuuaauuccaauaaaauaaauaaaugaaaaggaguauuuuuaguauaucuuuuuuuccacaaaccucauaaucuugcuuuauaauuaaaaucuuauuucacccuaaauuaugaauuaaaaaacuaaaacuaauuauaauuauucauucaccaauuauuuacucagagcuuucuaucugccaggcaguauuuuagacucugagauacagcuacaugccacuacagucauucuauuuuagaaaacauucaaguuuaaaguuuggaacacuuuaacuuguaaaggaaggauagauucaguguucuuaauagagaaguuuuacgagcugugaaaggaaaggaaaauuucuggguaaaguccuaauaaaaauuaggcaugacgugaaacuuaauaaaaucugaauuugaaaaacagcuuuggaacuaucacuuuuauuuauucuacuacugauuucugccauaagauucauaauuccuaugaagccaauauauauauauauguauauauauaaucauuuauucuuuaugacuuccuuuauucacagaauaauuugugguggcuuauagggaaugugaugaaauuuugcaacugaacaaauauuuacugaauaccuacuauacccaaaacaugauuggagccaugggaagcuaggguacaaagauuuauaagacuuggccaugucuauuucaaggcucuucuuuuugucccaagagaguaacaaauaucaaaauaagucauacucaauuuuaauuaagaacggucauaaagcugggcaaaguggcauacaccugcaaucccauccacucgggagcuggaagcaggaggaucgcuugagcccaagaguuugagaccagccugagcaacgcagugagaccccaucuccaaaacaaaaacaaaaaaccaaaccaaaccaaaaagaacggucagaaggcugagagaaguaaagcccuucucugacgauugguaggcaacaaaauacauguccaacccaagguccauuaagauguuaggccuuaaaccaggaacagcuguuggguauccagggcuggagucucuuucuggaccauaagcagaagauugugaacaauaagaaaacaacaagaaauagucuuaagcagagucagaagguuaguuuucuucagaaauaugaaaaaaagguagaaucaaguuuuauaauauugguaaaauauauuuaaaggaauaugaguaguauucaguuucauucuuaaaaugaacauauaaauaauucauaaguuuuagugcuagauuauuaaauagaagaaaacauuuuuugggagcuuuaucuaacuaugcugcuccaaauauuuucaccaaauuuuuaaccaacuuuuaaaccacauuccuauucuacaguguuuacggcacauaccuuagccaauggauuaauaacaccaacaguaggacuugaguuaaacacuuuguugaaguuaguuucucgauugacuaauuccagcugauaaaacuuauuauccuccuaugcaaaagaauuauaaacaucuuuuaaauauuuucuauggaauauuuuaaaaacauaaauguauaaacgccauuucauuuaaaauuuacuauaaaaccugaaugaagauuuagauacuuuguuuaaagauuucuugacaugauugcugcugucuuaaggaauguugggggauaaguuuucaacaccuuuuaaaccccauacccgagcacuugacccuuuuccuucaaaaguggaccuaaauguuuuauuugguccuagcuguuucacagggcugacuaugcaguuugggcagguuuacaacuuacauucauggggcucugggcaugacugaauuguuuccacagauaaggaugaaacuauaucauuaaucuuuauuuccauuucuuuuuauaggcaugugccaccauacccagcuaaguuuuuuuuguuuguuuuuuuuuuuuuuuugguguguguagagguagggucucacuacaucauccagguuggacucaaacuccuagccucaagcaauccucuggcuucggccucccaaagugcugggauuauaagcaugagccaucauauccggccucauuauucuucaguacuguaaauagauucgauugcaucuaauaugagauauuaaucuaugauagcaaugguaaucaaagaacagggaaaaagugauugcccacauagagauaaaaccuuuaccuuuggcuucaccaacaagauguucuaauugaguaagcagaaugugggaaggccauaaguaaauacaacagugugugggagaaugcagggcugugcucuagcagaacuacauucuagugaaaucuaguagaauucuuuaugccucucuuagucaccacugucauucaaaucacuaaucuugaccuaugugccucacaguccacggaaucaggcuguuguggaaggaguauggaacaacccuugccuacaauccuggcucuucccuggugagcugugcugcuuucgaaaguugcuuuacuguauuugcugugaggacaaaauacaauuauaacaccuccucaguaagaacugggaauuaauagcuauuuauauggaacagaguuucaauacauuuacuaugcuugcugauuucaugugugaaauauaauuuuccaugagucugcugcuaccagaugcagcaaucuauaaggccugugcucauguucacaauauguagaaaauuggguggcugguggauugaagcagcacacacucaucucuccaaagccugcuccuggauucuaccugugauccccaaucugcuaccuguugcuuucagcaggaacuucuagucucagacaacaggcugccucuccuaaaugcaaacagagaugcauuaaggaaaaaggacuucagaaauacauguugcucuuaugcucuuuuugcaugcuaaaguccaaagucuucagcugaagauaugaaugguuaaagaguauauucauuguuaaauccguauuuucuuagcugauaaacuucagagccauuaagaacccaguguuacugacuuuccaagagagaaccucaguguuacugaccguccaagagaaagcaugcaacuuuucuguggcuagauuauggaacauuuuuuuucuauagaguaaaaauuuuggauuaguguuugcuaggacacauuuuaggaaaucaauaugcucaaccuguuaguguacaauacaggcuaaugcaugaaugugcuggcuuuucuuugcuagccaauccuaauacuacaugugcaacacacauacauacacacacuucaaugguauauuaauuguauacuggcagugacauauuauuaaacauucaauauguaucaaaaagacuuucuuuuaaaaaaaaugaaagacguacaauucccuuacccuaaugccaaauuuaaauuuuaaaaauuacuuuauucauaaacauuucaaugaacuuucaaucacaaugcacauguucuguguuuucuauuuucacuuagcauuacuuaaaaagauugucccauauuuucccaaucaauaucuauugauuacuaacaugguuagacuaaaaccaaaauaucuuacaauuaguuucuuuaugaucuggucucuuucuguaagcauggcuuuuaauucuguaaucaucuguauaucuucugguuuugauucucucauuagauauuuuucuuccauuucuucuaaucugaaaacaagaaagacuuuagcucauugauaucacucagauacauucuucuguaauaccuacauuaaaaaaauuagucuaguugaacacacacaaaaaucugaaacaaaacuucuuuuuuccuuaaaacuuuuaagcauaaugacaugacugcuucaagagcaguaguugcauuaaaggaguuaaagggguagaugguacuaugaaaggcuuugcagguuacuucugaagaagucacucauuuuaagucauuccagaguauuuggagaaaaggugagcaguaucuggagauaagcucugcagaagaaauuauauguugaaugauacuaaccugacaaauaacagguuugauacuagaaaggcaggcucacuauuacaagugcuuaucacaauacaauacugugugauaacacaaggcuugguaacauauaaaaaggacaagaaacaaauacagaugaaagcaaaacaaaggacacacauguaugacgucauuuuuuccugguuuauagaaaagaaaguuuaaaaauucuauauuaucagccaauacauacaaacugaaaaaaaguuucaucagguaagagaagaauuauguucccuucuaagccuauucuguccugaaugauaugaggugguaauaggccugaaugccuugaacguuaaaauauaggccacuuuuuauaagcaggugacacauccugcugagucuaagaauauaggauggggcagacugaagagaauacaaauggaaacugcuggcuuaguuucagaaaaagcacuuucaauuuuagaaaaugcaaauacuuagaacaauuuuaaaaaucuuguuuucaggauauaaaggauagaacuuaaaauuucaauaacauuauucaauaaaauuaugguuaauaaagauucuuagaaaaaauuauucacucaugaauacugaguaacuuguagaugaucuaucuuccagaaaucaguuauacauuccuauucccacccaaaacccuagagagguaccugaaucucaguguauuugaguaccauaaaaucccuccaaaaacucagccuaagcuaaagauuuggagauaacauauuaggcccucuauccaguccccuggcuaaaguucucaauuagaguguugggagguaugaaggugaugaggaagugaggaagugauugucucaggaucagcuaggacuucaucagaucagugcgagguaaguuguacaacagggguguccaaucuuuugguuucccugggccacauuuaaagaauugucuucgggcacacaaaauacacuaacacuaaugauagcugaugagcuuaaaaaaaaaacucaauaaaaaaaucuuaucaugcuuuaagaaaguuuacgaauuuguguugggccacauucaaagcuguccugggcugcauauggccugcaggccguggguugaacaaccuugcuguacaauguguuaaguuccacuaucuuuaacuuuuguucuuuugugacaauagagaccaagugaaaaauaaugugauuuguuaacucaaauaaagugaccuugcauuuuaucccaauauggcagaguuaacucuuaaaguauuuuaugggcaaacauuaagagucgagaaauacuaaacuaguaaaagaaauggcaauuuggguuuuauguuggagaaaccacaagaggucacuggagcacuuucuuuuaucauuaaaagcaaaguacaagauuuaugaacugcuucccgcagcugagcaagaauacuugguauaaaugguagcuaaacaacuaaauuuaaagccuuauuuaaaacuauuauuucuauuuuuuuguuaauugagaaguuaagguaaagugaaucuaaagcaaucaguuacaaucucugaaccacuuuuuuuugcauaauaaaggucuaucccugaauccaaauugcaguguuuuuauuuagcuuaaacauccuuugccuacagaauuauuaucaguuaaucuucucuauaaaauaucugauauaguuuggcugugucucacccaaaucucaucuugaauuguaguccccacaauccccaugugucaugggagaaaccuggugggaaguaauugaaucaugggggcaguuauccccaugcuauucucaugacaguaacuucucaaaagaucugaugguuuuauaagggaaaaucauuuccccccuugcuuggcccuucuucuuccugucaccaugugaauaaggauguguuuacuuccccuuccgccaugauuguaaguuuccugaggccucuccagccaugcugaacugugagucaauuaaaccucuuuccuuuauaaauuacccagucucgggcaugacuuuauuagcagcgugagaacggacuaauacaauauuuuuacaucaucaaaaauguuuaauaagaaaaacaccuggauauuaaauaggaaaauauaauugauuaaauagaaaaaacauaauccauauaaacacaaacaggaaagcauuaaaggagagaacaaguaaguaauaugauauagauuuaacuugcaaauauauuucauuaauuacuagucuuucaaaauuuuuacagaaagaaaacuugauacuauuccgauauccauuucaagccaagacuagucaauauuuuucuuuucuucaguugccgcaggcagcucucauaaccagcacugcuucuaaaauuuaguccaggugugaacaacuggugauacaguuuuguuuuguuuuuuaauuauacuuuaagcucugggauacaugugcagaacaugcagguuuguuacacagguauacauggguuugcugcacccaucaacccaucaucuacauuagguauuucuccucaugcuaucccucccccugccccccaccccgugacaggcccuggugugugauguuccccucccugggcccacauguucuccuuguucaacucccacuuaugagugagaacauguggaguuugguuuuguuccugcauacacagcuguuuuuaaguugguucuuuaaucuuucuaaucacaagaaaaaaaaauuguuuggguguauauauauauaauauauauauauauauuuuuuuuuuuuugagauggaguuuuguucugucacccaggcuggagugcaauggcacaaucucaguuaccugcaaccuccaccucccggguccaggcgauucuccugccucagucucccaaguagcugggauuacaagugucugccaccacacucggcuaauuuuuguauuuuuaguagagacgggguuuuaccauguuggucaggcuggucucaaacuccugaccucaggugauccgccugccucggccucccagaagugcugggauuacaggcaugagccacugugcccagccgggucuguauaucuuaaauugccuucauaacuuauguucauuacucuauuucacaacacucaggcaggacuucagcauaaaugcuagcuagaaucuaauaacauuguuuuauuuucacaaaauuuacauucauauaauuauagcuuagcuuuuauuuagaauaaaggauaaaauuuuucaguagugauaaauguucuacuguagugauaucaaguuuuccuauuaaauauuuaaguuaaaauaagucaauuaaaaauauuaagaaaauaauauacguagccagaaaugacccaauucccaaggauguauaugaucaucccaaggaugauuaaagccugggaaaugccgccuugagaauaccacacaaguguagccuuuuacucaaauuuuacagauuuccauuaaaaguaauagaagagagaagagaaagggggaaaaaaggagaaaggagaaguagaacauauaaaauuacuaauuagggccacugauggauucucaccaggcaugcaugcccugcuuucuuuggcucugacaauauacaggucaaugucugugauucauggacaacaggccuaaauuacaaaugccuaaaaagcuguauacaaaguuuccaaguuauagucuuguuaagaaaaagaaaaggauaaaaaaauaaaaucagugaauuuuagaaccaaaaaugguauacuauuguuucauaaccaaacaauaguauauuaugcacacauauauccuauaacuuugauuuuauaaagaugaaaaaacuccuauaucaucauuuucuaaacucuuaaauaaaggaaauauagcaauugaagcacuuuaacgcugaaccuuucuuuucccauaaauuacgcacagacucugauuugugacaagacuacuuccguaccucacaaagcuuacaaccauaccugaaugguaaauuaaaaaucaaaugacaacaaaaacaaaaguuauuuggguauuauagaugaaaggacucaaaacuuaaacaaaaaauuaguaauucagguguggcggagugcuucuuuucaauuggggauuacugaucuauuuaaaaucuaaguauagaaacucaacauuucucucaagaagaaaucaucuuuugugaaauaaaccuaaacaaucaguaaucucagaaccaucuuuuugcauauuaaaaaucggccaugaccucaaguuguagagaauguuuucauuuagcuugaacuuucuuuacuuacagaguaaaucauucagauaaaaaaaaaucaaacagcccauuuucucauuuguuucuaaaagaaaccagaaucaggacauuuuuauuagauauaaaguuuuuacuacuauaucacugaaaaauaaaauuucuauagaacucucugaaaaaucuaaaacuuuaacuuccagcaccaaagcggauuuguaauaaucaucauccauaagcaauauagaacucaucaccacuucuacaauacuuacagacuuagaggguauuucccauccuuuacauguguugccccacccuucucucuccaggaagggaguucaacaggauuuggggcaggagcagaagcaagaagcugccucugcccccaagcuuccucaguggcaggcuguggccugucaggcugcaccaugucccuucagcccccagcaccacugccuuccaggaauccacaggacucuucugauuucaaaguuuuaaagccagggugcagcugauuaggaacuucaauagaauccccuaguccuugggaacaguacagauacuguuucccacagcuccauaaguuggaaccaacucucccugcucacuaccugucuaaauccaaaccauucagcagauccaagcaggcugcauuuaaggauaugaaacagaaacaaccaauugucuaaaacuauguuuuccaacauuguagccauuagucugcauauggcuauuuacauuuaaauuaauuaaaauuaaaugaaauuuauaaauucagcuccucaguuaugcuaaucaccguucaagcauucaagagccauuuuuagcuagaagcuacuaaccuggacaaagcagauacaaaacauuuucauuaucacaaucuauuggacaguguuggucaaauauaaauuugguguguguuuguuuuuaacuaaaggaguaaacaccuaaagcuaggggguaauuaccugguggcaguaaguuucuggugaaaaaagaaacauaauugguuagcauggacccaaguggaagcauuaaaaugaaaggagagucuagaaaagcagguaguuuacuuaaaagcaaauacuaauucuuugauuauuaaaaaugaucauaaaaucaaaaacuaaguuauuugcuaccuacugaagauucauaaugugcaaaaccauaugcaacagaauaaaggaaaaacaaggacacaaccuuuacucuuuguaaauuaacauuccuaaggagacaggacacacagacagacugacguuauucuuucugugacuauguuuuuucggagcaugaagugggggaugccaagauuucagucucugucugaggaguaccacugaggccaggaaaaaggacagccaaggaauugaggucuauuguaaaucauuucugcaaaaguaugggguuaugagcuguuauacaaggcagauaccugagcucauacuuggcccaaaaggauuuaaaaaucaccucuaauaacagcaaacaccaaacucagagugaccagggaaguaacacaaguuuccucaccauuucaaaggcaacuucaaaaagugguaaauaugauggagaaagaaucauaaaauucauucaugaaacauucacugagugcuuaacuaauguaacgauucugaauaugcccaucagaaagagcaccucaucucacagcauacucaaguaaauaacaacuggggaccuguuuucugcuguggcuuaagugaauacaugugugugcaugugugcgucuguauguguguguugugguguugccuauguauguaacaaucuuuaccgaaagauugaauuggucacauaaaucaaauaaaagaagauaauuuuuagauuugaggacaauacuuaaaacggcaacaacacaggagguuauucuagacuguagaggacaacacaggaaaccaagaagguccacuaggcugauaaaaagacagaauaagaaauaaggguugcuguuggaugauguagaauaaggcacauuggagcuguuaaguuuacauuugacuuugacaugaaggauaaugggauuagucacuaauugugacuuuacugaaguauguggauauauauauauuugauuggaagaggagagacuaaaggugaauaaacuacuagcagcagcuuagaguagauuaauucugaaauaacuuauguuggaccaggguuuaggccacagagauggacugaguacaaacugcauuagcuacaucaguuuacaagcaucuaggaaaggaaggguuauuaaauguuuccaaagaacauuaaauaagaauuagaaacuuugguuuuaacaauacuguaguuacuauguaugagcgguaacuuuauuuguaauguuuuccccuuuauugauuuuuaaaaucauaagacaauuagaugcuucuuguaggaauuuaaacaauauguaaguggaguauauaaaauaaaaagaaagaauugcucuuucucaucuccaguaccuccuaauccauucucuugagggaaccauuaccauuaaaauuugguauuuguuaagauauuuugauauuuugguaaaauauacauuauuaguguguauauaggaucauaguauuccuauuguucacuauauauucuuuuuacuuaacauuauauauagccauauuuucaguuuucaccauggcaugauaguucaugauccuaaggaacauucuuuagauuacuguucuagcagaacuggugcagucuuaguugauaaaacaucaucauucaacugccucauccuaauuaaagaacauauagcacugcaauuaccaucuguaacacagcacuaaaauuuucuuuuuaaaguauccuuuuuauuagagucaaaauaacagcuaaucugagguuaaacacagugcuccuaaauuuauuauccacauaugaauuuucuuauauaauaugacuuacgacacuuguaaagcggcauuuauuuccuugaguagcucguuagucuuauuaaaaucugcccgcaugauauuuuucucucugagguggucugcugucaugacauccaacucuuuuucaagucucuuguuuaaaucuuguucaugcaaccuguuugauuuauuuuuaguuaagaaaauguuauucugaagucaagcuuucaaaacuuucuauuauucuaccagauuugaaaugguuuuugguauaauauauagaaaauuuauguaaacagccuaaauuaagcuacuuacuuucugcuauaagcuucuggcuuuguuaaaguugucuccuuuaaugcuuuuucaaauaacauuuuaaaaagaauucaguuaauuauauacaauuuccaaagugaaugaauacauguuacaucauucaagauauaaacauuucaucuguguucuagauuauaacauagucaucaaauaaaguaaaaagaggucuucaauauuuuacuagagagccagucuagucacaaaauuagcauagauuacuaaauaucagcacaacaguuuuucagaugacacugcauauuccuucuguuguacuuaauggcauaccuuaucuguugguuagauucacuucguauucugagaauuucuuuccccuuaaauuccaguucuuugguuagggcacuuauauucucaugaaggugcugaaccuccuuauccaauucagagaugugaugcucucugugucuuaauuccucuuguagaucuguaauucuacauaugugcuccuuacucuguuaaaaaaaaaaagucauuuuuagaaguuuucuacauauuugauuucuguguuuaucugcgggaaagaaaaugacacacuggaaugucaaauguaaucauucugacauugcuucuucaaaagcaaacugcugaaaugagaaaaccucaaggccuguucucuuuccacacauauaguguguauauggauauagcuucaauaaugucagauuacaaagaacccaaaaggucaaaggacaucucucucauuuuacagaugaggaaaccaauacccaaagaugauuuauaaucaguggauuaguugagauuagaacacagugcucuuacauccucaguaaguuuuacaugauuuugaagaauaauuguggcaccacugccuauaaucuaaagagaaagugcaucuaaggaggcccuccuaaaacacacacaucacauggcuuacaaagcagacuuaguuuagugcugcucuagcaguuaucugacaguuaagcucccuucugugauugugccacuccacuccagccucagugacaaagcgagacccugucucaaauaaauaaauaacugaaucaaauaaagcucuucaauauaaauagaaugugauaacuagugaaaauaaguuauuacaaaauaauuuucaggaaauuaugaacauucaaucuauucaaauuuaagaaaucaucagaguacagaauacucuuacuuaccugucuucugcugaugucuaugcuucucucuaauuccauuuuagcagcugccaauucuugaugaugauuaugccguaacaaaucaauugcagcugcauguugaugguugaguucugagcgcaaggaagcuggaauugcaaggcaaaaauacauuuggcacauuuaaaaaauauuaucaauacuuuagauaaaaauuauagaaguaaaaaauuauuucaaaaauuagaacacuuguguauguccauuaaauuaauagauuauaaacuaugacaaauuuaaauauuacagacuacaauauacuaucaugaauuuaaaguuaauguagcuuugaugaggauauaaaauauuucaaauguuuaagcggaucaagguauuuuuauacaugcuuucaguaugcagguaaagugcuaauggagaugaaguauuuuuaauucgucucuuucacuauuaggauaauaaaauuuggucaagcacgggggcucaugccuauaaucccagcacuuugggaggccgagguggguggaucaccugaggucaggaguucgagaccagccugaucaacauggugaaaccccgucucuacuaaaaauacaaaaaauuagccaggcauggugguagguuccuguaaucuuagcuacucagaagacugacacaggagaauugcgugaaccugggaggcagagguugcaaugagccgagaucacgccauugcacuccagccugggcaacagagugagacuccaucucaaaaaaaaaaaaaagaaugaaauuuuagaguuuaaugguaccauaacaaauauuuaggaggcaacuucucacccaaauaagaauucuucaaaaauaucccuaaaggagccuggcuggucaauguucucaugauauugaaaaauguucaauaucaugagccacuaggaaaaugcaaauuaaaaccagaaugaguuaucacacauuccuaucagaaaggaugaaauauaaugacaacaucaaauguuggugaggaugugagcaaaauuuauaugaugcuaguagggauggaaaaugguacaaucacucuagaaaauguuuggcaguuuguuacaaaacuacauaugcagcugccauaugacccagcaaccgcacuccuaggcacuuaucccagagaaaugaaacuuauguuuauaugaaauuuguacgugaauguuuauagcagcuuuauuuguaacagcuaagaacuaaaagcucaggugaucuuuaacgggcaaaggacaacaaacuacgguggaucaaaaccacugaauacuacuuggcaauaaaaagaaacaaacuguugauacacacaauaaccuagaugacuucagauaauuaugccgagugaaaaaaggccaaccucuacauguuaaauauuguuggguguggugguucacaccuguaaucccagcacuuugggaggccgagacccguagaucacuugaggccuggaguuugagaccagcuugggcaacauggugaaacccugccuacaaaaauuacaaaaauuagcuggguguggcagcacacacuuauagucccagcuacuuaggaggcugaggcaggaggauugcuugaacccgggagguggagguugcagugagcugauagcacaccacugcauucuuaaccugggcaacagagugagacccuaucccuucuccccaaaaagguuaaauauuguaugauuucauuuauaaaauuagagcauucuuaaccugacaaaaucauagaaaugaacaggguaaugguugccagguguuauaggaggggaggacugggaauauagguguggcaauaaaugaacaacaugagucaucuucaugguaaugggaauguucugaaucuugacagaaucuucgucauuguacugguugugauacuguaccauaguucugcaagauguuaccacuggaggaacuaguuaaagagaucucuguaguauuucuuaaaacugcaugugaaucuacaauuauuucaaaauaaaaguuuuuuuaaagacccaaaacucuuuuugucaacaaagacauauuuuauuuauuuauuuauuuauuuuuugagacagaguuuugcucuuguugcccaggcuggaaugcaauggugugaucuuggcucacugcaaacucgaccuuccagauucaagcgauucucccgccucagccucccaaguagcuaggauuacaggcaugcgccaccacgccuggcuaauucuguauuuuuaguagagaugcaguuucaccauguuggucaggcugaucucaaaaucccgcccucaggugauccaccugccucagccucccaaaguacugggauuagaggugugagccaccacacccggccaacaaagacauauuugaaucauguuuaguggagcauguuucaauggacuaaacaacaauaguuccaacacugggacuguuuuugccugcccugacaaagcuguggaauguguauucccuuuuggccacauuucuauaaaggcgaccucuacauuucacuacaauuccugugcaaagacagggcaguaguucauuuuuuaauucuccuugcucagcaaucucuagcacaugaaaaggcuuuucacaaaucuuugacaaaugucuaaauuuaaucugauuuucaugcuagcagucauaguggguuuuaaaggaggaagaggagagcuuuaacgacuuggucugggacucccagcaacauuaucgaugagaaacagggucagacggcuuucccuuugaggcccaaaauauugauaacacuucagucuucuuugcuccaaauuccuacuuggaaagagugugccacugaaguaugacaacauguuaaaaauauuagcauaauuuggaauaaagccaaacagaaggaaaaugagaugguaagaauaaaaaguuauugaaugacauaaaaaacaaaacccaaaacaaaucuuuaaauacauauccaguuuuucuucaaaacucaaccuaccuccuuauaaaaaguaaugaugugaacaccucauagguagaaaucucaaagaaauauauaccucaacagaagagucagaccuaauacugacuuuucccauuaaaacaaaaucuugaaguguaaaaaaccauaugaccaugcagucuaaggacauguggcuccauguccuuucuacugagcagugauugauuucugggacaccucaauguccugaguccacuuaguccaaaaaggacagauuagaguaccagugguguugcuugcauagcuggaguacagagagagcugaggggaauucacuuuacuguuuguguccugccuauucaugugguaacuucaaauaaaauaugcaguacacuuagauauucauuuugacguuucaaaauuuuaaaauaaaacuuggugauuuuauguugaauuuaaaaaauguuaaaaauguacauaugaauaugacaagauuguaaucuuuucaaaauaccaagcauagccuuuccuucaucuucuaauucaaaccgaagagucugaaguuccuguuccauuucuauccggaagcccuccauugacucucugugugcaucuuuuagugauugaagcucugcagaaugcuucuguuguaaaugauuuucaagagccuagaacaagacaaauucaaauuauuaugcuagaauauaggaaggaaaaugcaaacaaaauagaaaacaguuacuaaaacucaguuauuauuuaagaaauacaaaauguuuuagguucauuuucaagaaaacuagacauaagauaaucaacauuagaaaaaauaauuagggucauuucaguagaauaaagaaaucaucaugaaaccaauuugauucaauguauuuugucuauauauugaacaggcugggcacaguggcucacccuuguaaucccagcaguuugggaggacaagguggaaggauugcuugagccccagaauucaagaccagccugggcaacauagcgagacccuguuucuacaaaaaaaaaaaaauuaaaaaauuagccaggcaugguggugugcgccuauagucccagcuauucaggaggcugagguggaaaaaucacgagucuaggaagucgagacugcagugagccaugauugugcugcugcaccucagccugggugacagagugagacccugucucaaaaaauagaaaaaaaaauuuuuuuaauuugaagacuaauuauuauuaggcaguuggguuacauuugaacguaugucacauaaaacuuacucuuugcuccuuuuccuuuuccucuuccauaguuugaaaugcaaggacaugugcuucuuuuaaugauuugugucuuugcugauguugcuccucuaauucuucaagcucuugcguaagccgcugucguucuugcguaaacugggcuugcaguuguugcaaagaagucugagacugggaaagcuguaucuccagauucuguuucagcaaggaaaucuaugccccagaaugguacacaaugaagaauaaauacaaggcauaguucacaaacuacccagcaaagggggaaaagcauuucaaagauauuaaugauaguaaaauaacugccuuaauguuuccauuuaaaauauucuaaaauauaucauaaaaauaaccauuuaauaucaccauuuaaaauuccacuuucuguaauuauucugaaaauaguuuaguuauauuguuuauagacugucuaaagaacacugcagcccacauuuagaauacaaugaauaucugucuuaaguuucaauaaaaauucauaauaugaaauaaaaacagaagacaacuaacauauucauuagguuauagucacuuugaggaaagaguauguuaaaccacuuauuuguaaaguaguaaagugaaauaggagugugagcucugaguuaaaauccuagcucugucacuuguuaguaucaacaccucaccaggcuauguuacuacauauagcucacuuugaacagacucuggcauguacuaagcauucaacaaauauuagcuaagauuauuugagaauuaaaaaccuacuguuuaaaagauacaucaguuuauaauuuagaaucaucauguaaauuuuuauuuuucauuuaacucaaaguuauugaaaaccuuuaaguuucuaaaaugucucaaacgucccacaaucuuuuauucagccauuauaauaaugucaggugcuuuucuuucacuauggaaaacugauuugucacuccuuuugaaaacagacaucagccucaguaugucuguaucacuucuagaugucuuaauauacuuaaaauuaaguauuuugggaagaauaaaaacauaaaacagguauauguauguauuauauacguucauauaugcauuugauaaaaccauuuaauugaccuauuucuauucucauacacaggauauuguaacuugaaacuacguaucuguauucuaaaagaagucuaaaucuaagaggaacuuaggagaaccagauacaaaguuguaaaauguguuccauaagcaacuuaaaacacucuaugcuuuuauauacugguaaaacaguuucugcggccaaaaaagccaaugaaaagaggaaacuuuaaagugaguuuuuguaaaugggaaaauacucucuuuuaauugauggaaggcagacauaaguugccucacaugcgucacaaagaaagguaccugggaaagaaagagaaaaggcggggaaucacuagacaugcaagagaagaacggaggaaagaaucauuaauuggaaaaagaaaaggucgaaagcaagccaccauaucccuuuaaaaagcagcaggaacagucacagacuguagugagcuuagggugaugauuagccuuccagaaggguucuggacaaaguuaucaaucagaguuaguuauaaagguuagcauauggcuuuauggaaacagucaagcacuggugagaaaucguaugaacaaucuagguguaaucuguuuuaauguauuuccgaauaagugacuccaccuguucaaacuuuaugaauucugcuuauuaauuucuacaaaaaccuaagguuucagagguuauuuuaaaguuuuggagccaagguggaacugcaacccucugauaccaaauaucacaacuccuuauaccucuaaauggcagcagcacccacgacuuacagacugaaauaaauccugcaaaugugagaaugugauaugcgcauaagaaucucacagccacagcuaaggccauacuuguggaauaugauaaauuauaccacaugacuucucaccauuuuaugcaaugaaaaucaggauaaaacgaauauugaagacagccuagaaagaaaaaauaaaccacaaaaggguaacaagaacaaaaauagacauuugugaacacugauuuguaaccgguagagccguucucuucccagcaaguugguucuugaaauagagaaagcaccuacccccucucuuuggaaguucaacccuagucccagccuaagcauggggacccaugggacugccuuuuuuguuucugaggauaacuuguugaaauguauacgggaaagcuggaaagggugugucacaugcagaauaacaauauucucaaagcuauuacuuggcaccugaccaaguggggauuaaagucuacccagcauucugcucaccaagcugucugcccugguacagaucuguguccauccaaaaagaauggacauguuuuucugcuuugcacaaaggugccauauaggcuagcaguggcccuggaucccauccucaaauuuaguguguacuucaauuaguaggaaaccaaucagcucacagugguguuucuuauuuucugcaauaccuacuucaaaauuugcugaaucgacagaccucucauacguuaauuugacucacguuugaccuauuaacagaugaaacuuaugaagaaaugcaauauuuaaagugaaugacuggaaguaccacagugcauaauaguuacauauuuaaaaucuacagaguuuuaaauuucuccagcuaaaauaaaauacacuuaaauauuuuacauuguaauauacuuuaccuugaaagaacuccaaaauaguacuuuccaucuuaggauaugugauuaaucuuuguaucuacacucaagaaaauaauauaaacuaugugcagaaagauaugaucaugcaauuuaguguucaaacauacuuagauauuuuguauucuuaacuuugaaagcacaucaaaauaauauuaaggccaucgaaaaucuuugaauucaugcucaagacaguaaugugaauuauaugcagaaagccuuaaucaugcaaugcaauaucaaaauuuauuuuguucuuuuuaaaaacaaguuagcagaauugcaauaaauagcuuuuauucagcaugaaaaguacauggcacuuuaaaagacaaugagcaaaguaauguaaagugaauuaauuuuuauagcuauaauuuaaacagcugaguuuaauauaaucaauagaaauacauauuaauguaaaacuuuaacucaaaagauaaaaaaccucugcuuuaaaagguuuaggcaauuuugguaaguauuuuuauuacagaauuauagaauaucuagaaaggcuuguguugaauaaagaaugagaacaaguaguugcuucaaacuauauauuauauucaaauuauguagugcacgguauuaguuucuauacauucguuaaaauuuaaaaaauucuauuucuuauuuuguuuaaauaaaccaaaauauuuuauuucagaaaauaauuuaaucuuuaguuuuuaaauucuuagcauagcaauuuagauaugaaauauauucuacugguugauaggugccagacauuuuagagacaauuuuaaaggucaaacugcacugauaguaauugccaccuccugucucuaccauuuaaaaaaugauugucuuuuugaaaauaaaguuuuacagucuuuuugaaaauggaauauuaaaguuuuauaaaaauuucaaaaagaaaaaauuaaaaauauaugggccgggcacgguugcucaugccuguaaucccugcauuuuaggaggccgagacggguggaucaccagaggucaggcauuugagaccggccuggccaacaugaugaaacccugucucuacuaaaaauacaaaaaauuagccgggagugguggcgggcgccuguaaucccagcuacucgggaggcugaggcaggagaaucacuugaacccgggaggcagagguugcagugagccgagaucgcagcacuacacuccaaccugggcaaugauaacgaaacuccauuuaaaaaaaaaauauauauauauauauauauuuauauauauauuuauauuuauauauauuuauauuuauauauauuuguauauuuauauuuauauauauuuauauauauggcucacugcagccucaaccaccugggcucaagugauucucccaccucagccuccuaaguagcugggaccgcagacaugcaccaacugauuuuauauuauuucuagagaugagguaucacuccacugcccaggcuggucuugaacuccugggcucaagcgauccuccugccucagugucuaaaagugcugggauuacaggcaugagccacugugcccagccuacuuuuuacagaccaguuucacaaagacucuguaccucuauaaugguguuuguggaagaacucucucaaaacaaaaagugaaacaucaaaucugagguacuggguaugacagaaugucaauaugagacaugucauuaauuaucuacaucuuaccuacaaccuuugguuuuugaugcaauaucgguguuuuuucuucaaaaaccauugagccuuguuacaaaagugaaagaauacagaaaguauacaaaugauguguucuccaaauaaagcaugucuugagauaguaaacguaaucugugauucucaaaccuggcuguguaucagaaucaucucugcagauuuucauaaagacaguugccugugcccugaucccuugagauucugauuuagcaggucuggaauugggcccaggcugccuaagauauuuuuauuccuauuuaucaaaguaaaaagugguucguuaugaaaauuuuaaaaauacaggaacauauaaauaaaaggaaaagucuccuucauucccuuuccucacuuaaucccuaaggguaacugguguuaauauuuugguaugccuuacugcagacuguaauggcuuaggucucucuugauauaauucaccguuuuguuuucuuuugcuuucuuaccuagaucauguguaaauggcuagaugauuuuaccaaauguagagauauaucugauaaaaugcuggcuaugccuuauauacaaaaguuacaaaggcuccagggcacaccucaaaagaucagugcuuaauguccauagcagcugaaacagagacaccuggggcagcugauggggacagacauccuguaaguaucacauagagaaacaaacaccacuucaaaugugaaaccaugagaguguccugaccugcagauguggaugaggugguuuucacacacucaacuuuauauaucuuccaagaugaguacgccaagggauuuaaugauguuuaauaauuuuuccaguagaggggccagccaguuuguguuuuuguaguuuuuuccuucccuucaaaguggcauuuauaagguacucacgauauucagauaugacccauuccuuuuaauaaccacauagacuuccuagggcuggcacugucccucacuucuacaacagcuguucucccuccuuccuuucuucccaguuggcugccuggguuuauucagggauuaaauggaaaucccuggaagguaagccccucucguagcaccuacagaugaauuaugacugggacaagaaaguaaucuaauucuaaaguauuaacuccaauccuuucaaauauauaaaacauuaaaaacugcuagccuaucagucugagcagaucucaggaaaaaaacugcuaaccuaggcuuaguagaggacaguaggaauaacuuauuauuaugccaaugacuuaacgaaaauggucauguaaaauguuuaaaggugcucaaauauuuuaauuauaugauuuauuuuucuucuuuaaucacuaaugugcuauuacugaggaggcuaguuaagaaaaguaaauuuggccuggcgcgguggcucaugccuguaaucccagcacuuugggaggccgaagcgggcggaucacgaggucaggagaucgagaccauccuggcuaacacggugaaaccccgucucuacuaaauauacaaaaaauuagccggguguggcagcgggcgccuguagucccagcuacuugggaggcugaggcaggagaauggugugaacccgggaggcagagcuugcagugagccgagauugcgccacugcacuccagccugggcgacagagcgagacuccgucuccgaaaaaaaaaaaaauuuguggaauauguccccaaucauccucuuauuauuaacuaaaacuaauuagaaaguuaucuaugaaggacagauguaucaauaacagucacuuguuuuugaaugugcuaagcacugaauucuuguauggaaagcugggguacacaccauguacagagggagugggcaggugcucauccugcagagcacggcacucugacaaagucauguuuugcuguggaugaugacagaguaaaaaggugauccucaaugacuauaauguuauaaaagagauuucauuguguuaccagccccuuuuacuuuuuuuguaggagaugaaucaaggcacuuucauucuaguuauuaauaggcaauuucaauaaggugguuuuuguuuaaugaauaaaaaguacaacuguuaaagaaaaugugacugugcugucacaaauauucuaaaguauaauucaauuaauuuuaaaaauaaucauauccuauuuggguucuuauuucuaucccaauuagcacauaugucaaaaugucuauauugauauagcuaucaugccaaaauuuguacuaugcucuaugucacugcuaaaaagaauuucuaaauauagccuauuucagcaacacugagauaaauguuuguuguuucuuuuaagagaugaaagaaaaugcugcuaaauguauuugcauauuuuaauuauuuuuuacauagaaaaaagacugaauaugaaaacuagguaaaauuuuuauuuucuugcauaguaggaaaaacuuaugggguaugaggaaauaguuucauuccaggaguaucagaauuucacaggacaucucuaggcucaaagcuuugauuucucuagggcuggcauuaguaaacuacaaucuguuuuuguaaauuguuacuggaauacagucauaccuauucguuuacauacugucuauaaguauuuucacacuacaauggcauagaguuucugccacagaaacugucuggcccacaaagccaaaaguauuuacuaucugguccuuuacagaaaagucugcugacuucugccuuaggacaucaagaaaaauauucaacaauguucaauucugugucaucuaauuuuaaaggacaaguugaguauggguuuggugugaaaauaaaucucacuuuuucuuaugauauacaaagaaaaauguuuuuaaaugaguguuaaauggaauauuauuuugaagaugaauuucugcauaccugaguguacauaaguaaagagugaucacuuugucaaugcuuaggaaagggauuuacucuauuuugcuuuucaucuguugauaauuauaacauuacaauguauaaaauauguucuaauucccauaaaccuucauaacaauccaguacuuuuaaaaaaggaagucacuaaugcuaguuuuucaaaaaauaaacuaguuuaacaacaaaaaaauuuuacauuuauuuccauuuuuaugauucaacuaguuaauaguuuuucaaaaauauuacuauaucuuucaaaguaaacauaaaaauaaugaaauuuaugucugagauauaaaaucucaauuggcuuuauaauaaauauaugcuuauuaauacaugugguagauguaugcauacacaaaugaaugacugaaaguuagaagcuuuuauuacccauacacaaaauauaucuuauugaaugccaaacaguauuuuuuauauaaguugaagcuuuaaagcagugauguuguuuaugcaaaaugaaaagugcaacaugcccuuguguacaaauuguaagugccgcucacuuacauugcugauagauuuaugcaaagcuucacccagagacugccgcuaugaagaaaagauuacaggaauaaagggaaacauucagaaaucaacuaagugaaagaaagaggaauaagaagggagaguaaaacacagaacauuaauuauaaugugcucaagagaaaacaaguugaaaacaguucuaagaaacaaacuaaacaaaaagaaauuaaagacacacagucuaaauuaucuauaaucccuuaaaacaaugucugauauauuugugggcuugcagacuuaccuauacaaacuacuaaaggcuaggccauauaaaucagaguucaguuuaaaagaugaugguuacugagggaccaagaggggauauuacuguucuaaauuccucccagaaagcuacaagauaacuauucaaagcauuaugcccacuuugcuguagguucacggagaauuucucuuaagagaaaugaguugcggugaaaaccgccaacacuaacuugacugaccauauaauuuggaagccagaaauaaauaugacauaaucacuagaaauuaaggauuuaauaauaaucugguuuuauauuagggggaaaggaagaagagacacccuuauaucuuuuuaauccuauuuccuaggauauauuuggcaaaauuauuuacaacauaggcucauuuuucagaaguucauugaaauuuuauguugauacaccauuggaaaaaccuacauaccccucccuccuaauaugggggaaaaugaaaauguaauuucauuuucagucaccucauauuuuuaccuuccaaaaauacaaaaugauauuuuaaauuuauauugcuaauuuaaauggaaaaauugcuuuaacaugguuuuuacucuggacaugauuuuuuuuuuuuuuuuuuuuugagacggagucucacucacucuguuacccaggcuagagugcaguggcacgaucucggcucggugcaagcuccgccucccggguucaagucauucuccugccucagccucccaaguagcugggacuacaggcgccugccacugcgcccggcuaauuuuuuguauuuuuaguagagaugggguuucaccauguuagccaggauggucuugaucuccugaccucgugaucugcccaccucagccucccaaagugcuugggauuacaggcgugagccaccgcgcccagccuggacaugauuuuaagugauaaaccauuggaaaaaccuacauaccccucccucccuccuaauaugggggaaaugaaaauauaauuucauuuucaaucaccucauuuuuuaccuuccaaaaauacaaaauaauauuuuuauuuauauugcuauauuuuuauauuuauauugcuaauuuucagaaagaaugcaauuuucuuuuguuuccauuuuuugcauauugcaauuauuucuucaagugacacaaucuaaagauaguuuuuauuggaaaauaauuuuuacuaauaacuuagacuaagauauccaaugauauaacuuauuaaaguugcaaauaugagauaaaaagauuaauuuucuauguugacuucauaacuucucaaucucaacuuucucaugcuuuuauguacaucacuaguuaauuuuacuuuuuacuuuauucuuucucauacucaauauucuuuauacaauaaugagagacaacuucuccagacuucacaaaacuuaagaaaauuggaagaacuuuuaguuguaguauuuuuacauuuauuuauuuauuuauuuauuuauuuauuuauuuauuuauuuuugagacagagucuugcucugucaccaggcuggagugcaguggcgcgaucucagcucacugcaaccaaagccuccuggguucaagccauucuccugccucagccucccgaguagcugggauuacaggugcccaccaccaugcccagcuaauuuuuguauuuuuaguagagacgggguuucaccauguuggccaggauggucucaucuucugaccucgugauccgcuggccucggccucccacagugcugggauuacaggcgugagccacagcgcccagccaacaucuuuuuauuucuuagaacugauguccuaguacuagaaguuaaacuaaaauuuauaccauuuacuuaugaaguagauuuuauuuucacucuuuaaggugucaucagacaaaauauguauguuauuuaagauuccugaauuauuugauaaauuagaauaugccaaaucagagugacaugccaaaucaucccuucccuagguguagauuuggggcuuuauaugacagaaauauauuugaaaucuaaacucauauggucacuaccucuguccacacccaguugcaggccaugaaaauauugaauccaaucgguacagugcccaagcugugaccucaagugagcuuacaucacagaccuggcauggcaauugguaaaggcauaguagugcugcuggguggcaauaccacuguuuguuaauacauaacugaaguaaccuuuuucauuuaaaaauacuaauuaggcacaugguggcucacaccuguaaucccagcacucugggaggccgaagcagguggaucacuugaggucaggauuucgagaccagccuggccaacauggcgaaaccucgucucuaccaaaaauacaaaaaauacaaaaaaaaaaaaaaauuagccaggagucauggcacacaccuguaauuccagcuacagcuacucgggaggcugaggcaaaagaauaguuugaaccgagaggcgaggguuguggugagcugagaucacaccacugcacuccagcaugggugacagagugagacuccaacucaaaauaaauaaacaaauaaaaaauuagaguacuauuauguuccagaaaacauccuaagugcagggugagauacagaguugaguaagauguaucaacuuauucaacuauguaucucacccuguauaaauuuuauacauuuauuuaaaacaaauguauaaaaauuaaaaaauaaggaaaaaaguauuaugauuuuuaaaaaggcuggugugauagggaaugacuggaggagauauugaguugaugguaagaaaagauauuuuauuuuauuuuuuaauuuuuuuuuuuuuugagaugaaugaagucuugcucugucgcucaggcugagugcaauggcacgaucucggcgcacugcaaccucugccccuuggauugaagcaauuuuccugccucagccgccugaguagcugggauuacaggugugugccaccaugcccagcuaauuuuuuguuuuaguaaagauggaguuucaccauguuggccaggcuggucacgaacuccugaccucaaaugagauccaccuaccucggccuccuaaagugcugggauuacaggugugagccaccguucccggccagaaaagauauuuuagaaguguaacauuuaaacugagguaaaugcaaauaggagauaacuuuggggaaagaguaccuggcaaguggaucagcuagcacaaagccccugaaggugaaagcaagcugggagcaagugggugugggagcggagaaaggguuagugagggacaguuagcugaaaugagacaggagauacacaaaggggccagcuggcuuaagguuuaguaggacagugagagucggaauaacggaauaacagccuggauucaauggggugccccugagaggacuuuuuuuuuuuuuuuuuuuuuuuuuuuuugagacagagucucacucuguggcccaggcugaagugcagugguaugaucucggcucucugcaagcuccgccucccggguucaugucauucuccugccucagccucccaaguagcugggacuacaggcgcuggccaccacgcccggcuaauuuuuuguauuuuuuuaguagagacgggguuucaccauguuagccaggauggucucgaucuccugaccucgugauccgccugccucggccucccaaagugcugggauuacagguaugagccagcgcacccagccucccugagaggauuuuaagcaagggaguggcaggaucugauuuacaucaugaaagaucacuuugagugcuguaagaaaagugaaauugaugaggacagacaggagacagaccuugguaacaguggcuuggacuaguguuuacuagggaagaugaaagcaaauagagcuagaauauguuuuggagguggaauaaauaggauuaaaggauuacaugggaaguaaaggaaagacauauggaugguauuuaaaccacagacugguugagauccccaagcgcuguggacuaaaaguguucccuuagccucagauucauguguugaaagccuaaccuccagugugaggauaauagcaagugcagccuuugguaggugauuaguugaugagggcaguacccuugugaauggauuuaauguccuuauaaagaaaucccagagagcucccuuggugcuuuuaccacgugaggacauaguaagaagauagcugucuaugcaccaagaagcaggcucucaucagacaccaaaucugcuggcacccugaucuuggacuucccagaauccagaacugugagaaaugaauuucuguugugggcaggcacaguggcucauguaaucccagcauuuuggaaggccgaggcgggaggacugcuugagcucacaaguucaagaccagccugggcaauaaaguaagacccuguugcuacaaaaaaacaaaaacaaaauuagcuggcauaguggcauguaccuguagugccagcuacucagaaggcugaaguuagagaaucacuugagcccagggggucaagaccacacugagccaugacuguacuacugcacuccagccugagagacacagcaagacccuaucucaaaaaaucauaaaguaaauuuuaauuaaugaauuuuguuuuaaagccauccaaucuaugguauucuguuauugcaguccaagugaagacaccaugucugcuuaaauaaauacuggauaaacuaaacauuuguauguaaaaauacuuauuugggaagcauucuauaugaguaagauccauguuaacaaaaagauggccuauauaauagucaauuuguuuuaaagcaucuuaaauuucuuguuaauuuuugagauucaugaaaagagccuuaagagagccuuuucaacugagaagacuuggagacuucagcauagugaguuuacugaauguauuucaggaauucuauuauugaaggauagauauaaugagacguugagauaagugaggaagaaaauuuacaauaacuaaaaaaaguugcugcaguuaauuagaaauuuagcacuugguacauaaaaaacaauguucuuaguuaucuaauuguucuaaaccucaguuuaaucauuuagaaaauaggacaagguuuuacaugcuuguaauuugcaaacauguuauuauacaaauacugaaauccauugaauuguaagcuuuuagaggacagaagccugucuuauucacauucugcauccaaacuggugccuggcacaggguaaaugauuaacaaauguuuauucaaaaacuuaaugaaugauaugaacucuuaacauugauuaguuuuugcuacucucuaaauuaauucucuccuaauaauagcagaaagagaaaauucuagauugcuaaaaagaaaacauauuauuuguccggaaaauauaaaucugaacacagaaaggcuucuaagaggaaagcaauguucauugagugacaccuagcuuguccuaccuuaaucuauucuccacacugcagccaguuuugaaaucacaguauuugaauauuucacccuccugcugaucaaagcccuucaacaguucacugcucuuuggauaaagucccaaaucccuaacaaggcaaagaaggccuggcgugaucugauccuucuuaccuccccagcuuccuagcucucacucuccagaauaaaggugucaucagggcuuccucaggggcugugcacacacugcccgcucugcucagaaugcuguucuucuggccaggucucagguaaagaauuccacauuuagagacgccuuccccaaguuacacaugaauguuuaccacaguugcaauuuaacacccaauuugcaguucagauuguaagcuccaggaaggcaaagaucacucugagccaguuacuauucuggcacaaggccuagcauaucagaggcacuucauuuugacugaauaaauggauaaaugcaugaaagaacaugcaaaaguaauuucuuacuacugauuucaauaccucgaguuaaaauaaauaaauaaauaaauaaauauggaggugaugugggccaagauuagagccacuuaaaaagccagaggguuggccgggugcgguggcucacaccuguaaucccagcacuuugggaggcuggggcagguggaucacaaggucaagagauugagaccacccuggcuaacauggugaaacccugucucuacuaaaaauacaaaaaaucagcugggcaugguugcgcgcaccuguagucccagcuacuugggaggcugaggcaggagaauugcuugaacccgggaggcggagguugcagugaaccgagauugcaccacugcacuccagccugggcaacagagcgagacuccaucucuaaauaaauaaauaaauaaauaaauaaauaaauaaauaaauaaauaaauaaaaagccagaggguuaucaucacacaaagccuuugaagccacacugaauacugggagugggaaauaggagacacccagaagacuaauuauaauuuaucagaaucaccauacuauuguguaaucagagcaacauugccauagggcuuaauaaaaagcacuacuaaugcuuuacacguacaagauauuacacaugcauauauccaugaauuuccauaauuguuauugcucgacuuucaauucuacuuugaauaagaaaucugaagcaauagaaaggaauucucauuacugacaaaaccugugucauuuaaaaaauuucuaacuuccuugaaacaauauugauacuagucuuacauuguaauucaaguaaaauacauuaaaguuuuaaaaaauuccaauuucaggccaggcaugguggcucaugucuguaaucccagcacuuugggaggcugaggcaguggaucgcuugagcccaggaguucgagaccagccuggguaacauggugaaaaccuguaucuacaaaaaaugcaaaaauuaacugaguguggugauaccugccuguaguuucagcuacuugggaggcugagaagugggaggaucacuugagccugaaaaguugagggugcagugagccaugauugugccacugcacuccagccuaggcaacagagugagacccugucuccaaaaaagaaaaaaaauguccaauuucaacauuuaaaauacaacacuauaacuucucaaagcaaauuauguaaacucuuuuucuaauguuaauuucaaguauacuaauaucuagaggaaagcaacaaauuaagauacagaagugggauucaaagcucugaaaauuucccaaaacaaaaagucacaaacuguuguucgauauuuaacuaaaauucaaugacaugaauuucauucauacaaauaaaaugaagguagaaacaagcuaauguguuagguuaugcuuaauacuuuuucucagagacucggucuaacauaacuucauaaucauaugaucacugaacccuuucagauugaaaauauuuuaauuauuuuuaguaucucaucacaugaaagagaaacagauuaaguugauuuguuacuauaaugcugucuaaauguucuuaagcauuuuuuaaguguguccugggcugcagcaccucugaagucaccgacuguucugcauuucaucacagguguuacuacaguacuucauagaacagauuuugcucaguauucauuaaagacugcccaguauucuuaacgcacacucucuuuuaaagcuagguacagauuucauaguuccaucucuucauucucuucuccuaaaggugacaauuuaagaacuggauggacuuaaauucuaauaagggaguuuuggguagggaaaagaaaauuaaauauuaauucauaauaaaauuauuuagaucaauucagaaaacaauuuagcaucauuuaucuuagaagaaaaaaucuuaagaggaagaauacuaaccacauaagugugauaaaagaggauauaauguagccaaaguaauaaugucauucaguuuuuugauugaagagaaauuaaaaacuuucauauuuaaaggaaaauaucaccaauuaacuuugaauucaggacuuggcguaggaaaaauaaggaugauggacuuggauugguuuugguagacuuuaauuccauuccacauuuucuaagaaagugaaauuaggucaugccagcuauucucacuuuccuuucuagcuggcuuuucucuuuucuucauacacuauuucucuuuagucuuuuuguuucucucuccuaugacuuucccuuaucuuacuccagccaucucuuucccccagggcucugaauguacauucaacauagguucuugcuuuccugacggcuagagagaggacucagagccuucagggucagcuucacuaucugcugucacugcuuagggaaccugucaaggaaucugacugaguuaucuuaggaagagauuuuauuuuugagacagaaucucacuccaucacccaagcuggagugcaguggugugaucucggcucacugcagccucugucucccguguuuaagccauucucaugccucagccucccaagcagcuggaauuacacgugugcaugaccaugccuggcuaauuuuuuuuuuuuuuuguacuuuuuguagagacaggguuucucuauguuggccgggcuggucuugaauuccuggccucaagugauccacccaccucggccucccacaugcugggauuacaggcgugagccaccagacccaaacaggaagagaucauuauucuagguaucuugcuauucccucuaccucagaaucuacuuccaucuauucuuccauugaaaguugaaagguagugguauggcugggcgugguggcucacaccuguaaucccagcacuuugggaggcagagguggacagaucacuugaaguugggaguucaagaacagccuggccaacguggcaaaacccaucucuacuaaaaauauaaaaauaagccagagguugcagugagccaagaucaccucaaagcacuccagccugggugacuaagugaaacuccaucucaaaaaaaaaaaaaaaaaauuaaaagagacagaauacauuucuugcuaacauaaugaaaauucaaagcuaagaaaaagaauagcagccgggcgcaguggcucacacuuguaaucccaggacuuugggaggccgaagcagguggaucaccugaggucaggaguucaagaccagccuggccaacauggugaaaccucgucucuacuaaaaauacgaaaauuaaccaggcagugacaugcacuuguagucccagcuacuugggaggcugaggcuggagaaucacuucaacccaggagguggagguugcagugauacagugggcugagauugcacaacugcacuucagccugggugacacagcaagacuccaucucaggggaaaaaaaaaacaaaaacaacagcagaaugaguacugagcucuaaugccaaauuuagucaauauuuucaugaucuagauagucugcaucagugcucuuuaacugaaacaugaaugugagccacauguacaauuuaaaguuuuucaguaaccauauuuaaaagagcaaaaagaaaggauacuuacuaucauauuggauagcauuggucuaaaaaucagaaagcaguuuacaacaaaccuuacugaaacuggcuuuucaacugcucuugauaaagagcauuuauuuuaaugcuguuucuuagucuagucauugcccuuuccuacugaguaugaaaaauucuaaaauacucuaugauuguaaaaucaauacaucuaagagaaaacuuaccaucucaucuccccagucacccacaccccaccccaaauaaauagcucaucuugacuuccuugucucagaugaugauuuccuuucugucuggcucaaacccaagucaacuuuaauauuuucuucucuucuaccaaagcagaugauugauccuuuuacaguuucucuugcacuugcagugagauaaacuuaauccagguccuaauugggcagaauuauuuguauuucauguaucugaaaacgucuuuggucucugugccucauucuguucacucuauucaacaacugccaagugcuuacuaugugccaggaacaguuuuaggugcuggggauacccuagugaauaccacaaagguccaggucucguggaacuuacaugugaauaggugagagaaucaauauauacuguguagaaguaaauguucugaaggaauacaaaggagaacaaagcauaggaggcuagugaaugaugauggugcuauuuuagagaaaguaaguaaagaaagcucuuuuuguggaguuaagauuugaguagauaacugauuaagugaagggaaaagcugugcagaucucuagaaaguggguuccauguggagggacugguaggugcaaaguccccaagauggguucagcuuguuguguguguuccaagaacugcaaggauccagcauggcuguaaaaaagaaagggagagagugacaggagaugauguuggcaaugcagccagagaccagaucaugagcguacuagaggcuauggcaugaguguggacuguauucuaauugugguagguagucaccaggcaucuugaaacaggauaguaauauaauccaacuuaauauuuuaagagcaucacuuuggcugguuagaaaauaaucuguaggugguaaagaguagaaacaagguaacaguugcaguacaggaaagaacuacaaguguccuggaaucagauggugguagagguaguagggagaagcaggaucuauuuugaagguagagcaguggggacugcugaugaacuaguugucugguguacaagacaggaguccaagauggcugagcaguaaacagugaacggacgcuaguucuagaaagagcaguuuggcugagguugaggggagcuggcgguacaugguauccauucaagaguucaguuccaaacacuuuaauuuagauauuuaaauugaaaugucucuauuucauucuuacuucaauauaaaagucauauuaagcuuccuaaaauaaaauuuucaacauguuauucucuuuuccacaaaccuuugacagaaucucauaguuuaccaaguaaucuuuaaacuccuaagcuuggaagucaagguuuuccacaauaaccucuacccaaacugcccccaacacuguuuuucuuauuacuguauuccucguaaugccugggaaauauacacauauguuuaauaaaauguuuacuaagugaauaaaaaccuuuauauuuuugucacuccucuguguucauccuuugcccuauucaugagucccacuaaagcuggccuccucaaugaaaccuuccccaagcacacuggcuauauuauacuguuucuugacuuuauacuccugaccaguuguaugcugguaaauguuuaacagcucucugaaaagcaaugacccgauuuguagcauuugcugauaucugugauauaaaugcaacuaccacaggagacugcaagucaucaacaugaugucccccaauguggugcugguaagagaggugcacaauuagcuaugaugagcugguaggagccagcaccaacacaucauuacucaguacaaacugcuuggaucauuuuuaaagucaccuacugcacagugacuuuuaaguaccuauauauaaaucuuccuauuagauuguaaauuugugaaguauaaacauugugucagauacagggcuauaaucagcuaaaugacuuugucucaaaguucacaucuacaaaauggagagucagacucaaacuguaaaauuccauaguucugugucucaauggucugugcaucucccuuaauuuuucaguccaaugcuuuaaggcugaauaaguaaaucauuauauuggacccaaaauaaaaucugccuuaaaaaagaugaaagaaaggaacaagugauggcauuuuaaaaucacaaauagaaaauaugaucacagaaaacucuauauaaucacuuuuccuuggauagaguugaagaauaagaauguaguuuuuucgcuuuaaagaauucaaauguauacacugaucaacccaagaagcauaauuagccuuggacuaaaguguaaucauuggacagaaagagagaacacaaugaaauauuaaaaggaaacuaaaagauacaaaauugacugaaucguagcacagaaugaaaauaauagcuuuuggaaaauuccaugaagugaaaaacaucugauucaaguaaaaugaaaauuuuaugcuuuuaaugcucauuuuuagauaggcagcccaugauggccggcuuaaaucuaauuuaacucucaagagauucauaggaaagacaaguuauuucacuccuuuccucuaaauaggaugaaauucagguauguuaagguauaaaaaucucauguuuuucacucagaaauaguuaaaauaugugaaaacgcacauccucugauacuuuuucauagcauaugccucugccuaagcccuagccacuccaauucuauuccugucuuacuccuuuaauaucaugaaucccaagccaugucuguuucccuuaugugcugaaugcugcuggccuugcggggcuaaaggaaaugagugagaccaguaggagugaaggcagugaaaggguccuagggguagggcuggggguggagguuauggggaacagggcuuagcagcaggggcaggcaaguagaaggugguagaggggcuuuagagcacaggcucuagaaauccauccaaaggagucgagacaacaagauccagagccaagaaggaagguuuuguccauaacgacguuccauuuaaaaagaaccacugguccuacuauaauuuuuugucaucuaguaugccuagaaaggaugaaaccuugauagcaucauacccauuuuuacuuuaauggggcaucuuuuugugcacuuguuuucuuaauuuucuucaggcauagacaauccuggagugcaacagcuacuugccaguuucucuauggcaaugcgugugccuaaacaauucagaaguguggaaaaaggaagauauuauaaucuuggaaauggucugauggcauggagcaucacagaauaguuuuaccuuuggaaccaauuaauucccgguuaucuugauauuuaugguuaaucugcuuugaaaauugauuuagaaauucuguaaagcuggcaaaaacuggagcuaauauguaauacauuauuuuaugauauacagaaccacaagaugcaaagcauuagguccucucaggaaagaacugcagaauagacacccaaagaaaaaaagaagaaaacaaaauucagagauguauggauggcaucugacaaacuaauacaagagauuaaaggaauaacaaauaaaacaauuugauagaaaaucggcaggagaagcggugggccacuuuacagugcaaacccagccgaaaacugucuauguucaauacuuucugguugaaaaaauauaucucuauuaaauaaucaaaguaauuuaaucuuucuacgggcagaaucuuacuacucgucuaacaauaggggaucaguagcacccuacccaguaaaaucuguccuugugggucccuaaaaggaauguaaaauaagucuaucauaagcaaugcuaaugugguguccaaauucuaguaaaaguuguucccuuguucuuuuuuuugucugaguuucaagugacugacaaaagcucauauauacacaaauguaaacauacauauguauucucucuuuucagaguaacauuauaauuaugagauacuagacacaaauuggcaggccccaaguauucuugaaagacacugcauguauguagcuauguaacaaaugaucuuacaaaaagucuauccuauuuauuuugaaauucaucaugcucacaaauagaaagauaaugguagguuucuggaacuacauuauugagcugcuucuugucuaaguucugcacuugcuuaucaacuggugauucaugcaguuaauccuauuuaaugacuugcucugcggaagaauguuaagaauuaauaaauuuaaaaguuguguaaaugagugaaaaugugcaaauucuuuuaauuacaguuacaaauguuauggaaauaagcaagcauaacauaagaacacagauuuaggaauacuaccaccuuuuguuuauguuauacucuaaggggcuuaaagcauuuugaaggauagcaggcaacgcuccuuuggugagaaaaguaagcuguucauuuuugguaagugguuuuagguaaucaugauacauauaauaaauucuacccucuguugcccaaacaguaucuaaggacaugaaaaaagauuuuaugcuuucaaaacauagguaacuuucccauuuaaaaucuuaaauauauucaggucaaauauuaaacuaaaaaaucauaauaaauucuucucgguauucagacugcauauauaacaaugauuuagcaaaauguuuuauaaguuuauaaauacaucuuccugguuuuauguauuuuuagaaguuuuaaguuugucccaugaaaaauaacaaaauucagugaauuaacagaguuuuacaauauuugccuagccagagaaugucaagggagaugaaacuucaucauguacacauuauuaauuaccugguuuaagagaucuucuacuuucuucugccaugaaucucuugcugcauuuuucucucgaucuuucaacugcaaaaguugagacauugcugacuucuuauccucuucauguugaagccuuaacucuucacgaaguuuagaacacucuugucuaaaauaaaacaacugcauuuacuuuguaaagagaauuauuccuuucacugacuguaauagagucuacagguuuuuuaagcgcuuaauuaauccucuucaaaagucuaugaugcugaggaaagcagauuauuuacuuaagggcuguaaaguaaauugguaacuuaccccaauaucacucauuuaucaauuuauuaacagcagaauagguaccagaacaaauaagucuucugacuuuagguuaguuuacugccuauuuuauauucaaggaaaugcaaaaaguaaaucugaauucaaacggaaaauaaauccaauuucucugucucuaaucacaggaaauuuuaauuuaaaauacugcuacuaugucuuuaacaauaggauaaugugagucauacaagagaaaaacuuucuugcaugucuuuauugauaagauuacagaauaaaaaauguaccuaagauuuucaguccacuuaauuucuaagucaugggccauuuuguccacuuugagcuucucuucuucuuucauggcagcaauuguuucuucaugcuguugccuuucuuguucuagcucacccugaagaauaaaaacuuuucaaugaagacuaaacuucaaaaacaaacacugcugguuauuuuaaauaaguaaagugcuuguauuaaaacuuuuaauuuuaaauucuuacagcccaauacuugauaaugcuaucugugaaaaugacucaagauuuucugaaaauaaaauauguaaaacaaauuuuauauuuuacauguucuugucuaaacuguauuuuauuaaggcuuauaucacaaauuauuuaaauaguuuaaagucagcauuaaucaucuuaauuacacuuuccauauauuagguaucuaacgguagacugauuauccaauuaccuuuaccuguacacccauuacauagacagauauguuauucaaauucacuuauauucaaaaguauguuacuugcucaaaacuuaaguauauagcuguaccugacaccauaaaaauaauuaugcagaauuuaggcuacuguuuuuauuauguaacugcaaacuagugguccguguguucauuguuauggcaauaugcugcaauauauacacaauuccuguagauuagcaugaaucaaguggcucuguggagccuggggauagaggugaccuguuuggacaacaguggcaaccaucggccccugccagcagagcagcugcucuugggacacaaggcagaagaggagcagaugauggucuaucuuccuguuaucacaaugacccuuucuagaucauccacuugcuaaugacaugugguguggcaguuuuugaaggguauacccagauuaaugagaaaaaaacaagccaauguugaaauugccauucuacauuguuggccuggcuacuaagcaguaaguauugagaauugaaggcagccaucuuagccaacuguucuuuucacuaaguguuuugccucuaguaauucuuuaauuuuccgccaaaggcaacauuaaacggaguagacugcuuaaaauguauuucuuuuccucaaugcaaaguacaucauuagacauuauugggguagguuaaaggaaaagagguaccaaaaaaacacuuggucuuaaggagcuuacgcagaguugugguaaaccaggaugcagcaucuauauuuugucaguuaaaauucuccagcagaacagaaaaugaagaauugauagaguuuugcuuaaaguguuuauuauuuucuacuacuggacagaaguacgauguaaauaugaaaaaagaccugaaagaaaugaaacugaaucaguaagcccaauacucagugccaggacagccgggggaaaggcagccaggauaaaauaccuuaaagucaggaacugggugcgcaccaaggcaagacagaacuuccaugauaccauauaaacacaaccuauauucaauuaacauucauuagaaauauuucaacugucuacuuuuaaauauauuuguauuaccuuaaaauaucauuuuccuuuuauuuguugacaauggaaaaaacaccucuuaauauaguuuggucaucgaguucagcuucacaccacagaaugcuaccaucgagauuauagucaauauauuuggcaucacagaaacuaaauauaucaaguuguauauuauacuagcucuaaauuccaauuauuucuuguuauauauuaacacugucauaucacacagccaccggagaaagguaaacauaaggaaaugauucgaggaaaaugaaguaauuuauugucacauaauucaaaauggaagguaaauauucaaugcacacagaauauaucauagauaaaauauaaauagaauuauguaugccccacacacaagguaaauucacuaaaguguccuuguuuauaugcuuuugaaaugucaccaauucugaacuaaaaaagaaaaucugaaauaauauuaguaaaaggcaguauuuacugaguguuuacuauuuugcuaagcacugugcuauaaaugguucaucucauuuaauuauuacaacagugcugugaagaguguuauuaccccccaccucuccuucauugugcagauguggaaggugaggcuuugcacaaagcuacacacuaugugguggauucagaauuuacauacaaccaaccugacuucagagccuauacucuaaaccaucucucugaaggaaaagauuaagaacuuccuggguacuauacacccaguuuuauggauucuuuuucucuacuaucuaagacaaucuaaaucuuugcugugcuucauaagaguggaagaaaaaaggcagagucuuucugaaaucugcagacacagagaagcacuuaguugcuguauaugagaguucuaccucuuacuaguaaaagaauugcacguuccaauuguuaucgguugaacuggguccccaaaaagauauaccgaaguccuacccucccaauaccucagaaugugacuuuauuuggaaauacagucaguacagauguauuaaguuaagaugaugucaaacuggaguagaaugagcccuuguuccaauaugccugguauccuuuuaagaugugaagauaggcagagauggaaauuauguugccgaaugccaagaaugccuggugcuaccagaagcuggaaaauacaaggacggaucuucccuuagaguuuaggaaggaacauagcugugccaacaccuugauguuggacuucuagccuccagagcuaugagagaauaaauuucuguuguuuuaaauuccccaguuuguaguacuuuguuaugguaguucuaagaacuaauauacuaauuauauacaaugugcuguuuaaauagcucuaggucaaauggcuaaauucuauuuuuauuuugccgcuguuuagauugcaguagaauuaugaaauuaccuccacauuuaauagagcauccuuggucuccuuuaggcugucuuuagucaagucaagcucauucugaagccuuuccugggaguccugaagacuagcaauaaguccuucugcagagccaagaccuuguucacuuuuccuuaccauaucuuggagguggccaaucuguaaguaaauagaguacuuuuaauauauuucauuguaauagaauagcaaaauagucuuacaauuucuuccuaaaguuuuuuauuuaguuguaauuuuacugaauggaugauuuccugauuaauuuggaaaaagcacucaaauaaccaugacagcuuucuucugcuguguuuugaaaagacuuucacauuuaagaucuucuuuuuucaugacaaccauguaaaggaauagauauaccuuuguuuaacaaagagaauuccuaguuccaccauauaauaaaauaccuauaagaagcugaagcaagauaaagauuauauaaaagaguaaaacaaaauuuuagauaaaaauaucuuaaaaaccauccuuuaaaauuuaaucacauauuucauuugaguccauaucuccugcuauuugcaaaggggauaaauuuaggucaauauugauaagcugguaaauguauuauaaacuagaguaaguuaugauuccuguguuuccauacaaaauuucucauuaaaucuuuaagaguugaauuuauacacucgaaauuagaagcuaauagauaauugcugauuaagcauaucccuaccauaaaguuaugaauacuaaaauacauacaugaaauauuucaaauuauuuaggacaaugcuauaaaguaaaaaccgcauucuuauaaaauggccaagccuaugaaauuucuacaaaaguugaaauugguaauuuaaaaauaauaccuauuuuuccuuguaaauacagacauuacaaaaaaaaaauacaaaaauucuccuucaauccuucucugacccacaauucccuccccaagugcacggccuuccuguccccucucuaugcagguauaugcucugcaauacugguggugguaguauuuuaucuugguggugucucuaaaggaaugcuaaucucauaagauaauuaggggagcuacacaucuuuucugugcucugaaauauuuucacagcaaaagaauuaccuguuuuuuaaaaguuugguaaaauucuuccauuaaauaaauuauaaagaauaguauucuagggcugggcgcgguggcuuaugccuguaaucccagcacuuugggaggccgaggcaggcugaucaccugaggucaggaguucaagaccagccuggccaacauggcgaaaccccgucucuacuaaaaauacaaaaaguagccgggugugguggcgcgcgacuguaaucccagcuaccugagaggcugaggcaggggaauugcuugcaccugggaggcagagguugcagugagcgagauugugccacugcauuccagccuggcaacagagcaagacucugccucaagaaaaaaaaaaaacaguauucuaguaacaauguaaagaauucaaagagaaggucuauuaaggcaauuacaaaucuagagauagaauauuuaaauaggcaaaaacuucaaacuucugcaaaguuaaauguaauaaaauauaaaaagcaaauaaguguugaacauaacugaucaguuuguuuucuuaaauacaauaaaaauggauacauggggaaaacaccuauugucucccaauaacaaaaucuccuuauggcauuuggggcaucuacucgccuucucuaucgguccauguggucuuaguaagcgcucaacuuaaacuccagaaugaagugcuucauugaaacguaaaccaauaaggucaucucauuuuguuuguauguggauugguucaggggcaggcacaugguuuaagcuuaucuagucacagugaucucaggacuuuaaaaggagcucccagaaaagguuuuuugccagcuccacguauaccucagggaauaugugauugaagcaugaagucaacacaagaacaaacccaauuuaagagaaaaagaaaagcuggguuccauugucacaauuucaguucugaaucuagucuugccugaugcuaacauuauccuuggacuuuacagucacaugagucaauaaauuuuuuuuucuuuaggcuaguuugagguaggauuucugucauuugcaauagaaauaaauacucagauucuccauauuaauguacaaacugagggaauacaguaaguagaaaccuccucccugaaauauccgucuaccucuauuuguucuucucuaauccacucuccuugcaacacuacagugaguuuuuuauaaauuacaaauauggacacgagcauaagccccauccacugcacaagcauccacauauuuauacuuaucaucuuucaacuguuuuucacugcccuuaggauaacuuucaaaaucuuucauggggcuuacaagaccuccacaacauagccccugcugaaaucuccaaccucagcauggcaucccuucuucuuggucuuuauauacuaauugagagaaagaguaggguuaagaauugaguucugaaagcacacuaccugaaauggaauucuggcuuuaccuacuuauuaugugcugacuugggcaaguuauuuuaacuuuucuaugcuuuaguaacugguaccuacugcacaggguugcugugaggauuaaaggagagaacaguauaaagaggcuauauaaaacaaagucugggacucaguaagcacuaaauaaauauuauuauaguugcuaucacacuccguuuuuucuggugauaugguuuggcuguguccccacccaaaucucaucuugaauuguaacucccacaauucccauauguugagggaggaacccaguaggaggugacugaauuauggggugggucuuuccugcgcuguucuugugauagugaaugagucucaugagaucugaugguuuuuaaaaaaugggaguuucucugcacaagcucucucuuugccugcugccauccauguaagaugugacuugcuccuccuugucuuccaccauguucgugaggccucccuagccauguggaacugugaguccaauuaaaccucuuucuuuuguaaauuaaccagucuuagguaugucuuuaucagcagcaugaaacagacuaauaccacugguauucuuacaauuccuagaaauuucucaugccucagagcguuugcauaagcuuuccuaaauuuauuauuuugacgagcccuuguuaauuacuuaccacccuuuguaauaugccucagacuuguguuuacuuguuuuugugucugucuguccauaguaguagggaccaugucugacugacuuaucacugaaaccgcaguguguaacagugcuuugguaccuaauaggcauuccauauuuauuaaauaaaugaaugagucacuuacagaaaaacuucguauauacuuacuagcaauuaagaauaaaaucucuuuaacaucucagaaugaaaguauuuaacuccuagaaggacccuaaaugccuucacuuucuugaccuuguauuguaccaaggcagcugcuaggccaugugugccucuaagcaggaaaaaggcaauaccccucaguguggaagcagccccagaacauggaaagagaagcaaacaaaacuugugugaacugggagaagacucccuuucuuccaggcagcagacuucagagaaaauuuaaguuuuucuauacuucuucuacuauaaacagugcugaaauuuugucaacaauccguaguuaucugcuuagguuaaauacacaaaaaaaugaaacuguugaguuaaaggacaugccugucuuuaaggcuuucauaugugcugauaaaucccuuucgaggaaaauuauacaauuuugaauccccaucagcaguuucugagugcuuauuucuuuaucguuauuaacacugcauggucucaauuuuuuuaucauuguuaauuuuauggugauggaauggcaucucauugauuucauuuccaguucuuaaauuauacaaauuauuuuuuccugcuuauuuuuagcuuguaaaaagauaaucugggugucuguauuuuucuuauuguuuuguaaauacucuuaaaaguguuaaagacaugaacucuucauuggucaauuugucagucucuucaucucucccaguuuuuccucuuuuuaaauuuugcuuaugguguguuuugauauaaagaaguuuuagcuuuaacuguacaaauauuccauguuucaauucacaacuuugauaucauguucaaacagccuucucuguccucagguuugucauuuuuguuuucauauuuuauuuauauucauauccaugauuuucauauuauauuccaauccuuaacccaccuggaacuuugccgauaugagauugaagaagagcucuaacuucccucuuuucuccucuuucauuuauaucuagucuuaaaagggcaaugucacagacuguaauucaaauuaagccuacugauucuagcuaccauccucaguuucuguugaaauuguagaaaaagaggcaguauagagaauaauaagcuauuuuuuggcaaaaggguagagaacucucucuuguucuuuuccuauguggugauauucuguuuugcuucuccccacaacagcaccuuaguuuaauguuuuugacaguaaauuuuaccugguggaacauaaucagagugucaugaaaaauucaacaccaauuaaaguuuuuaaauuauuuuuauucuagauauguuaccuuuacugagacuuaccuaccuauacaaugucaccagaauaaguuauuauuauuaaaaucuauaacauaggcaacaggucuaaagaauucuugccucuugauuggcuguauucaacuugucuuccaguacuuccuuuagguuuucuagcucuuguugaagcugauuuuuauccucuuccagguuuaguuuaucuuuguuauguuguucuuccaaauccuuagaaaaagaaauuuuuuaaaaauuaacaaaauugcaaguauuauauacuuugaagacucuaagaaaaagacuauucuguuuuguauuuugaaacuuugcucuucaaauuagccuuacccuuaauuaacaauaucugaauuaacagugacacccauaguggcuuagauucuaucauucugacucauuuauaauguaguuauacuuuuuuuaaauggugagaacaugugacuggacuagaucaagcugaaguccaaaaacagaaaagugugagauaaaaaauucuaauuaccucuugaauucaaaauucuuuuuuucccucaaauucuuuuauguuugcauaaaaaaugaaauccagugacacuucuacaaaucaguggucuagcacuggaacacaguagagaaugagcaaguauaaaaugaaggcaaauuaaagagcaaaacugguaaaacugauaauuacugaagaucacuuacuauuugccaggcaugcuacuuaacacuuggguaacaaaggcaauaagauauggagccugcccuuaauaagcucaugguaucaaacaauuaaagaauauuaacuaaauuagacaugcauagggaguacgggaguauauggaaggggaacuaauaacgucuagcuuggcagggaaaccuuuagagagaaagcaauuccuaagcaugguuugaaggaagaaaaggugauggagcaggaggggaacaucacauucuaggcacgggaaaaagcaugugcuaaggcuuuuucacaccacaaagggacaaaggagcacaguauguuacaagcaguucaauauuucuguaguguaaaaugagaagaagaaucaauaggguucugugucagaggaccccaagacaaacccaaguuugaugauuuacauucacggguauagucacacucauggcugugauuauggcacaggacucaaagcacacaccacaaaggaaaaagacacauggggugaagucugccagaaaccagacacagguacaaaguuuccaaaagcccucucacacaggacacacuuaauaccuccagacaccuguaacaacuugugugaaauguuguccuuauacaagacaggcugaauaccuccagcaaccugugacaauuugugugaaauguugucuacuaggaaagcucaugagagacuuaguacccagguuuuuuaucggcaacugaucauacagguaccaucuuccugucacaugucaaaauuccagauucccagaaggaaagcagguguucagcauaaaccacauuggcugugugguuaggccacagcuuaggccagugagucauucuuauuagggaauggggggaucuccagaaauccaaguucccagaugccagccaagggccaacuugccuuucuaaggaugguagccucaagccuccuauguuaacaguuuucugcauggguucucuguauauucacucucaguuguggugggucaacuacaguuauggacaguacaauccuuuuugauaacucaauaauaagacaauagaagucgucuucagcuaaauguuccuuaagagagaaucugacacuagaggaagacuauuuuggaaggaggcugguuucagcucagguucagacaugagguagacaggcaagaguggaagaaagagcaagugauacacaaguuacucugauaaaaaaaaaaagaaggguagaaauaaugcugcaauaggguggugaauauauucaccuauaggaaauuucaugucaucugucuuacggcaaccauguuuuaaagaaagacuuuaagaaauuuaauuagcuuaaggcaggugcuagaaaauuaaaauuuaaucaggugaagggauaaugaggaguaaaguaaugagguaaaaaugacguugaugaaagaugccucaauucuagcacuuauaacuuaauagagaggaauaaaggcuaaaggcaggacauaugcaauuuaaauauuccaauaagaaagaaaguggcuacagugaaaaugaauguagaaaugaaaaguaauaccaaaagauagcuaggaaacagaguacagaagaagcaguuaccaugaaacacuuuucuauaaaacucugaacacgugauacaggcacccagaacugcuaagcaugcacaugccucacuaacuaaugcugugcaaacugguucuggaauagugaccuggcacagagaauacuacagucagagucuugagaaauaacaugucauuaauuuuugucucuggcuacauaaacauauaguaguaaguuuaguaagaaauaacauucuaaugggaaguuuuauuugaauuuuaaauuaaguuuaggucuuaaauauuuuucccaacuagucaugucacaaaaggaaagcacacugaggcagaucucaauucauauccuaucucuucuuaauagcgcuguggcucucacgaaaucaucgagguuuauuaaaccuauuuuaccaucuauauaauaaaaaugacuuuaaucuccaagucguaaguauuaagguauauauaaaaaagcucuuuguaaacuguaaaguaccauuagugaaauauauaacaaccaucauuacuaaaugccuacaugaugguauuuagaugucugggauuugacagaucuggaaccugaguucaaggccugacugagucuuacuaguugcaugugcuugagcacauccccucuucaguaaaauguguagagaaaucaaaccaaagugucauaagaauuagauuuuuuaaaagaugcaaaacauuacuguaguaugugguacauaguaagaaguacuaauaacuaauuuuuaucaucaugugcuagaacauggcuugguacucaacacuuuaucugacuuaauccucgaaggaacauuuuaaguugaaucauaucuuuugucagaugaggagccuaaggcauagcuuuugaggcccaaaguaauacaguuaauaggcaaagagcucaguguaaggccaaggucugucagauacuuugcuuuuucuacucugcaauucugucugucauauauuacuauuagcaagcugaauacuuaauuguggaagaaacaaacaaaacaaaacauaaaucauuuucucaaagaagaaaacuaucuacgagagaauacauacuuucaacuaguugaggcuuccugaagagcacaccuauuaaauugucucaugaagagacagcucaagaacaaaaacaguguuucuauuauggcuuauaugaaguagcaaugucuuaaauaaauucaauaagcuauaucucauuucaagaacuaccagguauguuacucuuugaaccaugacuucaagaaugauuacaagacagaaaccaucaaaaugaaggaaaucagcugagugcgguagcucacaccuauaauuccagcauuuugggaggcugaggugggaggaucacuugaggucaggaguucgagaccagccuggccaacauggugaaacccugucuguacuaaaaauacaaaaauuagccaggugugguggcaugcgccuguagucccagcuacucaggaggcugaggcaggagacuuguuugaaccugggagguggagguugcaaugagccgagauugugccacugcacugcacuccagacugagagacagagcgagacucugucucaaaaaaaaaaaagaaaaagaaaagaaaagcagcagcagcagcaaaucauugcucuacaauauaggucacacuggacuacugagaggugacagugugcuggcaguccucagagcccucgcuugcucucggcgccuccucugccuggguucccacucugguggcacuugaggagcccuucggccugccgcugcacugcgggagccccuuucuggacuggccaaggccagagccggcucccucaacuugcagggagguguggagggagaggcacaagcaggaauugaggcugcacgcagcacuugcgggccagcuggaguucugggugggugugggcuuggcgggccccacacucagagcggccggccggcccugcgggccccgggcagugaggggcuuagcacccgggccagcggcugcggaggguguacugggucccccagcagugccagcccaccgaugcugcacucgauuuuuugccgggccuuagcugccuucccacggggcaggccucgggacugcagcccgccaugccugagccuucccccgccuccguggguuccugugcaacccgagccucccccgacgaaugcugcccccugcuccacggcgcccagucccaucgaccgcccaagggcugaggagugcgagcacauggcacggaacuggcaggcagcuccaccugcagccccggugcgggauccacuaggugaagccagcugggcuccugagucugguggggaccuggagagucuuuaugucuagcucagggauuguaaauacaccaaucagcacccuguguuuagcucaagguuugugagugcaccaaucgacacucuguaucuagcugcucugguggggccuuggagaaccuuuaugucuagcucagggauuguaaauacaccaaucgacacucuguaucuagcucaagguuuguaaacacaccaaucagcacccuguguuuagcucaagguuugugagugcaccaauugacacucuguaucuagcugcucugguggggccuuggagaaccugugugugaaacucuguaacuaacuaaucugaugggaauguggagaaccuuuguaucuagcucagggauuguaaaugcaccaaucagcgcccugacaaaacaggccacucagcucuaccaaucagcaggauguggguggggccagauaagagaauaaaagcaggcugcccgagccagcauugacaacccgcucggguccccuuccacacuguggaagcuuuguucuuucacucuuugcaauaaaucuugcuacugcucacucuuuggguccacgcugcuuuuaugagcuguaacacucaccacgaagaucugcagcuucacuccugagccuagcaagaccacgagcccacugggaggaacgaacaacuccagacgcgcuaccuuaagagcuguaacacucaccgcgaaggucugcagcuucacuccugagccagugagaccaccaacccaccagaaggaagaaacuccgaacacaucugaacaucagaaggggcagacuccagacgcgccaccuuaagagcuguaacacucaccgcggggguccguggguuuauucuugaagucagugagaccaagaacccaccaauuccggacacacuacuacagaaauaucaucaauuuacaaugcaaugauaaauuaaauuuuuacucaccauuugcaguuuuuucuuaucccuaauugcauuacuguggacagcuucaauugccauauggugcuuccaagcuaauucuuccaaagucuuagaaugggccucguuuaauugagucaccuccucuuccaaucuacuuugcagguuuuuaaguucccuuucauaauauucuugcugaguucucuuugcuucauuuacuuucuaaaauuaaaacaaagaucaauaaucggcaccugcuuuuuucauuacuguuauuaggguaauuugaauacccuauaaauauggaagcuugaauaaacugagugcuacgggaucuagacuaugaaacaugacaacaaaucauuaguguucucagaaagugaaaggggagccuauacaaaaucaaaaauguuaaagcaagagauaaaauagacuauuaucauauuagaccaaaugugaguuaauacaucugcaagcuuaagaguaaagggcugggccgggugcaguggcucacgccuguaaucccagcacuuugggaggccgaggcggguggaucacgaggucaggagaucaagaccauccuggcuaacacggugaaaccccgucucuacuaaaaauacaaaaaauuagcugggcgcgguggcgggugccuguagucccagcuacuugggaggcugaggcaggagaauggcgugaaacugggagacagaguuugcagugagcugagauugcaccacugcacuccagccugggcgacagagcgagacuccaucucaaaaaaaaaaaaaagaguaaagggcuuccuuuuaugucaaaauaguacacaaaauggcuuaccaguuaacccacucaaaggauaucacucaauacaauuuugaaugccaauuacguaccuuuugggcauucacaguucuaauaaugaaaaaaauacaaagacuauggcaauauaguuuuauaaguucuaugaaaaagggauguugacacagguuuggauuuuuuugucuccaccagaucucauguugaaaugugaccuccaauguuggagaugugacuagugggaggugucuggaucauggggguaaaucccauaugaauagcuuggugcuguccuugcaauaaugagugagcucucacucuaugaguuuaugugagaucugguuguuuaaaggagccuggcaccuccuuccucucucucgcucucucucuuguccugugacaugcuggcuccccuccuccuuccagcaugauuguaagcuuccugaggccucaccagaaacagaugccaguacuacauuucaugcacggaccgcagaacugcaagccaaauauccgucuucucuucauaaauuacccagucucagguauucccuuacagcaaugcaaaaugaacuaaugcagauguauaucccguguuaugggaguauauuagaaggaugccuaacuuggacgcggugagaaagugcaugugcgugugcauguguguguguguuucagagagagagagacaaagacagagacagagagauaucagggaaggcuuuucagaagagaaagcaucugagcuggugaugacauucucucauuuaauucuuacaacaaccccagaggaaauuaaugauaagaaaaugucaagccuaggucuguugucaaaagccuacauucauaacuguuucuauuguugugcagcauuggaaagauggcaaguagcuaaccagaugggaaaguuuagggagacagaaagucugugcagcuaagcagucuggauagaauacaggauacaaggugauaaaguggugaaagacggggcucagaaguaggcaggaauaaaauaaugagauggggucuuuuacaccaagaacuuugaauuuucuucugaagggacugagaaaucacugaaguuuuaagcaaauuauauacuuuuaaaaacaaucaucuuggaagcaggcuggugagccaacugaaaucagagauugcugcuaggcaguugugacuauaauccaggcaagcaaugacacgugccuaaaccucggaucuauaaauggguaugagcaggggaggauggaauaaaaauauauuaaggaaguagaaccaacaggacucuguaacagauaaaggggcugagaaaacaguaaucaagaaugacuuucagcuuuuugauuuagcaacuagauagacaguggugcuauugguugaaauaaggaguaaaagaaacuuaguacuuuugagaggagaaaguucugggcaugguaacuugauguuugugaaaaacauaaauggagauaucuaguggaaaggauaaaagacuuaaauucagagaaaaugucuggccuggaccuaaagauuuagaagcuaucacugaauaagugacaguugauguuacuggaaugaaugagugcguagaauuagaugaaaauacuggaaacaucaaugguaagggaacagauggaggagggaaguucacaaagaagacuguaaggccaaggagguacgagaaaaaugugaaagaaugugaaauaccaagagaugagagauuguaaaucaguggguaguaaguaccacaguaagauaugauccaccaaguccaccaaucaggauggcacugagggcugaggcaaaagcaaauucuguggacugauggucagagaggacugcaccagguuaaggaaugaauggaaguaaguaaagagcaaagagaauagauauuuucaaaauacuuagacguugagggaaagagaaagaaaaguauguccaaaacucccacuugguauugugggcaucugaaaaacuggaauacauauucagcaauuacucuauaaaugauguuucacuuguuaaacuagaaauucaauuaucuugguauacauuuucagagcuugaagcuugucauauuuucaguucuacagaaauuuccuacauggauaugcaguaauauauuucauuaauagaaaacgaauaaugauuauaaguauacacuccacugaaauaagaguuuauucaauuucuggcuugaaauagguugaaaugucuuaaaguuuuuauauuauauagauuguuacccacauauuuugaacauacauacagcauaggauagucuagcuauauacccauuuccucaaaauuagaaccaaaaauaacuacuaaaguaggaaauguauuguuacuggggaguagcaagaaauacuccaaauacuucaaaugugaaaaagagaaaaacggaacucuuucggggggaauggaguguccauuacuuuuuaccuucuccaguucuagaaucuguugcuucugcucuucauccagacuuuggguuuugcuucgcaaaaaagcucuuuccucuucaaguugagauaaucucucauugacucucgauuuuucugauucuaaaucuuuaauuguaacuuccugggucauuugaguugcuugaagcauuccaauaugaccuaucccccaaaaagaaaaucccuucaauuuaaaaaucaguuguacuaugagauaaacaguuuacauuuaauaacacaacuguacuuuauacuuaaguaaaauaaauggucuacauguacaaauuuuccuuuuguuucuucacuacauaaaauggaaauauuuacaugaaaauacuucuuagcgcacuagaauaauuuaaauuaaaacgucauuuucacaugauuaauguugcuuccugcaccucguaccguuuuacugguuuuuuuuguuuuuguuuuuguuuuuuuaagauugcaagcuaaacagguugaaguaggcgcaacuccucaguaggcuucauaagaaagucuccugggaauaaaagaaggacggagaggaugcacugacugacacuguggcgccaaaaugagugauucguucuuuucuaauuuauuuucaaauucuaacauaaaaaggaagaaguuuguauguaggaaacaaagauggcagauagcaguuugguugaaauugaauuuguuucaggcaagaggccagauaaagaccuaaaguggagcuuguaguuccagcuacuugggagguugagaugggaggauuguuugagcccaggaguucaagguugcagugagcuaugacugcaccuguaacagccacugcacuauguccugcaacauagcgagaccucaucuccaaauaaaaacaaccaaccaaccaacaacuaaggugauguaagacacagauaaagacagcaagguuaugaaagaaucucuuaaaugacagcaaaaagcagggaagguggagaaaaaugaggagagacagagagaugaaaagugagugaagaaaaaggucucauagaaaggauaguuuaaggcagagguucucaaaguacccaggaccagcaucaccagcaucaccugggaacucugguuagaaaugugacccaccccagaccuaaaagugaaucagaaacucugaggguggggcccagcaucuguaguuucacaaacccuucaggucacuccaaugugcacuaaaggcuauuaaaaacaacuauuuuagaggaaggaaaaucugagauucacugauaagccaaucaaaaucaaaugagauccucaaagaaccagcucaaacagccuuccugggcacacuaaacacuuagacaaaauauaacuucagaacugacacaagucacccacuuccuccaguaaugguugugaaaaagcauaccagccacuugagaaauaggcaagucagcuuuaguauguaaaaaugaaccuuaguaacaagcccuaagaaaugaacugcuguaauuuacaaacuucaacuaauuugagcacuuuaaaauguguauuuuuucagugagaccucaucuuuaaaaaaguuagcccguggcauaccuagagucccagcuacugggaaggcuaaggcaagaggauuacuuaagcccaggaguuuuaggcugcagugagcuaugaucaggccacugcacucaagccugagcaacagaacaagaucccaucucuaaaaacuaaauaaaugcuggcaugguggcucacaccugaaaucccagcacuuugggaggccaaggugggagaacugcuagagcccaggaguuugaggucacccuaggcaacauggcaagaccccgucuuuacaaaaaauuaaaaaauuagccagccaagguggugcaugccuguggucccagcuacucaggaagcugaagugggaggaucacuugagcccaggaaguccaggcuacagugaguuguguucaugccacugcacuccagucuaggugacagaacaagaccuugucucaaaaaauaaaauaaaauaaaauguauauuuuuaaaggacaacaccucuugaaaagugugcuucauuuuucguucuuucuuuuuuuuuuuuuuuuuuuuuuuuugauacagccuugcucuguugcucaggcugaagugcacuggcgcaaucucggcucacugcaaccucugccaccagguucaaguaauucucaugccucagccuccuuaguagcuggaauuacaaguguguaccaccaugcccagcuaauuuuuguuauuuuuaguagagaugugguuucaccucguuggucaggcuggucucaaaccucuggccacaagugaucugcccacuuuggccucccaaagugcugagauuauagguguaagccaccaugcccagcccguuuuucuuuuagugacuacuuuauugguauuuuaccugcuauugguauuuuuccucacaaaggaaaacucucaaguuuucuauaaaaauauauuccuaaaaauaaaaaauauuuguguaucuuauaaguaauuaguaacauauugaguccuuuaacuuauuuacagucuaaauaguuuuaaaauguuagaagaaaaaauaaaugcuaccuuaaauuaacauuuaaguguuggggccgagcgugguggcucaugccuguaaucccagcacuuugggaggcugaggcagggagacugccugagcucaggaguucgagaccagccugggcaacacggugaaacuccaucucuacuaaaaauacaaaaaaauuagccaagcaugguggcgggcaccuguagucccagcuacucaggaagcugaggcaggagaauugcuugaacccaggaggcagagguugcaaugagccgagauugagccacugcacucccgucugggcgacagagcaagacucugucuccaaaaaaauaaauaaauaaaguguugauuuuagcuaagcauuacaucaaaaacuguggucacacauacuagcuuugaggacaagaucugaagcuugcuguuguaaacguucucuggcagcugcuagcucacuuuccacuucuuugugcuugcuuaauagggccauuucucccuccuuggcaucaucaagcuguuuuugaagaaccuaagaaagauuaaauagccauuguuaaaaugcaggaauaauacuaagcuaaauaauucauuuaaauuauaagggucagcuuucucuuauucagaagucauacuaaacuauauaccaauuuuuaaaucuguaaguauuagugauuuauaacuugauguuuucauaaacaugacccaaucaggaaaggcuauuccacacuuucuaauccauucuaauguugcacagauauuaaaaacauggcuaugaaauuuucuaagccaacaaaacaaaacuuguggacuuccggcauuuuuuucccccagacuugugcaauaccccuauuaaauucagguuuagaaagcaagcaauuucuugaucaaauucuaaauaucagcuagcaggcaaaccauuauuagugaaaggaaaagaaaaaaauguauuuaaacuuuaagcccaauauuaaaauccuuuuguaaauaauuagcaauauuguccgcccccccccccaggaacagcguauuaccucgcuaagcucacucacccaggcugguuucuaacaccuggccugaagcgauccuccugccugggccccccaaagugcugggauuacagguguguaccacugugccuagccaauaauuagacaagguuuuaagcuugucuuuuugggccccuaauaucugaaagucugaaauaacaacuacaggguaauacaaauuauccugucauugauuuuucucacaaaggaaaagcaggaaaaguuaaaaaaaaaaaaaaaaaaaagucuaaguggugugaagccacugauucuaagugggccagacugcucuccagccuacaaaacaaauauuuuuaaaagaaaaaaaauccauguguugaauauaauauucuuuacuuaccugaacauuguucucugcuauggcaagugccgucugaagcuuuuggcauuugucaagaagacuuccagcuucauccuguaccaucuguaacucugucuuuaauuuuccuauaguuuuucguaaaauugcuucuugucccugaaauucuuuucuaagaucagcuuccuuuucuuugcuggccuguaggcuuucugcuguaaaaagcugugaccuuuucaaaguaucaagcucacguucauaaaaggacugagcuuuauucaacuugccuucauaauccucaauuaguuucuuccguucaagucuuagcuccucaagcauuuuguuuagggacuccaccuccauucuguguaguuccucugccuuuuccuggccuuuauuuacugaggcacugugauccugcugugacuucaauagcucuuguaucucccgucugugagcagcuugcaagucuuccaaugccaaucguuugucuuuuucaaacuguacuugaaguuguccaaagcuccguaauuuuucuucaaauuuccuucuaaucucuucgacuucucuagacauggucacuaugcguuggacaugcugggcuucugcacaaaguugcauguccucaacucugugcuuauaagcuucaaauucugucaaagccugcugcuucauuuuuaugugaucuucuaaugaugauucuaaaacuugaaucuuucuucuaaggucuagcuccucuguuacuuugcuuuuauacugcaauauuuuuucucuuguuucagcaagaauuuguugaauuucuucuucaugagcaucuuugagggcuugaauugcagauucaugcucaucauuuuuaguguuuaaagcauauauuaccugcaugguuuugaauaagaagggagaaggauugugaauccauauuauuuucuaacuugaagucaauucuuucauuuggauugauauuuuucuaugcacauaauauuggcuacagcuaauguuaaauauggaaucuugaugcaauuguuuuuuuacucauagauugauuugcuuagcaaauuucuaucuuagcacagucuuaagauuuguauuuaaagacuuuuuaguuauaauuuuaaaacauucaaauuuaagacuauuuuuuacuacaaaugaaacagcaaagaggaaauggacaaaggaggcaauuggccuaagagaaaggaguucucauaugucccaaucuagcuuaccggggacugugaagggguguucaggagaaaaagucucauaguaagacucugcccuauauugguguccuagagauacgagaggcuucacaugaagagaagcccuaggcccuaagucuucccaaaagccuuuuaucuuuguaauggccuguuuaaauauuucaaauuuuaaacuuuccuuucccaauuccccuauaguuugcuucuaaagcugauccucuucucucuucaaguuucuagugaucucuuuauaaaauccaauuuguacuuuuucucuucauauuucaaaugcuguaguuuuacucuuuggcuaauuuucucucugccuccaagcaacccaauuccuuaagccagaguuuugaguacaggucuuuauuuucauuuuaguuccuagguuuuaaugauuucacugagaugucccaaccuuaauuucaaaugacaacaaauucccugcacaguaacacucuccuuccuucccucuguuccucggaugccauccaucaugccacuguggucacacggugaaauuuucaugacuguuauuuaaggcuuugagaugagcccacuuucuucccccggaagcgaaaagaaguaaacacuguacaaucaaaaaauccagcagcuaaaaaucagugucuggagauuugcucauuuuaaugugauauuacucuggcuuuagaaaugaauuccagcaucagauaccagaaacugcaguuaugauggaaaacugcugccauuuuuuguagagaaauuauucaugcagccugagguaacuguggcagacuggcuggcucuccaaauaccacaguaacuccagaucccacucgcuaaagauaggcugucacugucugggacagcaguugugcuugcaaaagaaacaagaaggcugccucaacacaggggcaucacuuucuccacauagggcuuugucuuccagauccaguggcccuguccauauacucgcuuagucugccaucauaccaaagguaaaaagauugagagauggcaggaacccaucugucuugccaugcuaucccuuuuugcaaagucuacaggaaaaaaugugaacagaaguacuuauucacauucuguuuuuaaaaaacccuaauuucaaauuccaaauuauguucccaauaagguaacacagaucccaagcaggacuccuucauuuacacauuuacucauaaagguagcuuauaagccaagaaagcugacugacuuccuauucccauccccuugggucauauccgcccaccaagucaaauggccauaaaagacugaaaggaucugugauauaacaaguguaccaaaaauauaauucuaagcccccaaccgauugaacggacccuccucuuagccaaguggaccccaaagaaaccugaaaaaauaguuuaggccaugacugaaagggaggggucagacaugccucauuauggauuggacaugcugggcuuuucugcacucuauacuucgggauuuagacacaacugaccgacguuaacauuaaaacagagaucauaagacugacaaaacagacucuucauagcaauaaaauaccaaauuccaaacaacaucaugugauacuauaccaagagucagguuggaguuugguauuuuauugcaagcccugaagaaaaucaaaguauuuuacccuaaaauuuuuuuguuugacauuccauauucugaaaugccccuguaaagcugccuccuguaaaguaaauuugcauucuguagagaaucuccuucccauacucggucuucuccagagagcaugacaccuuuuaaggucugauaagagauauuuaccaucuauucucucugaagccugcuaccuggaggccucaucuacaugacaagaaccuuggcguccacaacccccuuaucuaacuaaacucaagcauuucuuuaugcugaauucaacucuuuagucagggcuuaccucuuucaaccaauugccaaucaggaaaucucugaauccaccuaugaccuaaaaccucccucacgcccaccuagagaugucccacuuuccaggcugaacauuacacauacugauuuaugucuuugccuguaacuucugucucccuacaauguauaaaccaaguuguaaccaaaccaccuugcgcauauguucucaagauucccugaggcugugucacagaccauggucuuuaaguuuggcaaaauaaaccucuaaauugacugagaccugucucacauacuuuuugguuuacauaagaaauauauauuuggucucuucccccaguuccugacauagagcuccuaagacuuuuguaauuuccugugcgauaggaucauuggacacagugaaauauagcagggaccccaccucuccuuuuagggaccugcaaacccccaaacauggaaauaaaggaaaaccccaaaguuccuuuaagaaacauuccaggcaucuagcuagccccggagguaauucaguaacuuguuaaacgaaaagguagcagaacaauagccaaggaaguuaaagcuccagagauguuugcuuuuccuacagaaacuaaagauaacauccuaacauacauccuugaguugucuuuuagaggcuugaaaccccacugaauggaucugcuggcauacagacuccagauaagggggaaaugaagacuaaauuuuagcuauuacccuuuguuuuauuaguaaguuucuuccugaggaacuuagagaaagucauucccucuagcaagucagcauuuuucuacugaacuuaaauguuuuaaacaaagcuucccuuccuuaaucaacugcaaauccgaagaguucugaaucuaccuaccaucugugagugccccccacuucaaauguccugcccuuuuaagcuuaagccaauguguaaccuccuuguauugauuuaugauuuugccuguagcuucugcuuucuugaaauuuaccccugccuuuaaaaauccuugccugcaagccuaaaaauccuugccugcaagccaucagggaggccagauuugagcauuuagcuggcuggucccccccugcuuagcacucugcaauaggcaacuuucugucacugcaaaaaccuugauguguguuuucacugugccaguugagcagacuccaguucuguucuuuaacagcagagcuccuaaaucccuuggaaucucuugcgggauaggagcaucuuuuguucuaaugacaugacuccuagugggcucuugggaaggccucaggauuggggcuggcugccagaggaacccaucaugugacuauacaguuggaacuuccagccccauacaggguccucuagggaggagacaaggucggagaguugaguugaucaccaacaaccaaugauuuaaucaaccaugccuacacagcggagccuucauaaaaacacaaaagucaaguuuccagauuucugaacacguggaggugcugggaggguggcaugccuggaaaaugcaaagaaacuccacauuccuucccacagacccugcccuaugcaucucuucccucuaacuaacuucuucuguacccuauaaauggggguaaacauguuuuucugaguucugagagccauucuagcaaauuaauccaacccaagggaggguagugugaacccucuacuuacuuuuuugccagaagaacuugcaguuggcaucugaaugagggcagucuugugggauugagccuuuaaccuguggaaucugaugcuaucuucaggcagauagugucagaaaugaacugaauuauaguauacucauuugguguccacuagagaacugguuguugggagagaaaauccacacacauuuuggugaccagaggugagguguuauguguucuauccaguguaaggguaggaaaaccuguuuuuuccuaucucauauagggacacuaaggaaaaacaagccaaccagccagagagaagcccauuugcuagagugccuagagcaacacugguauaggccacaggcuucaggccuuuccaaggcuggucaguccuagccacaaggaaggaaaagagaauucaacgagguaaaauccaaagagagaacuaagucacaucauuagcauucugugcauucuguuccaggaaaugaucugggaaagaaccagucccugguggaauucauauuuuggggaugaaaugagggaaggaggaaauaugugaguuuccccuugucgacaauuuauugaaauaaucuucucuuuuuucuaauauuaaauuucccucgaagcuuugaugaaucaguuccaguccugccuccuuuaaugagucuuccaugaccacccaaauccauaagagucuaucuuuucuuuauaucuagaaccuccauugccuuaccucacucacuccugauugucaguaaauauauaauuaaauuuggaggagucuugauaagguuggaaagauguaugaggauauuagagacccuaaaaagaagcugaagauauaaaagcacgguagcaaucaaaaaggugaaauuuaaaaagaaaaauguacaaauuaaagcauuaaguuagaauaggauuuaaguaaacaaaacauggcaaauaauuuaaaaaauauuauagugaggagcuuuuauuucacuugacauucuaaugcaggaguuagcaaacuacaaccuguaggccaaauauggcugcugcuugucuuuguauuaauaaauaaaauauuauuggagcacaguuauguccacuuguuuauguauugccuauagcugcuuucccacuaugacagcaaaguugaguaguuguggaaaacaccuuauuacaaacuccuguucuaaucuauacauagaaaagccaucuuaucagccaaaauuggcagccacaaauaaaaaauaauaaaagaucuaaauuugcaauagcuugguuuacucccuauuaaauaguacaggguucuuuccacuaccacucauacacugagaaaaccaauuaagagauucuggaagcauauuuuauaaaagaauauauauucaugcugaccauauauugguauuucccaaggaaagccauguuaaauaaguuucuaaaaacuuaaaaagaaauaacaaaaugaagccaaacauaauaacaaauuaauacugcuuucauuagugaucacuugaaauacaccacuacuaacuuauuuuuaaguaagaaugcuacauaugaauuuucaaguugagcuuaacuggauauaguauccucuaauuguucauuuuucuauguaauuauaaagguaacuauuuauuaguguccuucucugaacacuauuuuucagaucaagguaauauaaaaauucccuauguucuuugaacauacagaagauauaacaaagguuugacacuagauaaaaucacuuaauuucuucaagcuuugaguuucucaaauauuaaauaaagaucauauuaucuaccuuagcagcaccauugauauaagaucaacugaucacugaaauuucaaaaauugauguuauguaacuauuuaaaaauauauauguaaggcacuaaaacaugguaagacuuccuuauuaguuguauuauuuauuuauggagagggugagacuaauuuuaaaaggaacuuuaguaaaugaucauaaucacccauaaaauuggcuauuuuuuuacaaauagaaaaaaaaacucucuuaaagucucuuuucauaaaguacuuuaaaagacauuaagaaacauuugcacuuuuuauggaacuaugaacauucaugggauggaauaguauaggaaucauuucagcaauuucauaguucauuuuaugaacuauguaacauuucauaguuccguuuuaugccaaugaugcauaauuuaacuacguauuuaaugaugaauaagcaauaguaauuuuuacuuuuccuauaaaucuuuuacuuuuaacuauguauuucaugaugaauaagcaauaguaauuuuuacuuuuccuaugauaaaucuuuuuuuuccuaugauaaaucagauaaucuuucccccagguaaaaugugaacaauucuagauccuagguuuaacaugauacuuagguaaaauaagaaguuucugaaauaguccucauuuaugccugcucuggaccaaauugccuaccucaaaaauucuuauguugaagcccuaacgcccaauaugaugguauuuggagacgggaccuuugggagguaauuagguuuagaugagaccaacaaaguggagcccucauucugggacuggugcuauuacaugaagagacaccagagagacugccucugcucucucucuguagugugacgacacaucaagaaggugaccaccugcaagccaggaacagagcgcucacuguggaacugaauuggcugcuaccuugaucuuggacuucccagcucccagacuguaagaaauaaauuuuuauuguuugagccacucaguccagguuauuacauuauggcagcucaagcugaauaauaucuuggcaauauguaaauacguucccauuaaaaucuaacucauuagucauaagauaaauucacugaaagaguaauaaagcacauuuguaauaacauacauucacuaaagugauauauauuagcuuaguaauguaaaacauuuuaacuggaccuuaauuguugcauauuacaccaacaggcuuaacauugcuaagguaagggaaucacugaauaaaugaugguauauucauacaguguaauaccaugaaaccaucaaaagcacauuucauuuggaagaguauuucacaauauaagaaaaaaugauauaaggcaaguauacaacguuacauacaauaagaucccauuuuacaggaggaaaaagugaguacagauauauagauauagauauguaaagaaauaaaccaggccuggcacgauggcucacuccuguaauaccagcacuucgggaggccuaggugggcggauuaccugagaucaggaguucaagaccagccuggccaacauggcgaaacccuaucuuuacuaaaaauacaaaaauuagcugggcauggugguacgugccuauaaucccagacacuugggaggcugaggcagaagaauugcuugaaccugagaggcggagguugcagugagccaagaucaugcuacugcacuccaaccugggcaacaaaguaacucugucucaaaacaaaaaaaaaaagaaaagaaauaaaccaaauuuuuaccgaugagauuucaguauuucuacacauucuauaaugaauguauguuccuauuauaaucagaaaauauuagaccuuuuuaauaaguuaacagugacugccagucucagucucauuuuuuuacuauuaaauucuggauacugcuucucuaucccuuccagaccagggagggggugggggagggggagagggagagggaagagggagaggaagaggaagagggagagggagagggagagggaagagaaggagaaggagaaggaagaggaggaagaggaggagaagagcaggagaagaggggggagagggagggggaggaggaggaggaagggaggaaaagaggaagggagggagcagggagguggaaagggaagggaagaaaaagggugggaaaagacucucccucagaauacauaaccacuacaugaggcaaaagguagcuuaccaaguuaauaaaagaguaaucucggauucaguaauuguuuaaaaauagaucugguacauuuuaaacaaagagaauguuuguauuauuaaaucuucaauucuucuaguugagcuaaucaccaaaagguuacuugagccauaagacaucagaguuaaagaauauugaaaacucucaaacuucucaaaaacaguggguuacuuccuucugccagaggcuauucuaucgguuccagagcaggaacauacacuaaaccucuguaccucaauuuauauucaaugguacucccagaccagccuuauaaauauaauuuuuuugcaaauuauccaauuuauuaaaaaaauuauuaaauauuccugaugagcccuaaguagcuuacuaagggaaucuuauguuucuauaaaaugggucacuguuuggagccgggguauuagcaccacaucucaauaugucauccuuacuguauaagggcauguuaauaaaauguuuuuaaaacuggcuugcuucggaggugaugaaauugcacaaauccuuccauauuuucuuaccuauuuuacuggugaucaauaacagcacacauuuaugcuaccuaaauuaucuggaugacaggaucaaucacugcaacauaagaaaaggccaggugcgguggcucacgccuguaauuccagcacuuugggaggccaagguggucaaaucaugaggucaggaguucaagaccagccuggucaacauggugaaaccccgucucuacuaaaaauacaaaaaauuaucugggcguaguggcaggugccuguauucccagcuacucaggaggcugaggccggagaaucgcuuguacccaggagguggagguugcagugagccaagauuaugccgcugcacuccagcccggacgacagagugagacuccgucucaaaaaaaaaaaaaagaaagaaagaaacuaaagaaguuacagaauuaggccacugcgguggcucacaccuguaaucccaggacuuugggaggcccagauggguggaucaccugaggcuaggaguucaaguccagccuggccaacauggcaaaaccccaucucuacuaaaaguacaaaaauuagucagacaugguggcacgcgucuguaaucccagcuacccaggaggcugaggcaggagaauugcuuguccugggaggcagaggcugcagugagccgagaucaugccacugcacuccagccugagugacagagugagacucugucucaaaaaaaaaaaaaaaaaaaaaaaaaaaaaauauauauauauauauauauauagagagagagagagagagagagagagagagagaguuaaauccaagaaauagucccaaguaccucaggcuaauaaaaugagguagaugaaagaaaaaauauuaaaaugaggagaucauaaacgaacauacauucuaaagaaaaaagcaagaaccaaaacucauagaguaucgcuuagugcaaagugaauguuagaaagaaaaaucccaaacucuuucaccaccaagcauuuguauauacauaugcaugaauuuucuuuuuucugaaucauuugaaaauaaguugcagcuaucagaacccaucacuaaauaucuuaguacauuguuucauaagaucaaagacaguagcauuauuauucccaggaaauuuaacuuaauagaauauuaucuaacacagagccuauauuuaaauucaccaaauuaugccaauagugaaaucuacaauagcuuuucuuugucaaugaagauccagucaaggaucccacauuguauugagucgucauauucuuugucuguuuuaauauauaguuuuuuuuuuuuuuaaaaaaaccuuugcuuuuuguuuuuuuauuucaucauauuaacauuuuuuagagagccuaggcuggauauuuucuagaaugcauauauuuuuauagucuuuauuuuauagguuuuuaaugucaaguuucucuuuguggaaaucuuacauuguggcuucucaauccauccuaccuaccacugcuuacaguaucuaauacauuaucagggcacauuucaucagugggcuuuuccuauacuaccuuucccccaacccuaugcuaaacuaguguucuucuucuguaauguccgacucaguauuaagagauaagaaaaaauauuagaaaaugaauuuuguuuacaaaagguuuagucccuaagacaaaccaacguacuccuguguggcaagcccuuuaggagggcucgccugaguaauaacagcugucucuguggaccacauguccuuucuuuuccugaguggaguuugugagccaaaggucagaauuagacuguucacaacuacggaaggauuuuuuuuaaaaggcugugagaguggaagaaaaagcaacuggccgguuagacauuuaaagaggauuuuaacaaaaccuuuuaacccacuguaaaccaaaaauaaaauuccaaguuccccaaagaacugaauggacuccuccucuuggccaagagcauuccaaaguuaaccugauaaacuaguucaggcuaugauaggaagagggggucacacauaccucauuauacccuccucccacuggaauucagggacagcugacaagaauuaacauuaaaacaaugauuuuaagacugaugaaccagacuuuuuguagcaauaagacaccaaauuccagccagguuuacaggacgcacagcaagcccugaaagaaacugaaguauuucacuccaaaauauauuuauuugacauauuuugaaauggcccugcaaaacugucucuuguggggaaaaucuacauuguguggagaaucccccucccuuuccagguguucucccugauccgggagagaauuaacuaagagucugguaucuuuuuaggucugauaagagcucugaagccugccaccuggaggcuucaucugcaugauaaaaccuucgucuccacaaccuuaucuuaacccagacacuccuaggucuuuagguaacaacgcuuuuaaccagcugccaaaaaaaauuuuuuuugaauccaccuaugaccagaaacccccacccugucacccuccuuucaaguugucgcaccuuucccaauggaacaaacguacaucuuacguguacugauuuauguuuuaugccacccuaaaauguauaaaaccaagcuauagcccgaccaccuugggcauauguucucaggaucuccuggagcuaugucaggggacauuggucacucauauuuggcucagaauacaucuuuucaaauauuuuacagaguuugacucuuuucguugacaccauauuaauauaaaauauugagucacuuaucuauuuccuauuaaugacuagaacaggaucuacuagagagaugcacugaagaucuggaguucaacgugaauagaaugggaacaaaugcuaccuacacagaauaguucagccccauaaaugauucacgucuuuuuuuccccucgguccagugucuuuuuuuuuuuaacuagaaaggaaaaucaaaagacaaaagccauucuucguacauuauguaaucaaaugaaugucagcaacagauguguguccaaaugaaacauuuacaagacaguucacaaaaggagcucauuuggauuuuacuuaagccaagggcacuauaaaacucuaauuuuaaaagaacuuuaaaauccaauugcauugggaaauugucuuuaaagauauauuuccucgcuguaugauucuauaauuauugcugggaaaucuuuuggaaaauauugauaaagucuaauaauguuggagguaucuuuguguaugguaauguggaauacaucuguuuccccagauuuaacuugaauucucaaacagcaagcagaaguccuacuauacagcuaugauucaggaucugugcaaugggaucugugcuaccauacuucaacaacaacaaaaaucaaaacaacaaacauuuugugaaugcucaguacuuuuuuauaugcauucuggcaaagaaaaguaugaauguucuuaaucuuucucaaaauagaccugcucaaaauaaaacauauuuuuauuuuggcauaaaauauaauggcagacaauuuuuagauaauauauauuaagugucaagcuguauaguacagaauacugugacauggcauaauaaguuuucaguagaaagaacuggauaaagauugcaguaauuagaaaggcauaaaagggcaaagucaguugucaagaacuacgaggaaagcaacuucaguuaaggcacaaaaugugaaugauuuuugugguugguguggcccaauaauccuggacacugagagaaugagugccauggaaugucaguuaaaguuaaaaacuuccuaguuauuaauuugucccugaaauuuaacuggaaaaagugucuuuauaguaauuuuaagauuuagaaucucuguauauuuuucuguuuguaugccuacaaugguacuaggcaaugguucuaagacagauuuuuuucuuucacauuugaacauuucuuaaaucaggguucaucuuacagucaauuaaauaucauaguuugacagcaggacaaaaggauagcaguugugagggguuuuuuuguuguuguuguuuguuuuuaaguuuuuuaagagacagggcuucacuauguugcccaggcugggccuugaacuccugggcucaagugaucuauugccacagccuccugaguagcugggacuacaagcaugugccacuacaccuggcuuugauaauaguucauugguuuauucugauaacaugccuucacuguuugcuaucuaaccaauacaaacaccaucaauauucuugaaugagauggcaacaccaaaacuguguuuugcccuuuggaauaaaaaaugacaacauccaauaacaaauaaaaaagaaaaauuaauaauaaaauaacagucacauagguuaauugugguaguauaacuuaauuuagaauacguaaaaauaauauuugcuaagcauuggcaaagccauuucuuuuugcguuuuauacuacagaagacacugauaaguuucaaccuucaaaauuuuacuuuagaaaaucaacaagcaagaaaaugaagucaaaaacuaccuuuuucucuucuugaaaagcaguccaaagcaaaaaagaaaauaagaaaaagguaaacucuuaucuuggauaaaguuuuaucuacgaggcaucuuuaccugaaucucaauaugugaggacagaaagcaaaugaggaaauacgaaauaauuugucagaauacaagaagguaaaaccuuaguguugagagagagaaaaaucacuaagaagaaauuugacuuguccagcacagcccuagaaacacaagaggagcagguggggagccgagauaagaggcugauaacaggagguuguuuucuaguuugcaaagggcaguuaaacccccagcugucaccugaaucaagcagacaggacaguaaucucuccuacacuaguaaaaaaaauaaacaaacaaacaaauagagaaaaugagcuaaagaaacuguaggcuuggggaugcuggacacagagugucagaggcaauugaaccugagcaacuucaucuuaaauaggagcugaguaaaaugaggcugaaaccuacugggcugcauucucagauugcuaaggcauucuaagucacaggaugagauaggaggucaugacaaaagacaggucacaaagaccuugcugauaaaacagguugcaguaaaggagucagcuaaaacccaccaaaaccaaaauggccaggagagugaccucuggcuguccucacugcaacacucccaccagcgccaugacaguuuauaaaugccauggcaacgucaggaaguuacccuauauggucugaaaagaggaggcauaaauaauccaucccuuguuuagcauaucaucaagaaauaaccauaaaaaugggcaaccagcagcccucagggcugcucugucuauggaguagccauuauuuuauuucuuuacuuucuuaauauacuuguuuucgcuuugcacuacggaccggcccugaauucuuucuugagcgagauccaggaacccucucuuggggucuggaucgggaccccuuuccuguaacaagaggaggucagggaugaguacaaaaagcagagggauucagugaaaaaacucacaagccacagacugggagaaaauauuugcaaaagauaaaggacuuaaccaaaauguacaaagaacacuuacaacucaacaauaagaaaaugaguaaucugauuuuuaaaugggcaaaauaucucaauaaauaccucaccaaaaaagauacauacauggcaaauaaguauaugaaaauaugcuuaacaucaauaaugauuugcauauuaaaauaguaagaugucacgacacacauauuagaucuaggccaaaacccaacacacugacaacagcaaaugcugaugagaauauggagcagcaagaacucucauuuauugcuugugagaauauuguagacauuuuggaagauaguugagcgguuucuuauaaaacuaaacacauucuuaucauacaauccaggaauugguauuuacucaaaugaguuaaaaauauauguccauacaaaaacuggcacacagauguuuauagcagcuuuauucaaaagugccaaaucucaaaaguaaggcguccuucaguaggugaauggauaaacugauccagacgauggaauauuauucagagauaaaaagaaaugaacgaucaagccaugggaaaacaugaagaaaucuuaaaugcauauuguuaaguaaaagaagccaaauugaaaaagcuacauauuguaugaucccaauuacaugacauucuagaaaaggcagaaguaugaagauaguaaauagaucaguaguugccagggguugaggagagggaggaaggaauaggcaguguuacagguaucauagcuaggcaagacuggggcuggacagggcucugccccaccccccacuagaaaugucaggugaugguuuggcaauuaucacacugccucucuaaaaaugauaauucagcagcaccagggacaggccauuucuugaugguccacaccuguuaacaucaaaacguuaauuggaugcaggccccagggagaugcaacuuccuggacaugcagauuaagagacaaaaauggcaaaguaucuucuggguacgcuacacuggaaaaaggaagaaagccucagaugggcauguguauaacucccuaaacacacuacgcgugcucugcacaugcaggcagcccacccuuagggaaaaaucaugggaaaaaggugagccuauaaaaguccuagcaucagguuaaacggggacucgaccuucucucuuuaaucuucauaugccugcgugggucucuuccaagugcaccuuguucuaaggccuuuuaaauaaauuuccauuccugcucuggaacuugccucagucuguuuuucugcuuuaugccccucaguugaauucuuucuucugaggaggcaaagacugaaguugcuguggacccguauggauuugccgccgguaacucgggguaccucagaucucuuccaccacuaacauauuuguugccgugacuuggauaccuuccuagugguaagagauuucuaugccucaccuucuucagcuggaggcaucugacccacaugcauggcuuuuccucucuuuccugcuuacuaacaaauuccccagaguaauuccucuuggccagagugacucugcuccgcccagcugauuucucaggucaccuugccggguggcuugcaaggguggcagggacuuuagggucuguacugagcauaucuaaggcauuauauggcccuucuugacaggagccuugcacaaaugguggggcuaaagccuaaaccauguaaugucucgggcuuccucugcuuuuucaacuaaaaucggcucuuuuccgggacaaauacgaauuggaacucuggcuuugcuggcuuuucauaacucaccaagugcuuuuuguuccuguuauaucccggggcuaaguuuucuaauggcucuuaaaagcugcuuguccaccugcacagaccuucaaucuggcccuuuuuaaggacuccacccacuugcuuuuuaaguuagcaccacuuuaggagguggagaaauucuuaccccaagccgcaaguccucagggguuacugauuuauguuugaacuuuuguuccagaaggugaacaaauguugcacucuugaauccaagggcugcuguuuuugcaagcauuugagggguuuccaugcguguuccuuccacuuccuccuuuagcucccauuucuugaacuacuuccacacccuucucaacaggcaacagggccuucaaagucauauucuaggggagagaauuccagccccuguagcaguuaauggagaaauaagcuucuaagaaaagacaugaucauuuuauuacuaaaauacuccaagugaggguuacuauaaggucguggcgacaaggccagcccaaggccgcagacacaagagauccacgggacagagaugaaggguggucccaagcuaaaauuaugaugagaugggacugagagacaagacuagcuggauuucccaggcugacuaagaaucccuaaacccagcugggaaggugagcgcauccaccuuuaaacacggggcuugcaacuuagcucacacucggccaaucagguaguaaagagcgcucacuaaaaugcuaauuagacaaaaacaguaaguaaagaaauagccaaucaucuaucgccugagagcacagcgggagggacaaugaucaggauauaaacccagacauuccagcuggcaaccgcuacccucuuuggguccccucccuuuguaugggagcucuguuuucacucuauuaaaucuugcagcugcacucuucugguccguguuuguuacggcuagagcugagcuuucacucccaguuccccacugcuguuugucaccuucgcagacccgccgcugacuuccaccccuccggauccggcaggguguccacugugcuccugauccagugaggugcccacugccacucuggaucgggcuaaaggcuugccauugguccugcacggcuaagugcccggguucguccuaaucgagcugaacacuaguugcuggguuccacgguucucuuccaugacccacggcuucuaauagagguauaacacucaccgcauggcccaagauuccauuccuuggaauccgugaggcuaagaaccccaggucagagaacacgaggcuugccaccaucuuggaagcggcccgccaccaucuugggagcucugggaacaaggacccccugguaacaggaccaaggguacccguuaagacugguuaagcccggaacccagaacugacgguacauggcaagaccaguuaagccuggaacccagaacuaggggaauaugguaagacugguuaagcccagaacccagaaccggggguacaugguaagaucgguaaagccuggaacccaggacgaugggggaugccucauccaggauaaugggaagaaagggggaaugccuucuuuuuccuuuuucuucuccucuguucucucuucacaaguggcagauggguaaucauguguccacacugcagggcauguuccucggaugcauuccccaaaacugggaaguuuaauuuccccaaacuuuaaacuacuuggcuucaaaauaaacugggaggaaauuacuucuaaacuuccauucuuagucuggaacuugccugggucucuuuuuuuugcuuuaugccccucaguugaauucuuucuuuugaggaggcaaagacugaaguugccguggacccauauggauucaccaccaauaauuugggguaauucagaucucuuccacugcuaacaagagcacagaggauuuuuagggcaguggaacuauucuauauaauaccacaauggugaacacaugucauuauacauuugucaaaaucccuaggauguacaacaucaagaacaaauccuaauguaaaccauggacuuuagguaauaaugauggacuuugggugauaaugaugugucaauguaggucuaaugauucuaacauaucacucuacuacacgaugcugacagucagggaggccauguguguuggagaaaaggggaugggaacucuguacuuucugcucaacuuugcugugaaacuaaaaauugcucuaaaagaguaaagucuauuuuucaaaaaucugcauccugaacaaugugucccgaguucuccccacaccugcccaaauucugaaugccaagagucaggcagcagauuaaagaauucucugaagaaaauuaaauaucuauucacauugacauuuggguguguucaauuuauuaaaaauaaaucugaugggguuccaguuuccaccuagaauguagaaauauaaauggagcaauguucuaccuaaugacuaugaaauaaccuauaaauucaucaauuuucaugaaccuaucagaaagcugagaucacaaugcaaccaacuggcuuucacucuaagaaaagccuccaaggacagacaggacacaggcauuggcucaccuguggcagagcacagaaggaaaaugagaaggucacauaaguggguaagaauucagcaaaaauuuacuaaaaauugcucaagguaagaacaugggcaagugugagaaaauggaacccagggaagccacagacacaaucaaguuugccuacucauagucucuuuucuaugaccucaguggguagucacaagaaaaacuguuuacuggguaggagacagagaaagcuuugcucagagaaacaggccucccacugcagggaaagcacaaaaacuacccagauccuucucaucuaaggaacaaaagccauaagcuacuaggguaagggcaacaaacccucuuuuucuaccccugccccaccucggcaccuuuagccccagggcaaaugugauaaccuagugaggcuggggaaagagaaaaaaagaaaaacucuuugggagaaugggcaggaagccauuggauguaaaugaaaacaaaauguaucaaaacuuguaggaugcagcucaaacaguggucugcaaccuguuuuguaaauaaaggaacacagguaugccuuuucauuuauguauugucuauggcugccuucccauuauacuggcauaauugaguaguuauaaacuacacugaaaaagaaagaacucaaaucaauaaccuaaauucacaccucaaagaaccagaaaaggaagaguaaaugaaacccaaaacagaaggaagaaaacaauaaagauuagaguagguauaaaugaaacagagaauagaaaacaguagagagaaccaaugaaaccaaaaguugauuuuuuaaaaugaucaacaaaauugacaagccuuagacugauuaagacaaaggagaaucacacuuuuaccacuauuaacauugcacuggauguccuagcuagagcaauuaugcaagaaaaagaaauauaaggcauccaaauuggggaaguaaaacuaucauuauuugcagaugauacaauuuuuuuaaucuacaaaaucucaaaugaucaacaaaaaacuauucgagcuaauaaacgaauucagcaaauuugcagaagauuuagaagccuuaggucucugaggcacaagaaucacuugagaccaggaauucaagacuagccuaggcaacaaagcaagagucugucucuacgaaaaauuuaaaaguuagcuggguguggugguaugcacuuagaguccuaguuacucggcaggcugagguggccagauugcuuuagccuaggaguucaagggcauaguaagcuaugaucuugucacugcauuucagccuggguaacaaagcgagaacuugucucucuuuaauuaaaaaaaaaaaaagaucaacacacaucaauuauaaacuaucaaugaagcaaugaacacuuugaaaaaaaaaauuaagaaaacaauuccaauuaccuggguacuacugaugcugugacuuacaugccccaaauaauuuaauguuaauagagacugaaguuuguaaacgugaagaaaaggaaagccuuaauggccaauacacugggaacuggguauaacucuuaguuuaucucaucuauguuggaguccucuagagagugacagcuacugauaucauuaagguauguggugauuaggaauuagagugcuuuauuuucuuccaaaauuuauggaguuggucuguaccuggcucuguacauuacacagguaaacaugcaccaaauauguugagcaaggaacacaauucuagcgaucucuucuaauuuggaaugcuguaaauacaaccuacgcuugcucucaaagcauuucuuauggguucuccaaccuuuugccccuucauccauucaaggauugcugauauucuuaggcagaagggaagugaagccaaaagugacauuccuucccucaucuacucaucuaguucacugcucuauggucauaucaaagaagcugggaaaccucugguauauugauaaaaauaaaugagaaaaggaaggcuguuuuccucuaccugcuaaaacaguauaacuaucaguuucucaauuuuuuuuuuuuuuuugccauucuauucaucuacguauaucaaggaaagagacccuaauaggagcuagacucuucuuuuaaacacuuguuuucuaauuguccuucuuaaaccuacccgaugugcagaugacauaaccaucaccuagggcuggcucaaggucacaugcaggccucugaaaaaugcauuuuggcauuacaaccuuggagaaaaaaucacccacaaagcaaccuuggagcagugacuuaacagcagauuuuucuucuuggugacugaacuuuggaauugaaagaggcagaagaacaguggagaggggauguaggguaggauacaaaaauggcgagaccagacugccugccugccucauauacagauagaagaugcaaaaugcaccacagugaaauuacuaauaagagcaacaaauacucaaagcugcaauaacaaagauuuccuauauuuucaugcucaauucagacaaaauuucuucuuaaauacaauaaagccaauuaaaaaaaauuuauauugcaaaaaucuggauuagggaaguuaauaaauauuuaagaacuaauuaugcuucuuuuucucuacaccuuugccauuacuagugaucucccuggaauguccuccuuuugucauaucccuauugaaaaugaugcuuaggaaaaguauauguacuauauauucccugauuacuaaaguaaucacuauucauuguagaaaauuuggauaauauauuaaaaacaaaaggaauaaggaaaaacauuccauccuuuaucuuauuacaacuguuaucuuuuuuccauaucucaccuuguaacagaaccuaauaagagguuggauauagggaaugaaauacaaagaaaaauuuaaaaucacaccaaguauuuggaauugguaaguaagauaaaaguuguggucaugauagaaaauguauaccuuuuuuuuuuuuuuugagacagagucuagcuuuguugcccaggcuggagugcaguggcaugaucuaggcucacugcaaucucugccuccuggguucaagcgauccuccugacucagccucccaaguagcugacaaguacagacaagcgcaaccacacccagcuaagguuuguauuuuuaguagagacaggguuucacaauguuggccaggcuggucucaaacuccuagccucaggugauccaccugccucggccugaaaagguaugcuuuaaaaaguuaacuacaccaaguugaucuucaaacgaccaauuuuguagugauuguuauaccuaccaaauaaaaaaaaaaacuaugcaaaaauacaccauaauuuuuacuaugcccaugcaauuuccugucaucaaaagcaugaauucuuugugcuguauaucaaguaaagucaauuaugacuaacauuucuuuaguauuuggaaaaggccauaugacaccacagucuugcuaauacauaccccugaauggccaggaaugcagagcagaucuuaggagcaacuaccgcuauaaccauuauaugguauaucauagcauccacaagaucguggaaucuauuuuuaagaauauccugcaccaaggcaaccaaagcaaaaaugaacaaaugggauuacaucaagguaaaaagcuucugcacagcaaaggauauaaucaaccaagugaagagacaacccacagaguagaaaauauuugcaaacuacccaucugacaagggauuaauaaccagaauacauaaaagcucaaaaaacgcuacaggaaaaaaaucuaauaaucugauaaaaaaaugggcauaagauuuaaauagacauuucucaacagaagacauacaaauggcaaacaggcauauaaaaaagugcucaacauuauugauuaucagagaaaugcaaaucaaaacuacaaugagauaucaucucauuccaguuaaaauggcuuauaucuaaaagacaggcaguaacaaaugcuggcaaggauauggagaaaagggaacccuuguacacuauggaugggaauguaaaugaguacaaucacuaugaagggcaguuuggagguuccucaaaaaacuagaaauuaaacuacuauaugauccagcaaucccacugcuggguauguacccaaaagagaggaaaucaguauaucaaagagauaucuauacccuuauguuuguugcagcaccgguuauaauaguuaagauuuggaaguaaccuacguguccaucaacagaugaauggauaaagaaaaugucguacacaauugcaaagaugaaggggacguuaccacugaucccacagaaauaaaaacagccaucagaaacuacuacgaacaccucugugcacacaaacuagaaaaccuagaagagauggacaaauuccuggacacauacacucucccaagacugaaccaggaagaaauugauucccugaacagaucaauaaugagcuccaaaauuaaaucaguaauaaauagccuaaaaaccaaaaaaagcccaggaucauauggauucacggccaaauucuaccagauauaaaacaaagagcugguaccauuccuacugaaacuauuccauaaaauugaggaggaaggacuccuccccaacacauucuauaaggccagcauuagucugauaccaaaaccuagcagagacacacacagaaaaaaagaaaacuucaggccaauauccuugaugaacaccagugcaaaaauccuuaacaaaauacuugcaaaccaaauccagcagcauaucaaaaagcuaauccaucaugaucaaguagucuucaucuccgggauggaagguuaguucaacauacccaagugaacaaaugugauucaucacauaaacagaacuaaagacaaaagccacaugauugucucaauagaugcagaaaggcuuuugauaaaauucaacaucccuucaugugaaaaaaacucaguaaacaagauauugaaggaacauaccucaaaauaauaauaaccaucuaugacaaacccacagccaacaucauacugaaugggcaaaagcuggaagcauuucccuugaaaaccagcacaagacaaggaugcccucucucaccacucuuauucaacacagaauuggaagucuuagccagagcaaucacacaagagaaagaaauaaagggcauccaaauagaaagagaagaagucaaacuaucccuguuugcagaugacaugauucuauauauagaaaaccccauagucucgggccaaaagcuccuucagcugauaaacaacuucagcaaaguuucaggauacaaaaucgauguacaaaaaucacuagcauuccuauacaccaacaacagccaagcuaagagacaaaccaggaaggcaauuccguucacaauugccacaaaaagaauaaaauaccuaagaauaccuguacacaaaacaucccguucucacuuauuuguagaucuaaaaaucaauacaauugaacucauggacacagagaguagaaugaugguuaccagaggcugggaaggguaaugggauaaugggggaugguagugggggacugguugaaagaucuccacaacaagaauuacaaaacacugcucaaagaaaucagagaugacacaaacaaaugagaacacaucccaugcucauggauacaaagaaucaauaucauuaaaauggccauacugaccaaagcaauuuacagauucaaugcuauuccaauccaacuaccaaugauauucuucacagaacuacaaaaaacuauuuuaaaauucauauggaaccaaaaaagagcccauauagccaaggcaauccuaagcaaaaaggacaaagcuggauccaucacauuacuugacuucaaacuauacuacagggcuacaguaaccaaaacagcaugauccugguacaaaaacagacacauacgccaggcgcgguggcucacgccuguaaucccagcccuuugggaggccaagacaggcggaucaccugaggucaggaguucgagaccagccuggccaacaugguaaaaccccaucucuacuaaaaauacaaaaauuacccgggcgugguggcgggcaccuauagucccagcuacuugggaggcugaggcaggagaaucacuugaaccugggaggcagagauugcagugagccaagauggugccauugcaccccagccugggggauaagagcgacacuuugucucaaaaaauaaaauaaaaacaaaacaaaacaaaacaggcacauagaccaauggaacagaauagagaguccagaaacaagaccacauaccuaugaccaucuaaucuuugacaaagcugacaaaaacaagcaauggggaaaacauucccuacucaauaaauggugcugggauaacuggcuagccauauguagaagauuggaauuggaccccuuccuuacaccauauacaaaaaucaacucaagauggauuaaagucuuaaauguaaaacccaaaacuauaaaaacucuggaagauaaccuaggcaauaccauucaggacacaggaaugggcaaagguuccaugacaaggacaccaaaaacaaucacgacaaaagccaaaauugacaagugggaucuaauuaagcuaaagagcuucugcacagcaaaagaaacuaucauuagagugaacaagcaaccuacagaaugggagaaaauucuugcaaacuaugcaucugacaaagaucuaauauccagcaucuauaaggaacuuaaauguacaggacaaaaacaaccccauuaaaaaguggacaaaggacaugaacagacacuuuuccaaagaagacauacaugcagugaaccagcauacgaaagaaaggucaauaucacugaucaugagagaaaugcaagucaaaaccacaaugagauaccaucucacaccagucagaauggcaauuauuaaaaagucaaaaaacaacaaaugcuagugagguuacagagaaaagggaacacuuauacauugcuggugggaguguuaauuaguucaaccauuguggaaagcaguguggcaauuccucaaagagcuaaaaacagaacuaccauuugacccagcaaucccauuacuggguauauacccagaggaauauaaaucauuccaccauaaagacacaugcagacgaauguucacugcggcacuauucacaauagcaaagacauggaaucagcuuaagugcccauuaaugacagauuggguuuuuuuuuuaaaaaaaggguacauauacaccacagaacacuaugcagccauaaaaaaaaaaugagaucauaggccgggcgcgguggcucacgccuguaaucccagcacuuugggaggcugaggcggguggaucaugaggucaggagaucgagaccauccuggcuaacaaggugaaaccccgucucuacuaaaaauacaaaaaauuagccgggcgcgguggcgggcgcuguagucccagcuacucgggagguugaggcaggagaauggcgugaacccgggaagcggagcuugcagugagccgagauugcgccacugcaguccgcaguccggccugggcgacagagcgagacuccgucucaaaaaaaaaaaaaaaagagaucaugucuuuugcaagaauauggauagagcuggaggcuauuacuauccuugcaaacuaacucaggaaaagaaaaccaaauaucgcagguuuucacuuauaaaugggagcuaaaugaugagaacucaugaacacaaagaagggaacgcuggggccuaccugagaguggagggugggaggagggaaaggagcagaaaaaauaacuguuggguacuaggcuuaacaccugggugaugaaguaaguuguacaacaaacaccugugacaugagauuaccuacauaacaaacucacacauguacaccugaaccuaaaauaaaaguuuaaaaaaagaaaaugugguacauguacacaauggaauacaauucagccauaaaaaagaaugagacucagucaucuacaacaacauggauggaacuggagaucauuagguuaagugaaauaaaccaggcacacaaagacaaaacacuacguguucucacuuauuugugggaucuaaaaaucaaaacaauugaacucauggacauagaggguagaaugaugguuacuagaggcuggagaggguagugggguguuaggaagaaggagggaugguuaauggguaccaaaagaaaaaaaugaauaagacuuacuauuugauagcacaguaggauaacuauagucaauaacuuaauuguauauuuuaaaauaaagacuauaauuggauuguuuguaacucaaaggauaaaugcuugagagaauagauacuccauuuucauugacaugcuuauuucauauugcaucaaaacaucucauauaccccauaaauauauacgaguacuauguacccacaaaauuuuuuuuuaaaaagagaguaucuugccaaaaaagaaaaaaaagaauauccugcuauugguuugagagguaaaguaagagguaaaauaagagggcuauaauguguuaucuugucugaucgcaggacucaaauacagguuuuugaauaagaacuuggaaauuaauaaaaguuaaugaggugagucagguaagacuggaagauuauuuuaugcaacagaaaauaagcacuguagacucugguuguauuuggugagaaauccucuuugaaaagccagagccuucagagucagcagccauuggaggcccagguucccagacagcaguaucuauguaugagacucagguccugagcuggggugcagacucccugaacaucuccugagguacgacugcagucucucacauagugaucucuauuaugucaguccuugaauggaccuaauguucugccaaucacacauucuccuguaauuccuaaauuaguuaccuaacucaagcauaauucaaagacugaaaauaauuucaauuagcuauuuuggauauagacaccuacauucuauuuuuuucuucauuucuuccuuucacaccuaaauguacugugaaagaaugaaaagauacaaauauguuaccuaagaguuccuccauuauguacucuuccccuccuccuaccacaaagucauuauuagauccuaacaguucuacuuccaaaauacaucaugaugucugcacuuaccucuauuuccaucacaaccacccuaaugcaagccaccaccaucuggcauuaggccuaggaccauuguaguagucuccuaacugaucuuucggcuuccccucaugcugugccacaauucauuccugaaucaguagccaaaguggucaucucaaaacauaaaucauaacagaacccuugcuugcagccugccgaugguuucccaccacacauguacaggaggaaaaaagucaaacucuucucuguggccuucagaguuguaucugaucugauucccacuccugauuuaagcuggcagccacuuucaccaaaugaaucaacaaccaaccaccagaggcaggagaggaagcagcacuagcugaaagaggccaguaucacacaagcuguauagguagaggcuuugugcaaaacacauaaggaauuugaauuucuaaauacacugaguugucuuaaaggaagguaccccaauauaaugaaucaucuaacagucaaguuauaacauugugccaaauucaguaaacacuccuuucuuuguagguaauguagaaccagugaagggauuuaaguagaggaauaacuugaucugacuugcauuuuagaaauuaaaauucugguugcacuguggaggauguauuagaugagauuugauuaaagaacagccaaaggcaucgaaauaccucaggaaaagagcccugugcuuccuaacacaaaccuugggcuggagaacugauaccugacugaagagcuauuugggucauacauacacucagcaagggaagcuggugguugcuugaaaguuaggggagaggugcccucucucaguuguugagucuguuaaugaggucaugcaccucuacaaacuucauucuaucuucaaucaagguuuauacuuuacaaguuauagaggacuuguacagcaccugcuaacugaaauuacucacauaccccccagacagugaccugcuauuucagauaaaccugagcuggaaugggcuauuauaacucaggcaccucugacuccuguguuuauagcucuguucuuagguccuaucuucccagcaaagcaggcacaucuaaaaacacaucaccccaaauuucucuauguaacagccuaacgccaauugugcuuaaccacuuuucugcccaaugaccaaggggauauuacacuuccauuaauaccuuuugaucacuauggcaauauuuucaauuuaggguagagguaggauguaguauaagaaucacuaaguggcccuuuaaaaagacuacacauucauucccauucuccauccuauggccacccacacacccacaaagggagguaacugaguggaaaaaugauugacaaccaccugcuuuacuaaauacaaagauaagggccaauaaaauuaauucaguuauuagaauauuaugccaaccuguuuuuaagaauucugaaacagaguaguauuaucccaaacagaauucuuagagaagcgucuguguuuuaaaauacuuuucuguuguuuccuauggugauaaacauuuucaagucccaaucuacuucucagcaggcacuacacauaguuuaaugagacgaauauuacgaugugcucccuacugagaaaaucucagugccauaauaaaaggauaugaaguuaauguaaugaaguuuuaagaaaaaaccuuaaaguucucaacauucaaauccuuuagagaaaaaaaaaaaucauauauaauuuaaugacaaccuucccaauacauuuaucuuucuacuaucccaucuccacuauuuuuuacagaaaacgaaaacacuguauguaacccuaaaagggaagcugaaauaaaugacugaauuacaaucaaaaugaaucacgcuagcuuagcaauuauauacaauaauucagaauuguuuuagucuguuugggcugcuauaacaaaaauaccauaaacuagguagcuuauaaacaacagaaauuuaucucuuacaguuccagaggcuggaaaguccaagaucaucagcagacuggguggcaagggccuguuccguagugauggugccuucuauguguucucacauggcagaaguggcaaauaagcucccuuggaccucuuuuauaagggaaguaauccauucaugagggcucuuuccucaugaccuuagcaccuccucaaggccucaccucuuaauucuauuacacuggggauuagauuucaacauaugaaguuugggggacauaaacauuuagacaagagcaagaauuuccuaaagugugacauaagaagggacuuuagguaaucaauauuuuuauuugauauguaugcauuuaucuuaaccgucacuaaaccuaaguggcccaccaaaucugugaaguuauauguuacugcuuaggauaaaauuaaaguaggcagagaaauucacauagacuucuugccuuauagguccuauacucaggaauauucacgcuuugagucuugaguaacugagccuugugacaauuuuuuuuuaauaacagcuuugagauauaauuuauguaacauaaaauucacccccuuuaaaguguacaauucaguggguucuaagcacauugacaaaguuguacaaccaucaccacuaccaaauuccauaauauuuucauugcccuaaaaggaaacaccacagccaucagcauuucuucccacucccccuucuccucacaaccccucucaacuacuacucuacuuucugucucuauggauuugccuauucuggacacuucagagaaaugaaaucauacaauauuuagccuuuugugucuggccucuuucacuuagcauaauguuuucaagauuaaucuacauuguagcauauaucaguauuucauuccuuuuuaugggcaaauaauauucuauuguauggauauaccauauuuuauucauucaucaguugauguaacaguuggguuguuuccauucuuagcuauuacaaauauguaaugcugcugugaucguuuguauauaaguuuuuguguggauguauguuuuuaauuuccuuggauauauaccuagaauugcugggucaugugguaacuguuuaaccuuuugagaaauugccaaacuguuuaccaaagugacugacugcaccauuuuauaaacccaccaacaauguauagggguuuuaauuucuccacauccguggcaacacuucauugucaauuuuuuuauuacagccauccuagugugugugaagugguaucgcacuguguuuuuuauuugcauaucccuaaugacuacugauggugaccuaauucuuugaaaguaugcacaguaaacaugcuauauaucucugguguaaaaucucauauacugcauuucuuuggguaucacaacauacuuuuuuagcccucugauacugucuguaauggguaugacuuauuaugggcuucaucuacccuuuucagcuccugucuuggcuaccuucccaaaggcaugccccuugccuaauaaaucuacccucuucuuccuccuccuacaaaauccacaaucuccacuuuucuggggccuggccuuuauuauaucucugcuccccaucuugauaacagauaugauaaacacaugcagaagaguuuagauuugaugugguaaauaacaaagagaauaugaguauuuauacaggguauauuuauuaguacuaccauaucacuaagcaggauaaacugaaauagaagagccugaaaggaaacuuugcaaaaauaaggucuacauugauuccuacuuggggaaauggaaaaggaaaaucuaaaagauauuucaaagaaagaaguguaaauacuuaaaagaaaaaagaggaaauuuuaauucaaauguucuauucuaaaagauuucauuuaagauagggucagacagaaaugcuagauugagacaagaaacuagguuuuugguuuauuuguuauuugggauaugggggaugucugaugaagaagaagauuaauuagauuuuggacacguaguacugaggucauagcagacauccagguagagaugacagucauaaaagaugaaauagacagaaauuucccaaaacaaaccuaggguucuaucgucccacaguaacauuuuaugcuuacuagaauacauuucuugucuuauccauggacauuacuuggcauugggcaucaaauuuacuggcuacuaaaucaugguucuaaugguucuagcacaguucaucaacucacugaaauccucaaguagcuccaaagacuaaugcuauucauguaaccuacuaggaacuuccuuuccaaagugauguaaauugggauguucacaacaugccaagcauuuauacaugauagaaugaagccaagagacaagagaagaaaagcccaaccaucacaaacauucuguaauggaaccacuagaccgcuaaccuccuuagaaccucccugccaaggaacuauaucccauauaagccuggucuggugggcacucaccacuguguacuaaagaugugacuuucuuccuuucugacacaacuacuacucaugucaccaucugcccguuucucaaacaagcuaacaggauagaaauaagaacuuaaucauauugagaaauuuauuccacaguauguuuaagaauuaacccauuuaugccgaagguugcaauuuuuugaauuuuuggaaucagaccuugagcaguaggauauaaauaauucacaugcuuagcauuucaauaauggaacaaaaggcauaaaugaguuaauuaauguagucuaucuugaaaccaauaaaugcugcugcccaaauacacacauacacacuauuacuaaugaaguaaagauccaaaucuuggaaguaauaauccaauggccuugaaauuaugguccucuuucuuacuguuccaauagguaaaagacugggaagugucuaagcagugacaauauccaaagugcacaugauuauauaguguaaauucuaaauuucugcuaugcuuacaauauaaaagucuuucuuacuaccauauaucuaagaauuccuuuguuugacuacaggacugaggaaaagcaacccuguuaauuuagagauucuacauuuguguuuaaaauggcaaagaaggcugggcgcaguggcucaugcuuguaaucccaacacuuugggaggccaagacaagaggauugccugaggucaggaguucaagaccagaaugcucaggguagugagacccccaacuguacaaaaaaauuuuuuuaauuauucaggugugguggugcacaccuguaguuccagcuacucgggggagcugaagcaggaggaucacuuagacccaggaaguggaggcugcaguaagccgugauugagccugugcacuccaccccaggugacagagggcaaccuugucucuaaauauaaauaaauaaauaaauuuaaaauaagagaaaauggcaaaggagaggucuuucuuaaugacgcauaucacauuacauuaccaacucucuucuguguuuuuuuuuuuuuuuacucucuuaaaaguuugugguggcugcucugauaguaguggguuaucagaacacauuaacauuaguguuacugaaguuaguauaaaacucccccgcuccuaaaugacuggcuuuaaaaaaaaaaaaaaaaaacuuuguggcuaaccacugaaagaacuguaaauauggguuaauguuuuucccuauucccugaaaguguacauuguggcagacuauauuucccaaagauggccacaauauuucccaucccacaugcucuucuacaaugugaccugccacucucucaucaagaaguagaguccaauucuccuucucucuuuuuuuuuuuuuuuuuuuuuuuuuugagauagagucuugcucugucgcccaggcuggagagcaguggcgugaucuuggcucacugcaaccuguaccuccaggguucaagcaauucuccugccucagccucccuacugagccucuugccucaguagcugggauuacaggugugcgccaccacaucuagcuaauuuuuuuguguuuuuaguagagaugggguuuugccaugugggccaggcuggucucaaacuccugacuucaggugaucugcccaccuuagucucccaaaaugaugggauuacaggugugagccaccgugcccagcccaauucuccuucucuuaaaucuaggcuggccucaaugauucacuuguaaccaauaaaauguggcaaaaaugauagugaaugacuucugagucuaggucaguaggagccuggcagcuucuuucucaguuuccggaacacuuagucuccaggugcugccaugcuaugaaaagccuaagcuacaaggagagaccuacacuguccuccagguccucuggucuagcaucccagcugagcccagcuuucgaguuauccuggucuagguaucagaugaguaaaaaagucaacauggaagaggauucuccaauuccagcuguuuccaucccagcagguccaauuauacccagccauuugagucuuccauucugaggcuccaaauaaagcacacagcugucucuucucugaauuccuaccucaauaauuuguaaccauaauauaaugguuauuuuauuuuuauuuuauauuuauuauuuuauuuuauauuuuaucuuauuuugagacaaggucuuguucugcuaacagggccuugcucuguugcccaggcuggagugcacuggcacaaucucagcucacugcaaccuccaccucccggguucaagcaauccucccaccucagccucccaauaagccaccacacucagauaauuuuuuaauuuuuuguagagaugaggucucacacuauauuguccaggcuggucuugaacuccuggacucaagcaauccucccaccucggccucccaaaauguggggauuauaggugugaaacaccacaccuggccaguuguuguuuuauacaaauuuugggugguguaaaagcaguagauuaccacagcagcgacagguaacuggaaugaagguugauaaccugucugucucuucacuuuaauaaacauuccacauuuuucuuccaauguauuuuacugagauuuuauuuccaauuaauuuuuuugccaauaauaaacauccacuauuaaguucuccauuuauuuugacaguucaacuuuacaaaccauuacacaucuaacaaaaccauuucccagggcuugguuuccaacuuauuuguuuuaaaagcuucuuucuuaacauccucuccacuuacuggaauuauuucaguuuuucacccuuucuuccaaucuaugucuaaauuaggucaugacuaaagacauaauuacuugaagcaaaaugcugugcacccaacuauaaacaucauaaguaaacauucugucagguauaauaauuauucagcacuuauuauaaacaaaguaucauaccaguacuucagauguuuauaauuauacaugcuuuauuaaugaaaauggcuauauugaguuuuauauaucuacgcucacaaguauuauuuugccagaaaagcacauuuuaauauuuucaacaaaaagacuauuguuugguauaauuuuaauauaaacuucaaaccauugcauuuuuauaaauaaaggcuaucuuauaacuugccacuccauuuaauagguauaaauuggucacuaacaaaucacaguguauaugacucuuuguaacuaccuggcagaaaaaaacuuaauccugcugccucuaaguguuuagucacuucgagauuaaaguuuagauuuugguagauauuuaguuaaaaccagguacuguuuuuagguacuguuugaggccagccuagaugaccgugucaucucaguuacaauucaaagcuccuuccuguaauucuuucccuccuaguaucaugucuauuuucacccugcucagccuuacaggaguggcuacagggauacuguuuucuugcuggcauauaugaaaagggaacgagcuguauaucuggucaauaauaucuuuuugccaguucuagaaaguguaguggaaaaacaugggcaaggcagcuaaugguacuggcaagacaguggcuaaagcaacagcccacagucuaguacagauaaagaaugaaaugaaaacagacaugaugaacagggagaaaaugaagaggcuaaaacacuaaagaaacugaagaauugguagaauuugaaaaagggagaagugaaaguuuaagacauucauucauuuaaucaacaaguauuaauaccuucuaacaugguuuagaucuguggccccacccaaaucucuugucagaugguaauccccaguguuggagguggggccuggugggaggugacuggaucaugagggugguuucuaaugguuuagcaccaucccccucuugguacugaauagugaguuaguucucaggagcuccgguuguuuaaaacuguguagcaccucccccuucucuuucuuccuccuggccaugugaagcuccucacucucacuuuguguuccaucgugaguaaaagcucccugaggccuccccagaagcagaagccgaugugcuucuuguacaaccugcagaaccaugaacgaauuaaaccucuuuucuuuauaaauuacccagucucaggcauuucuuuauagcagugcaagaauggacuaauacaucuuccauguggcuggaaguucuggaguuuaagauucagaggaaauguguaugaguagcuugauuaaagauaaagaugacacaauuugaaaaugucaagaaaugcaaagccaggauguuagugaacccauggacugugucucuucaauauuaagaagcaacaggggaagguauagguaaaagagcuaguuggccuaaaccucaaggaggaauaguuuacaaguugcgguaucggaaagcuagaagaaagauuaccaucuuuaggaccuuugguugaugaacugugugaaaaugagcuguguucaccugcaaaggccacaggaaaagcaauauccugaggagagagccaggauuacuuuucuuucuuucuuuuuuuuuaauagagacaaggucacacugugucauccaggcugaagugcagugaugcaaucacagcucacuguagcuucaaauuccuggacucaagcaauccuccugccucagccuccuaaguaucugggacuacaggugugugcuaccaugccuggcuaauuauuuuucuuuuuuuuuuuuuuuuuuuuuuuuuuuguagagaugagcucucacuacguugcccagacugguguugaacuccuggccucaagcaauccucucucaaccuaugggccaccacaccuaaacuacuuuucaacuaaagugaggagacugaguaauuuaugaagaaguguggcugcagagaaguuuguucagcaugaaauaagagcucuacaaaggacuuauaaaaacgugaugagagaggaugggaagggcuugaggaagggagggauagggaaagauuuguuaaaggauacaaaaguacccugaucugaucacuaaacacuauauguaucaaaacaucauacguaccccaucaauaucuacaauuauuugucaauugaaacaaaagaaaaaaauaggggcaaggcauaguggcucacaccuguaaucucaacacuuugggagccugcauuuggaccugggauccaggcagacagagguaugaggcaagauggacugaacugcuugaggcuuccaagacacacucuagucuuaccauuuugaacacagccaacuagauuuuacacaggauuacaaauaugcuugagaggugaucaggguuagccuucuuacuuacaaauguauaacuuugaaaaaguuauuuuaaacaucucuaagccucagaguuuuuugguaaaacaaagagaaaaauaacuacuucaagaaguaccaugauuaaacagcauaauguauguauagugcuuaacacaauaacgcacaauacacuuuucaguuuaauuguuuuuguuguuacugauguggcccuccaaagaaauuguaaccagguacacagggcauaagauugguuaguuuuguccuggcaugguggcucacaucuguaaucucagcacguugggaguccaaggcaggcagauugcuugagcccuggaauaacagccugggcaacauggcaaaauccugucucuauaaaaaauacaaaaauuagccgggugugguggugugagccaauagucccagcuacucgggaggcugaggugggaggaucaccugcgccuggaaagguugaggcugcagugagcugugaucgcaccacugcauuccagccugggugacagagagagacccuaucucaaaaauaaaaaauaaaaaaaagauugguuaguuccacugaucccaccucaugguaaaagcaguugcacuugguaggagaaacaaaaggacucagaaugcucugaguuggucaguuucacucagauaaagcuaaacauuaagagguuuaccaaagacugcuuugucucagguauuuucugucuuauacaucuguuagauugcaagcuccugaagcuugacuuguguccccaagaguacauauaggaauaaaauaaaacaacauucuauaccucagggaugguaauucuagaggguacauuuaacacaguaucucuccuucuguuaaauaacuucauuguuaauuuucuaaaagacauuuagauugaagagucauucagauuuaagauuaaacaucaacaaaaaggugaaacccaaaaaggugaaacccccccaccaaaaauccauauaccuaguaaauaggagaauauugguauauuuauucaugcuauucauuauuuuucagaugauaaaauaugcaaaaauuuuguauaaaugaauaaucaguuagaaaagacaguacaaucaaauaacucacuuaaauacaucacauguugcuguaaaauuuguguuguuuaacauuuguuaaauaucuguguuuuucuaguugcuguuuaaaaaaacuuaagcacaauaagacuuuacauucuaagacgauauauuccauauuauuagccacaugacugcagaacauacugcauguuaaauuccaauauccaaauauagaaugucuuaggcaguuagucuuacugguuucuaucuugauauaugccuuccuuaaaugaccuagaagaaugugcauguucaguguuuuuacugguaguguauauucauaacauguaacugcgaacauguuugcaguucaaccccagcucuucuggcacguggccucgagcaagucacuuaaccucucuaacauucaguuucauggugaaaucuaguaucaaccucuugggauuauggcaaggaugaaauuaaacagcauaagaaaauagcagguaauaguugcuccaaagugguauuuacuguuauuaauuagacucaguauuccucccucauaauaaaaaaaaugcgucuuauuuuauaacuguuccuauaauucagcuuuaucaguugacuugcuuugucauacuaauaaaccagccuccgggucacugcccucaucaguguagauuuagccaugagacucauaaagcucucuuccaucucaacccuacuaucuuuggagaguucaaaaaugccuguggaacccaaaauaucagacuuauaguucuuugggauucuaaauucuaauaauuuucacccccccauaaacaaucucaagacuguaccccggaucuuguuauaacuuauccaccucugaagucuucauauagccuccucucaggcuaccacuccuugccuuuaucccucaacuucuaggcauuaucuucauacauaccaauuguccucucaaucccuaaguuuucucuuaaucuauuagcuccauccuaccucacuuccuuccuuacacaguaacuaaugguagauuaacuaaauuacuaccuacaaaagcucuuuaauucucuuaaaaugcaguucuucaguucuucagcuacaccuaccaggcaaaacucaggcucuggauuuguaaccugacugcuucucuccucauaugcucaaccaugguccucuccaaaggacugcauaggacuuucagaaaacugcaaagcauucaaacugaggcugggcaugguggcuuauaccuguaauuccagcacuuugggaggccaaggcagaaagacagcuugaagccagaaguuugagaucagccuggcaaacauaguaagaucucaucuccacacaaacacacacacaaaaauuagcugggcauaguggcgcauaccuguaauaccagcuguucaagaggcugaggugggaagaucccuugaguccaggaguuuggagcugcaguaagcuauuacuaugucacuggacuccagccugggagaaagagugagacuccaucucuuaaaaacaacaacaaaaaacugauaccaaauaccauguuucaauuccucuugggacaaccagaugucuuauggaugcuuuccucugucucuggucagcucuuuccuucucuuuuccucagcaacuauuccaaauguuuucuacucugcuuaaggccccaaccaacuacacaugauuuuaauuaccaucuacaugcuaaugacuuuaacaauuuuauuucuacuauugaucucucccuuuagcauagacacauauccaagugcuuacuaaauguuucuaccuagauguacauggccaacuaaaacucucagaacucucccaucaauuuugcuucucuugggguaaccauccuccaaaauaaccccuagugaucucuaucuccuaguaucagaaucuuucuguaguuauuuccuacacuguaccaugguugguccauguaaccaauagaauacagcaaagaugaugacaugucaccauucugugaucauguuaugaaaagacuauggcuuccaucuuggucucucucccuucccaccccucagaucacuuacuauaagaagacccauaugguaaauaaagucuccuaacagccacaugagugaacucaaaaguaaaauuucuagcccuagucaacucuuuacagagacuaucgcccuggccagcagcuugaaugcaaccucaugagaagccgagccagaaccacucaguuaagugacuccucgauuucugaaucucaaagugucagauaauaaacacuugcuguuuuaagcugccaaauuuggggauaauuuuuuacccagcaauagguaacuaacacguguccuuccuuuauucuuaucucagucaacguuaauaguuaucuaguccaucuagucacucauucacucucucauucauucaggaaacaccugaguacacaguauaugacagacccguuauccucaaucuucuccuacaacaaacugucacaaagugcugccaaauuuaucuccaaaauguuucucaaaucuccuccucagaucugagauuucucaaaucuccuccucagauuugauauuucucaaaucuccuaucucucuaccacuauuguccuaauccauggcccucauaauuucucaccaauacuauuacaauagcuucccauuuaauuuccuugauucccaucugucucugccaagggugaucuauuuaagacacagaaaagcaguaguacaugagagcuaaggcagcuaagaaucaggagaaaguucuuuucacgaauaaaugaccccaguaucuuugcagacaaguaaguuaagcuugauaguuucaguaaaauagcagcuuauccaucccauguguacagggaaggaagagaggacacacgguccacagcugugaacaauucagagaacaacaucauauagugcagcaauacugagugaucagacaaaauuggccuacaugacuuuguagagagccauguugugguaacaauuuaacaccaagugucuuaaagcaacacaaauguacuaaccuuagaauuccugagguuagaagucugaaaauaguuuuacugggccaaaaucugaaggcucuuggggagaacuuguuucccugccuuuuccagcuuccagaggccaccuguguuccuuggcucccucuuucacuuagaaggauccuugugauuacaguugcccauccaaauagucaaggauaaucuccccaucucaagaucccuaaccuaaccacaucugcuaaugcuaaugucagauaacaucuucacagguucuagguauuagaacgugaacaucuuugagggugccauugugcugcuacaguccaguuccauaauuuucucuagcaaugcuccacaauccagaaguaagaauagagagagcaaauagcaacagugacucaggauugaagguuaaagauauacaugguccuaaauagagcaauauuauaguaaugagcuuggcuccagaucaaauuguuauuuauuccaggacaguuaucuuugccaacucccucaugaucacaguaguacucuuaacuggguuccuuuuucugauaauuacuaggggguugaaacaagaaaguguggacagauaugaauugaauugcagaaguuuucuguauguugcauaagguuaauucagaaacauccaaccaaaugugcuauagccucgaacuguauaagauuucaaguuaucuuuagguacauagacaaagacuuuuaacaaaaccaacucccacagugacaauuuaugcuagaaaagaaguaacugcaaacauguuuuaggcaaaugaugacuaugaaagauuuuauuuaaacuaaaauaaauuauuuuuuaaagguuuugcuccaugcccuggaaucauuuacauauuuuuuuuccuuuuucugauguagggcaaugugauagauucaaguuuagaucuugaagauuacaauuaacauacaaggaaagaauuuaucccaugcuuaugauuguaggguggccuguaggugacuggcaagucacacaaaagauuaguauuucagccuccauuauccuuuccaccccuuucaucugaggguguuuacugagauaaugagagucaaagucacacucaugugaggguguuuagggugguaauaagagucauagucacuuaggccccuaacaauagcugauaaacagcaggagcuaagaaaacagcagaugcaaaguugugcuuccauuuuuagauacaguugaucuucuuuacucauggacucccuauuuguaaauuaucuuacuugcuaaaauuuacauguaaccccaaaaucuaacacucaaggugugcuaaauaaccuuuguucaggcaugaguuauagugauauuuggcuguggcuucacuguuaauggaucaauauauauuuuaaaagguguuuuaaacagaaacacacauaaaacaagguuauacauugaucaguuggugaaaauguugugaccagagggugucaggaaccuagcucuguauucucccuagaccaugcaauacaacgaccacgaauaaugagaacugacuauauuuuauuugcugcucaaccuuuacuugacagcuaugguccccaacaauguagacuauauauccaucagaaaagaaaauauagcugggcacaguggcuugcaccuauaaucccagcuacucagaaaacugagguggaaggaucacuugaccccaggaguguaagguugcagcaagcuaugauggcaccccugcacuccagccugggcaacauagccagacucuaucucuaaaaaauaaauaaauaaacaaacaaacaaaauaaagacauauaaaaaccuacuuuauuguuuuuuuguguguggguuuuuuuuuuuuuuuuuugagauggaguuucacugugcacccaggcuggagugcaguggcgcaaucucagcucaccacaaccuccgccuccuggguucaagcaauucuccugccucagccucccgaguagcugggauuacaggcaugcaccaccacacucggcuaauuuuuguauuuuuaguagagacaggguuucaccauguuggccaggcuggucucgaacuccugacuucaagugugauccacccaccucggccucccaaagugcugggauuacaggugugagccacugcgccuggccuaaaaaccuacuuuauuguuaaagaguaugucagcagaggcuuaaccaaguggggaggggauaguggguacaaacugacuucucucuccugcaucaauuaucuccuuuaaucuuuauaauaauucuaugaaguacgcuuugucauucucauuuuacagaugaggacaagacagcccugagugguuaaaauauguauuaaaagucaaacacuaggaaguggugaaggugaacuucaaauaagggaaugccuaacuuacugaaccacaccucugacccauaugaugggcacugcugccucacugggccguuuggcucugggaacaauguggcucuccggcugcccaugagaaaccuaaaccuaacacaaacacauuaacuccgggguuuccaagacugaaauuuccuuuuacccgcucuaccccccagccaaauauauuagagauuuguaaccagaauaugucaacugagucaucaaaaccuuauuagagaauuuagaagguaucaguauaguuucuuuauccaagaaaagcacguacauaaguucuacccaaaaagaacgaaaccaaauagaaaaauuugcccaugauuacacaucuaaaauuugucagaauuaauguacugauaaauauguuguaauuaaaauauaugauuaauauauuccaguuacauuuucucaagucuguuggaaaauauaugugaaguauuagguuggcacaaaagcaacugagguucuugccauugaaaauaaaggccaaaaccacaauuacuuuugcgccaaccuaaauauauagucugaaauggaauaauaaauaguauuaaauaauuaauaguaccaagcacaaugucuuucauaaaguaggcauucgacaaguuuaccaaacacauagaccuauauauucuacuucggucauaucuaaguauauuuuauuacucugaguagaccauuaaacacacacacacacacaccuuccucccaaaauucacuaggcgaaacaucuaaagguaggcaaagaauacuauuuaguauuuuggucauaaaauguuuucugaaagaaaugagaaucuuuaaaacugugcuuaaggagcuacaggaugaaaaaugcaaauaccugugaacacauagacacacauucgccagaauaaacaaaaucugcucaaccaccaaggccaaugucuagaauuuguaaauauccaaaugcgacacuucauuuuauaaguaaaaaagacaugacaaguaaaagggcaaguaacaauuuauucagaaauuaaauaucagcauucauggauuuggccuaauaggacuagcauaaguuugguccaauuuccuauauaugcacugaugauccuaacaaugaucuggaguugaugaagaacuccagugugauauaugaaugguaugauguaaauguaaguauacuauaugagaaagugaaaacuuauuaaccccuauggaaacuucuaguuaacuaaaauaauucauucucuaauaauuucgcauaaauaggaauuuacccuguuauuuuacuaaaauuaucaauuuuauugauaauuuaaauauuaguaaugcacuuuauagaugaaauguuuuacuuuccaacuuccucaaacuuugguauagagaugguacauguaaauaaggaaauacagaauuagcaauuaaaaaaaucaaaguacuaucuccuuuacaauuaaaugagguagcacaugguagccaagucuaaaauauccaaaucccacauaugauuguuaaucacuaagucuuguuuuuccauguacuauagauccuuugauaguuucagcuuccauuugcaucucaagauaauaguguaagauacaggauaaaaaauucauauauucaacuucacuacuuuuuauacauucucguugaaguuuugguagaaaagaaagauguaauccuuggugaaauaagguuacaaaugacaguuguucacugauguaauuuaguuaaaaguuaagaaucagagauuuucuaaaauuuuugcuuggucuuaaagguuaagcauaccaaaauacaacuggcaaucuccaacuugcaaauaucauuguuucaaaaauucauuuuuauauauuaauugauuggcagccaaagaauauuuuccaauauuuugaaggaccauuaacucucuaggucaaucuaaaaagcccccuaugguuuagaccacacuugacauauaaaauauaaaccuaauaguuugauaugauucccccauaucaaacuaccauuuauaacauuguuuuucuuuauuuuuauuuuuuaaaaaguagagaugggaucucaauguugcuguuuuuauuuaucuauuuaucuaauccugaaaucaguuagugauugucucccauaggugucuaucuccaaaaaagggacauggggcaccaauucugacauuuacuuaauguccuuuacauucugaagugggcugcaggauagaaacuuccuguggugaauaaaaagaauggcguuacgaacucccgucauucacauccuuuccauuucauggcauaauauucaaauuuauuugaaugcuuaugaagauuuucuuuaaaaaaaaaaacucacaagaucaauugaaagggcaaaauaacaguauuuuaucaauacuccccuggcccccauuaccuccuauuuucuuccacaaacuaauuagcuuuauagacccagguuauucuucauucccaucucacauuuaagagauacaaaauuuucaaaaauaucacaauuuuaaaaguuaaaguauagggaacuuauuaauuaaaaugaagaaauuacuccagucacauauuccugcugaaucuuuaucuuucauaacacuuuuuaagacuggugauuagaggcuagcaaaggauuuucauaaacuaaacagauagugaaucaauaaaaacuggaaaacuugcaauuuacuguguuuaggaauggggucuaagcaacaaucuaaucaagaaugaaagcagucaaaagaaagacauuuaaaauaaccacaguaguaauuuucacaccaaguauggcagucucuaaguuaauguuauuuuaaauacguuucaguuuggaaugacuaaaccuguuaauaaaaacaugaaaauauuaugacauuuagcugacagcacacacaauaaaccucuguuacaaagugaccaagucauaguauacaaaauauacaaccuauaaacccagaaaguuccacaguaaguauacagaggagacacagguugguuucacccuuaucaaaaauuugauucagaugguaaguaaaacaugguuccaacauggaaaaacaauaacucuguggucucuuauugaauaaguaauauuagaaagaagguagacacagggaaaagaggccuguuaguguggccacccccaccuagaccaaucuagagagcugaaugugaguccagguugaguaaucuucaaauggcaccgagcccucacaccuucuauacuuauaaaaugagagggucagccuggucacagucuaaagucuaaaccuuuaaucuuuuuuuuuuuuuuuuuuuuuuugagauagagucuugcucugucacucaggcuggagugcaguggcaugaucucaacugcaaccuccgccuccuggguucaagcaauucuugugccucagccucccaaguagcugggauuacaagcacccaccaccacaccagcuaauuuuuuguauuuuuuguaaagacgggauuucaccauguuggccaggcuggucucgaacucauggccucaagugaucugccugccuuggccucccaaagugcugggacuguaggcaugagccagggcacccaaccuaaaccuuuaaccuuuaacucuaaaucuuuaacucuaaaggaagucccuuuauaaguuugugaccaguuaauuaacaggauacuaugcuuuuguguccauuaguaaaaugcaacaaauuaauccaaaccacuccacuaugacuaaaagauuacauccaagccacugcauaacagcauggcaaagcuacaauguaacaaagaaaaagagaugcugcauuuggcauguacuagugcuaaggugaaacacagccaauugcuauguuuuaugaggccacuuaccauucuuguucaaagacucaagucauaagcaauauagaauuauuaugaaagaguaucuagauaauucaaacaaaccaauuagugaaaaaucauuuauuucauguacagaaaauaguauuauuugaaaaauucacugguuuugguguuauauaaacacauucugguuuuggauauaguaaaagcagaguuaguauaaaaugacugaucacaaggcuuuuuuauauuugcuaagaaacuaguauauuaauuaccuacauucugaagugucaaauacuuauaauguagacaaagaacauuauauuuguauuuuuuacaucaaaaauacauuaagaaauaaaauagcuuuuugaagcaguuuaaagggcagucaauaaacauuuacauauuuaggaauaauuuaacucagcugaaaugaucuaucauuaacccagaagaguagcagauacaauuccuaaaaaguacugucuuucucugcuguauaacaaaauuacuugcuguaucauuaugaccaccaucuucuucaguaaauacuuauuaagcuuugguacuaugugcaaaccauucauauuaagguuacauguaauaaaagauacagucccuagagcugagaaccuuacagucaaauuaugaaaacaaaguauauuuauaaacacaauaaacaguauuugcaaguuugcauuauuaaguaucaaguaagagguaccaacaaucaaugcuaacgcacagcaaggaaagcccaacaaggguagcuggucaggacaguuuuaguagaagagccauaagcuggguauuaaauaagaggacuugaugcuaagcacagaaaacacaaaauaaacuacuuccugcuguuugggaacuuacacuguaccauauauuacuuaugucuauacuaguuaagugauaaacagacucuguaucaaaagugcaaucaacuaaagagggauuugauaagcagcuaacauaacaagguauuaaaagggaaguuucugcugagaaccagagacgauagaaaugacauuccaaagcagcugccagaacauucucgaaaaugucaagaggcagucuaaagaagagugcugagauguguuacuuuccacccccaccacuagugagguggugcuucaagaagauuacagaguagguuucagagauuucccuggggagagcugugguaacaggggccugugucuucaagggggaaggguggaagaugcuugucccacaccuaaagccuagggaaaaaggcuuugagggaaugacuugaagaacuugacaugugccucaagcacuuugaagaacaugcuaaccugguaccugauuaauccccagaaaaucuaaaugaugagaagcugcaugaagaggcaugugagaacaagagagagggcugaacugggaccacuagcagaguuugugcaaagaaugagugcucccuauguggccucuacggaagagugaacaaccuggggugggaucacacaaguccaugcaagagggguaucuagaguuugcacagaccucagcaaaguggaggugaagguacugcuagcuccaagaggcugaggaaggaguaagcaaccaaucagcgcauaagggaauucucacugucaaggaauugaggugaaaaucuagagccacugaggugggagguagaagauucaccagugaaagaauaagcuuuaaacaucugcaacggcuacaaaagcacugaaacuagaucaccagcuagcuucuucacuaaucaaguaaaaguuugcugcuccucuuuacucuuuucacuucuuccuugaccaacuuuggaagggugagaaaccagaacuggcaagacaaagcaggaagaguagaaaaaccagguaagaaguaaaaaggcaauaauacccccuucccuaguuacugguuucccccuugcaagagacagagcaagagaccaguuaagggagaagcuucaucuuuauuucaggcuuggucugcaguuuuuacuuguugguacugggcauuuuaauuuuaauaaucaaauugagacuuuugugacuuuguuacugaaggaugauuuguauuaucuaaaagcaaccagaaaaauuaaguuaacccaugaaagaggaugaaccagucucaaagaguaaauugaaagagacaaaaagggaaaaaaaguaauuugaaagugacaaaaaaaaagcuuuuauaauuacaucccacaaggccugcuuuucaaccugauauccugaaaagucaacacaguggagagcacagaaguauacaaauguggucuuauaaaacauaauugaauccauccagcuucacugccuaucuugagauaguucagccauuaacauuugcagaaacuugccauaauguagcucaagaaucuaauauuaauucuuaaaacuugacacgagugacccaaauaugcuagacuuccuuuaaaaggcagggacugugucuugcucccugcuguaucuguaacauuuuccaaagucucccuuacauaaaaggugcuuaaagaacugguguucuccuuaccaugagaaggcagcuauguuaggcucuuaggaaauaggauaugaacaaauaugcauacagcaaagacugcuuuuuaauuaaaaauauauugagcuuugcuaugggcaaaauuauaaucuuuauuacuuuucaugcuuauccuuucauagccagccaaaccuuugaaacaugcacaauguauuuucagaacauucuaccacaaugcagaauaaaugugaaaccuuuaaacuuugauauucgaaggagaaaaaaaacuacuauauauacauuuuuaaagaguuuagcagaaaacccucaaaauaaguacacuaucacacaacgcuguuaaaugcagaaugguuuaaaaggagagaagcauuuuuaaaauauccauauuuuauuaauacucauauugguauaugucuuuucagugagugacagccugaaugaagagccuacuaugugccgcuacaacucuguaaaauagguacuaucaucccuauuuuaaagaugaggaaacugaggcucaguguuucauggcuugcucaaggucacaauaguaguaagugguggagugagaauuuuaacucagugugucagguucccacacugcucuuaagugugcugcugcuauaaugcugaagaguugaguucuacugacuucuuuccaaaagaaauaaaauccaauuuuaauuguuacauuuacaguguacaauuaugaaauauuagccauugucaaguuccaaccauaguuggaacacaccucugcuaauaugaauaaacucuucaugaguaaaaauucuauauggcaggcaguaguaaaguucauaacagucccucucucucuauguuuauauacacucaugaugucaugcuuaugguauaguauuuacaauaaguguauaugacuauaaaauuugacaacuuucaaaaugguguauaaagaaagcaagucuuauauguuuguagaaacagaaagauguuggcuccaacagaguccuauuaucaaacuguuucauucucaggccucaucuuaguaaauaaaagcaggauaaucccuugauauuucaguauaugucaaugguucuuaauuggaaugauucuguuucaacuacccugcccgcuccugggaaauuuugguaauaccuggaggcauguuuauugucaugacuggggguggggggugagggcagcuacuaguaguacccacugaguagugccagggaugcugccaaacauccuauaaugcacaggauaucccacaaucaacaaggaauuauccaguccaaaaugucaauagcgugacacugagaaaccuaguaugaaggauuaaauaucuuaaguacuuagcagaggggguggagaguguuuagagacuguaacuacaaacacaaaaccagagaguccacguaacacucaguaaagaucagaugaggcauucaagcgguguugagagcacuggccugagagcacccucuugucucauuagauaugagguggguaaugucaugggagaaaacaccagcuuccgaucaauacaccuacguuuaccaguggugcugacuuauuuuuuucugauaaaagaacaggaaacugaaaaaguguuaaguagaaagaaaaaaaauguacugaagagcaacagcauuuguuaaacagaacacagucccacuaccaguuuacugaguuuuccuauuacuuacaguagggcucuagaggguuacaucuaaaaugagaacaguggauguuauggacacaucauaagagaaaaucagaauaaauauucacgugcuucauucaggacaucaauauucggaagaucaaacacuacugcaggaagccuggcuuuuagacuccaaauguguaaauguucugaugauacacuacuaucauuccuucuuagauuuuccuuucucugaaugcaauacucugacaaaaaaggaaacaaaacaccgcacaccuaacaauuucugagacagugcugagaucaaacaaaagacaaaaaagaaaacuucacaagacguugguugaguuuuacuguuauguaccuguaacuuuucuuuugcucuuccauuugugcucucauuuuguaguccuuuuauguuaucuuuucuauccucaaucacauuucuucacuaaaaucuuuuuauucucuuuucaaccuuuuuucacuccuauuuccuccuuuccucucuuccgaaucucaugucuuacuucacucucucaaaagugccaaccagcaaugggauuaugugagaacuuuacaguugagucagacucagaggcuaucuagcaguaacccccacgaugcccaucucucuucagcauaccaacucuccuaacaagcuguuaggagacagcuuaaacacauuaagguauaucaucuuucuuaacuuucagacaccacaaaucacuucuuaccgauagguauugcuagauugcuggugaguucuaagcagagcaauauaacagauaugaauugcucuugcuucacagauaccaauuccuucucauuaucaacauuaaauuagaaaaaaaguucacuaauuuagguacaguccuaaacuacacguggccgaaugugaaagcuaacugcucuuugaaaauuauccuucgacagacaaacauugaacuagaugcaggcacagugugagauucaucuaauaagccuuguuugacauuuugucaggauaaggaaugacucauuaaaugccccaaauuggcacucaagguauguuuuacccuccuacauuccucugaaaguugauucuucccuuaacugaguaaccaguaagauacuguuuaauuccgagucauauuagguaaauacgguacuguacuucaaaugguacuguagugugaugccucguggagcccuggcagaugcauggaagcaacaguaaagugauuuaguauugugaaauaaaggaacuaaauccuaauuuguucugugcugguuuagccccaaagggcaaggaggugcaagucccuuacgcgcaccgugccgcugugcugucuagcuuaaauucauguugccagcguuccaccaaaguuugcaggguuuuggaggugucuccggcuguugcuucggcggaggaguagaguuccccucgcugcgggcgcagggcgcacugccucccggggagacaggugaguccggcgcggcccgcacggggucgccaccugccccgucgcugccccccuuaccuuggugagcugggcgauuuucuugcucauuuucaggugcaucuccuggcuguaguccaugcugugcccagccagcugugcgguggccggcgagggcgcgaauuuggccgccgagccgccguaauagugcugcugccagcucaugcccggggucgccaucuucccaacagaccccagccggggcaccuguccccgcggguggaggcaggcccguggagcaacgacgcccgggaggcaagagucgcggcggccgcuucccgacccgacacccggcgccccccagacucggccgcaggcgccgucccacccgcgacccccgggucaccccuggaagggacggggcggucccgccggcccgaagccgcggggacaacggcgcggggcagaugcccgggguugggcggcggcggccgggggccgggccagcucuuggaggcuccucggcccgcgccuggcggaggcgucgaggacagcgcagcuccgcgggucccgcucgcagcccgcaccgaggacucggcgaggcugcggagggaggaggagacggggcgggcugcggcggggauaggcggggacauggaggaggacgcgggagccgccguuaccagggcgcgcgcggggacggcgacgucauuuccccgcagccaagccccgcccagccccgcgcagccgccgccgccgccgccagucccgcagccccgcggccagugcgggcgccucgcgaggucgauccgggaucgugccgccagugcuucccccguguggcggggauccagcagcccagcccuggcggcgauccccgugcagcgagcgugaggccugacguaaaaaaaaaaaguauccccaagaagacggugcuguaaucaccuucgguuagcagaacgggugucgauuuacagacccuuuccacaugcguccucgugugugcagggccccaagaaguggcucuuccccaagaagagaggcaagcccaauccagagacaugaguagugaaguagcgaggauucccugcccugaccuuccuuccaauggcacacaagugaccgugacacugucuuagccgcccccucccaccccgagugcccggccacugcccccaguucagugcugaguguauguguggagggaacgcuccuuuucagucagcugguggagcaccgcauagcuacuuucccgcgguggagcccaagacaaauagauaugaaacuacuuggcuggaaauaaguaagaauaggaucggagugaaaguaaugguaaaaaaaacagaagauggaacaagacaucagugcuuuaaggauuuggagcugggccaaaaugugucauaacuugugcauuuucgccuucauaaauguguuauucccuacugauuuucucuuaacaucucuaccccugcaagucaaaugauuuuuuaaaaaaguuuuuguauccugcauugaagcaugugagucauuuuagggcauggauaauacuuuaaaaacguagaauuguaccuguuuuuuuaaaaaucguaucuccacgcaguuuugcagaaccaaauuccccaacuccaugugauuucuuuuuagcaugcaaguagccaaaauauaaaucugagaauauuaacaaacuagagagccgaauuuaacaaagauugucuggaugugacaacaucuaaacaaggugaagguuuaaucggacccugaaauacuuuaagaucuguuggaauuccugaaaggaaacuugaaauuggcucuuuucccagaugcuagguacucagucccccuuaaauagaccuuccaggaaaaauguugucuaguuccgagguucugaauggagcauauggccagaaacaaauauccuacaaauguugcuccuuaagcacuaaugaucaaauaaaauuaaagagaauuagaaacuagugcuauuucaucaaauucuaggcauggaagauucacagucauuuuagaacucauguucuuuacguucuaagcagaaauguaugcucaaaagacucucuguuucacuaaauuuguauagccaagucuugcuaggacaaagauauuuuuguuuuugucacuaugauaaaguggaaagagaauaagacuggaaauaaggaaaugaauguguagcauuaguugagucacccaaccuguucacuccucaagugcuuccacugaaaagagaugguguuaccagcugcuuccagcucggacuugguaaugagaaguuaggacccugguccacugguaauucacucugaacuccaucacaugaguuuccaucaucacuauguagcauagcccaaaaggacccuuuucuuaaauacuaugcucaaaagacauccacugucacuucaugaauuuaauauuuuuccccacgacaaugggauaaaacaagacacaauuaaaguuauauuuaauuauaaauaaugaauagaaacauaauauacaggucgaguauccuuuauccaaaaugcuugggacccaaacuguucuggguuucagacuuuuuaggauuuuggaauauuugcauuauacuuacugguugagcuucccaaauccaaaaaucugaaauccaaaauguuccaaugagcaguuccucugaguguuguguuggcacucaacauuucugguuuuggagcauuuuagauuuugaguuuucagauuugggaugcucgguugguaagacacccuguauuagucuguucucacauugcuauaaaaaaaaaccugagucuucauaaagaaaagagguugaauuggcucacaguucugaaggccguacaggaaucauagaagcuucugcuucuggagaggccucgggaaacuuacaaucauggcagaaggugaaggggaggcaggcaaaauuuacauggcuggagcaggagggggaaagagagcggggaggugcuacacgcuuuuaaacaaccagaucucaugguaacucacugucaugagaacaccaccaagugaauggugcuaacccauucaugagaacuuugccccucagaaaacuuacaacauggaggaaggugaaggagaagcaagacacauccuacaugguaucaggugagaaagagagaaagagagacaggaacuaccaaacacuuauaaaacuaucagaucuugugacagcucacucaccaugacaagaacagcaugggggaagccacccccaugauccaauugaaacaggaaaaguucccuuguccccuucgcagggcgugcaaugggagugugacucacuucuuuagugccccgcugcucaaaccucuaggggagcacagagaugggcaagcugugaggcucagaccccaaagcagugucuaggggugaauguuuauagccgaagccacagugggcauguguuacagggugcucuuuuagcuuagcugucuguagguggcuuguguuagccaguucaauuagaccccugccuuaucacaaggacagagggcuuucuauauccugggguucuugccuugguguacuggaagaauuggaucacacgugggcuuggagaaugagugcaagguuuuauugaggggaaguagaucucagcagaugggguagccagaagggagaugguuuuccccuggaguugggccacucgacagcccaggcucuucuccaacugccccagucaaacuccuuguuguucugccagucgacggccugcuggcaugcuggugccuaucagugcauugcucucaacguccagcugccugugugacccuccacugaugugcuccucuuggcauccagccaccuguguguuacucugcugaugugcuccucucaacauccagcugccuguguguuccuccacugaugugcuccucuugacauccggccaccugugucugccugcuaggguccccagguuuuuauaggcacaggaugguggggguggcaggccaggguagucuugggaaaugcaacauuugggcaggaaaacaaaaaugccugugcucaccuagguccaugggcauaggccuggggguguagcccuagccaaggaccacacccuucccccguucuguauuauuugaagggacuaugcccuucccuucccagcacuuuccuucuguaucacagucaccucccagcaggucccuccccuaacacauggggauuucaauucaauaugagauuugaguggagacacagagccaaaucauaucauuccaccccuguucccucccaaaucucauauccuucuaacauuucaaaacacagucaugccuucccaacagucucccaaagucauaacucauuccagcauuaacccaaaaguccaagcccaaagucucaucugagacaagggaagucccuuccaccuaugagccuauaaaaucaaaagcaaguuaguuacuuccaagauacaauggggguucaggcauuggguaaauguucccauuccaacugggagaaauuggccaaaacaaaggggccacaggccccaugcaagugugaaaacugacaaggcacucauuaaaucuuaggacuccaaaauaaucucuuuugacuccaugucucacauccaggacaugcugaugcaagaagugggcucccaaggccuugggcagcucugcuucuguggcucugcaggaugcagcccccauggcugcuuucaugggccaguguugagcgccuguggcuuuuccagaacauggugcaggcugucaguagaccuaauauuaugggaucuguaggaugguggcccucuucucacagcaccacuaggcaguaccccaguggggacucuguguaggggcuuugaccccacauuucccuucugcacugaccuagcagagguucuccaugaggacucaaccccugcagcaaauuucugccugcacauccagauguuucuauacauccucugaaaucuaggcagagguucucaaacgucaauucuuaacuucugugcaccugcaggcccaacaccauguguaagccaccaagguuuggggauuacacccucugaagcaacagccugagcuguacguuggucccuuuuagccacggcugggauaaaaggcaccaagucccaagaccguacaaaguggcaaggccuugggcccagcccacgaaaccauuuuuuccuccuaggccucugggccugugaugggaggggccaccaggaagaucucugaaaugcucuguagauauuuuccccauugucuuggcaacugauauuccucuucuuguuacuuaugcaaguuucugcaacuggccugaauuucuccccagaaaguaaguuuuucuuuucuaccacaggaucaggcugcaaauuuucuaaacuuuuaugcucugcuucccuuuuaaauagaaguuccaguuucagauaaucuuuuugugaaugcauaugacuguaugcuuucagaaaaagccaggucaccucuugaaugcuuugcugcuuggaaauuucuucugccagauacccuaaaucaucuaaguucaaaguuccacagaucucuagggcaggggcaaaaugcugccaguuucuuugcuaaaccauagcaagagcgaccuuuacuccaguucccaauaaguuccucaucuucaucugaaaccaccucagccuggacuucauugucuauaucacuaucagcauuuuggucaaauucauucaacaagucucuaggaaguuccaaacuuucccacaucuucuuaucuuccucugagcccuccaaacuguuccaguucugccuguuacccaguuccaaaguugcuuccacauuuuuagguaucuuuacagcaauaccccacuaucccaguaccaauuuuuuguauuagucuguuuucacacugcuauaaagaauaccugagacuggguauuuauaaaggaaagagguuuaauugacucacaguuccacauucuggggagaccucaggaaacuuacaaucaugguggaaggcaaaggggaagcaaggcacaucuuacauuguggcaggagagagagagagagaaagagagagagaaagcaaagggggaggucccacuuuaaaccaucagaucucaugagaacucacucgcuaucaugagaauagcaugggagaaauuguccccaugauucaaucaccucccagcaggucucucccucaacacauagggauuacaauucaagaugagauuugaguggggacccagagccaaaccauaucaggguuauaggcacuggguaaacauugucauuccaaaagggagacauuggccaaaagaaacccaguuucuuuugaguuugaaacccagcaaggcagucauuaaaucuuaaagcucccaaauaaucucuuuugacuccaugucuuacauccagggcacacugaugcaagaggugggcucccaaggccuugggcaguuccaccccuguggccuuccaggguucaggccccacaguugcucucaugggcuggcaucaagugccuguggcauuuccaggcacagggugcaagcugccaguggcucuaacauucuaagggcuggaggauggcagcccucuucucacagcuccacuaggcaaugucccagugaggacucugugugggguuuccaaccccgaauuucuccuuggcacugcccuaguagagguucuccaugagggcucugccucugcagcaggcuucugcuuacacauacagguuuuuccauacacccucugaaaucuaggcaguggcucccaaaccucaacucuugcacucugcacauccgcaggcuucauaccaccaagguuuauggcuugcacccucugaagcaacagcccaagcugugucuggagcccuuugagccaaaacuggagacagagcagggagcaggguccugaggcugcacagggcagcaggguccuggguguggcucaugaaaccauuuuucccuccuggggcuccaggccugugaugggagagguuaccuucaauggcuuggaggccuucugcccauugucuuggcuaucagcauuugcuuuucuuuucauuaugcacauuucuguggccugcuugaauuccuuugcugaaaauaggcuuuuccuuucuaccacaugaccaggcugcaaauuuuccaaaguuuuaugcucuguuucccuuuuaaauguaaguuccaguuucagauaauuuuuuuucucacacauaugagcauacauugagaagcagccagggcacaucuugaacgcuuugcuguuuagaaauuucuucugcgagauacccuaaaucaucacucucaaguucaaaguuccacagaucccuagggcaggggcacaauccaaccaaauuauuugcuaaggcauaacaaaagugacauuugcuccaguuuccaauaauuccucaucgccuucugagaccuucucagccuggacuucauuguccauaucacuaacaacauuuuggucacaaaaauuuaaccaguuucuaggaaguuccaaacuuuccuucauuuuccugucuucuucugagcacuucacacucuuccaaucucugacaguuaccuaguuccaaagucacuuccacauuuucagguauauuuacagcaacgccccacucuuugguaccaauuuucugcauuagucuauucuuacuaugcagaaauauuugagacuggguaauuuauaaagaaaaaagguuuaaucggcucacaguucugcaggaugcagaggacgcauagaagcuuuugcuucuagggaggccucaggaaacuugcaaucauggaggagggugaaggggaagcaaacacgucuuacauggccagagcaggagaaagagagaguggggggaggugcuacacacuuuuaaacagccagaucucauaauaagucacccauucauuaucaugagaacagcaccaaggggauggugcuaacccauucaugagaacuuugcccucaugauccaaucaccuccuaccaggcugcaccuccaacaggacauuacaauuccacaugagauuugguagagacacagauccaaaccauaucacacccauaaucccaucacccaaaccucacuuuuaaaaaaaucuagcaaaguuagcaugugaaagagagaaaaugagagaaacuaguuaggcaagaaaucuauacuuagugccuguuucuuucaugagauuguuuaugcagaaauauuuguugacugccuauuguguuccagguacugaggcugcagugaugacuaaaaaguagucucuucagggcaguagucucuauccugaggaaguuaaaagucuagugaagacagacaaaugaagaauuagaugcuacaaagugggugagugugaaaggaacuccaaaagagucgcuuaaccuagacuuggggugucagagaaagcuucacacauacaaacauagugcuugaauggacccugaaggcugaguuuuucagguaaaauggguaggaagguagauuacaagcucuaaggacgguaagggcaaagccauggagauuagaugagagcaugaccuauuuagggaaaagcaaguaguguaauauggcuagagcacaguuugagagggaugucagaaugugagguggaacagguaucaagauuacuuauggaaggggacuuacaugccuugacaagaggauugggucucugucccgaagacaaucacgagccauuggagggcuuuaagcaggaacaugaaauaaucguauuuucauuuuaguuacaucauuuuuugacuguggaaaaucgauuaugggacaacucuauaaacaaggagacuaguuagcaggcuauugcacuuauucuggugagagaugaugaaccacugaccuaaaauaaggcagugagaguaggaacaaaaaaggauggaugugaaauauccauaagguaaaacagacaggacauugaggcugaggaacagagagcugucaaguuugccugauuuuuuccaaggaggggaggcuccuagcacacgauacaugguuauaaaauuaaguaaaauuuacaaaaauaacauucuuuguauuuuuuaggccuucccaaauuguguauguuucaggccccagaaaaccuagauuaaccccaggcaguagcaguuaagguuaagaauuaaaauuaggauugagaugugagcucaacaguuaauggaccaaaagcauaggcagcaaaagaaaaaacagauaauuugaacuucaucaagauaaaaacuuuuaugcgucaaaagauacuaacaagagagugaaaagguagcccaugaaauaugagaaaacauuugcagaccaugcuucugauaaaggauuaauauccagagcauauaaagaauuucuaaaacucaacacaaaaagcaaauaacccaauuaaaauauggacaaaggacuugaauuguuauuuuucuaaagaagauauacagauggcuaauaaacacauaaaaagauggucaaaacaucacuaauuauaaaugcaaaucaaagccacaaugagauaccacuucacacccauuagaauggcugcuaucaaaaaaacaaaacaaacccaaacagaaaaauaacaagugguacauggagaaauugggaucccugugguugaaauugcugguugaaaugugaaaugguacagccacuguggaaaacaguaugcugguuccucagaaaauugacagaauuacuguaugauucagaaauuucaccucuaaguauauacccaaaauaauugaaagcaaagacuugaaaagauaauuuguacaccgauugucacagcagcauuauucacagaagccaaaagauggaagcagcccaaauguguauugauggauaaauauggauauacagaaugugguauauacaacagaauguuauucaaucuuaaaaagaaugacacaugguccauaaaugaaacuuaaagauauuacauuaagugaaauaagccaguuacaaaaggacaaauaccauaugauguuuuacuuauaugaaguagcuagaacacucaaauucauagagacagaaaguagaauggugguuuccaggggcuagaaggagaagggaauggagaauuauuguuuaauggguauaggguuucaacuggggaagaugaaaaagguccagaaaugaaugguggugaugguuguacaacagugugcaucuacuuaaugcacuaaauauacacuuaaaaaugguuaaaaugcuaaauuuuauguuauuuauauuuugccacaauuaagaaaagauucaucgaugaaaaguacucuugcuacuuaugggaagugcauuccagugaacagacaaucagagaaugcuguucuaucaaucaauaaacauuuauucacugcuuuccucauggagaugaaauagacauuuccuauccaaggucaugguuagcuaaagaggacgucuaaauauaagauuugaaagaaagagguagaggaaauguucuucuuucuucuuuuuucuauucuuucuucccauuuuggccagaagaaucauagagaccaaguuaggcagucaauggaaaaugauacuaaauaucuacaaaagcaccuguacuaaagaucuacaaaaacuucuucgggguuggccaggugaucucaaagguacuuuucaggucuuuuauuugcaucucaauguuaugccucuuaggaacauucaguauuugaaugggacucaaucuaaggccauagagcaagguauaagggacucagaaucacuauagacuguguacaagcaacugaacuccaauggaaucaauaaucauacuagcuuuuuguaagacuucacacaaauaaggaaaacauuuugaguuaaacauuuucuaaaugacaacucuucucuuggugcaaguuuccauguauaaugaaaagagaaucagaaucuugguugguauucugggucucauguugccacuaagccaccucuuuucuucauuuguaaaaugaggagauuggacuaaaugaucuugaguauuucuuauaucucucucauguuacauguugaauuauuuaauauuuucuauuauuuauuuauuuuagacaggaucuuucucugucacccaggcaggaacucuugggcucaagcaaucuucccacccucggccucccaaauagcuaacaccuauuuuuuuuuuuuaauuaucucucucucuuuauuuauuuauuuauuuauuuuuuuauuuuuuugagacagagucucacucugucaccgaggcuggagugcaguggcuugaucuuggcucacugcaaccuccaccucccagguucaagcgauucuccugucauagccucccaaguagcugggauuacaggcaucugccaccacaccuggcuauuuuuuuuuguauuuucguagagacggguuucaacuggucucaaacuccugacgucaaaugaucugccugacuuggccucccaaaaugcugggaauauauacuuuuuaauucuuguagagaugggaucuugcuacauugcccaggcugguccugaacuccuggucucgaguaauccucuugccucaaccucccaaagcacugggauuacaggugugagccaccaugcccagccauuauuucauauuuuuagaacagaauuuuguuguauuuguauggauauaccacauaucaaucaugcuccaacucucacuuccaccuccuaacacacccaaagcaugguacacaaaauaagccuaaauaaggugguucuuguuucuuuagauaagugguuaaucuagauggcugcauauugguaaacaucguuauaaaagaguuugacuaugauuuguugguuucuugcuaugugcuucuuucucuuuuuuccuuauuuuuguuucuuccccaugaauucagaaaacucaucucuaucaucaacugauaaugauauugaaaaccuucuaaaauguuugauacauaauacaugcacaauaaauguuuauuuccaauuuuuaguuaacuucauuuucucaaccaacacuaucauuagcuuuuucucuaacaacacagccaacccuuucuaugaauaucacaaucaaccagaagccaacugguuuauccaucuacuuggcuuccuuugcaagcagggacugaauaaguuuacuugauaggugaucuugaaaagcaagaauaugagagagauaaggaaaagccauugaaggacacauuguugaguugguuaccacuuuggucaauugggacucaaucucugaagaaucuuguaaaaugaaucucagaauuuucucuagcaaagacgaaaggcuaacacauuuaucugcugucuccuuucacucacugaucgaggauggcugccaggggaauuaacaucucugugugucugguuauucaaugugagcuuagugaacuccuguggcuuuggagagagugggagucaggaaggcagagagauccagcaggugcuugagggaaaacuguggcaugcauaggaacuguccaacaccuuugcagcugaaaucaaaagaaguggcacaagacaucaaaaguaucuccuacaaucuaucccuuaccuuucagauccauuuuugcucuauaugaaauucauucugucaccaacucuuuaaggucauagcuagcuucugauuguuaaaaggacuccagaugagacuuaguguagcaagcaaaugucccuugcugcaacugcucaaagggccauaacugauauucaucaggucccacucagauuuccacccauuccagauuuuuuuuacccuuggugagcacuucagcuaaucuaaguuauuugguugguggggagauccaaaugucuucauccuugaggaauccaagcucuugguuggcuuacccaugucaggcugaggcugcuauaauuuuucauucagugcuuuugccagguaugaaagagcuagaugaaucccaguuaaucuuucgagaucuagaaauacuccuuacugccuucauuauuuagcaauaauccuagaugcuuaugauaaucaggaucaauuaccuugccaguaugaaaaaugccuuucuuugucuacuaguccuuuggcauaaagagccaaagugagcaggggguagucauagcuacagguccugugagauucuugcuguguauuaaugcuguguacuaaugcuacguauugauacaagucauuuuucucccuccuaccaccaguaaaaauuuauaaaaauaauucuuugcauuuuuuaagaauguuagcagagccuaaggaugugaacauaggaagcacaaauucugcaagugggucgcuggguaugacggugagagaagccaauucaacuucuccaccuugguuucuagacuuauguauccuagcuauuagauacacggcauuggcucaaugcguauaucacauccuauaggccaaauccuaaucaugcagaguauugucuccaaacuagccgaucucuaaauuguucauuccaacauuuuaucaguucagcaacuuguggauacugugguauaugguaggaacaguggaucccauagucuugugcccauguugucuuguugugccuccuucacuauggguccuuuagugcaaacugauguuauacagguaacaacguuaguaaaugaagcauucuguaagcugucagauaauaauccuagaagcuacacuaugagcaagaaggacaaacucauauucagaacaggaaacaauuccaguaaggaugaaucacuguccucucuggagggaggaugagggaucggaugcaaucaauuugccccuaaguucuuggcuaguguccuugaagguugguacucugcugaauguguguuauugguuuuuguugcugacaagucagaacuuuguagauacaguagcuaugccagcuuggugagaaugagccaauacaguuggggccuugcauggccuccauaccugcugacaaagcuacuauguugauggguccauugcacuagcauuggagugccaagaauagaggcuggcugacaucuacccaagggguagccucuuuuccucauugcuaagagccucucagugauggauguucuccagagaacauuagugugaggcaugaagaugugcauguucauuucuacucuuauucguauauccacaugacuuuuauuugccugcuuauuuacuuauuuacuugggggacaggaucucacuuugucacccaggcuggagugcaguggcauaaccauggcuuacugaagccucgaccuuccaggcuaaagcaauccucaccccucagccuuccaaguugcugggacuacagguacacaccaccacaccuggcuaauuucuuauuguuucuagagacagggucuugccauguugcccagccugguuuugaacucuugggcucaagcaauccucccaccuuggcuucacaacauguugggauuacaggcaugagccacugugcccagccaauuauuauuuuuaauugacauauaauuguacacauugauggaguacaguauaauauuucaauauguauauacaauguguaaggaucaaaucaggguaauuaccauauuauccaucaccuuuaucaauggggccaugauagcauuuggguccccuguuauuagugucaccucagauccuguaucuaacagcccuugaaaggucugaauaaauagccauaggucucuuugggggaagaauuggagaguuaauauauauauauguuuaugaugugauugcagggccuuuccuugagcagaucaugcuuccccuucaauuauuggguucugggucugauaacucacucuggucuaaaaacucaacagaguauuauacuuuucuacuguggcacugauccuagccuacugcucaccuguuuuuacuuuuuuucugguuaugaaagucaaguaauauuuuuguaggcugccuauccaucucacuccugggaacaugaagaucuauuaucacaaaucucuaggggccuggcaaaacccugguuaccccuauagucuugcauauuacaugaauuauguccaucuggccuucgauguuuaagugcagcuaccuggacucucaaauaauugaauucuuuuuauucccauugacccuagaaggcucaauucuguggcagaauuuuauucugugaaccccaauucauagaggccacugccacuaaccuuucauaaaaugcugguauguuccuucuuaccuuuguggagggaguacaguaggaaacagucaggcgauuggucucacauaaaaaucucauucucuuaugcccacuuccuugagccuucugaccuuuuuuuaaauagacaacuguggcaucucuacauuguuaucauguccaaguuucaaggcaccgucuuagcaguguguugggacaaacuccaggaguccuugaugggauguuaccgugagucacgggagaauuacacucuccuguauucagccuuauaucucacuuaccuauccuauucaauuuaacacuuucagauuuauucccauagaucuuuuccucuuuccugucagaauuuuucuguaauucuuucagcaaguuauuucuucccauagaagaaacaguaccuucccucuuacgguaugcuagaacuugacacauuuucaagcuacaggcaguuagaggagucacuggagggaucccaaggaggacgaguaacaucuuccaagacacucaacucaggaagguuuucauccucuucaggcaagggaagacugcuguccuccagcaagaggcaggagacugguuucuguaaccucccugauucaagagcacccaggauuuaagguccucauccauauccucacagaggccuucaucccaagucugagucccacuguuucccuaucaaagcugugacuuuagcauagaucuuuagcguagaagaccuguauauucagucuccuuugccauucugccaccccuaagauugaauuuggagcuugaauuuuagcacagacugcccuuucaucuuuuuuuccuuccuuccuuccucccucccucccuccccuccccucccucccucucucccuucuuuccuuucuuccuuccuuccuuccuucuuuccuuucuuuuucuuucucucucucuuuucuuuucuuucuguuucagagaugggaucucacucugcugcccaggcacaaucauagcucacugcagccuuaaacuccugagcucaagcgauccuucugccacagccucucgaguagcugggauuacaggagcaagccacugugccuggcccgacugccguuuugcuacacagucccuuuacuugcugucauggaagacuucugacuuucacagaaugucuugaccugauaguuggcugaccugaacucgucuuuuucuuugaggcagucuucaaaacucuuauggcauuucacaaaagccagucaauuccacuacuguuauaauuaccauugcccccuuucaucccaguauuagauacuauauaagugaagcuuucccuuccacaacauccuguccaccacgggugagaguuugauuguuaugccagagguuaucaacaccacaauuacuaccagcaauggagcuuuuguuuucaucugacuggugaguaaaccuguuccagaauaccaucccgaggggaugcuuucuccaacuacaccagauauuacugucuuaguuuggguccacccaaaaguagagcaugagguaaggaauugaguucagguaauuuauuugcaaaaugacuccagaaaguaggaaugaaggaguaagcuuacugagagaaggaagauggaaaaguaaaaaaaaaaaaggaggggauguuauugaacuaauuaccgcagugggcaauugggcucaagccuuccgaggauccuuugaggaaccauguggaauacacuugagaauggcccugcaaaagaggggaggcugaacaauuuauccccuggcaccacuggcugggguucuaaugggggaauauuucuccuuugggcuugcccuguacacuuauaagcuccuagcauauaagcucccacugcuuccuugguaaaggaugucagagagaugaagaggaacuuguggugggacucugucagcaugcauaggaaagugcauuacagcugcagcaaaaaaaaucaaaggugggcugaguggauguagagcaucuacuuuaucacaaaagccagucccguacacccagcaaauggucuccuuuaauuaaauauucccaucucuuccuugcuaagaacccuacuuauaagcccuauucauucuuaccaggauaaccuuugucuccucaaaggcacugagagaagaaacaauccauguguguuuuauaaaacgugcugaagucaggaaagauccuagugagaggcauuggugaguuccuguuagguguucuuuuuuuacacuuuuuauuaaguuccugggggaagaacuauaagcaaguuguaguuauccaaucccuugcuccuggcuugaaaauccaguggccagagacagaauuuagcucuaccuuucauggcacucuuuggguggucucucagagaggauauuauaauaucuagaugagaaauaauauaggcuuuuauuuucuuucauuauuuauuuauuuuagagguagguacucuguugcccaggcuacagugcaauggugugaucauagcucacugcagccucgaacacuugggcucaagugauccucccaccucagccuccuguguagcuaggacuacaagugcacaccaccacaccuggcuaauuauuuuuauuuuuauagagacagggucuugcuauguugcccaggcuggacuugaacuccuggcuucaagugauccuucuggcucaacuucccaaagcacugagauuaaaggugagagccaccaugcccagacagguuuuucuauuuuuuugugugugugaacuuccaguccaucuuccauugccuuccaaugggcgcaauuaguugaaguagcaagauguugacucuuguggguuccucuuucacaguggguucuuuucugacuuuggacuuuggcaagauucuucuuuguauuugagccuaucucauuccaccucuccucaaagcaacucaugucauuugaaaagaauucuuuaggccaucgauuaaaaaaaucaccccuuugagguggugacauuggguaccaggggaaaaaggguaccuacuguguauucugauaaguggcuugaaaacagccuccuccucagcuugcugucuuuauugccucaucucucaugacacuuguuuucuucacugcuccuggcaugucuucagguuauugacuucugggauuugcagauuuuguaacgugguacugcuuugaaaggaguacuuuacacugcuuuggaagaacagaaagaaagaaaaggggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaggcggagcuugcagugagccgagauugcgccacugcaguccgcaguccggccugggcgacagagcgagacuccaucucaaaaaaaaaaaaaaaaaaaaaaaaagaaagaaagaaaagguuaaugcuaaggacuguuauuaguauugguauuggucuaggcugagauucaguaugggagugauagcacucuggauaaaugcuugaacacacuuuugucucuccuaccuccugacaccaauuacuuccccacccccacuccucccgacuugcuucucucagguccaggccuguccuugacgucagaaggcaugggcuggucuccaggaagcccguccaagcucagaacuuagagacaaagcaaagcauucugcacaguccugcuugacauuuccucucuuuucucauuugaagauuuuauuguguuacccuggugaugagaaauguaguuaagaaagaggaauucccagaguagaaaguaugggggccagaagaggcaauaagaguccagauuuagaaaaauccuaucagaaggaauacuggggucagaacaacgaugacauucccuuccacccuucccaucucgcaguucaugcaguucucucucaccucugccucaugacugguuguauucacacuuaaaaaggaauacuuccuuuuucaaaacauguuuuuucacuuaagaaaaagagcucagcuuucaguucuccaccucuuuuccucuuccuccuuccuguccuacucuccaauuucuuguguucuuuuauaaaaagaacaauuaaaagcaaagacaaacaaaaugugaaccaucacaaacacaugcuuguaaagcaaguuuuaugcaacagaaugaauauucaaaaaugaaaaacaaaugucuuacuucagauuucacccaaaaguggauucugagacaaggauuuggguacaagcaguuuauuugggagguugugauacuauuuuacauauacauuuauauauauauaagucuuuucuaccacggucccuggcucauaacucccauagcccugguuacuugcuaaguggccgaaacaauaaucauaucuuucgcucaagguuuuguccuuuugucuuugguuccugaagcagcuucagggugaaaaagguaaaagguagucuuuugguguaauguugcaauacuuuaggccucagaacuagaccuuaggaaacagaaucugucucucucuuucucucucucugaccugccuuccuuucaccugcuccuuuuucuccucgaggcaggccauagaaacuaaaaauauacucuaaucuuuccucaccuuucugucuuggagcuggccauaaagaaauuaucugacuacauugucugauuguaggucauaauguugcugaaccaaacuggggcccucucaccggaugcaguaaggccgaacaaccacaccgagguuuugcaucaggaggagggagggugauaugguuuggcuguguccacaccccagucucaucuugaauuguagcucccauaauucccauguguugugggagggacccggugagagauaauugaaucaugggagugguuucccccauacuguacucgugguagugaguaagucucaugagaucugaugguuuuauaaggggaaaccccuuuugcuuggcucucauucucucuuggcugccaccagguaagacaugccuuucgccuuccaccaugauugugaggccuucccagccacguggaacugugaguccauuaaaccucuuuuucuuuauaaauuagucucgaguaugucuuuaucaguggugugaaacagacuaauacagaggggauuuauuugcagaaugccaaguaaagaaaaucaggcagcucacgcuuaagacccaaccucccugugucuuacaagcaagacuuuuuaaaggcaggaguaaauuucagcaaagcagaaauuacaggcaaaaucauaaauguaugaaggcuauacguugguuuggcuuaaaauggugagauaucuugaaguagcguguuaugggucauagguagauucaaaauuuuuuuauuuggaauugguugaggaagggaagcuuucuuuaaaauuuugaguucagcagacagaaaugauaggucuggcccaugggcaugacuuccuccaggucccucaggaagaaauuuagaacaaagaaccguggucagaguucaguccucaauucuuaugugaggucuacgugccgguggacccauuuaguaggggucugaguuucugaaaaacaacucagguacauguguuaagauguuaucuuuaggcugggcguggcggcacuuugggaggccgaugcggguggaucaccugaagucaagagugggagaccggccugaccaauaugaugaaaccccaucucuacuaaaaauacaaaauuaguugggaugugguggcgcaugccuauaaucccagcuacuugggaggccgaggcaggagaaucgcuugaaccugggagguggagguugcagugagccgagaucaugccauugcacuccagccuaggcaacaagagcaaaacuccguaucaagaaaacaaaacaaaauaaaacaaaacaaaaaagcuucccggaggggcgcacaccugaagagggcauggaagcuccacaccccuucccauaccucacccuaugcaucucuucaucguauccuucgcaaucuccuuuguaacaagccaguguuucccugaauccucaucuuuagcuucugcagggaaccaaacuucucaugacuguaacuuucuugccaauuguuuuaagcuacuauuacuguccugcuuguuaaguugcucauuuacuucucagggcuagcuaggugccuggaauuuccccugaagaaacuaaagauuuuccuuuauuucaugcuugggggaagagcuuccaguagaccccuaagaggagucccugcuccaucucaauaagacccccauuucaaaagggguccugcuccguauccuggaagaaggaaaauugcaccgacaggccaagaagaaucuggacagacaggccuugcuggguuucuccacccaaucuauuaguaugggaucauacacuuuuugcccaaucacauuucucacaguugcuaacauuccuaucuaucgaagucuccguaaaaggcgcaagaggacagguuauggggagcuuucagauagcuuaauacauggagcuuccuggaggggggcgcaccugaagagggcauggaaacuccacaccccuucccauaccucacccuaugcaucucuucaucguauccuuugcagucuccuuuguaacaagccaguguuuccuugaauccugugagcgacucuagcaaauuaauggaacccagaaccaggauuugggaucuccaguuuauagcuagucagucagaagcacuggugaaagaaccugggcuugagaugggcaucaaaaggugagaagucuuggggacugagcccucaaccugugggaucugauacuaucuccagguagguggugucagaauuauauuggaggacacccagcugguauucacugcagaagugauugcuugcuggcugguggggagaaauucccacacgucuggugugagaguauggugggagaaacugaguuuauuuuuuuucuacacagaggugaucccaggaacuauggugagggagaaaugaaaugguacaggaaauggaaggagacagggaaaagaucaaugcauuaucuuugcauuguacaaugcaauguacagguuacugccaugaguaauuggggcucacuaucacuauggacacucugagacacauuguaaagcacaucugaaauuguuccaagagacaaggaagcaaggguuuuuauccaucaaugucugcccauuacugguugaaguuugcuccccaggaaauuaacucccugagagcucucaggcagagggaugcuuaaggugaaaagucauugucuaccuaaauacaguugaccuccagcgugggccggagggauaugggcuggacacugacauuagcuagucaaacauuuuugucugaauaaagccaauagcuaguuuaguuuuuaccucucuguacugacccauugguuuaguuuucuugaacauuaaaaauacucuaggcuggaugcaguggcucaugcuuguaaucccagcacuuugggaggccgaggugggcagaugacuugaggucaggaguucaagaccagccuggccaauaugucgaaaccucgucucuacuaaaaaaauacaaaaauuagccagguguggcagcgggcgccuauagucccagcuacuugggaggcugaggcaggagaaucgcuuaaacgcggaagggggcaguugcagugagcugagaucacgccacugcacuccagccugggcaacagagcaagacugucucagaaaaaccccaaaaaacaaaacaaaaaaacuucucuauauccucauguuuuuauaggcucuaugaaaauaguaaucccccauaaugucucacauuucucacaaugcacuuucuuuuuuuuuuuuuguagauggaguuucacucuuguugcccaggcuggaguuuaauggcaugaucucggcucacugcacccuccaccuccuggguucaagcaauucuccugccucagccucccgaguagcugggauuacaggcaugcaccaccacgccuggcuaauuuuuuuuguauuuuuuuaguagagacgggguuucuccacguuggucagaauggucuugaacucccaaccuccggugauccgcccgccucggccucccaaagugcugggauuacaggcgugaaccacugcgcccagccacaaugcacuuucauaucaauuaucucauuuaaucucaaaacaguccuugagauaaauauuaugagccuuacuuuacuauaggauaacagugaccaagauaaguuaaauauuccccuguaaggccauaaaucaagcaaguugcuaauguucaaacuucacucuuuugauucuaauuuugguacuuuucccaccauacccacauuugucuucuauaaucgcgcaaauuucuugagugugggcaugggauguaacauacuaauaaugcuuaaauuauauguacaaaucauguuaacauucuucauaugaaucuuuuguauucauaucccuugcugguacaagugggauacauaguaggagacaaccaccauaaagacacacaaaaaauuaaagaauaaaggauaggcugggugcggugacucacgccuguaaucccagcacuuugggaggcugaggugggcacaucacccgaggucaggaguucaagaccagccuggacaacaugaugaaacccugucuguacuaaaaauacaaaaauuagcugggcuugguggcgugugccuguaaucccagcuacucaggaggcugagguaggagaaucgcuugaaccugggaggcagagguugcagugagccgagaucauaccacugcacuccagccugggcaacacagugagacuucaucucaaaaaaauaaaaauaaaaauaaauaaaguauauaaaugcaucauaaauagaguaaugcuaggaagaaacugaauaauauucuaucauggaaaaggaguaguuagggcagggcacaggaaacagcagauuguuuuccaucccucaucagaagauugggaguauaauuuucaaugaaaagagugaagcugauuauaaauguaagauauuggcccuuuaggauuugcuguaggccagcaguuaguggaauucuuaauuccccccaauuauuacuaaaauuguuauacccuaaagaccaauaaggcaugagaaggaggccugugcuuaaaauaaucucuacuuagaaucagguguauuaggcaauaggaaucauaguaaauaagcuucaguauguaucaggaaagcagagagcuauuaccagcagaaaaucuugaguuugaaaauaucacuauaggcugggcacaguggcucacaccuguaaucacagcacuuuggaaggccgagguagguagaucaccugaggucaggaguuugagaccagccuggccaauauggugaagccccgucucuacuaaaaaauacauaauauuagcugggcaugcuggcaugcaccuguagccccagcuacucaggaggcugaggcaggagaaucguuugaauccaggaggaggagguugcagugagcugagaucgagccauugcacuccagccugaugacagagacuccaucucaaaaaaaaaaaaaaaaaaaaaaagaaaagaaaaaagaaaagaaaauaucacuaaaaaagggcagagaagaacaauaugagcucuaaaguaggacagaccugccaggaaaugcuacaaagagcauauaguaggccuugguuuucuauacaaugucuacucccuucuuauucuuucuuaacaggacccuaguuuugcucagauauucaucuguucuucaugcaauucuggaguaaccuccagcucgggagucaacccuaauuggucugaaucaauuaugauauucuuauucuccugccaggaauugguuuaugaucaugugguucagggaccugguucuuguccaugacaaggauagagaagggccugcuuucuaccuguggacacugcugugucuguaugugaugccugaaacuacuacauccaucuuguuaccagucagaguaugaagccaggacacugaugaguguagaguggaaagacgaaaugaagcuggauccaagaugacauugaugaguagcuacaucaacccccccaaaucuauuuacugacuacuucaggauuuucugauacaugaguuaacaaauuucuauuauuuaagccaaucuggcugagugauuuuuuuguaauuuauagacaaagacacuuuagcugaugcaagaauuaggauggugguagaccuuccaucccagcaugcguucuuugcucuuucaauaauaaaagaugagcaagacaaaacuagaagauugugcauaauuggauguccaauucauuuguuggaaaaaauucagggaaauucuaaggaaccacaucuauguuuuucugaggcaggaaaacaaaauauuuuuaaaaagagagagaggaggccaggcacgguggcucaagccuguaauccuagcacuuugggaggcugugacaggcggaucacgaggucaagagauugagaccauccugggccaacauggugaaaccccaucucuacuaaaaauacaaaaauuagccaggcaugguggcacgcaccuguagucccagcuacuugggaggcugaggcaggagaauugcuugaacccaggagguggagguugcagugagcagagaucgagccacuguacuccagccuggugucagagugagacuccguguagagaaaaaaaaaaaaaaaaaaaaagaggaauguucauucuuuacucugguaauaauguauugugccauauuuuggaaaaugaugauauuuuuauuuaauuuauguaaguuuauuuuuauuuuuauuuuugagauagggucuugcccuauugcccaggcuggagugcaguggugugaucagggcucacugcagccucaaccucccaggcucaaacgauccucccaaguaucugggaccacaggugccugccaccaagcccagcuaauuuuuguauuuuugccauguuggccaggcuggccucaaaccccugggcucaagcaaucugcccaccucugccucccaaaguacuggaauuacaggcuugagccaccaugccuggccaaccauaguucuaaaaagauguuugaaaauauuccaaaugccaccgcaagaaaaacgaggaaaguauuggcuuuuagaauguggaaucucuaaaaugagaacuuaaaccucuugagggcaaggauaaugucucagguuugcauucccaggguccaccauagugccugauaauaaaagcuugucagagaaauaaucugagaaccugggaaaauguguccaaagugguaucacgcaaauaguaucacacagaagaugucccuacaaagauucuaagaauaugaucuuaaguguguaaagugucaagaugccacaacuuaccaagacuuugaugauuacauuuuuuuaaauggugcaugcuuucaaaauuauaaauuacauuuuauuuacauauaaaauuaaauggcucuucacuccuuaaguguggacugcaaauagagacuucuuuccaaaaagcccuauaaaacgcgcgaaaaacuguaacuuuagagugcagaaagcuacuacccaauacuaccucaacuaggugaucaaggucaacgucaauagugauaagucauuuugauagcaugugcccuugaucugaugugaugaaaauagcaguugauuucugugaucuucacuaucaaaaccccuaaguccagucuaauuaugagaaaaacauaagguaaauuucaguagaggaacauucuauaaaacacuggccaguacuacucaaaacuguugaggccaucaaagccaaggagagccuaagagauacgaugacuaaauguaauaugguauccuauaugggauccuggaacagaaaaaggauaguagguaaaaauuuaggaaaaugggauaaaauguggacuuuaguuaauaauagugugucauacuaauauaaaauguuaacaacaggggaaucuggguguggaauauauaggaacuuucuguacuauugauaugguuuggcucuguguccucacccaaauuucaucuugaauuguaauccccacguguuggaggaggggccugguuggaggugauugaaacauggggguggauuuccccucugcuguucucgggauagugagugaguucuccugagaucugaugguuuaaaaguguguggcauuuccccccucacucgcugucucuccugcuccaccaugguaagaccugcuugcuuccccuuugccuuccaccaugauucaguuuccugaggcuucccagucauguuuccuauuaagccugcagaacugugagucaauuaaaccucuuuucuucauaaauuacucagucucacgugguucuuuacagcagugugaaaacggacuaauacaacuacccucacaauuuuucuguaaaucuaaaauuguucuaaaaaaaguuuauuuaaagaauauaugggcugcaaacagguaccuucaguuuugagcuaugucucccauuuucccaauaauuuucaucuaauacaaagcuggucuugcccuuucaauaauagaaauacauuuagaaaaccauacgcauugcagaaauuuauuauaaucuguacuuugacagcaaauaucaagcacauuuauugcccagaugcauaguuaguuggcaaacauuaauuuuaauuaauuaaguauguauaacuaacgugaagauaucagucaugaacagcugaaucucaguaaauuaccagcuccauauuuaaacaaaccacaucacuguuuaaggucacauaauugucucagauuuuuggcaugcuuuuuaaaaauugucauucgugaauuggauacugcuaggaaaagaaaugcuauuaaaaaaaccaaacugaugccgggcgcaguggcucaugccuguaaucccagcauuuugggaggccgaggcgggcggaucacaaggucaggagaucgagaccauccuggcuaacacggugaaaucccgucucuacuaaaaauacaaaaaauuagccgggcgugguggugcgcgccuguagccccagcuacucaggaggcugagacgggagaauggcuugaacccaggaaggcggagcuugcagugagaugagauugugccacugcacuccagggugggcgacagagcgagacuccgucucaaaacaaacaaacaaacaaaaaaccaaacugacauauuuaaaaagagaauguauuaaaugaucauuuguauggcuauuacucagagugggaccuuucgucuucucaucugcuuucacagucuuaugauuuugaaaaguaagccaacuacuggcuaugccaucaggcuauuaguuuaacuuuuauaacuagaggucauaugaauuauucagaguaaacucaguauaacuacuuaauugguuggcucuaacuuuaguuuugaaacuaauuaacuggaagggcuucgguaaauuacuuaaucuuuuugugccucaguuuucucaucucuaaaaaggacuaauuguaauuaucuuauguggcacaaagauguuguaacaaaguaaaguaauaaggcaugaaaacuguuugggagguaagguuuauuucacacuacaaaaaguucuuuguaaauacagauauucacugaaaaaaaucugguaaguuacggugaaugggaaagguucuggaagaagacagagauugguaauuaggaguaacuuuuuccaaaaaugagaaaaagccauaaacauuuguugcacuaauuuauccaaguuacucauuuccugaaauguuuuuguaggccauauauuacuuucacagcucucaagggaauaucaaaauuugggauaaaucuauuauccugaaauuguaauauggaauuguuagugagaaauaccacuuaauguguaguaaacauuaaauguauaagcugcauaugaaaauaguuucuacaugauuucagucugccaaagccaaucaucugucucauggaaacuuauguucauacaccuuucuuagguugucaugggauucuuaaguuuuaaaauacuuauguuuacuaauauuaucaauguuauucugaaaaaaaagacacuagaaaaaauuaucucuaaauaugauggauuuacucaggaauagaaguaaagauuauaauuuggagugcauggaauggcaagcuaccagugcauuuauuuggugagggaaggguaagaggagcuuuuauuagcaaaaaagagucuuacauaaacugcuuagaagcagaguucauucggcugggcacaguggcucaugccugcaaucccagcacuuugggaggccaaggugggcggaucaccugaagucaggaguucgagaccagccuggccaauguagugaaaauaauuugucucuaauaaaaaaccuaaacaaaacaaaauaaauuagcugggcaugguggcaugcaccuguaauuccagcuacucgggaggcugaggcaggagaauugcuugaaccugggaggaggaaguugcagugaaccgagaucucgccacugcacuccagccugggugacagagugagacuuugucucaaaaaaaaaaaaaaaaaagaaagaaaagaacagaguucagaguucauugguccucaaguuucaaagccagaguuauugucaguucauuguuggagaugcuguugcugggcaaguguuccuuggagaacugcucuuaguauucuaaagaaauuuaagacauauuuauuaggugacaacauucuuuacaaauaugaacugaauuggaauaaaagguuaaucagguauuguucuaugcgugacuaggguucuccagagagcagaaucaggaauucugguagugagguuagaaucuguguuuuaaugagcucuucacauaauucccaaauuugaaaguuugagaagcacuuguuagugugugugugugugugugugugguguguaggguucuuguaugguugccaugacauucauuuucuuccuuguuuguaguaaauaugagucacucaucgagaccuuuugaugccuugauauaugaugggcaaauuccccuugacacucucaccgaauaauuuuuguugaaugagauuggagcaccugucuggagcagaguggaaccaucaccaagaacucgagucucuucucucuucugaaaugcuguuaaauagccucuaccccauccaggcucuauugagguccucugcacuuuaguuugcuuccuccaagucagcagcucuagaagguggccagcacugguggcaauuuuuuuuuucuuugccucugccgaaauuccaugaugguguacugggguugucacucuuaaaaacuuuuucuugacuuuuuaaaagacugucuaccuuuucaaaucauaaucuucucuucaaauugcagggagugccugcaauccucuucauggauugaaaaugacaguacccucuggagguuggguugguucccucuuuggaaggagucacccagggauugauggauggaguuugauggagagugaagagagcugcuggcucaggagcugacacucaguacaagcuuggguaccugggaugcuccuggguuucccaaccauuaaagcuuugaguggaguugggaaugccugagccaauaaucuccacgcuccaggaaacagaagugacuucuacucaacuuccaaauguuuucuuccuagcuuuugagggcaucuaugaguugacucaauacuacaaaccuaaaucuacuccccacuauuuuccaaaacaagucuuccuuucaugccacaaacaagccaaacaucugcauccuuucuugucuuuuuuccuuucuacuuagaaaguuauuucuucaauauucucucuuuguaaauuaucccuauuccuaucuccuccaugaaacccuuucccaacuauucuuggucuuauuguuuucucaauuucuguagcacuuguccuugaaccauauaauuuagccauuaauuacacacugugccacacuauuugcucuuaugcuaaugugucuuuaguuuuuuauucuccaacuaaauuauaagugucaugagacauuucccaucucuuacuuuacaaauguagaaaccuguuuaaaguacacagaagaaauuagagucacagauuuagaccugauuuuagcacuuaaaccucagccucucucacagucacucuccuguuugguuccaucccuuugggugcucugauucuagaauauuuucuccaagucuuucauuucacuuuuucugugaauccuucucucucucucugucugucucucugucucucucucagauguugguaaauguucaugucacuggaugaauacuuuagcuauguauacagagcaccaaauguucucacuaaaaagauauggaugaggacaggauuaucuugaccuuguggcauuucacaaaugaguuauuauaacauuguggcaaaaucugacgaauugaagcuguuaaugaacagagacucccacauucaugaggacuuucaucuuagaaacucagcucugcuuuuauuauuuaaaauagcucugcuauuuauuauuuauuauccucuucuccuacuucuacuccuaaaugccauuccuuuauuuauggaaaagccuacuaacucauuacuuuaaauguugcguaauaucugccuuaguauuuuuagaccuaugucugauaaaaauguaguucugcccugcauuuuaggcaccuuuucucaauuaaaaaagaagcuaguauauuuauugucuuuaucuuuaaacacacauuuaacucaucgaugcaucccagggacuaucuauccaucucaccuggggguugggcgcugcuucaccuaacauaagucuaaguaucgugcuuuaacucaauaaggaaauauuuuucucgcauaacaggaagugagaaguccugcuugaaaguaagcaguccaccuacagauggguagcccagggauccuggggcaccucaccugggccaucaucaccccaggcuccuuuuucuacucugcagugcuuaacaugugcguuuauuuuccugguggucucaucguuacaguauggcugucccaccuuuaguuucccacccagguuuuugguaggaagcaaccaaaacaacaaucgaaacacaacaaacacaaggaagaacgggaggagccuguaucaggaaagcaaaacuuuugauuuccagcagacuugagcuucuaucuccaggaaagaacuguggcauacccucaucucggcugcaagagaggugaggcaauggagauuuuuuuuuuaguuggguacacgguggccuaaucaaaauugggguuuuuauuuguaggcaaaaaagugaaaaggauauuggauagacaacuagcagggucuaucccauggacaagccagaggccguuccucaugaaugaugaagaccuauuuucagagcuugaagauguggcaagauuaugaaugugugguuggcugagacauuucaggcaagacugugaaagcugugagcagaauuucaagcacucagauacugauccaccauucuuuuauauuucacaauuaaaguacuccuuguuaguuaaacccacacaaaugcuuccagcauuucuuauguugaacauaggcgaccuggggaaaaaugugaauuccauucuaaagaggcaaaauuuaacgcaguaaaaaacagcuaugguuuugccagacauugggucuaguucaugaauauuugcugccaccugcaguuuaaacuugauauucacucuggucaccaccuguaacugaaguguggcccagcaaaugaaaaggaagguugcgaugaguauccucgucauugcugcagccuuaugcuuacuuaaaauugaaguuucuauuuguacauccccauucauagcaacauuauuuauaaaagucaaagcauggaagcaacccaagugucccuugauggugaauggauaaacaaaauauguuauauacaaacaauauaauauuauucagccucaaaaaggaaguuuugacacguuaucacauagaugagccuugaagacuuaacugcaauaagccaauuacaaaaagauaacuaauauauuauuucacuuauaugagauucucagagcacuuaaauucccagaaacagcaaguagaauggugauugacaggggcuagggaggaagagggaacggagagucagaguuuaauggauacagaguuucaguuggggaagaugaaaaacggcuggacguggaugguggugaugguugcacaaaaaugugaauguucucagugcccagaacuguacauucaaaaauggcuaaaauggcaaaagauaauuuuuuaaaauguugaauuuccagggaagugaggaagcugauuccguagaccacagaaacccggcguauuccaguuuauguuaccauguaauaauaaguugacacuaagucuguuggguuuccccauuccugaaagaggugucuugucuguugaugaacagauugucauguucuagucacaaugcaaauuauuuuggcggugucgagaaugcagcaguuuaauguacuacgaaaaaugcauguaguagauucagcugcagggaaggaggcaaguuaggguaauuugggcaacucauguuucucuauaaaauccauuuccuggcauauagacugaauauuuucauuaaagaaacaguuuucauuaaagaaacagaaaagagacuguuuaguggcccuagagaaauugaaaaauuguuuucauggucuucugguaguuuuaaaacauagcaaaguaacaaggccauguacugcauauuauucuauuaaaaacuauguaaucccugauuguacuuauucuggaaagaaagcagguggggaccuccuauguccaugaaauguguuauuauuauacauagagugugggaaugaucauauuucuuuuuucuuuucuuucuuucuuuuuuuuuuucagguguaguuucacucuuguugcccaggcuggagugcaauggcgcaaucucggcucaucacaaccuccgccucccggguucaagcaauucuccugccucagccuccucaguagcugggauuacaggcacguuacaugcccggcuaauuuuguauuuuuaguagagacgggguuucuccauguuggucaagcuggucucgaacucccaaccucaggugauccgccugccugggccucccaaagugcugggauuacaggcgagagccaccacgccuagccuugaaugaucauacuucaaauugaacgugccaugacuuccauccggguuagguuuaaaccguuuagaaaacucuugagauaacauuuuuaguuuucuggccauugaaaguugaauggguuuuagaguagagcagucuccuuuauccuuuucacuuucagcuuaauugauuuccacccccacacuugcaauucagaucgucaguggcuauuaccuguuauacccugaagaguggccacaggacagacaucacucuacagagaaauugaauuuuauucuuuuggaaaauggacugcaauccugucucauagcuugagauagucacacuauuuuuuaaaggaaauguguggaaaagauaaaaaugaaauugagaaagauaguuaaaauaugaggaaaguugaaaaaggauagauguggaauccaaggcaucuuuggaaaacuucuuugugugggauaaaggaugccuucugcgaagaaaaucagcaaaaugaccaacugccauaaaagggcacuuacaguacauuuuuccuugccuaaaugcuaaguggagcugcagaagggaggggaagguuuuacuuccugucucucuggcagaggggaguguaguuggcugccaguccccuugcuguucucuggguccacaccgccccaguauggcugcagccacugacugagcaugacaggguacuacugccagcccauuucuguggcauggccauugugcucauggggcaaguuuccugaucaccauuaucagauuauuugacucaacccuuuaaaaaaaaaugcucucauuauguuccugaaacauuacaacuguggccaggaaacucucucgcuugcucaaccugccuccuaauuuccccagaucucccuggcucucaagguccuuccccuucacuguuuaaaugaggccuggcuguguccugaguuacggguugucaugcagcuuucuuaaguccccauuaugacuuggugccuggauguggagacuugcuucccagugaugcuucugaaaccaguuuucuuccuuuuuuuucaaccucaccaccccuaaucaugcuucuuugaagcucauaccauacaacuauaguucucaguccccccuuaucugugguuuugcuuuccaagguuucaguuaccugaagucaacuguggucugaaaauaggugaguacaguacaauaagauauugagagagagagagagaaagagagagagagagagaccacauucacauaacauguauuauaugccuguaaucucagcacuuugggaggccgaggugaguggaucacuugaguucaggaguucgagccagccuggccaacauggugagacccccugucucuacuaaaaauacaaaaauuagcugagcaugguggcucaugacuguaaucccagauacuuggaaggcugaggcaugagaacugcuugaacccgggaggcagagguugcggugagccgagaucaugccacugcacuucagccugagugacagagaaacuaugucucaaaauaaauaaauaaauaaaucacauuuauuacaguauauuguuauaauuuuucuauuuuauuguuauuguuguucaucucuuacggugccuaguuuauaaauuaaacuuuaucauagguauguauguauaggaaaaagcauagcauauauaagguucagcaugaucuguggucucaggcaaccacuggggguuuuggaacuuaucugccaugaauaaggggugccuacacuaucccauauugcuauuaucucucauucacagaacaccuuccagggcaguguuucucuccaccuaaaguugucagauuuggcaaauaaaaauacagaaugcccaguuaaauuugauuuucagacaaacagcaaauaguguuuuauuuggcaacccucuauugucccugauuccucccaugaauuucagugcuucaguauccacagggaugaccccacuaacacagccucugucacuagccuccuaaccuuccauggcuguauaaaggaauggacuuuccugcccucugaugucaccacuucauagauucuucucucuugucaaugcuccuccagauauugccccauuuaucuguuauuuauuuuuuauuuuaucucauuuauuuauuuugagacaggaucucacuuugucgcccaggcugcagugcaguggcaugauaacuacucacugcaaccgccaccuccugggcuuaagugauccuccugccucagccucuagaguagcugggacugcagguauaugccaccaugccuggcuaauuguuguauuuuauguagauaugggguuucaccauguuggccaggcuggucuugaaugccugggaucaagcauuggccucccaaaaugcuaggauggccuuggccucccaaaaugcuaggaugacaugagugagcuacugugccuagcguuuauuuuguauauugagacaaggucucacucugucucccaggcuggagugcaguggcacaaucauagcucacugcagccucaaccucuuggacucaagcaauccucccacugcagccuuccgaguagcugggagcauuuuuucaggugcuuauugaucauuuguauauauucuuuggagaaauaucuauucaaauccuuugccaauuuuucaauuuuuagauaaauauucacuuaauguuccaaaugauuuauaaauuugucuucuuccaaaauauuucugauggucuucauuuuuccaucaaccauauuuaaacuggucacaaagaaacuguuuauuccacagcucaaauaaaauugaauuuucauauuccaacaauauuuaaauauaguucauucaauaaccauuuauuaauuauuuuauuuuaggcacagaggaaagggaaauaaauaagauacggcucauaugccuaauaauucuguucugaucacccugcagaaguaggauagacccccauccggaacuugauucagaugucaagacugaugaugugacugggcgagguggcucaugcccguaaaccuggcacuuugggaggccaaggcaggaggauagcuugagaccaggagcucgagaccaccaugggcaaaauagugagauccugucucuaauuaaaaaauaaaaaauaauuuuaaaagacugaugaugccacacauacaucaagaaguuaugaaagguuuguuacuuacauaaugaggcuuucugaguacagcaggucaaguuucccaagcugguucaaauggcuuaagagagcaggguauauggcagggugugguggcucaugccuguagucucaguacuuugggaggcugaggcagguggaucaccugaggucaggaguuugagaccagccugaccaacauggugaaaccccaucucuacuaaaaauacaaaaaaaaaaaauagccugguaugguggcacacgcuuguagucccagcuacucgggaggcugaggcaggagaaucacuugaacccaggagguggagguugcagugagcugagauggcgccacugcacuccagccugggugacagagaaagacuccgucucaaacacacacacacacacacacacacacacacacacacauacacacacacaacgagagagagagagagcagggacuagagacugucuuggggcuuuauggugguuaggagauggggccacagugaggguuucccuguugaggguuugaauuuccuaucagcuccaaaggagagagagcauggcuuuuuguaauggcuugcucagaggugggggcagaaggggaaaagggacuggugggcuugaaaacuuccaguaguccauuauccuaagugaucuaacacaaaggcaaaaaaccagauaccgcauguccucauuuauaagugggagcuaaacacuaaguacacaugaucauaaagaugggaacaauagccacuggggaucacuagaugagggagggaggggggcaugggcuaaaggaccccauguuggguacuaugccuaugaccugaacgacaggaucguugggaccucaagccucagugucacacaguuuacccauauaacaaaucugcauguguacccuuaaucuacaauaaguugaaaccuguuuuuaaaaaagaaaacuuucaguagucagacauaaaaaauagacucaggcucuuuauuacaaaucccagucuaguggaggagaaaagcaggugaaucaauaaaaacauuacaaggcgauaaauguccacagugcugugcaaguccagagaaaugaguguccagcugccuguggaagacuucauaaaacuggcauugacuggaucucaaagggaagaagacucucucaaagcagagaaggauuaaggaggacaggaggaauuuucaggcuuagggaacaguauuuggaaaaucacagauauaugaaagugcauaguguauucugaaaacaauccacagucccuuuguaaagaguaaggggcaucuggagaggaagcagaggccagaagaggacccuggggaggaaguguguguaugugagaugagcucuguauggcauucuaaauguuuugacuuuauccuuuggaaaacaggaaagccucccagacaggauaguaucugcauuuuagaaauauuauucaggucucaggagaauuggugagugaccaaguagaacuaccaggugcgaccagcaggggacacgauugcaaucaucgaguuuggaggcuaggaggacauuaaccaaggcuaggggauugggagugggcauagauuugggagacaagucuguggaucauuuuguguguaagggugagagagagugagaaacaaacucuugggauuuuaacuuggacuacugggaaucaggaaugaucaacagauuucugauuuuggugaccauguacauaguggugcccuuaacuaggcuaggaaacagggaagagggaagaagaaauagugagauccauguagagaauguucaauuagcaaugcccuggcagggcuuccuggcuaguccuuuucguacuuaaaguugucaguaggccauacugccacacaauacauuugaguacagcaauguauaaucggacccuaacccaggcggccucuuccacuguggucaccuugagaggcuauaucaguucuguugcugcugucagaggccccauugcuuugaacaugccugcgacucagagguaagaccugcuucuuacguaccuucacgguuuaugaaguacuuuaucuuaggugaaccucaaaacaacccugugaaguauacaguaggauuaucauuuuuuacagauaacaaaacagacucaaagagguugcuucucuaguucacaugguuagaaauggaggacuugaacccuccuuuuuagugauuaauuuaauugguugaggauuuguaggaccugaaaguuuagcuagguguguggagucugccuuuuagugcaaguuuagccagccaaggguugagagaaacaggcagggguggggguaucccagaagcaggaccagucagggacucaguuacaggagagaagcagucagggaccagagagcuggaggcagggucuaaauucuggaucacccagagggucaagaagagaugaagugacaccaaagaucacucagauuuuaaggcagaaacuuugcuuucuggauugcuguauauggccuuuggggcaugggaagcucugaccugcaguuauuaauuaagccaggaccuuuccauagaugcagaaguuuggucuuccacaaucaaggauaauucuuauuuuuuauaauaaugaaaaacuggagugaauguaaaacaguacacuggcuccaccauucacuagcuauaaaauuaauuuaacauucauuucuuccuauguaaaaugugagcauaaaaaucacugaucuccuaaaguuguugucaguauuaaauaagacaauauauauaaagggcuuagaauaauacuuagcucauauuaaacacucaauaauaguuaccuuuauuauugugggaaaugaucucaacagaguuuauaaagcuauuauguuucucaugaguuguugcgggaagucagggaccccaaacagagggacuggcugaagccaugguggaagaacaugaauugugaagauuucauugacauuuauuagauccccaaauuaauauuuuuauaauuucuuacgccugucuuuacugcaaucucugaacauaaauugugaagauuucauggacacuuaucacuuccccaaucaauacccuugugauuuccuaugccuaucuuuacuuuaaucuccuaaucccaucauuuucguaagcugaggaggauguaugucaucucaggacccugugaugauugcguuaacagcacaaauuguuuguagagcauaugugucugaacaauaugaaaucugggcaccuugaaaaaaaaacaagauaacagcaguguucagggaacaagagagguaaccuuaaacugaccgccagugagcugggcagaacagagccauauuucucuucuuucaaaagcaaaugggagaaauaucgcugaauucuuuuucucagcaaggaacaucccugagaaagagaaugcaucccuaaggguaggccucugaaacggcccccuugggugcggcugucuucuauggucgaaacuguagggaugaaauaagccccagucucccauagcgcccccaggcuuauuaggaugaggaaauucccgccuaauaaauuuuggucagacugguugucugcugucaaacccugucucccgauaagauguuaucaaugacaaugcgugccaaaacuucauuagcaauuuuaauuucgccccgguccugugguccugcgaucucgcccugccuccauuugccuugugauaguguauuaccuugugaagcacgugaucucugugacccacacccuauucguacgcucccuccucuuuugaaaaucacuaauaaaaacuugcugguuuuacagcucagggggcaucacagaaacuaccgacaugugaagucucccccggacacccagcuuuaaaauuucucucuuuuguacucugucccuuuauuucucaaaccggccagugcuuagggaaaauagaaaagaacccaugugaaaucgggggcagguuccccugauaaugaguuuguaauaagauggcauacuuuaaaaauuguuaguauaugaacacaaaauaaccacaacuauaaaauuaagaaaaaaagagacuggaaaaaacuucuccaacaugucaucaguuuuugccuuuuuaaaaaaaguaauagcuauauugaggcuaggugucguggcucaugccuguaaacccagcacuuugggagacagaggcaggaggauuacuugaguccaggaguucaagacuggccugagcaagauggugagauucugucucuacaaaauacaaaaaaauaaaaaaauaaaaaauaaaaauucguagggcauggugguuuaugccuguagucccaggaggcugaguugagaggauugcuugagcccaggaggucgaggcugcagugagccaugauugugccgcugcagcacagcaugggugacacagcaagacccugccccaaaugauaauaauaauagucuuauugagacauaauucacguacccuaaaauucacucuucuaaaguauacaguucacagucaguuguuuuuagcauauucacagaauugugcaagcaucaccagcaucuaauuuuagaagguugcaucacugcaaaaagaaacccugcacccauuugcuguuacucauaauccgcuuguucuucccagccccuggcaaccacuaaucuacuuucucuacggauuugccugugguggacauuugauagaagugacaucauacaauauaugguauucuguaucuuucaggaaacauaauguuuucaagguuuauccauguuuuaguacguaucuauauucauuccucuuuauggccagauaauacuccauuguauagacacacuacauauuguauagacacuguccuucaguugauggaccuuugaguuuuuucuacuuuggggcuauuaugcugccaucaguauuaguguucaaauguguggacaaauguuuucgguucucuugaguauauacacagagguggaguugcugugucauaugguaacucuauguuucacauuuuaaggaacucccaacuguuuucuaaaguggcuguacuauuuuacaaucccgcuaacaacguaugaggguucaaauuucuccauauccucaucaacacuuacuauggucugucuuauuaaauacagccauccuaaugggugugaaauaggaucuaguggcagagcuguuucuauuugaguggagaaauguauuacuuuuuuuuuucacucaauuuuauggacuaaaauaaagugaugguuuuucucuuucuuucuuucuuucuuccuuucuuucuuucuuucuuucuuuuuuuuuuuuuuuaggagacagggucuuguucuguugcccaggcuggagugcaguggcaugcucauccugccucaaacuccuguguagcuaggacuguaugcagguaccacugcaucugaaaaacuuucuuuuuuuuuuuguagagaugaagucuugauaugaugcccagacugcuguugaacuccuggccuccaguaauccucccacauuggccacucaaaguacugggauuauaggugugagccaccacaccuagcccuguauuauauuuuuaauaggaaaguuuuucauuuguuuugagacagggucucacucugucacucaggcuggagugcaguggcaagaucauggcucacuuuagccucaaccuccugggcucaagagauccucccaccucagccuuccaaguagcugggccuacaggugcaugucaucauaccuggcuaauuuuuguauuuuuuguagaauaaagauaggguuuugccauguugcccaggcuggucucaaacucuugagcucaagcagucagcccaccugggccucccaaauuguugggauuauaggcgugagccaccgugccuggccuuuuaaaauucuuuuuuaaggaaaauuaaauccauaagcaguaugagaguuuuaguuugagugccauuuccguuaauuuuaaauagucccugaaauugcauaauccagaaauuaacaaaacuuaaugaugucagcaaauuugaaguggcaucuuuucuuauuuauaaauauuuuagcagcacugacauucuaaugaggacaucuaagauauuugcugucaguugagugauuauuugguauuuaaguguaaauuaacccaucagcuauaucacuuauauccggcuucaugcuaaauaguuuaggaggcuaagugguuugagaauaaggcaaagugauuucuuaaaaaggcaugaagaucugaacugucaguuaaaaagaacaguauugaacgcugcuuuaccaagauaagugacacagugcuuaacauaauuuggcccuauuuauuauccuuucuauguagacucuugguaacuuuuuauuuuauuuauuuacuuguuuguuucuuuacuuauuuauuuuuauagagaugcaguuguuggccaggguggucucaaacuccuggccucaagcaguccucccaccucggccucccaaagugcugggauuacaggcaggagccaccaugaccagcuuggaacuuuuuagugcaacucuuuucuaucagagugaauuaauuaauccaucucuuuggagugcuacugcucuuucucuguggggauauagaucuuucuagaagcacuacagagacagcccucuccauucuggaccuccagccuuaguggucagggagaagcggaaaaaggccucugaagggaaugucuugcauuaauaggguuucuagaggaauucagauauuguuggucuaacaagagcaagcuccuuuuuuaugccucugcuguguuaacuuaaaaaaaauacaauuuaucaauuuagaagaguagaagaggagacuuuauuuuuuacaaaggguuguagccagcaagguggccuuucugacagucugggaagcauagucuguggccagaagccagaaacagauacuucagaggagggcaaaaggaacaggaauguaugccaaguagagaggucaaacauacauauucaauaagcuguaaaaggagucaugaauauuuaugaaaggagaaacgugcacaugcacaacugagcuuccugcuucuucuccauguucaaaaaauggcauugggaggggcgcgguggcuccugccuguaaucccagcacuuuggaaggcugaaggggguggauugcuugaguucaggaguucaacaccgaccugggcaacauggcaaaacccuggcucuacaaaaaauacaaaaauuagcugggcaugguagcaugcaucuacucgggucccagcuacucgggaggcugaggugggaggacugcuugaaccugggagguggagguugcaguaagccgagaucaugccacuguacuccagccugagcaacggaggaagacccugucugaaaaaaaaaaaaaaaaaaaaaaaaaaaaaaaaaaaaaaaaaaggcagugaucugaggguggaguuuucaguccucuaaugucacaaagugaagcagaggacaugaaaacccuuacugugcauucuccauggacuggccagaaccacuccauggucuguggucucaggcaaaacaguaggggcaggcggggggaugguucacaccgguaaucccagcacuuugggaaguggaggugggcagaucacuugaggucagaaauuuugagaccagccuggccaacauggugaaaccccaucucuacuaaaaauauaaaaauuagccgggccuggugguguaggccuguaauccuaucuacuagggagccugaggcaggagaaucacuugaaacugggagguggagguugcagugagccgagaucaugccacugcacucuaccuugggcgacagagugagacuccaucucaaaaauaccaaaaaacaaacaaacaaacaaaaacaaaaacaguaggggcaguguugggugguugguucacgucagggguaacaugauuuuaaacaugauuuaaauguuuaaaucaagccaauaaugauuauaacuauuccauuggcuuuaacuuuugaaaguguugaguucuguuaggcccuuagggaagaaagcccaaucaugguuggcaaggaagggagucugaccccggcucccaucagggccgagaacucuguuuucaacguuacucagggguccccuuggcaaagagaugauccauucaguccguuggaggcuuggaguuuuauuuuuaguuuaccauuguuuauguugacaaguugauugcuguuuaugcuauuugcaguauguauagguguuugggucacagaaucuuaagaaauaaauauggacaguuauauacuguagagaaauauauucagaaacauuuguuuccucucuacucuauuuuaaauuugaaguuagccauuugcugauugugccauuacauuacaguuguaaaaugcaaguuuagauacaucuucagacacaaacauuuacaaagcacacuccaagauacaacuuugcacacucccaaaacauagugacuauugcuauuuauggaacucuauguugcugguuauaauauccacuuugaaauuucucauuuuauucuuuuuuuaaauuuaaaauauucucaguuauucauagucuuagccaaucaguauuuaugcaguuaaagaugacagcuaaagaaauauuuuaguucaaaggauuuuuaucuuuuguuucauuugguuuaauuaucuggccucaaacaacuuaaauucuggcagcauugcucuuacucuaguucuuagccuugaaaacuucuuauauaugucaacuauguaaauagcuuuacaguaucaacauucuucuuguaaguucaacaacuuuuauugacuggcaauguuuuauguaaauuguagaguuauguugaaacuuauaaggcaucucuuaaauguuuaaaucaaggcaauaaugauuauaacuaucccauuggcuuuaacuuucugccaguaauuguaauuauaauuuuaaaaaucuacauuuauuuauaaaauuuuaccuggggguguaaaagccuucucauacucuauuaaaaagaccauuauaugcuguuaaaaugagucaugcugaaaucauugcuuacaaaggguucaucuaaaugauaauggguauaauaaggaaguuacaaccugguaguagaggucuuuuuuuccaucuggcaaaucuaauaaaacgugaaaagacauuaagucaugaacaaacacccaauuagaagaucaaauaaacuauggcccuaauuuuuuuuuuuuauaucuuuaaaguacuuuugguaacaauuauuaaucuguauauuccaaguagauacaaccucagaaacuuuauaauacaacauuuguuuuuagcuuucaugagguuauguagcugaugagagagauaaacauuuugccacaggaaaaugcauaugugcuuacuugauuuuacauaaaaaucccagggauccacaguucccuagaacuccuguuauuauauuguauuauguauuguaauuaagcuaauuuuuacuaacgcuuugaaagugccuugaaagguguuauuuacaaaucauucuuuauaaacauuguuguagcuugauauucaggcauuuuaauucauauccaggcaguuguaucuauuaauaguuuuuuagaauaagcuuucagaaaauuuguauguaagucuggucuaugacuucaaacagcuuuauuaaucaaucaacauauguaugguuaauaauuacugucuggaucucuuucagcaaguccaauaacaaaauauuauuuccuucuuuuuucuuuuugagauggagucuugcucugucacccaggcuggagugcaauggcguggcuuggcucacugcaaccuccgccucccagguuuaagugauucuccugccucagccucccgaguagcugggacuauaggucgggacuaugccuggcuaauuuuuguauuuuuaguagagaugagguuucacuguguuguccaggcuggucucgaacuccugaccucgugaucuagccgccuuggcuucccaaugugcuagguguuauuuccuuauuuuaaagcucauuucuuuacauucauugaagaguugguuauaaaccuagacggacacaccaauuugcauaccauuguuggauagcaugaguuuucuggcauauacauaucuaaacuuugcagccacaacuggcagacuacuuuuacauucccagaagaguugaucuaauuauacaguggaccaauaggucaacuuucugugaggaguuuccagagucuugcucaucguaugugcccagagaaguuguuggaagcaacuagcaagccagcaaguggaggacuuccugguagcacuccagccacucagaguuguaaaauuucccugaauaugaucuguuguaguuucaguguagagggucuauucauuuucuauuacugcauaacuaauuaccauaaauuuaauggcuuaaaacaacagcuuauuagcucacaguucuacagguuagaaguccagacaugacacagcuagguuccuuguucagggucucacaggaauaaaauuaaggugucagcgagggcugugauucuaaucugaggcuuggggucauccaaaguuauucagguuguuggcaggaucuuguucccugugguuguaggacugugauugccaccuucuugcucacagaguugcucucagcuucugugggcugcccacuguucccuaccauguggcaccuucaucauaaaaagucagcaauggagaaucuccuuugcaugaaaucucccucaugcuucgaauuucucuuuccaggaagagcccagucacuuuaaggacucaucugauuaggucaggcccaccaaagauguucucccugaaacaggaaauuuucccugaccccuuugcagcaggugggaacuggacugugggcacuggagcuagcuagcugcuuuggcuggcuucacuugcuuggauccacugcacuccagcccuagugggacggggaguguagcugagugggugcaagagccagggcgagugcuuccgggcaccggcaagagcaaaacucugugcaggccccauggcaacaucuagagggggaguaccugugacuccugaagccccagaaggaguguuaacagucagugcucuuuuaguuuugcuguccacggacagcuuauguguuuaaaggcucagugaagccucugccuuuuugugcgggcagagggucaguguguuagccuucuguaccccgagcucuugucuggcauccaggaaaaaucaggucucacaaaugaauuuaaggauaguaaaugugggggauuuuauugccaauggaaguggcucucagcaggaaggggagcuggaaaagggauggaguggaaaaauauucuuccccugaagucuggcugucucuggccggacucugaagucccaucaucaagccaucccucugaagucaagcugcuucuccccgauguccagcuguuucuucuccucucaauguucagcuguuuccuuuucucugccagcugggucagggguuuuuaugagugcaggauggugggugggacaggccaugggugguuuuggaaaaaggcaacauucaagugggaaaacaggaaugcauguucucacuuugggcugugguuccaggcucgaggguggggcccuugccgggaaccccacccuuuuaugccuagaauuucucugccuccugucccuaucacccuuaucuuaaggucaacugauuugggccucaaauuucaccugcaaaucccuucacaguagcaccuagguuaguguuugauugaaaaacugggaaaaggugugugcacacuagugguggugagguaucuuggaggacaccuuagaauucuaccuaccacaguggaagggcagggccuaggaucugacaggggaaaagaguagcuaggacuguuuucuacucuuuagaaaaaauaucuaaacacaugcaaauugugagaggacauauccuggguaacugucaaugcugguaaaccucauagaaagagacuuugcccaagacuugggaaacaugccccugccacuaucuaauuaugugaucccggucaaaugauuuaacuucucuggguuuggagcugagagaaccgaauggaucaggaauucccuaccagguaggaaagcaggagggaagcagcuacccuaaagucagcuggggagcuuuuucaaagcaagcauuucuccuuccuucccaagaugucauaacaguugggaguggggagagaaagguugagaagggaggcaugaguaugugcaguguggaauuguucuucaggucauuccaucauucaugcauucauucauucauucauucauucaacaaacauucauugaccgucuacuuugugucaaacacuguguuaagcacugauaauguuagaguuguaaaucaaaaauaaaauucuaagccccucaaccaacuaaauggacccccugcuuggcccaggagaucccaaagaaaccugaaacacuaguucaggccaugacuggaagguggagguagaguagccagacaugccuccuuauaaccuccucccuuuggaguuuaggcacaacugacuaccauuaacauuaaaacagagaucuuaagacugacaaacagacucuuuguagcaguaagguaugcaaacccagguuuggcugcuaaccccuggaaaaccagacaugagagacaagaauuggugggaagaaaagcaggcuucuuuggaaagcccgcaaaaccaagaagaugguggacuagucacaaagaccaucuuaaauuuuaaaauuuuaucauaggguuuuuaaagggaaacuugguaugggagaugugagggacuagugcaggaugaagggucuguauguuuguucugaugguuaucuuggguaauugccuaucuggaaguauguuuggcauuauuuugucuugggccagauggugguggacuaauuguuugagacuccuucuaagcaggaugauuaagcaggggcucugugccugguuuguuucaagauuaucuucugaaauuucuuaagcaagaacauaauuagauaaacaugaguuacuggagaggagugucuagagagggagggaauaaaagggugaguggggagggaaggaagaaaaagaaaaugugugauuaaaaauauuuuuaaaacugaggcccccaguuacaauaaaauaccaaauucuaaccugacucugguauagcaucgcauggcagauagcaggccuggaaggaaaucaagguauuuuacccccaaauauauuucuuugacauauuuugaaaugguccugcaaagcugucuccuguggaugggggaggggcccuggaauuugcauucuguagagaauccccuucccuuacuaguuuuuuuuuuuccggagagccugacaccuuuuaagguccaauaaaaaacacugucuauucucucugaagccugcuaccuggaggcuucauuuauaagaaccuuagcuucacaaucucccuuaacucaagcauuucuuugugcugacuuuaaacucuucaggcaaaacucaacucuuucaaccaauugccaaucaggaagucuuugaaucuaccuauaaccuggaagccccucucucccagaugucgcaccuuuccaggucgaaccaauguguaccuuacauguauugauuuaugucuuugccugcaacuucugucccccuaaaauguaagaaaaccaagcuguaacccaaccacuuugagcacauguucucaggaccuccugaggaucuguggcugggcagagacaccuaaaugugaucugcagaggauugcauagagaaagcucugccuguggcugacauacugagaacuaaccugggcgccuuacagcaaaaccauccaugaagcagaugugguggggcuuuccugaucuuuuagggcccagaugcauuucacugagaugcauguugccuuuuucugaaagcgucucauaauuagucuuuacauguguuucaaucugguuucacacucguuaacugcuuaaauuguagaaagcgcauuuuauuucaguccacuagggggaaccagagggauuaggcauuggagcuaacaagccuuuaacauucuuaauacuguaauuagagaaauuucuagggguucucaaagugagcugacuuugagagagcugaauagggggguguuuuuugguuucauuuuuguguuuugugugugugugugggggguuguuauuguuguuuucuuuuuaacuuauuugcauaaaagacuauuuuuuagagcaauuuuagguucacagcaacauugaacagaaggggaguuuagaaauauguagauuuccagcccuugcccccaauccacaaaaucagaagcuuuggggauguggcccagaaaucucuauuguaaagguugguggaauaucugccuuuggcaaaaaucuacuuaauuauauaaacuuuaagcccaccaggggcagggacacacugcaaguuccuagcauccacagcaagauguacaaacagaggcucgcaagguuuuaaacauuuuuuuuuaaagauagaggugaaauacuuggagauugucaauauuuggaguaugagucauauauuuuuccaugucaauauuuggaauaugagucauauauuuuuccaguugaacaacuucaacuguuaagcagaauccacauaauuuacuuagagcccaaggaaaaucugaaaaccaccauuugaggaagacuuccggcuccagaaaugaaauuuuagggagcccccaaaucagaaaacaguauauuguuucugaaauaagcauuuaaugaaagacugacagauuccuguagaucuuauccagacucagggaauagaaauaaaugcccuagauucaauugccauuagacacagauguuuccauaguaucaaauacauucuggcacacuggccaacagacacaaguuggaguuacagggagaagagaggccauagagauugucacaggggaggauuuaauacauucuaucuucauaaaaagcaguuuaguauaaaaugaagauacucauugauuuauagggguguauguuagauagcccaagugauauaaaaaaauuagcaaucuaguuuaagaaacacagaacugccuacccugauggacccugcugcacuuuggaaauuuacaaaguaauuuguuuaaacaaacgucaaauugccagaaaucauaugauaagacccggucuucguaacaggucucugaaacucuaguuugaauaucaaauaaaaauucagaacaaugauuugccuuucccaagguccaccugaaguggguauuugacauaguguccugcucagaauuguauuucuuuuuuucuuuuuuuuuuuuuuuuugagauggagucucgcucugcaccuaggcuagagugcaguggugugaucuuggcucacugcaaccucugccucccggguucaaacaauucucccugccucauccuccugaaguagcugggauuacaggcgccugccaccaugcuugguuaauuuuuguauuuuuagcagagaugggguuucaccauauuggccaggcuguuguuagacuccugaccucaggugauccacccuucucugccucccaaaguguugggauuacaggugugagccaccaugcccagccagaauuguauuucuugaugccaaugaauuuccuaaaucaaagguggaaggaaauggcccuuuacuuccuccaucugaagacguaaagauucucagcuagucagacuugaaacauuuauccuaaaauauucuucuggauuaauuaaauaaaacaauaauuuaaaaauauugcaaggcucaguaauaaguuggaauaaauguggaaacaagauuccucucuuuaagcuuuuaccugaggcaucugggcagacugguggcaaucuuagacuucuuccuuauucuuuuuucaaagguuuguuugccauguauggagggcacucauacuuuuauuuauuuauuuauuuuuuggagagggucuugcucuauugcccaggcuggaaugcaguggugugaucacggcuccccgcagcuucaaccuccugggcucaagcgaucccccuaccacagccuccugacuagcugggcacacagguaugugccacuaugcuagacuaauuuaaaaaauuuuuuuuuuguagauacuggguuauugcccaggcuagucucaaauuccuggacucaagccauccccccacccagccccccaaaguauugggauuacaggcaugagccacugugcccagccuuauacacuuuuauaaccuaaccuacuauaacauaaaauaaaauccuguauuguguuuugugcuauagauacauuuuaauacaggaagacaguggaguauuggaagaugugguaaggagaguuauagggauaaagcuauucuuuaauuuauucucaaacuaacauuuggaaaagagguuauaugagagagaacaguauaguuuuuaauacucaaaucuuccaaggaaagcuuguaaaugaauaaaauuccauuucuagcuaacuugguuauauuuccuuucuugcauaaccaugccucauuuuaagaguaaaauuuuaaaaacuuugcucccccauaaaacauuccuucauuuguuuauuucuguuuugaaauaacaaaugccaaauucuguguagguuuuaaugauauugagugucagaauauuuaucauuucucucauaauaaucaauuuacacuguuagccauccuguaauaacugcaaaaucaguuuuagucucuuaccugccccuuucugcuaagaguuuaucuucuaucagccuaugguugcaaaugcaauguaauuugcaguaagcugguuggcagcaaaucgugguaaauccuacuagcuggcuuggcuagaggacaagagcucuuguuugagguucugauacaacucagccacaagagagcauuaaaauugucaucuggugcuacaacagcugccuggaucccagucucuguaauucaugcacucaaaauccacauuuuugaacagaaagguaauuacaauuguaaaggccacuuuucauucauuugcaaauuuuuuuaaaaaacguacucaucuauuuucccacacauuagccaccccuuacucugcccugucuauucuaccucugagagacauuucuaacggacuuacagcucucuuuucuuuugaaugaggauguagcugucuaaucuuuugcaacacagugacccaagucauugcugcaaauucuuggaaguuggcacgugaggugaaaucuacuuauuagccuggcuuugagcugcagcuuucaggaauauuagauuucaauuaacuuuucccuugauagcgaggagcuuagaagguggguugacugggaugcagauguucacaugaggccccauaauuuuaaucaacucuaagaguugaaauaucaggggacaaagagugaaaucaggcaaagagcgaaaucagauaggauuuguucauaaauacuacugguuugaggcuucucacugaguugaagaacugggccguaguaaaucuuauuugauucugcuuguuuauacucaauuguggauauuuugugggaucaaugagguaaacucaucagaggucugagaauuagcaaagucuuaggaggaaccauguguucagaagagaaagcuugacaaaguguuuggugcauaaguucuacuaguugguuguugccaacugcauucuacagcucaguuccuauauaggcuuuuuuggugugaguuugauuuauucugaauuguuuuacuaguuuauuauaaauuauauuaauugaggauugauaaaaguaauugucacagcuuaagaucccuaggaagacuccgaaauggagauuaacaugcaggaggguuauuagggaguguucuuguuguuagcaccuauggaaaggaaaggaaggaaguaggauugggcagaaguaagagaagcggggcugcaguagagccaagggaaagccucagccuacccuacagagagcucugaaacuagacuagcucuuuguaguuggccugacuugcgguaaguugggccuuuguaccucauguuaaccaguuaccugagguaggcugccccaagaaaugggugugaugugggcaaagugacuuuguucagcugaagaaggcugaccguugagggcugucugccagcagcacucuuagcugcugggagaauuacuucaccucagaaggggguccuccaagucacaucacagugucucucagugucucuuacaaguacacaggugcauaccaccacaccuggcuaauuauuauuauuacgauuuuuaauuuuuuuuguagagacaagaucucauuauguuguccaggcuugucucaaacucaaguuugaucuuugggaggccaaagcagggcucaagugaucuuccugcuuuggccucccaaaguguugggauuacuggugugaacccucaugcacagcgaguaagcauuucuugaagaagacacaaaagugcaaaauacacaggaaaagauuaauacacucaguuacguuaagacuaaaaaucaggucaucaaaagacguaauaaugagaauaaaaaagauaaacuaaaaauugggagaagguauuugccacucaaacuauugacaaaagauuaguaccuagaauauaaaacuuugaagaaucaauauagaaaagacaaacuaauacaaaaauggggaaaacacaggaacucuuaaaaaaggggaauacaaauagucuauaaucuuaggaaaaugucaaccucauugguuaucagggaaaugcaaacucaaacuaaacugugcgguaccaguuuucaguuaucuuuuucuccuaaagauauuauugcacaucuaauagauugauacaaauuuaaaagucuauugcggggggugccaagaugagaggauugcuugagucccgaaguuugagaccagccugagcaauguagagagacccuaccucuccaaaaaauaaaaguaaauuagcugggcauggugauguacacauguaaucccagcuacucaggaggcugaagcaggaggaucacuugagcccaggaggucgaggcuguagugagccaugaucaugccacugcacuuuagccuaggugacagaaugagaccuugucucaaaaaaaaaaaaaaaagagaaagaaauaaaaaaagaaaaaaaaguguaucacuucuuaucauaaaaggacacaauauacucacugagaucacaugggaaaaacucacaggcagaagaguuaacagaaugugaguccuccauccucuugacaucuuucuggggagagagagguuccaggggcauuaaaucauguuggcucuccucaauccaaggguguggagcaauggaaacacuauccccugcuugugggaauauaaacuccuauaaccauguccagaaauuuuugcaauauugcauuuugcauauuggagaguugaaccugugccuaacuuuugauccagcaauucccuccuaguacguuccuuaaaaauacuuucguacauaugcacuagaaaacauguuugcagaagccuuacucuuaagaacaaaaaguaauaaauaauacauaaauggauaaacuaauugugguauacuuauacagugaaauacuacugaguaaugcaaaacgaaugaacuacagguacauguaucaaccuagaaaacaauauuaaacaaaagacucaaguugcaaaggaaugugcacaauauauuuuuuuagcgagccauauauaugacauaaaaauauacagaaaagagaauggucaauacccaauacagaaugguaguuacaucugugggagagggaucaggaaguaaauggagaggaacacacaaaaggcucuaaagaauugguaaugcuguguuucccaaagaccauuaagagcuuauuauuauucuuuaaacucuacagauacauuuuagacaaucuuuuuguaaaaaugauaugcuucacaauaaaaaaauuacaguauuccuucaaaaagacauaauuuaaaauggaagggcuauuucagugagugaaugaauguucuuaaauauucaucacaacacaucaagcaucuccccaucuuccauuccucccugucagaauagaaaaguauaaauggacugagccuggaaaagagaguugaguuuccacaguucacaaauguuacuacaaaagucuugguaauuuguucucagaauucccucagagaagagcuaaacuagaauaauaagcucagauccauacuucacgcaaaagaagauuagaauuugguugaaauugauucaccaggugaauucuacuauuuuuuaggucuguagcauuuuaguauuaaaauauuaaaauauauauuauucuuuuuauucuccuaaauguucaaauguuucagaauagaaaucuuaucaacucuguuguuacccagauggcccuaaauauuaggguuuuccugccaaaaaaaaaagcagaaagaauauuuccaggccgggcgcgguggcucacgccuguaaucccagcacuuugggaggccgaggcggguggaucaugaggucaggagaucgagaccauccuggcuaacaaggugaaaccccgucucuacuaaaaauacaaaaaauuagccgggcgcgguggcgggcgccuguagucccagcuacucgggaggcugaggcaggagaauggcgugaacccgggaagcggagcuugcagugagccgagauugcgccacugcaguccgcaguccggccugggcgacagagcgagacuccgucucaaaaaaaaaaaaaaaaaaaaaaagaauauuuccagaaguauaccacauuuuuuucuaauguguauacuaaucacuaaaauuguaaaaguaaaauucuugcccaauuauagauaucuuucaauauguguauguauuuuaguugcauaaugauaucaagauaauuuauuggcauuaaaaaaauuggcagcgcagauuugauagacccaugugucacugagaguuuuuuggguggaagcaaccaaauccaaaucugacuaguucaaacuagaaaagauuuuuuggaaguuuauggacuguuucauuaaauugaagaagcaacugaccaaccaggcuuuggaaaggguaggaauuaggguagcuccaggaaucuagauaaugggacuugucgggcaguauuuguuccuagauacuaucaugaaaauaaacucgcuucaguauuuuuucaauucuugugucacugugcuuaacuuucaaauuccugcuacugucuggccugguuugggccacaugcccguuucuuggcaagagaaaaguauggcauaauugacaguuccaccaagacggcuacaguaagaggguugacauggugcugggagaagucugggauuguccaaaggaaaaccaagaugcuguuacuaaaaaaauggggacauugaugcuggacuggcaaaauugcagauagcuacuauaaccucuuuagcagaaauuaauuuugcuguaaucuucuuauccagaauaauuguacaauuuauauuagugcuacaaacaucugggcacugucccagucugcucagcugccaucacaaaaaacuauagacuaggugacagacuguuuaaaguagaaauuuauuuucucacaguucuggaggcugaaaaucugggaucagggugccagccuagucugguucuggugagggcucucuucuuggcuugcagagagcugccuucuaacugugaccucacauggucuuucuucuguguguguguguauguguguguaugcuugugugugugugcacgccagauagagagagacagagagagagaagagagauaagagagaggaagagcucuuucuccauuuuguuauaaaaccaguccuaucagauuaggaccccacccauauguccucauucaaccuuaaucaucuccuaaaagcccuaucugcaaauacagucacaauuggaccucauuuaaucuuaauuaccuucuaaagaccuuauuuccaaauacagucacauuggggguuagggauucaacauaagaauuuucagaggacaccauucaguccacaguaggcaccuacuaugggacucagaauuugcuaacucauuuuugauaaucuucucauucuuaugcacaaauaugauugcaaaauccagugagugagcaccagccauuuccugagucaucugucagggguuugucagguucuaugggguuuacugcuguuggcaguccugucucuccuccuccuggaccaagaaacccuguccucagagccaaggcccugucuccgaugucuacgugccaggcuggcuuguuugagucuauuacuauucuguaguucagcuccacagcagucacugcuccagucuuuguaguguuuccucuucugucuugcagauaccccaacagaaauucuuagcaaggccggguggaauagcagacagauguggaagucagaacagcuguguucuaucccuagcuccggcacuuagacaagcuauaugaauuuagggaaaucacuaacuuucaguaaguucuuuuaugccaugagugugcauugcugucuuucaaguuuugugcuagguauugagaagucagugauacauacuaugaaggaaacauauagaaugcuaugagagcaugaggauugggggagugcaguuguuguaggaucaagugagauaugugagcuacccaaauucaaaugacuacuuugggaucuggaguucacugauuucuuuaauagaaaguacuguuuuucaauuuccuuccuuuguuaguuuccugcugcugcuauaacaaauuaccgcaaacuuggauuaaaacagcaccaauguauuaucuuaaaguucuaggggucagaaguccaaaaugugucucacugggcuaaaaugaagacauucucaaggcugauuaugcaagcucuuggggagaauucauuuccuuaccuuaccagcuucuagaagcgaccugccuuccuggcacauggcugcccuccauccugaaagccagcaauggccagucaagucuuucucacauuucaccacucugacacacucucuccuuccucgcucuuucacuuauuauuauuauuauuauuauuauuauuauuauuauuauuauuauuuuugagacggaguuugguucuugcugcccaggcuggggugcaauggggcgaucuuggcucaccgcaaccuccgccuccuggguucaagcaauucuccugccucagccuccugaguagcugggauuuacaggcaugugccacuacgccuggcuaauuuuguauuuuuaguagagacgggguuucuccauguuggucaggcuggucuugaacuccugcccucaggugaucugcccucuucggccuccaaaaugcugggauuacaggcaugagccaccgcacccagccccuuucauuuauaaugauucuugugguuauaucaggccuaccggaauaaucuaaaaaaccuccccaucucaagauccuucacugaaucucaucugcagaggccccuuugucaugcacgguagcagauuucacagguucugggggccaggacguggaccucucuggggauggggcuugguccugcccacuccucuccccauguagcucaaaucaugaaacagaagugguuuuaucugcuuuccuuuuaguuuuguucucaguggauaacuaagcaguaaagugacugaaacacagggacaaccaaagcuaaaucagccucuuucucuggugccugaagaguuucaaaagaagcccagagagcuugcucuuuauuagaaagucaagugucaaaaccacaggccucucuggagcggcuggggagaagggcccagcaguuuguuucugguuaucacacuuaacucacuguucucagaauauuccagccaguaucuggaaaucuuuaacugugagugcucugucgaggaagauuuccuaccuacagggauacucguggggagaaaaauuaggcacuuuaaagaaaaucccugacauguuuuacagcagagacaggaaaaaauucaagugaauaagaaaagauauggaacuuauuuccucaugggagacaagauucucagcaauuucuuaaaguauuauacguucucauaauguuguauauuuaaaguaaaaaaaaaaaaaaaccacuggggauauuuggugacccauuuaaaacuaaauuaauuggcauuucauugucaggguccaggcuguaguuuuacaaaucucucucucuggcacuuuuagaaaagcagcuuugaaaaagaagcaaaggguugucuucacguccucuuuuuuuuccuucgagcaaaugacuagaguuuccugauuccagguaagaaacugccaauucaaucacagcaagugaaaaauuaacccuuucagaugcacaagugugugagaugugagugaauucugcagcugcugccaucaucugugcucacuccccagcuuugagcaguggcgccuugcuggggcugcccaggguggcuuggaccucaggccgcugagugagagggcuuaaggacuggcaguggggaguugcuaaaaaugugugggucuucaucuguaaaacggauuaguaaaaaaauaugugugggugaaagugggcuuaagagggagcuuggguacuagaauguucaagaaggcaaggucauccaggaggaaaauggugcagucugcccucaugaguugccuugggugugguagggagaggacauugaggauguaagggaguaccaagaaaggggagcaggagaaugcauuuucuggccacgugucuuuauuguuugccauuucccaugcuaguggguugucugaucagauuugcuucuucagugaaaaugauucuccacuuucccuggccucaugagagagccccugggagaagcagugaaacugacuucagacaggaugggccucaccuuugaaggacaaaugcacaggagcuacccaauaugcaauauucacuuucccaaacucacagggcguuucuuucuuccuuucucagccauuuucggaaccaugcucuccgcuuucuuucaguccuuguaaucagcaucaucucauccgcaccuuucaaccacuggcaacacaaugccugcaaucugguucccucgccuuccuucucugcuguugcaguuugaagucucaagggcaccagcagaacagaggcugcuucugccagaaauugagucuccuuucccacacuccaagcaggaaaaccggugaaagggaggcgagggagggucucucuuucucuuucagaauccugguaugagaacccugcuaggauuuacacacagcacuuuauuuugcaucguggucuacagccacugucuuuucuauuaacgcuagaauugauucacuagguaauaaauggaggaauccuccccaggcuuuccagcaaaauuacuuaugcuauuaguagcauuaagcaggcguugacaacuggagauaagccaccugauguucugucuucugggauauguggaagccaaggcuacuuuauaugacccggaguaggugauagggacaaaggagaauguaaccauuugcaucucaaguccuuuucuaagauuuggucauauuagaaauugcucuuuaauucuuuuacuagagagccacagcucauuaaaacuaacuagacccagagagcauaaaauaacaacacuuuaaaacucagucuuugccuuaggguuuagcaaccugccuagucgaauugcccugguguugaucuuacagcaaagaugccucuguaaauaaaucaccagguggcccuguccaagccucugagaaguuugugucacugaguuugucacuucuuccuucuggcugguugcagcucgacagucgagugcagcguuggcaccaaccggaggggccuggaugcagggcugcugccugcugcauggcgugggcggggggaggauccagggaauccuuugccugaacuccuuuauuuuauuuuauuuuauuuuuuuugagacagagucugguucugucgcccaggcaguggcgcgaucuuggcucacugcagucucugccucccagguucaagcgauucuccugccucagccucccgaguagcugggacuacaggugugugccaccaugcccggcuaguuuuuguauuuuuaguagagaugaggugucaccauguuggccaggcuggucuugaacuucugaccucaaaugauccaccuaccuuggccucccaaagugcugggauuacaggugugagccacugugcccggccccugugcuccuuaaaaaaaaaguacaucuuggggccccagagcugcauguuguggaaagaagcugugugauaaauauucaguagcaccuauuccaauagaggagcucagagaaauuugaaguaaaaauacuuuauuauuuucuuacaucaucuccuuaaaggaaucacacaacaaauccugucuaagcccaaauaaucaccccuuaauuguaucucuucuauaaaugcugauuuucauauguuugagaaugguuauuccucuagagugcagggcaccuggguaugucagccauuuagcagcaauauaguuaaagcguugagaguuaaucauucccaucccugcucccagcaaaucuauuuuguaugccccagcuuggagaauguuaugcaggacucgggcgaacaucugaagacaauauaucagcuaggcagcccaagccucucuagggugugguauuuauggauguggugacuacugagucggccgggaaaggacguaaugaccucgaagcccugauggugucacuucccaagaucaucccaggcgcacuguuucuucuaggacaaggaggauaacgcaaugcagcagaggguguauucuucagagaccaaaggccacaacaauuagaaaguuucuaaaaccaggcuugaucuacugaaguccacacuuaacauucuucauccucccagguaugaaaacgacauugaacauuuaacaacucacagugaaugcagacccaguuggaacuagaguggaacucaaaaaaacaaguauggauuuaacaucgcgagucaagcagcacagggagaaggacguucuugcauucagaagacaaacaagcuaaaugucaguuuagccauguccauuacuccucuccaguacgaagccucagcaucuacaaaaugcacuuaauucucauagaccuccuggaggaggaguguugugguugaauugugucuccccgaaagauauguugaaguccuaaccucagcagcugugaaugugaccuuauuuagaaaugggucuuuguagauguaaucaaguuaggaugaaguuauacuggauuaggauagccccaauccaauuauugcugaccggauaaaaugagggaaauuuagacacacacagaaaaagcacgccaagugagaacacagacacucaaaaggaagauggcaaacaauggcgauauauagcuauaagcugagggcaccagggguuucugggaaucaccagaaacuaggagggagguauggggcagauucucccuaagggcuccuaagaaggaaccaauccugcugguaccuugauuuucagcuuuuaguuuucagaacugugaaagaauacguuuguguuguuuuaagguacccuguuuuugguacuuuguugaggcaucucuaggaagcuaauaccaugauuauuccuuuaguaggagaaacaaacacagguuucagagauguuaaagaaauugccuaagauugcacagcugguaaaugauuaacauagagaauuaaaauccaggguugugacuucaaauccuagauccuucccccaacaugaacuugcuuuaugagaugcagagaagcccacauuguccuguucagaaaauccacuaaucuauaucucugaaaacaguuggcauggaggugaguaaaacaaaagaugugcagcaauuccacaucuggguauaugcucaaaaagaaucaaaaucagggucuugaagagauauuugugcacucguguacacagcauuauucacaauagccaagagguggaaacaaucgaaguaucccacagcagaugaauggauaaacaaaauguggccucuacaugaauagaauauuauccagccuuaagaaggagugacguucugacacaugcuacagcuuaaaugaaccuuuaggacaugacgcuaagugaaauaagccagucacaaaaggacacacacuguacgaucccacuuggaugagaggcaucuagaguaggcuaauccaagaugagaauuaggaauuauuuaauggguuuagaguuucaguuuuguaagaagaaagaguacuggagauugguuugacaacaaugccaguguaguuaacaauacugaacuguauacuuaaacuugauuaagaugguaaauuuuauaugugcauuguacaacauuuaaaaagagagagagagaaagagaugugcauggggcuuuuucugauaacagcauuauuagcuuggccuagaugugagaaggcagucugauagaacaggcugguuuccucauucaaggaaauauuguuucucacgccuguaaucccagcacuuugggaggccgaggcggguggaucacgaggucagaagaucgagaccauccuggcuaacgcagugaaacccugucucuacuaaaaauacaaaaaaaaaaaaauuagccgggugugguggcgggcgccuguagucccagcuacucgagaggcugaggcaggagaauggcgugaaccugggaggcggagcuugcagugagcugagauagugccacugcacuccagccugggccacagaacgagacucugacucaaaaaaaaaaaaaaaaaaagaaaauauuuuuucugccugccugggacuugcguccuauggaagcauucacagaaagggggcugccuaaauugcuccaguggggccuggaagccgacagcucugacaggugcuggcuuugcccuucacgccggcacacacucugccacuguuaguccaaacugcuguuagagucagcguggcucagguguuuagcaucugcuccugagacugacagugcuagguucuuuucucaaaagacuuggggaacaaacucuuucuuugcuaguaggugagcgauucuaauugcauuucuucuuuauuuugcuagcuuguggugaagauaaaagucaugagagucuuuucuauggacugucccugccuccaaaagcaugcugcuuaguagcagagcucuggcuaagaaaugggagacagugcugagcugcugccagcucccgugacgugcccccuggccuagggggugguagaugggugguauaugccucuauuuuguuugcaccccugcuugucuuugugucacugacauacacauucacagucugauuuacuuaaugucugcaacuaauucuacugagaguuuacagagugcaaaagggcaucauagaucaagcaacaucaucgcguuaugugauaaauguauugguccuucucugucuggcucuccagguccacucuccacccuucucugcugaccucuaggcauggcauguccagugcuucccuugugcuguagcugcagcugguuuguucuugaguggcacuggccagagauuggcaggcaggaggagaauccauccauggcagguauucucucugcucccucucugcuggucccuaccaacaucgagaccccuguggaggguuggguggaguggccuaucauggccaccucucuccccagguugcagcaacagcuuccucccauugucugcuaggcuguagggguguaagagcuuccuguuguugcuaggcccugggagauaacuaucuuuuauuggcuucuuuagcucuuacccacacuucugcaaauacacccuucugucauuaaacccuucaaucacuccuuuggguacgaucugauuccugcugggacucugacucagugagugccaggaaaaaaauaccacagagaaccaaggggcuaggaaacagcaaauaauaucaaaaauaaaagugaaaaguugguugauacacuuagguucacugccucacuggcuggcguuuuugacaugaaaggcccuuuggcuugguuucuuauuuucaguagucugcaaaucuuuuaaggcauccauccucuguauauuucaaccacauuccucuccacaaauaaggcgugaguguuuugaggaccaacuauuaggaagaguuaugcaccagugacccaauucaaaaggauaauaguaaucauacugauaacagugacagcuaauauuaauauuuauuguuuaucauauaccaggcauugugcuaaaucuuuagguaucaucucacugaaucuucacaucagcuccauuaagcaaaaacaugauuuuuacagggaaggaaaucagacuuacagaggcuaaauauuugcacaugauuuuacagcuagaaguugaaccgaggcaaucugacaccagagccagagcucuuaacuaguauugcacagguauuuccccaaauguggcacuaguaccacuagcggcauaggagaccaucuggggacagucuaugggugaagaguuugauuuguuuaguuauguauuuauaguuaggauuaccuucuauuuaugacaggugauauugacuuuucauuuucaauagugauauaauuucccuuucaaaauaaauauaauuaaaaauaaauaaauaaauuuaaaggaaaacauugaggaacuauguaggcugaguauagauauggccaaaauuaaugacugaaauuuggggaacucuguacauuccacacuggcccgcagugugcuccacauguucacacagaacaagacugcuagaaaugagaaaaauuauauaccaucugcucuucagugccuuucccgauuaacuuacguguguguguguguguguguguguguguguguguguguguguguuuauuuggagacagaggcucgcuauguuacccaggcuggaguguggugacgugaucacagcccacugcagccuugaacuccugggcucaagcgauccuccugccucagccuuccaaguagcaaggacuaccaguauaagccacuaugccuagcuuaaaucacccauauuuucccauuuccagauacuauucauaauacagucaguuuugcuauaacuaggguuucggugucaccaauuggcucauaugaauuugacaaauaaggaauaaugucagcauaguauggggguuguuggucgacauguaucuuuucccagaugagagaugcuguaaaaaugggaguagaguuaaaaucacuagcaggaaaggaauagucacccucuccccuggugcacagauuggagcucuuccaacucuccuugaauuaaaaaggagugccuguacccaggguuuccucccagagaugugcacccccaggcuugcauuuauagcucuugcccuuuccacaugauagucacuacauuccagaaaaaaacaaauguaguuuauuaucaggauagagccagggccccaaacccuaguuagaggcacuaagacauccagcgggggcaguggcaggcucuguuuuuuuuuuuuuuguuuuuuugucucccagaugccuacaaaaugugccacccuaacaucaauaccacgaacacaagcaccacuuccuccucuuucuccugaaucugaagucucuuccaaguuccucauccagucaugacuaaggcagcaaauaaucaaguugcuucagcuacauaguaguggcuggaagaggguuuagcgugggugcauccuagcugugggucugaucgaugauacaaccugguauuaaccgcugggcuuccaacugguccuguccccuugaagacuugauucugacuggggauagggugggguggguggggccuuuugccaauuccaacuccucauuguuugcugacauaagaugagggcucccaacccccaccaccucuugccaggcugauccuugcuugagucauagcagggaugacucagagaugauagacugaaucuagaaacagaccagaccacauguaaaaauagaucuuugacccacucucuguaccagagaaggaaaccaacccccuuauguacaauaaauaacccaggaagucagccugcucgaacucagacuuguaggaagccaggcugcugucucuggugacaauccaggaagcugaacaauaacuucuguaacaaucagccagaaauggccaggaccugauuaauaacggacagcuucccuaacuuuugucaccauuuuaaauuuaggaacaaccagagaaagccaaaucuguaccuaccccuaaccaaucacacagugugcccugcuuccaguuagcccaccugcagcuuccccaggccaacagccucccaucagggcacaccucaagacuucccuuuuuuuccacucuaaagcuuucccagugcuuugccugugauggggucucugacaaaaugcaagugaugguggccaacuucauugcuauagcaagcucagaauaaauagccuuugcuuuuucucauuugguuggucuuugucuauuuccauggaaccuauaaccugcuuacugucaacccacccacccuaguucccugccuagcaaugaaacuccauaccucaacuucuccuauauggacaagauuucuuccucugcugggaagaagaucguggccaggagagugucagcagaagcacuuuccugggaaggagcccaggcagggcuuggcuggacuucuggugaucuccugagugaggugcauggaaugccugucuucuucuaagagccagugaccagggaagacuguaacuggguuuuagcuccaguugcuauuuuauuucccagucccaccuaccccacgagaguuggagccuagccacauucuucucagugaugaaaguguugcguaugaacccaagcccacuaguauggcccuaacccccacuggguaaauguccucucugccagcugccuguccccacggccaaguccaacugucuggauucucuuugucccgccccugcucugccugcagggagccucucagcucuuucuuucuuaaccccuuccccagcacacuauugcugccagcaucagaugugugacuagccagcacuguucuauaagccucccaacaccaugaaacuggaaucauucagucauccugccaggcuuagauccagcagaauuuuugaacagauugagaaguggccacaugauggcacuauaaaucuagcaaugcccucagaaaguuggcaaacugcaaagcuccagggaaucaggaucuguauuuuuuuuuuuuuaaugaaugucagaaaagugaaaacugguaauggucaauagcccccagaaaaucuugaucuuauuuugcucaggauucuuccugaucaauggccauuuguuuuugacacuugccaaacauuagcuaucccucuucagcacgcaucccaccgcccaaugcugucuucgcuuuguacucaacgcaugcacauuucuguucuaaauagucugccgguugcuaugaacacaaaaauagacacacaaagauuuaagaaagauggaaaugucuuaccuaagcaugagugaaaugauuucuucuuuuguuuugguccaucauuaugcuaaauaaacggaagccuuuucccucuucacacgcagagcugagccaaucacaggcacaaaugaaaa

SEQ ID NO: 192137 - RNA, 189363 nt, Homo sapiens
uuuucauuugugccugugauuggcucagcucugcgugugaagagggaaaaggcuuccguuuauuuagcauaaugauggaccaaaacaaaagaagaaaucauuucacucaugcuuagguaagacauuuccaucuuucuuaaaucuuugugugucuauuuuuguguucauagcaaccggcagacuauuuagaacagaaaugugcaugcguugaguacaaagcgaagacagcauugggcggugggaugcgugcugaagagggauagcuaauguuuggcaagugucaaaaacaaauggccauugaucaggaagaauccugagcaaaauaagaucaagauuuucugggggcuauugaccauuaccaguuuucacuuuucugacauucauuaaaaaaaaaaaaauacagauccugauucccuggagcuuugcaguuugccaacuuucugagggcauugcuagauuuauagugccaucauguggccacuucucaaucuguucaaaaauucugcuggaucuaagccuggcaggaugacugaaugauuccaguuucaugguguugggaggcuuauagaacagugcuggcuagucacacaucugaugcuggcagcaauagugugcuggggaagggguuaagaaagaaagagcugagaggcucccugcaggcagagcaggggcgggacaaagagaauccagacaguuggacuuggccguggggacaggcagcuggcagagaggacauuuacccaguggggguuagggccauacuagugggcuuggguucauacgcaacacuuucaucacugagaagaauguggcuaggcuccaacucucgugggguaggugggacugggaaauaaaauagcaacuggagcuaaaacccaguuacagucuucccuggucacuggcucuuagaagaagacaggcauuccaugcaccucacucaggagaucaccagaaguccagccaagcccugccugggcuccuucccaggaaagugcuucugcugacacucuccuggccacgaucuucuucccagcagaggaagaaaucuuguccauauaggagaaguugagguauggaguuucauugcuaggcagggaacuaggguggguggguugacaguaagcagguuauagguuccauggaaauagacaaagaccaaccaaaugagaaaaagcaaaggcuauuuauucugagcuugcuauagcaaugaaguuggccaccaucacuugcauuuugucagagaccccaucacaggcaaagcacugggaaagcuuuagaguggaaaaaaagggaagucuugaggugugcccugaugggaggcuguuggccuggggaagcugcaggugggcuaacuggaagcagggcacacugugugauugguuagggguagguacagauuuggcuuucucugguuguuccuaaauuuaaaauggugacaaaaguuagggaagcuguccguuauuaaucagguccuggccauuucuggcugauuguuacagaaguuauuguucagcuuccuggauugucaccagagacagcagccuggcuuccuacaagucugaguucgagcaggcugacuuccuggguuauuuauuguacauaaggggguugguuuccuucucugguacagagagugggucaaagaucuauuuuuacauguggucuggucuguuucuagauucagucuaucaucucugagucaucccugcuaugacucaagcaaggaucagccuggcaagaggugguggggguugggagcccucaucuuaugucagcaaacaaugaggaguuggaauuggcaaaaggccccacccaccccacccuauccccagucagaaucaagucuucaaggggacaggaccaguuggaagcccagcgguuaauaccagguuguaucaucgaucagacccacagcuaggaugcacccacgcuaaacccucuuccagccacuacuauguagcugaagcaacuugauuauuugcugccuuagucaugacuggaugaggaacuuggaagagacuucagauucaggagaaagaggaggaaguggugcuuguguucgugguauugauguuaggguggcacauuuuguaggcaucugggagacaaaaaaacaaaaaaaaaaaaaacagagccugccacugcccccgcuggaugucuuagugccucuaacuaggguuuggggcccuggcucuauccugauaauaaacuacauuuguuuuuuucuggaauguagugacuaucauguggaaagggcaagagcuauaaaugcaagccugggggugcacaucucugggaggaaacccuggguacaggcacuccuuuuuaauucaaggagaguuggaagagcuccaaucugugcaccaggggagagggugacuauuccuuuccugcuagugauuuuaacucuacucccauuuuuacagcaucucucaucugggaaaagauacaugucgaccaacaacccccauacuaugcugacauuauuccuuauuugucaaauucauaugagccaauuggugacaccgaaacccuaguuauagcaaaacugacuguauuaugaauaguaucuggaaaugggaaaauaugggugauuuaagcuaggcauaguggcuuauacugguaguccuugcuacuuggaaggcugaggcaggaggaucgcuugagcccaggaguucaaggcugcagugggcugugaucacgucaccacacuccagccuggguaacauagcgagccucugucuccaaauaaacacacacacacacacacacacacacacacacacacacacacacguaaguuaaucgggaaaggcacugaagagcagaugguauauaauuuuucucauuucuagcagucuuguucugugugaacauguggagcacacugcgggccaguguggaauguacagaguuccccaaauuucagucauuaauuuuggccauaucuauacucagccuacauaguuccucaauguuuuccuuuaaauuuauuuauuuauuuuuaauuauauuuauuuugaaagggaaauuauaucacuauugaaaaugaaaagucaauaucaccugucauaaauagaagguaauccuaacuauaaauacauaacuaaacaaaucaaacucuucacccauagacuguccccagauggucuccuaugccgcuagugguacuagugccacauuuggggaaauaccugugcaauacuaguuaagagcucuggcucuggugucagauugccucgguucaacuucuagcuguaaaaucaugugcaaauauuuagccucuguaagucugauuuccuucccuguaaaaaucauguuuuugcuuaauggagcugaugugaagauucagugagaugauaccuaaagauuuagcacaaugccugguauaugauaaacaauaaauauuaauauuagcugucacuguuaucaguaugauuacuauuauccuuuugaauugggucacuggugcauaacucuuccuaauaguugguccucaaaacacucacgccuuauuuguggagaggaaugugguugaaauauacagaggauggaugccuuaaaagauuugcagacuacugaaaauaagaaaccaagccaaagggccuuucaugucaaaaacgccagccagugaggcagugaaccuaaguguaucaaccaacuuuucacuuuuauuuuugauauuauuugcuguuuccuagccccuugguucucugugguauuuuuuuccuggcacucacugagucagagucccagcaggaaucagaucguacccaaaggagugauugaaggguuuaaugacagaaggguguauuugcagaaguguggguaagagcuaaagaagccaauaaaagauaguuaucucccagggccuagcaacaacaggaagcucuuacaccccuacagccuagcagacaaugggaggaagcuguugcugcaaccuggggagagagguggccaugauaggccacuccacccaacccuccacaggggucucgauguugguagggaccagcagagagggagcagagagaauaccugccauggauggauucuccuccugccugccaaucucuggccagugccacucaagaacaaaccagcugcagcuacagcacaagggaagcacuggacaugccaugccuagaggucagcagagaaggguggagaguggaccuggagagccagacagagaaggaccaauacauuuaucacauaacgcgaugauguugcuugaucuaugaugcccuuuugcacucuguaaacucucaguagaauuaguugcagacauuaaguaaaucagacugugaauguguaugucagugacacaaagacaagcaggggugcaaacaaaauagaggcauauaccacccaucuaccacccccuaggccagggggcacgucacgggagcuggcagcagcucagcacugucucccauuucuuagccagagcucugcuacuaagcagcaugcuuuuggaggcagggacaguccauagaaaagacucucaugacuuuuaucuucaccacaagcuagcaaaauaaagaagaaaugcaauuagaaucgcucaccuacuagcaaagaaagaguuuguuccccaagucuuuugagaaaagaaccuagcacugucagucucaggagcagaugcuaaacaccugagccacgcugacucuaacagcaguuuggacuaacaguggcagagugugugccggcgugaagggcaaagccagcaccugucagagcugucggcuuccaggccccacuggagcaauuuaggcagcccccuuucugugaaugcuuccauaggacgcaagucccaggcaggcagaaaaaauauuuucuuuuuuuuuuuuuuuuuuugagucagagucucguucuguggcccaggcuggagugcaguggcacuaucucagcucacugcaagcuccgccucccagguucacgccauucuccugccucagccucucgaguagcugggacuacaggcgcccgccaccacacccggcuaauuuuuuuuuuuuuguauuuuuaguagagacaggguuucacugcguuagccaggauggucucgaucuucugaccucgugauccacccgccucggccucccaaagugcugggauuacaggcgugagaaacaauauuuccuugaaugaggaaaccagccuguucuaucagacugccuucucacaucuaggccaagcuaauaaugcuguuaucagaaaaagccccaugcacaucucuuucucucucucucuuuuuaaauguuguacaaugcacauauaaaauuuaccaucuuaaucaaguuuaaguauacaguucaguauuguuaacuacacuggcauuguugucaaaccaaucuccaguacucuuucuucuuacaaaacugaaacucuaaacccauuaaauaauuccuaauucucaucuuggauuagccuacucuagaugccucucauccaagugggaucguacaguguguguccuuuugugacuggcuuauuucacuuagcgucauguccuaaagguucauuuaagcuguagcaugugucagaacgucacuccuucuuaaggcuggauaauauucuauucauguagaggccacauuuuguuuauccauucaucugcugugggauacuucgauuguuuccaccucuuggcuauugugaauaaugcuguguacacgagugcacaaauaucucuucaagacccugauuuugauucuuuuugagcauauacccagauguggaauugcugcacaucuuuuguuuuacucaccuccaugccaacuguuuucagagauauagauuaguggauuuucugaacaggacaaugugggcuucucugcaucucauaaagcaaguucauguugggggaaggaucuaggauuugaagucacaacccuggauuuuaauucucuauguuaaucauuuaccagcugugcaaucuuaggcaauuucuuuaacaucucugaaaccuguguuuguuucuccuacuaaaggaauaaucaugguauuagcuuccuagagaugccucaacaaaguaccaaaaacaggguaccuuaaaacaacacaaacguauucuuucacaguucugaaaacuaaaagcugaaaaucaagguaccagcaggauugguuccuucuuaggagcccuuagggagaaucugccccauaccucccuccuaguuucuggugauucccagaaaccccuggugcccucagcuuauagcuauauaucgccauuguuugccaucuuccuuuugagugucuguguucucacuuggcgugcuuuuucugugugugucuaaauuucccucauuuuauccggucagcaauaauuggauuggggcuauccuaauccaguauaacuucauccuaacuugauuacaucuacaaagacccauuucuaaauaaggucacauucacagcugcugagguuaggacuucaacauaucuuucggggagacacaauucaaccacaacacuccuccuccaggaggucuaugagaauuaagugcauuuuguagaugcugaggcuucguacuggagaggaguaauggacauggcuaaacugacauuuagcuuguuugucuucugaaugcaagaacguccuucucccugugcugcuugacucgcgauguuaaauccauacuuguuuuuuugaguuccacucuaguuccaacugggucugcauucacugugaguuguuaaauguucaaugucguuuucauaccugggaggaugaagaauguuaaguguggacuucaguagaucaagccugguuuuagaaacuuucuaauuguuguggccuuuggucucugaagaauacacccucugcugcauugcguuauccuccuuguccuagaagaaacagugcgccugggaugaucuugggaagugacaccaucagggcuucgaggucauuacguccuuucccggccgacucaguagucaccacauccauaaauaccacacccuagagaggcuugggcugccuagcugauauauugucuucagauguucgcccgaguccugcauaacauucuccaagcuggggcauacaaaauagauuugcugggagcagggaugggaaugauuaacucucaacgcuuuaacuauauugcugcuaaauggcugacauacccaggugcccugcacucuagaggaauaaccauucucaaacauaugaaaaucagcauuuauagaagagauacaauuaaggggugauuauuugggcuuagacaggauuuguugugugauuccuuuaaggagaugauguaagaaaauaauaaaguauuuuuacuucaaauuucucugagcuccucuauuggaauaggugcuacugaauauuuaucacacagcuucuuuccacaacaugcagcucuggggccccaagauguacuuuuuuuuuaaggagcacaggggccgggcacaguggcucacaccuguaaucccagcacuuugggaggccaagguagguggaucauuugaggucagaaguucaagaccagccuggccaacauggugacaccucaucucuacuaaaaauacaaaaacuagccgggcaugguggcacacaccuguagucccagcuacucgggaggcugaggcaggagaaucgcuugaaccugggaggcagagacugcagugagccaagaucgcgccacugccugggcgacagaaccagacucugucucaaaaaaaauaaaauaaaauaaaauaaaggaguucaggcaaaggauucccuggauccuccccccgcccacgccaugcagcaggcagcagcccugcauccaggccccuccgguuggugccaacgcugcacucgacugucgagcugcaaccagccagaaggaagaagugacaaacucagugacacaaacuucucagaggcuuggacagggccaccuggugauuuauuuacagaggcaucuuugcuguaagaucaacaccagggcaauucgacuaggcagguugcuaaacccuaaggcaaagacugaguuuuaaaguguuguuauuuuaugcucucugggucuaguuaguuuuaaugagcuguggcucucuaguaaaagaauuaaagagcaauuucuaauaugaccaaaucuuagaaaaggacuugagaugcaaaugguuacauucuccuuugucccuaucaccuacuccgggucauauaaaguagccuuggcuuccacauaucccagaagacagaacaucagguggcuuaucuccaguugucaacgccugcuuaaugcuacuaauagcauaaguaauuuugcuggaaagccuggggaggauuccuccauuuauuaccuagugaaucaauucuagcguuaauagaaaagacaguggcuguagaccacgaugcaaaauaaagugcuguguguaaauccuagcaggguucucauaccaggauucugaaagagaaagagagacccucccucgccucccuuucaccgguuuuccugcuuggagugugggaaaggagacucaauuucuggcagaagcagccucuguucugcuggugcccuugagacuucaaacugcaacagcagagaaggaaggcgagggaaccagauugcaggcauuguguugccagugguugaaaggugcggaugagaugaugcugauuacaaggacugaaagaaagcggagagcaugguuccgaaaauggcugagaaaggaagaaagaaacgcccugugaguuugggaaagugaauauugcauauuggguagcuccugugcauuuguccuucaaaggugaggcccauccugucugaagucaguuucacugcuucucccaggggcucucucaugaggccagggaaaguggagaaucauuuucacugaagaagcaaaucugaucagacaacccacuagcaugggaaauggcaaacaauaaagacacguggccagaaaaugcauucuccugcuccccuuucuugguacucccuuacauccucaauguccucucccuaccacacccaaggcaacucaugagggcagacugcaccauuuuccuccuggaugaccuugccuucuugaacauucuaguacccaagcucccucuuaagcccacuuucacccacacauauuuuuuuacuaauccguuuuacagaugaagacccacacauuuuuagcaacuccccacugccaguccuuaagcccucucacucagcggccugagguccaagccacccugggcagccccagcaaggcgccacugcucaaagcuggggagugagcacagaugauggcagcagcugcagaauucacucacaucucacacacuugugcaucugaaaggguuaauuuuucacuugcugugauugaauuggcaguuucuuaccuggaaucaggaaacucuagucauuugcucgaaggaaaaaaaagaggacgugaagacaacccuuugcuucuuuuucaaagcugcuuuucuaaaagugccagagagagagauuuguaaaacuacagccuggacccugacaaugaaaugccaauuaauuuaguuuuaaaugggucaccaaauauccccagugguuuuuuuuuuuuuuuacuuuaaauauacaacauuaugagaacguauaauacuuuaagaaauugcugagaaucuugucucccaugaggaaauaaguuccauaucuuuucuuauucacuugaauuuuuuccugucucugcuguaaaacaugucagggauuuucuuuaaagugccuaauuuuucuccccacgaguaucccuguagguaggaaaucuuccucgacagagcacucacaguuaaagauuuccagauacuggcuggaauauucugagaacagugaguuaagugugauaaccagaaacaaacugcugggcccuucuccccagccgcuccagagaggccugugguuuugacacuugacuuucuaauaaagagcaagcucucugggcuucuuuugaaacucuucaggcaccagagaaagaggcugauuuagcuuugguugucccuguguuucagucacuuuacugcuuaguuauccacugagaacaaaacuaaaaggaaagcagauaaaaccacuucuguuucaugauuugagcuacauggggagaggagugggcaggaccaagccccauccccagagagguccacguccuggcccccagaaccugugaaaucugcuaccgugcaugacaaaggggccucugcagaugagauucagugaaggaucuugagauggggagguuuuuuagauuauuccgguaggccugauauaaccacaagaaucauuauaaaugaaaggggcugggugcgguggcucaugccuguaaucccagcauuuuggaggccgaagagggcagaucaccugagggcaggaguucaagaccagccugaccaacauggagaaaccccgucucuacuaaaaauacaaaauuagccaggcguaguggcacaugccuguaaaucccagcuacucaggaggcugaggcaggagaauugcuugaacccaggaggcggagguugcggugagccaagaucgccccauugcaccccagccugggcagcaagaaccaaacuccgucucaaaaauaauaauaauaauaauaauaauaauaauaauaauaauaauaauaagugaaagagcgaggaaggagagagugugucagaguggugaaaugugagaaagacuugacuggccauugcuggcuuucaggauggagggcagccaugugccaggaaggcaggucgcuucuagaagcugguaagguaaggaaaugaauucuccccaagagcuugcauaaucagccuugagaaugucuucauuuuagcccagugagacacauuuuggacuucugaccccuagaacuuuaagauaauacauuggugcuguuuuaauccaaguuugcgguaauuuguuauagcagcagcaggaaacuaacaaaggaaggaaauugaaaaacaguacuuucuauuaaagaaaucagugaacuccagaucccaaaguagucauuugaauuuggguagcucacauaucucacuugauccuacaacaacugcacucccccaauccucaugcucucauagcauucuauauguuuccuucauaguauguaucacugacuucucaauaccuagcacaaaacuugaaagacagcaaugcacacucauggcauaaaagaacuuacugaaaguuagugauuucccuaaauucauauagcuugucuaagugccggagcuagggauagaacacagcuguucugacuuccacaucugucugcuauuccacccggccuugcuaagaauuucuguugggguaucugcaagacagaagaggaaacacuacaaagacuggagcagugacugcuguggagcugaacuacagaauaguaauagacucaaacaagccagccuggcacguagacaucggagacagggccuuggcucugaggacaggguuucuugguccaggaggaggagagacaggacugccaacagcaguaaaccccauagaaccugacaaaccccugacagaugacucaggaaauggcuggugcucacucacuggauuuugcaaucauauuugugcauaagaaugagaagauuaucaaaaaugaguuagcaaauucugagucccauaguaggugccuacuguggacugaaugguguccucugaaaauucuuauguugaaucccuaacccccaaugugacuguauuuggaaauaaggucuuuagaagguaauuaagauuaaaugagguccaauugugacuguauuugcagauagggcuuuuaggagaugauuaagguugaaugaggacauaugggugggguccuaaucugauaggacugguuuuauaacaaaauggagaaagagcucuuccucucucuuaucucucuucucucucucugucucucucuaucuggcgugcacacacacacaagcauacacacacauacacacacacacagaagaaagaccaugugaggucacaguuagaaggcagcucucugcaagccaagaagagagcccucaccagaaccagacuaggcuggcacccugaucccagauuuucagccuccagaacugugagaaaauaaauuucuacuuuaaacagucugucaccuagucuauaguuuuuugugauggcagcugagcagacugggacagugcccagauguuuguagcacuaauauaaauuguacaauuauucuggauaagaagauuacagcaaaauuaauuucugcuaaagagguuauaguagcuaucugcaauuuugccaguccagcaucaauguccccauuuuuuuaguaacagcaucuugguuuuccuuuggacaaucccagacuucucccagcaccaugucaacccucuuacuguagccgucuugguggaacugucaauuaugccauacuuuucucuugccaagaaacgggcauguggcccaaaccaggccagacaguagcaggaauuugaaaguuaagcacagugacacaagaauugaaaaaauacugaagcgaguuuauuuucaugauaguaucuaggaacaaauacugcccgacaagucccauuaucuagauuccuggagcuacccuaauuccuacccuuuccaaagccugguuggucaguugcuucuucaauuuaaugaaacaguccauaaacuuccaaaaaaucuuuucuaguuugaacuagucagauuuggauuugguugcuuccacccaaaaaacucucagugacacaugggucuaucaaaucugcgcugccaauuuuuuuaaugccaauaaauuaucuugauaucauuaugcaacuaaaauacauacacauauugaaagauaucuauaauugggcaagaauuuuacuuuuacaauuuuagugauuaguauacacauuagaaaaaaaugugguauacuucuggaaauauucuuuuuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccuggaaauauucuuucugcuuuuuuuuuuggcaggaaaacccuaauauuuagggccaucuggguaacaacagaguugauaagauuucuauucugaaacauuugaacauuuaggagaauaaaaagaauaauauauauuuuaauauuuuaauacuaaaaugcuacagaccuaaaaaauaguagaauucaccuggugaaucaauuucaaccaaauucuaaucuucuuuugcgugaaguauggaucugagcuuauuauucuaguuuagcucuucucugagggaauucugagaacaaauuaccaagacuuuuguaguaacauuugugaacuguggaaacucaacucucuuuuccaggcucaguccauuuauacuuuucuauucugacagggaggaauggaagauggggagaugcuugauguguugugaugaauauuuaagaacauucauucacucacugaaauagcccuuccauuuuaaauuaugucuuuuugaaggaauacuguaauuuuuuuauugugaagcauaucauuuuuacaaaaagauugucuaaaauguaucuguagaguuuaaagaauaauaauaagcucuuaauggucuuugggaaacacagcauuaccaauucuuuagagccuuuuguguguuccucuccauuuacuuccugaucccucucccacagauguaacuaccauucuguauuggguauugaccauucucuuuucuguauauuuuuaugucauauauauggcucgcuaaaaaaauauauugugcacauuccuuugcaacuugagucuuuuguuuaauauuguuuucuagguugauacauguaccuguaguucauucguuuugcauuacucaguaguauuucacuguauaaguauaccacaauuaguuuauccauuuauguauuauuuauuacuuuuuguucuuaagaguaaggcuucugcaaacauguuuucuagugcauauguacgaaaguauuuuuaaggaacguacuaggagggaauugcuggaucaaaaguuaggcacagguucaacucuccaauaugcaaaaugcaauauugcaaaaauuucuggacaugguuauaggaguuuauauucccacaagcaggggauaguguuuccauugcuccacacccuuggauugaggagagccaacaugauuuaaugccccuggaaccucucucuccccagaaagaugucaagaggauggaggacucacauucuguuaacucuucugccugugaguuuuucccaugugaucucagugaguauauuguguccuuuuaugauaagaagugauacacuuuuuuuucuuuuuuuauuucuuucucuuuuuuuuuuuuuuuugagacaaggucucauucugucaccuaggcuaaagugcaguggcaugaucauggcucacuacagccucgaccuccugggcucaagugauccuccugcuucagccuccugaguagcugggauuacauguguacaucaccaugcccagcuaauuuacuuuuauuuuuuggagagguagggucucucuacauugcucaggcuggucucaaacuucgggacucaagcaauccucucaucuuggcaccccccgcaauagacuuuuaaauuuguaucaaucuauuagaugugcaauaauaucuuuaggagaaaaagauaacugaaaacugguaccgcacaguuuaguuugaguuugcauuucccugauaaccaaugagguugacauuuuccuaagauuauagacuauuuguauuccccuuuuuuaagaguuccuguguuuuccccauuuuuguauuaguuugucuuuucuauauugauucuucaaaguuuuauauucuagguacuaaucuuuugucaauaguuugaguggcaaauaccuucucccaauuuuuaguuuaucuuuuuuauucucauuauuacgucuuuugaugaccugauuuuuagucuuaacguaacugaguguauuaaucuuuuccuguguauuuugcacuuuugugucuucuucaagaaaugcuuacucgcugugcaugaggguucacaccaguaaucccaacacuuugggaggccaaagcaggaagaucacuugagcccugcuuuggccucccaaagaucaaacuugaguuugagacaagccuggacaacauaaugagaucuugucucuacaaaaaaaauuaaaaaucguaauaauaauaauuagccagguguggugguaugcaccuguguacuuguaagagacacugagagacacugugaugugacuuggaggacccccuucugaggugaaguaauucucccagcagcuaagagugcugcuggcagacagcccucaacggucagccuucuucagcugaacaaagucacuuugcccacaucacacccauuucuuggggcagccuaccucagguaacugguuaacaugagguacaaaggcccaacuuaccgcaagucaggccaacuacaaagagcuagucuaguuucagagcucucuguaggguaggcugaggcuuucccuuggcucuacugcagccccgcuucucuuacuucugcccaauccuacuuccuuccuuuccuuuccauaggugcuaacaacaagaacacucccuaauaacccuccugcauguuaaucuccauuucggagucuuccuagggaucuuaagcugugacaauuacuuuuaucaauccucaauuaauauaauuuauaauaaacuaguaaaacaauucagaauaaaucaaacucacaccaaaaaagccuauauaggaacugagcuguagaaugcaguuggcaacaaccaacuaguagaacuuaugcaccaaacacuuugucaagcuuucucuucugaacacaugguuccuccuaagacuuugcuaauucucagaccucugaugaguuuaccucauugaucccacaaaauauccacaauugaguauaaacaagcagaaucaaauaagauuuacuacggcccaguucuucaacucagugagaagccucaaaccaguaguauuuaugaacaaauccuaucugauuucgcucuuugccugauuucacucuuuguccccugauauuucaacucuuagaguugauuaaaauuauggggccucaugugaacaucugcaucccagucaacccaccuucuaagcuccucgcuaucaagggaaaaguuaauugaaaucuaauauuccugaaagcugcagcucaaagccaggcuaauaaguagauuucaccucacgugccaacuuccaagaauuugcagcaaugacuugggucacuguguugcaaaagauuagacagcuacauccucauucaaaagaaaagagagcuguaaguccguuagaaaugucucucagagguagaauagacagggcagaguaagggguggcuaaugugugggaaaauagaugaguacguuuuuuaaaaaaauuugcaaaugaaugaaaaguggccuuuacaauuguaauuaccuuucuguucaaaaauguggauuuugagugcaugaauuacagagacugggauccaggcagcuguuguagcaccagaugacaauuuuaaugcucucuuguggcugaguuguaucagaaccucaaacaagagcucuuguccucuagccaagccagcuaguaggauuuaccacgauuugcugccaaccagcuuacugcaaauuacauugcauuugcaaccauaggcugauagaagauaaacucuuagcagaaaggggcagguaagagacuaaaacugauuuugcaguuauuacaggauggcuaacaguguaaauugauuauuaugagagaaaugauaaauauucugacacucaauaucauuaaaaccuacacagaauuuggcauuuguuauuucaaaacagaaauaaacaaaugaaggaauguuuuaugggggagcaaaguuuuuaaaauuuuacucuuaaaaugaggcaugguuaugcaagaaaggaaauauaaccaaguuagcuagaaauggaauuuuauucauuuacaagcuuuccuuggaagauuugaguauuaaaaacuauacuguucucucucauauaaccucuuuuccaaauguuaguuugagaauaaauuaaagaauagcuuuaucccuauaacucuccuuaccacaucuuccaauacuccacugucuuccuguauuaaaauguaucuauagcacaaaacacaauacaggauuuuauuuuauguuauaguagguuagguuauaaaaguguauaaggcugggcacaguggcucaugccuguaaucccaauacuuuggggggcuggguggggggauggcuugaguccaggaauuugagacuagccugggcaauaacccaguaucuacaaaaaaaaaauuuuuuaaauuagucuagcauaguggcacauaccugugugcccagcuagucaggaggcugugguagggggaucgcuugagcccaggagguugaagcugcggggagccgugaucacaccacugcauuccagccugggcaauagagcaagacccucuccaaaaaauaaauaaauaaauaaaaguaugagugcccuccauacauggcaaacaaaccuuugaaaaaagaauaaggaagaagucuaagauugccaccagucugcccagaugccucagguaaaagcuuaaagagaggaaucuuguuuccacauuuauuccaacuuauuacugagccuugcaauauuuuuaaauuauuguuuuauuuaauuaauccagaagaauauuuuaggauaaauguuucaagucugacuagcugagaaucuuuacgucuucagauggaggaaguaaagggccauuuccuuccaccuuugauuuaggaaauucauuggcaucaagaaauacaauucuggcugggcaugguggcucacaccuguaaucccaacacuuugggaggcagagaaggguggaucaccugaggucaggagucuaacaacagccuggccaauauggugaaaccccaucucugcuaaaaauacaaaaauuaaccaagcaugguggcaggcgccuguaaucccagcuacuucaggaggaugaggcagggagaauuguuugaacccgggaggcagagguugcagugagccaagaucacaccacugcacucuagccuaggugcagagcgagacuccaucucaaaaaaaaaaaaaaaaagaaaaaaagaaauacaauucugagcaggacacuaugucaaauacccacuucagguggaccuugggaaaggcaaaucauuguucugaauuuuuauuugauauucaaacuagaguuucagagaccuguuacgaagaccgggucuuaucauaugauuucuggcaauuugacguuuguuuaaacaaauuacuuuguaaauuuccaaagugcagcaggguccaucaggguaggcaguucuguguuucuuaaacuagauugcuaauuuuuuuauaucacuugggcuaucuaacauacaccccuauaaaucaaugaguaucuucauuuuauacuaaacugcuuuuuaugaagauagaauguauuaaauccuccccugugacaaucucuauggccucucuucucccuguaacuccaacuugugucuguuggccagugugccagaauguauuugauacuauggaaacaucugugucuaauggcaauugaaucuagggcauuuauuucuauucccugagucuggauaagaucuacaggaaucugucagucuuucauuaaaugcuuauuucagaaacaauauacuguuuucugauuugggggcucccuaaaauuucauuucuggagccggaagucuuccucaaauggugguuuucagauuuuccuugggcucuaaguaaauuauguggauucugcuuaacaguugaaguuguucaacuggaaaaauauaugacucauauuccaaauauugacauggaaaaauauaugacucauacuccaaauauugacaaucuccaaguauuucaccucuaucuuuaaaaaaaaauguuuaaaaccuugcgagccucuguuuguacaucuugcuguggaugcuaggaacuugcagugugucccugccccuggugggcuuaaaguuuauauaauuaaguagauuuuugccaaaggcagauauuccaccaaccuuuacaauagagauuucugggccacauccccaaagcuucugauuuuguggauugggggcaagggcuggaaaucuacauauuucuaaacuccccuucuguucaauguugcugugaaccuaaaauugcucuaaaaaauagucuuuuaugcaaauaaguuaaaaagaaaacaacaauaacaaccccccacacacacacacaaaacacaaaaaugaaaccaaaaaacaccccccuauucagcucucucaaagucagcucacuuugagaaccccuagaaauuucucuaauuacaguauuaagaauguuaaaggcuuguuagcuccaaugccuaaucccucugguucccccuaguggacugaaauaaaaugcgcuuucuacaauuuaagcaguuaacgagugugaaaccagauugaaacacauguaaagacuaauuaugagacgcuuucagaaaaaggcaacaugcaucucagugaaaugcaucugggcccuaaaagaucaggaaagccccaccacaucugcuucauggaugguuuugcuguaaggcgcccagguuaguucucaguaugucagccacaggcagagcuuucucuaugcaauccucugcagaucacauuuaggugucucugcccagccacagauccucaggagguccugagaacaugugcucaaagugguuggguuacagcuugguuuucuuacauuuuagggggacagaaguugcaggcaaagacauaaaucaauacauguaagguacacauugguucgaccuggaaaggugcgacaucugggagagaggggcuuccagguuauagguagauucaaagacuuccugauuggcaauugguugaaagaguugaguuuugccugaagaguuuaaagucagcacaaagaaaugcuugaguuaagggagauugugaagcuaagguucuuauaaaugaagccuccagguagcaggcuucagagagaauagacaguguuuuuuauuggaccuuaaaaggugucaggcucuccggaaaaaaaaaaacuaguaagggaaggggauucucuacagaaugcaaauuccagggccccucccccauccacaggagacagcuuugcaggaccauuucaaaauaugucaaagaaauauauuuggggguaaaauaccuugauuuccuuccaggccugcuaucugccaugcgaugcuauaccagagucagguuagaauuugguauuuuauuguaacugggggccucaguuuuaaaaauauuuuuaaucacacauuuucuuuuucuuccuucccuccccacucacccuuuuauucccucccucucuagacacuccucuccaguaacucauguuuaucuaauuauguucuugcuuaagaaauuucagaagauaaucuugaaacaaaccaggcacagagccccugcuuaaucauccugcuuagaaggagucucaaacaauuaguccaccaccaucuggcccaagacaaaauaaugccaaacauacuuccagauaggcaauuacccaagauaaccaucagaacaaacauacagacccuucauccugcacuagucccucacaucucccauaccaaguuucccuuuaaaaacccuaugauaaaauuuuaaaauuuaagauggucuuugugacuaguccaccaucuucuugguuuugcgggcuuuccaaagaagccugcuuuucuucccaccaauucuugucucucaugucugguuuuccagggguuagcagccaaaccuggguuugcauaccuuacugcuacaaagagucuguuugucagucuuaagaucucuguuuuaauguuaaugguagucaguugugccuaaacuccaaagggaggagguuauaaggaggcaugucuggcuacucuaccuccaccuuccagucauggccugaacuaguguuucagguuucuuugggaucuccugggccaagcaggggguccauuuaguugguugaggggcuuagaauuuuauuuuugauuuacaacucuaacauuaucagugcuuaacacaguguuugacacaaaguagacggucaaugaauguuuguugaaugaaugaaugaaugaaugaaugcaugaaugauggaaugaccugaagaacaauuccacacugcacauacucaugccucccuucucaaccuuucucuccccacucccaacuguuaugacaucuugggaaggaaggagaaaugcuugcuuugaaaaagcuccccagcugacuuuaggguagcugcuucccuccugcuuuccuaccugguagggaauuccugauccauucgguucucucagcuccaaacccagagaaguuaaaucauuugaccgggaucacauaauuagauaguggcaggggcauguuucccaagucuugggcaaagucucuuucuaugagguuuaccagcauugacaguuacccaggauauguccucucacaauuugcauguguuuagauauuuuuucuaaagaguagaaaacaguccuagcuacucuuuuccccugucagauccuaggcccugcccuuccacugugguagguagaauucuaagguguccuccaagauaccucaccaccacuagugugcacacaccuuuucccaguuuuucaaucaaacacuaaccuaggugcuacugugaagggauuugcaggugaaauuugaggcccaaaucaguugaccuuaagauaagggugauagggacaggaggcagagaaauucuaggcauaaaagggugggguucccggcaagggccccacccucgagccuggaaccacagcccaaagugagaacaugcauuccuguuuucccacuugaauguugccuuuuuccaaaaccacccauggccugucccacccaccauccugcacucauaaaaaccccugacccagcuggcagagaaaaggaaacagcugaacauugagaggagaagaaacagcuggacaucggggagaagcagcuugacuucagagggauggcuugaugaugggacuucagaguccggccagagacagccagacuucaggggaagaauauuuuuccacuccaucccuuuuccagcuccccuuccugcugagagccacuuccauuggcaauaaaaucccccacauuuacuauccuuaaauucauuugugagaccugauuuuuccuggaugccagacaagagcucgggguacagaaggcuaacacacugacccucugcccgcacaaaaaggcagaggcuucacugagccuuuaaacacauaagcuguccguggacagcaaaacuaaaagagcacugacuguuaacacuccuucuggggcuucaggagucacagguacucccccucuagauguugccauggggccugcacagaguuuugcucuugccggugcccggaagcacucgcccuggcucuugcacccacucagcuacacuccccgucccacuagggcuggagugcaguggauccaagcaagugaagccagccaaagcagcuagcuagcuccagugcccacaguccaguucccaccugcugcaaaggggucagggaaaauuuccuguuucagggagaacaucuuuggugggccugaccuaaucagaugaguccuuaaagugacugggcucuuccuggaaagagaaauucgaagcaugagggagauuucaugcaaaggagauucuccauugcugacuuuuuaugaugaaggugccacaugguagggaacagugggcagcccacagaagcugagagcaacucugugagcaagaagguggcaaucacaguccuacaaccacagggaacaagauccugccaacaaccugaauaacuuuggaugaccccaagccucagauuagaaucacagcccucgcugacaccuuaauuuuauuccugugagacccugaacaaggaaccuagcugugucaugucuggacuucuaaccuguagaacugugagcuaauaagcuguuguuuuaagccauuaaauuuaugguaauuaguuaugcaguaauagaaaaugaauagacccucuacacugaaacuacaacagaucauauucagggaaauuuuacaacucugaguggcuggagugcuaccaggaaguccuccacuugcuggcuugcuaguugcuuccaacaacuucucugggcacauacgaugagcaagacucuggaaacuccucacagaaaguugaccuauugguccacuguauaauuagaucaacucuucugggaauguaaaaguagucugccaguuguggcugcaaaguuuagauauguauaugccagaaaacucaugcuauccaacaaugguaugcaaauugguguguccgucuagguuuauaaccaacucuucaaugaauguaaagaaaugagcuuuaaaauaaggaaauaacaccuagcacauugggaagccaaggcggcuagaucacgaggucaggaguucgagaccagccuggacaacacagugaaaccucaucucuacuaaaaauacaaaaauuagccaggcauagucccgaccuauagucccagcuacucgggaggcugaggcaggagaaucacuuaaaccugggaggcggagguugcagugagccaagccacgccauugcacuccagccugggugacagagcaagacuccaucucaaaaagaaaaaagaaggaaauaauauuuuguuauuggacuugcugaaagagauccagacaguaauuauuaaccauacauauguugauugauuaauaaagcuguuugaagucauagaccagacuuacauacaaauuuucugaaagcuuauucuaaaaaacuauuaauagauacaacugccuggauaugaauuaaaaugccugaauaucaagcuacaacaauguuuauaaagaaugauuuguaaauaacaccuuucaaggcacuuucaaagcguuaguaaaaauuagcuuaauuacaauacauaauacaauauaauaacaggaguucuagggaacuguggaucccugggauuuuuauguaaaaucaaguaagcacauaugcauuuuccuguggcaaaauguuuaucucucucaucagcuacauaaccucaugaaagcuaaaaacaaauguuguauuauaaaguuucugagguuguaucuacuuggaauauacagauuaauaauuguuaccaaaaguacuuuaaagauauaaaaaaaaaaaauuagggccauaguuuauuugaucuucuaauuggguguuuguucaugacuuaaugucuuuucacguuuuauuagauuugccagauggaaaaaaagaccucuacuaccagguuguaacuuccuuauuauacccauuaucauuuagaugaacccuuuguaagcaaugauuucagcaugacucauuuuaacagcauauaauggucuuuuuaauagaguaugagaaggcuuuuacacccccagguaaaauuuuauaaauaaauguagauuuuuaaaauuauaauuacaauuacuggcagaaaguuaaagccaaugggauaguuauaaucauuauugccuugauuuaaacauuuaagagaugccuuauaaguuucaacauaacucuacaauuuacauaaaacauugccagucaauaaaaguuguugaacuuacaagaagaauguugauacuguaaagcuauuuacauaguugacauauauaagaaguuuucaaggcuaagaacuagaguaagagcaaugcugccagaauuuaaguuguuugaggccagauaauuaaaccaaaugaaacaaaagauaaaaauccuuugaacuaaaauauuucuuuagcugucaucuuuaacugcauaaauacugauuggcuaagacuaugaauaacugagaauauuuuaaauuuaaaaaaagaauaaaaugagaaauuucaaaguggauauuauaaccagcaacauagaguuccauaaauagcaauagucacuauguuuugggagugugcaaaguuguaucuuggagugugcuuuguaaauguuugugucugaagauguaucuaaacuugcauuuuacaacuguaauguaauggcacaaucagcaaauggcuaacuucaaauuuaaaauagaguagagaggaaacaaauguuucugaauauauuucucuacaguauauaacuguccauauuuauuucuuaagauucugugacccaaacaccuauacauacugcaaauagcauaaacagcaaucaacuugucaacauaaacaaugguaaacuaaaaauaaaacuccaagccuccaacggacugaauggaucaucucuuugccaaggggaccccugaguaacguugaaaacagaguucucggcccugaugggagccggggucagacucccuuccuugccaaccaugauugggcuuucuucccuaagggccuaacagaacucaacacuuucaaaaguuaaagccaauggaauaguuauaaucauuauuggcuugauuuaaacauuuaaaucauguuuaaaaucauguuaccccugacgugaaccaaccacccaacacugccccuacuguuuuuguuuuuguuuguuuguuuguuuuuugguauuuuugagauggagucucacucugucgcccaagguagagugcaguggcaugaucucggcucacugcaaccuccaccucccaguuucaagugauucuccugccucaggcucccuaguagauaggauuacaggccuacaccaccaggcccggcuaauuuuuauauuuuuaguagagaugggguuucaccauguuggccaggcuggucucaaaauuucugaccucaagugaucugcccaccuccacuucccaaagugcugggauuaccggugugaaccauccccccgccugccccuacuguuuugccugagaccacagaccauggagugguucuggccaguccauggagaaugcacaguaaggguuuucauguccucugcuucacuuugugacauuagaggacugaaaacuccacccucagaucacugccuuuuuuuuuuuuuuuuuuuuuuuuuuuuuuuuuuuuuuuuuucagacagggucuuccuccguugcucaggcuggaguacaguggcaugaucucggcuuacugcaaccuccaccucccagguucaagcaguccucccaccucagccucccgaguagcugggacccgaguagaugcaugcuaccaugcccagcuaauuuuuguauuuuuuguagagccaggguuuugccauguugcccaggucgguguugaacuccugaacucaagcaauccacccccuucagccuuccaaagugcugggauuacaggcaggagccaccgcgccccucccaaugccauuuuuugaacauggagaagaagcaggaagcucaguugugcaugugcacguuucuccuuucauaaauauucaugacuccuuuuacagcuuauugaauauguauguuugaccucucuacuuggcauacauuccuguuccuuuugcccuccucugaaguaucuguuucuggcuucuggccacagacuaugcuucccagacugucagaaaggccaccuugcuggcuacaacccuuuguaaaaaauaaagucuccucuucuacucuucuaaauugauaaauuguauuuuuuuuaaguuaacacagcagaggcauaaaaaaggagcuugcucuuguuagaccaacaauaucugaauuccucuagaaacccuauuaaugcaagacauucccuucagaggccuuuuuccgcuucucccugaccacuaaggcuggagguccagaauggagagggcugucucuguagugcuucuagaaagaucuauauccccacagagaaagagcaguagcacuccaaagagauggauuaauuaauucacucugauagaaaagaguugcacuaaaaaguuccaagcuggucaugguggcuccugccuguaaucccagcacuuugggaggccgaggugggaggacugcuugaggccaggaguuugagaccacccuggccaacaacugcaucucuauaaaaauaaauaaguaaagaaacaaacaaguaaauaaauaaaauaaaaaguuaccaagagucuacauagaaaggauaauaaauagggccaaauuauguuaagcacugugucacuuaucuugguaaagcagcguucaauacuguucuuuuuaacugacaguucagaucuucaugccuuuuuaagaaaucacuuugccuuauucucaaaccacuuagccuccuaaacuauuuagcaugaagccggauauaagugauauagcugauggguuaauuuacacuuaaauaccaaauaaucacucaacugacagcaaauaucuuagauguccucauuagaaugucagugcugcuaaaauauuuauaaauaagaaaagaugccacuucaaauuugcugacaucauuaaguuuuguuaauuucuggauuaugcaauuucagggacuauuuaaaauuaacggaaauggcacucaaacuaaaacucucauacugcuuauggauuuaauuuuccuuaaaaaagaauuuuaaaaggccaggcacgguggcucacgccuauaaucccaacaauuugggaggcccaggugggcugacugcuugagcucaagaguuugagaccagccugggcaacauggcaaaacccuaucuuuauucuacaaaaaauacaaaaauuagccagguaugaugacaugcaccuguaggcccagcuacuuggaaggcugaggugggaggaucucuugagcccaggagguugaggcuaaagugagccaugaucuugccacugcacuccagccugagugacagagugagacccugucucaaaacaaaugaaaaacuuuccuauuaaaaauauaauacagggcuaggugugguggcucacaccuauaaucccaguacuuugaguggccaaugugggaggauuacuggaggccaggaguucaacagcagucugggcaucauaucaagacuucaucucuacaaaaaaaaaaagaaaguuuuucagaugcagugguaccugcauacaguccuagcuacacaggaguuugaggcaggaugagcaugccacugcacuccagccugggcaacagaacaagacccugucuccuaaaaaaaaaaaaaaagaaagaaagaaagaaagaaaggaagaaagaaagaaagaaagagaaaaaccaucacuuuauuuuaguccauaaaauugagugaaaaaaaaaaguaauacauuucuccacucaaauagaaacagcucugccacuagauccuauuucacacccauuaggauggcuguauuuaauaagacagaccauaguaaguguugaugaggauauggagaaauuugaacccucauacguuguuagcgggauuguaaaauaguacagccacuuuagaaaacaguugggaguuccuuaaaaugugaaacauagaguuaccauaugacacagcaacuccaccucuguguauauacucaagagaaccgaaaacauuuguccacacauuugaacacuaauacugauggcagcauaauagccccaaaguagaaaaaacucaaagguccaucaacugaaggacagugucuauacaauauguagugugucuauacaauggaguauuaucuggccauaaagaggaaugaauauagauacguacuaaaacauggauaaaccuugaaaacauuauguuuccugaaagauacagaauaccauauauuguaugaugucacuucuaucaaauguccaccacaggcaaauccguagagaaaguagauuagugguugccaggggcugggaagaacaagcggauuaugaguaacagcaaaugggugcaggguuucuuuuugcagugaugcaaccuucuaaaauuagaugcuggugaugcuugcacaauucugugaauaugcuaaaaacaacugacugugaacuguauacuuuagaagagugaauuuuaggguacgugaauuaugucucaauaagacuauuauuauuaucauuuggggcagggucuugcugugucacccaugcugugcugcagcggcacaaucauggcucacugcagccucgaccuccugggcucaagcaauccucucaacucagccuccugggacuacaggcauaaaccaccaugcccuacgaauuuuuauuuuuuauuuuuuuauuuuuuuguauuuuguagagacagaaucucaccaucuugcucaggccagucuugaacuccuggacucaaguaauccuccugccucugucucccaaagugcuggguuuacaggcaugagccacgacaccuagccucaauauagcuauuacuuuuuuuaaaaaggcaaaaacugaugacauguuggagaaguuuuuuccagucucuuuuuuucuuaauuuuauaguugugguuauuuuguguucauauacuaacaauuuuuaaaguaugccaucuuauuacaaacucauuaucaggggaaccugcccccgauuucacauggguucuuuucuauuuucccuaagcacuggccgguuugagaaauaaagggacagaguacaaaagagagaaauuuuaaagcuggguguccgggggagacuucacaugucgguaguuucugugaugcccccugagcuguaaaaccagcaaguuuuuauuagugauuuucaaaagaggagggagcguacgaauagggugugggucacagagaucacgugcuucacaagguaauacacuaucacaaggcaaauggaggcagggcgagaucgcaggaccacaggaccggggcgaaauuaaaauugcuaaugaaguuuuggcacgcauugucauugauaacaucuuaucgggagacaggguuugacagcagacaaccagucugaccaaaauuuauuaggcgggaauuuccucauccuaauaagccugggggcgcuaugggagacuggggcuuauuucaucccuacaguuucgaccauagaagacagccgcacccaagggggccguuucagaggccuacccuuagggaugcauucucuuucucagggauguuccuugcugagaaaaagaauucagcgauauuucucccauuugcuuuugaaagaagagaaauauggcucuguucugcccagcucacuggcggucaguuuaagguuaccucucuuguucccugaacacugcuguuaucuuguuuuuuuuucaaggugcccagauuucauauuguucagacacauaugcucuacaaacaauuugugcuguuaacgcaaucaucacaggguccugagaugacauacauccuccucagcuuacgaaaaugaugggauuaggagauuaaaguaaagauaggcauaggaaaucacaaggguauugauuggggaagugauaaguguccaugaaaucuucacaauuuauguucagagauugcaguaaagacaggcguaagaaauuauaaaaauauuaauuuggggaucuaauaaaugucaaugaaaucuucacaauucauguucuuccaccauggcuucagccagucccucuguuuggggucccugacuucccgcaacaacucaugagaaacauaauagcuuuauaaacucuguugagaucauuucccacaauaauaaagguaacuauuauugaguguuuaauaugagcuaaguauuauucuaagcccuuuauauauauugucuuauuuaauacugacaacaacuuuaggagaucagugauuuuuaugcucacauuuuacauaggaagaaaugaauguuaaauuaauuuuauagcuagugaaugguggagccaguguacuguuuuacauucacuccaguuuuucauuauuauaaaaaauaagaauuauccuugauuguggaagaccaaacuucugcaucuauggaaagguccuggcuuaauuaauaacugcaggucagagcuucccaugccccaaaggccauauacagcaauccagaaagcaaaguuucugccuuaaaaucugagugaucuuuggugucacuucaucucuucuugacccucugggugauccagaauuuagacccugccuccagcucucuggucccugacugcuucucuccuguaacugagucccugacugguccugcuucugggauacccccaccccugccuguuucucucaacccuuggcuggcuaaacuugcacuaaaaggcagacuccacacaccuagcuaaacuuucagguccuacaaauccucaaccaauuaaauuaaucacuaaaaaggaggguucaaguccuccauuucuaaccaugugaacuagagaagcaaccucuuugagucuguuuuguuaucuguaaaaaaugauaauccuacuguauacuucacaggguuguuuugagguucaccuaagauaaaguacuucauaaaccgugaagguacguaagaagcaggucuuaccucugagucgcaggcauguucaaagcaauggggccucugacagcagcaacagaacugauauagccucucaaggugaccacaguggaagaggccgccuggguuaggguccgauuauacauugcuguacucaaauguauuguguggcaguauggccuacugacaacuuuaaguacgaaaaggacuagccaggaagcccugccagggcauugcuaauugaacauucucuacauggaucucacuauuucuucuucccucuucccuguuuccuagccuaguuaagggcaccacuauguacauggucaccaaaaucagaaaucuguugaucauuccugauucccaguaguccaaguuaaaaucccaagaguuuguuucucacucucucucacccuuacacacaaaaugauccacagacuugucucccaaaucuaugcccacucccaauccccuagccuugguuaauguccuccuagccuccaaacucgaugauugcaaucguguccccugcuggucgcaccugguaguucuacuuggucacucaccaauucuccugagaccugaauaauauuucuaaaaugcagauacuauccugucugggaggcuuuccuguuuuccaaaggauaaagucaaaacauuuagaaugccauacagagcucaucucacauacacacacuuccuccccaggguccucuucuggccucugcuuccucuccagaugccccuuacucuuuacaaagggacuguggauuguuuucagaauacacuaugcacuuucauauaucugugauuuuccaaauacuguucccuaagccugaaaauuccuccuguccuccuuaauccuucucugcuuugagagagucuucuucccuuugagauccagucaaugccaguuuuaugaagucuuccacaggcagcuggacacucauuucucuggacuugcacagcacuguggacauuuaucgccuuguaauguuuuuauugauucaccugcuuuucuccuccacuagacugggauuuguaauaaagagccugagucuauuuuuuaugucugacuacugaaaguuuucuuuuuuaaaaacagguuucaacuuauuguagauuaaggguacacaugcagauuuguuauauggguaaacugugugacacugaggcuugaggucccaacgauccugucguucaggucauaggcauaguacccaacaugggguccuuuagcccaugccccccucccucccucaucuagugauccccaguggcuauuguucccaucuuuaugaucauguguacuuaguguuuagcucccacuuauaaaugaggacaugcgguaucugguuuuuugccuuuguguuagaucacuuaggauaauggacuacuggaaguuuucaagcccaccagucccuuuuccccuucugcccccaccucugagcaagccauuacaaaaagccaugcucucucuccuuuggagcugauaggaaauucaaacccucaacagggaaacccucacuguggccccaucuccuaaccaccauaaagccccaagacagucucuagucccugcucucucucucucucguuguguguguguauguguguguguguguguguguguguguguguguguguuugagacggagucuuucucugucacccaggcuggagugcaguggcgccaucucagcucacugcaaccuccaccuccuggguucaagugauucuccugccucagccucccgaguagcugggacuacaagcgugugccaccauaccaggcuauuuuuuuuuuuuguauuuuuaguagagaugggguuucaccauguuggucaggcuggucucaaacuccugaccucaggugauccaccugccucagccucccaaaguacugagacuacaggcaugagccaccacacccugccauauacccugcucucuuaagccauuugaaccagcuugggaaacuugaccugcuguacucagaaagccucauuauguaaguaacaaaccuuucauaacuucuugauguauguguggcaucaucagucuuuuaaaauuauuuuuuauuuuuuaauuagagacaggaucucacuauuuugcccaugguggucucgagcuccuggucucaagcuauccuccugccuuggccucccaaagugccagguuuacgggcaugagccaccucgcccagucacaucaucagucuugacaucugaaucaaguuccggaugggggucuauccuacuucugcagggugaucagaacagaauuauuaggcauaugagccguaucuuauuuauuucccuuuccucugugccuaaaauaaaauaauuaauaaaugguuauugaaugaacuauauuuaaauauuguuggaauaugaaaauucaauuuuauuugagcuguggaauaaacaguuucuuugugaccaguuuaaauaugguugauggaaaaaugaagaccaucagaaauauuuuggaagaagacaaauuuauaaaucauuuggaacauuaagugaauauuuaucuaaaaauugaaaaauuggcaaaggauuugaauagauauuucuccaaagaauauauacaaaugaucaauaagcaccugaaaaaaugcucccagcuacucggaaggcugcagugggaggauugcuugaguccaagagguugaggcugcagugagcuaugauugugccacugcacuccagccugggagacagagugagaccuugucucaauauacaaaauaaacgcuaggcacaguagcucacucaugucauccuagcauuuugggaggccaaggccauccuagcauuuugggaggccaaugcuugaucccaggcauucaagaccagccuggccaacauggugaaaccccauaucuacauaaaauacaacaauuagccaggcaugguggcauauaccugcagucccagcuacucuagaggcugaggcaggaggaucacuuaagcccaggagguggcgguugcagugaguaguuaucaugccacugcacugcagccugggcgacaaagugagauccugucucaaaauaaauaaaugagauaaaauaaaaaauaaauaacagauaaauggggcaauaucuggaggagcauugacaagagagaagaaucuaugaaguggugacaucagagggcaggaaaguccauuccuuuauacagccauggaagguuaggaggcuagugacagaggcuguguuaguggggucaucccuguggauacugaagcacugaaauucaugggaggaaucagggacaauagaggguugccaaauaaaacacuauuugcuguuugucugaaaaucaaauuuaacugggcauucuguauuuuuauuugccaaaucugacaacuuuagguggagagaaacacugcccuggaagguguucugugaaugagagauaauagcaauaugggauaguguaggcaccccuuauucauggcagauaaguuccaaaacccccagugguugccugagaccacagaucaugcugaaccuuauauaugcuaugcuuuuuccuauacauacauaccuaugauaaaguuuaauuuauaaacuaggcaccguaagagaugaacaacaauaacaauaaaauagaaaaauuauaacaauauacuguaauaaaugugauuuauuuauuuauuuauuuugagacauaguuucucugucacucaggcugaagugcaguggcaugaucucggcucaccgcaaccucugccucccggguucaagcaguucucaugccucagccuuccaaguaucugggauuacagucaugagccaccaugcucagcuaauuuuuguauuuuuaguagagacagggggucucaccauguuggccaggcuggcucgaacuccugaacucaagugauccacucaccucggccucccaaagugcugagauuacaggcauauaauacauguuaugugaauguggucucucucucucucucuuucucucucucucucucaauaucuuauuguacuguacucaccuauuuucagaccacaguugacuucagguaacugaaaccuuggaaagcaaaaccacagauaaggggggacugagaacuauaguuguaugguaugagcuucaaagaagcaugauuagggguggugagguugaaaaaaaaggaagaaaacugguuucagaagcaucacugggaagcaagucuccacauccaggcaccaagucauaauggggacuuaagaaagcugcaugacaacccguaacucaggacacagccaggccucauuuaaacagugaaggggaaggaccuugagagccagggagaucuggggaaauuaggaggcagguugagcaagcgagagaguuuccuggccacaguuguaauguuucaggaacauaaugagagcauuuuuuuuuaaaggguugagucaaauaaucugauaauggugaucaggaaacuugccccaugagcacaauggccaugccacagaaaugggcuggcaguaguacccugucaugcucagucaguggcugcagccauacuggggcgguguggacccagagaacagcaaggggacuggcagccaacuacacuccccucugccagagagacaggaaguaaaaccuuccccucccuucugcagcuccacuuagcauuuaggcaaggaaaaauguacuguaagugcccuuuuauggcaguuggucauuuugcugauuuucuucgcagaaggcauccuuuaucccacacaaagaaguuuuccaaagaugccuuggauuccacaucuauccuuuuucaacuuuccucauauuuuaacuaucuuucucaauuucauuuuuaucuuuuccacacauuuccuuuaaaaaauagugugacuaucucaagcuaugagacaggauugcaguccauuuuccaaaagaauaaaauucaauuucucuguagagugaugucuguccuguggccacucuucaggguauaacagguaauagccacugacgaucugaauugcaaguguggggguggaaaucaauuaagcugaaagugaaaaggauaaaggagacugcucuacucuaaaacccauucaacuuucaauggccagaaaacuaaaaauguuaucucaagaguuuucuaaacgguuuaaaccuaacccggauggaagucauggcacguucaauuugaaguaugaucauucaaggcuaggcgugguggcucucgccuguaaucccagcacuuugggaggcccaggcaggcggaucaccugagguugggaguucgagaccagcuugaccaacauggagaaaccccgucucuacuaaaaauacaaaauuagccgggcauguaacgugccuguaaucccagcuacugaggaggcugaggcaggagaauugcuugaacccgggaggcggagguugugaugagccgagauugcgccauugcacuccagccugggcaacaagagugaaacuacaccugaaaaaaaaaaagaaagaaagaaaagaaaaaagaaauaugaucauucccacacucuauguauaauaauaacacauuucauggacauaggagguccccaccugcuuucuuuccagaauaaguacaaucagggauuacauaguuuuuaauagaauaauaugcaguacauggccuuguuacuuugcuauguuuuaaaacuaccagaagaccaugaaaacaauuuuucaauuucucuagggccacuaaacagucucuuuucuguuucuuuaaugaaaacuguuucuuuaaugaaaauauucagucuauaugccaggaaauggauuuuauagagaaacaugaguugcccaaauuacccuaacuugccuccuucccugcagcugaaucuacuacaugcauuuuucguaguacauuaaacugcugcauucucgacaccgccaaaauaauuugcauugugacuagaacaugacaaucuguucaucaacagacaagacaccucuuucaggaauggggaaacccaacagacuuagugucaacuuauuauuacaugguaacauaaacuggaauacgccggguuucuguggucuacggaaucagcuuccucacuucccuggaaauucaacauuuuaaaaaauuaucuuuugccauuuuagccauuuuugaauguacaguucugggcacugagaacauucacauuuuugugcaaccaucaccaccauccacguccagccguuuuucaucuuccccaacugaaacucuguauccauuaaacucugacucuccguucccucuuccucccuagccccugucaaucaccauucuacuugcuguuucugggaauuuaagugcucugagaaucucauauaagugaaauaauauauuaguuaucuuuuuguaauuggcuuauugcaguuaagucuucaaggcucaucuaugugauaacgugucaaaacuuccuuuuugaggcugaauaauauuauauuguuuguauauaacauauuuuguuuauccauucaccaucaagggacacuuggguugcuuccaugcuuugacuuuuauaaauaauguugcuaugaauggggauguacaaauagaaacuucaauuuuaaguaagcauaaggcugcagcaaugacgaggauacucaucgcaaccuuccuuuucauuugcugggccacacuucaguuacagguggugaccagagugaauaucaaguuuaaacugcagguggcagcaaauauucaugaacuagacccaaugucuggcaaaaccauagcuguuuuuuacugcguuaaauuuugccucuuuagaauggaauucacauuuuuccccaggucgccuauguucaacauaagaaaugcuggaagcauuuguguggguuuaacuaacaaggaguacuuuaauugugaaauauaaaagaaugguggaucaguaucugagugcuugaaauucugcucacagcuuucacagucuugccugaaaugucucagccaaccacacauucauaaucuugccacaucuucaagcucugaaaauaggucuucaucauucaugaggaacggccucuggcuuguccaugggauagacccugcuaguugucuauccaauauccuuuucacuuuuuugccuacaaauaaaaaccccaauuuugauuaggccaccguguacccaacuaaaaaaaaaaucuccauugccucaccucucuugcagccgagaugaggguaugccacaguucuuuccuggagauagaagcucaagucugcuggaaaucaaaaguuuugcuuuccugauacaggcuccucccguucuuccuuguguuuguuguguuucgauuguuguuuugguugcuuccuaccaaaaaccugggugggaaacuaaaggugggacagccauacuguaacgaugagaccaccaggaaaauaaacgcacauguuaagcacugcagaguagaaaaaggagccuggggugaugauggcccaggugaggugccccaggaucccugggcuacccaucuguagguggacugcuuacuuucaagcaggacuucucacuuccuguuaugcgagaaaaauauuuccuuauugaguuaaagcacgauacuuagacuuauguuaggugaagcagcgcccaacccccaggugagauggauagauagucccugggaugcaucgaugaguuaaauguguguuuaaagauaaagacaauaaauauacuagcuucuuuuuuaauugagaaaaggugccuaaaaugcagggcagaacuacauuuuuaucagacauaggucuaaaaauacuaaggcagauauuacgcaacauuuaaaguaaugaguuaguaggcuuuuccauaaauaaaggaauggcauuuaggaguagaaguaggagaagaggauaauaaauaauaaauagcagagcuauuuuaaauaauaaaagcagagcugaguuucuaagaugaaaguccucaugaaugugggagucucuguucauuaacagcuucaauucgucagauuuugccacaauguuauaauaacucauuugugaaaugccacaaggucaagauaauccuguccucauccauaucuuuuuagugagaacauuuggugcucuguauacauagcuaaaguauucauccagugacaugaacauuuaccaacaucugagagagagacagagagacagacagagagagagagaaggauucacagaaaaagugaaaugaaagacuuggagaaaauauucuagaaucagagcacccaaagggauggaaccaaacaggagagugacugugagagaggcugagguuuaagugcuaaaaucaggucuaaaucugugacucuaauuucuucuguguacuuuaaacagguuucuacauuuguaaaguaagagaugggaaaugucucaugacacuuauaauuuaguuggagaauaaaaaacuaaagacacauuagcauaagagcaaauaguguggcacaguguguaauuaauggcuaaauuauaugguucaaggacaagugcuacagaaauugagaaaacaauaagaccaagaauaguugggaaaggguuucauggaggagauaggaauagggauaauuuacaaagagagaauauugaagaaauaacuuucuaaguagaaaggaaaaaagacaagaaaggaugcagauguuuggcuuguuuguggcaugaaaggaagacuuguuuuggaaaauaguggggaguagauuuagguuuguaguauugagucaacucauagaugcccucaaaagcuaggaagaaaacauuuggaaguugaguagaagucacuucuguuuccuggagcguggagauuauuggcucaggcauucccaacuccacucaaagcuuuaaugguugggaaacccaggagcaucccagguacccaagcuuguacugagugucagcuccugagccagcagcucucuucacucuccaucaaacuccauccaucaaucccugggugacuccuuccaaagagggaaccaacccaaccuccagaggguacugucauuuucaauccaugaagaggauugcaggcacucccugcaauuugaagagaagauuaugauuugaaaagguagacagucuuuuaaaaagucaagaaaaaguuuuuaagagugacaaccccaguacaccaucauggaauuucggcagaggcaaagaaaaaaaaaauugccaccagugcuggccaccuucuagagcugcugacuuggaggaagcaaacuaaagugcagaggaccucaauagagccuggaugggguagaggcuauuuaacagcauuucagaagagagaagagacucgaguucuuggugaugguuccacucugcuccagacaggugcuccaaucucauucaacaaaaauuauucggugagagugucaaggggaauuugcccaucauauaucaaggcaucaaaaggucucgaugagugacucauauuuacuacaaacaaggaagaaaaugaaugucauggcaaccauacaagaacccuacacaccacacacacacacacacacacacuaacaagugcuucucaaacuuucaaauuugggaauuaugugaagagcucauuaaaacacagauucuaaccucacuaccagaauuccugauucugcucucuggagaacccuagucacgcauagaacaauaccugauuaaccuuuuauuccaauucaguucauauuuguaaagaauguugucaccuaauaaauaugucuuaaauuucuuuagaauacuaagagcaguucuccaaggaacacuugcccagcaacagcaucuccaacaaugaacugacaauaacucuggcuuugaaacuugaggaccaaugaacucugaacucuguucuuuucuuucuuuuuuuuuuuuuuuuuugagacaaagucucacucugucacccaggcuggagugcaguggcgagaucucgguucacugcaacuuccuccucccagguucaagcaauucuccugccucagccucccgaguagcuggaauuacaggugcaugccaccaugcccagcuaauuuauuuuguuuuguuuagguuuuuuauuagagacaaauuauuuucacuacauuggccaggcuggucucgaacuccugacuucaggugauccgcccaccuuggccucccaaagugcugggauugcaggcaugagccacugugcccagccgaaugaacucugcuucuaagcaguuuauguaagacucuuuuuugcuaauaaaagcuccucuuacccuucccucaccaaauaaaugcacugguagcuugccauuccaugcacuccaaauuauaaucuuuacuucuauuccugaguaaauccaucauauuuagagauaauuuuuucuagugucuuuuuuuucagaauaacauugauaauauuaguaaacauaaguauuuuaaaacuuaagaaucccaugacaaccuaagaaagguguaugaacauaaguuuccaugagacagaugauuggcuuuggcagacugaaaucauguagaaacuauuuucauaugcagcuuauacauuuaauguuuacuacacauuaagugguauuucucacuaacaauuccauauuacaauuucaggauaauagauuuaucccaaauuuugauauucccuugagagcugugaaaguaauauauggccuacaaaaacauuucaggaaaugaguaacuuggauaaauuagugcaacaaauguuuauggcuuuuucucauuuuuggaaaaaguuacuccuaauuaccaaucucugucuucuuccagaaccuuucccauucaccguaacuuaccagauuuuuuucagugaauaucuguauuuacaaagaacuuuuuguagugugaaauaaaccuuaccucccaaacaguuuucaugccuuauuacuuuacuuuguuacaacaucuuugugccacauaagauaauuacaauuaguccuuuuuagagaugagaaaacugaggcacaaaaagauuaaguaauuuaccgaagcccuuccaguuaauuaguuucaaaacuaaaguuagagccaaccaauuaaguaguuauacugaguuuacucugaauaauucauaugaccucuaguuauaaaaguuaaacuaauagccugauggcauagccaguaguuggcuuacuuuucaaaaucauaagacugugaaagcagaugagaagacgaaaggucccacucugaguaauagccauacaaaugaucauuuaauacauucucuuuuuaaauaugucaguuugguuuuuuguuuguuuguuuguuuugagacggagucucgcucugucgcccacccuggagugcaguggcacaaucucaucucacugcaagcuccgccuuccuggguucaagccauucucccgucucagccuccugaguagcuggggcuacaggcgcgcaccaccacgcccggcuaauuuuuuguauuuuuaguagagacgggauuucaccguguuagccaggauggucucgaucuccugaccuugugauccgcccgccucggccucccaaaaugcugggauuacaggcaugagccacugcgcccggcaucaguuugguuuuuuuaauagcauuucuuuuccuagcaguauccaauucacgaaugacaauuuuuaaaaagcaugccaaaaaucugagacaauuaugugaccuuaaacagugaugugguuuguuuaaauauggagcugguaauuuacugagauucagcuguucaugacugauaucuucacguuaguuauacauacuuaauuaauuaaaauuaauguuugccaacuaacuaugcaucugggcaauaaaugugcuugauauuugcugucaaaguacagauuauaauaaauuucugcaaugcguaugguuuucuaaauguauuucuauuauugaaagggcaagaccagcuuuguauuagaugaaaauuauugggaaaaugggagacauagcucaaaacugaagguaccuguuugcagcccauauauucuuuaaauaaacuuuuuuuagaacaauuuuagauuuacagaaaaauugugaggguaguuguauuaguccguuuucacacugcuguaaagaaccacgugagacugaguaauuuaugaagaaaagagguuuaauugacucacaguucugcaggcuuaauaggaaacaugacugggaagccucaggaaacugaaucaugguggaaggcaaaggggaagcaagcaggucuuaccaugguggagcaggagagacagcgagugaggggggaaaugccacacacuuuuaaaccaucagaucucaggagaacucacucacuaucccgagaacagcagaggggaaauccacccccauguuucaaucaccuccaaccaggccccuccuccaacacguggggauuacaauucaagaugaaauuugggugaggacacagagccaaaccauaucaauaguacagaaaguuccuauauauuccacacccagauuccccuguuguuaacauuuuauauuaguaugacacacuauuauuaacuaaaguccacauuuuaucccauuuuccuaaauuuuuaccuacuauccuuuuucuguuccaggaucccauauaggauaccauauuacauuuagucaucguaucucuuaggcucuccuuggcuuugauggccucaacaguuuugaguaguacuggccaguguuuuauagaauguuccucuacugaaauuuaccuuauguuuuucucauaauuagacuggacuuagggguuuugauagugaagaucacagaaaucaacugcuauuuucaucacaucagaucaagggcacaugcuaucaaaaugacuuaucacuauugacguugaccuugaucaccuaguugagguaguauuggguaguagcuuucugcacucuaaaguuacaguuuuucgcgcguuuuauagggcuuuuuggaaagaagucucuauuugcaguccacacuuaaggagugaagagccauuuaauuuuauauguaaauaaaauguaauuuauaauuuugaaagcaugcaccauuuaaaaaaauguaaucaucaaagucuugguaaguuguggcaucuugacacuuuacacacuuaagaucauauucuuagaaucuuuguagggacaucuucugugugauacuauuugcgugauaccacuuuggacacauuuucccagguucucagauuauuucucugacaagcuuuuauuaucaggcacuaugguggacccugggaaugcaaaccugagacauuauccuugcccucaagagguuuaaguucucauuuuagagauuccacauucuaaaagccaauacuuuccucguuuuucuugcgguggcauuuggaauauuuucaaacaucuuuuuagaacuaugguuggccaggcaugguggcucaagccuguaauuccaguacuuugggaggcagaggugggcagauugcuugagcccagggguuugaggccagccuggccaacauggcaaaaauacaaaaauuagcugggcuugguggcaggcaccuguggucccagauacuugggaggaucguuugagccugggagguugaggcugcagugagcccugaucacaccacugcacuccagccugggcaauagggcaagacccuaucucaaaaauaaaaauaaaaauaaacuuacauaaauuaaauaaaaauaucaucauuuuccaaaauauggcacaauacauuauuaccagaguaaagaaugaacauuccucuuuuuuuuuuuuuuuuuuuuucucuacacggagucucacucugacaccaggcuggaguacaguggcucgaucucugcucacugcaaccuccaccuccuggguucaagcaauucuccugccucagccucccaaguagcugggacuacaggugcgugccaccaugccuggcuaauuuuuguauuuuuaguagagaugggguuucaccauguuggcccaggauggucucaaucucuugaccucgugauccgccugucacagccucccaaagugcuaggauuacaggcuugagccaccgugccuggccuccucucucucuuuuuaaaaauauuuuguuuuccugccucagaaaaacauagaugugguuccuuagaauuucccugaauuuuuuccaacaaaugaauuggacauccaauuaugcacaaucuucuaguuuugucuugcucaucuuuuauuauugaaagagcaaagaacgcaugcugggauggaaggucuaccaccauccuaauucuugcaucagcuaaagugucuuugucuauaaauuacaaaaaaaucacucagccagauuggcuuaaauaauagaaauuuguuaacucauguaucagaaaauccugaaguagucaguaaauagauuuggggggguugauguagcuacucaucaaugucaucuuggauccagcuucauuucgucuuuccacucuacacucaucaguguccuggcuucauacucugacugguaacaagauggauguaguaguuucaggcaucacauacagacacagcaguguccacagguagaaagcaggcccuucucuauccuugucauggacaagaaccaggucccugaaccacaugaucauaaaccaauuccuggcaggagaauaagaauaucauaauugauucagaccaauuaggguugacucccgagcuggagguuacuccagaauugcaugaagaacagaugaauaucugagcaaaacuaggguccuguuaagaaagaauaagaagggaguagacauuguauagaaaaccaaggccuacuauaugcucuuuguagcauuuccuggcaggucuguccuacuuuagagcucauauuguucuucucugcccuuuuuuagugauauuuucuuuucuuuuuucuuuucuuuuuuuuuuuuuuuuuuuuuuugagauggagucucugucaucaggcuggagugcaauggcucgaucucagcucacugcaaccuccuccuccuggauucaaacgauucuccugccucagccuccugaguagcuggggcuacaggugcaugccagcaugcccagcuaauauuauguauuuuuuaguagagacggggcuucaccauauuggccaggcuggucucaaacuccugaccucaggugaucuaccuaccucggccuuccaaagugcugugauuacaggugugagccacugugcccagccuauagugauauuuucaaacucaagauuuucugcugguaauagcucucugcuuuccugauacauacugaagcuuauuuacuaugauuccuauugccuaauacaccugauucuaaguagagauuauuuuaagcacaggccuccuucucaugccuuauuggucuuuaggguauaacaauuuuaguaauaauuggggggaauuaagaauuccacuaacugcuggccuacagcaaauccuaaagggccaauaucuuacauuuauaaucagcuucacucuuuucauugaaaauuauacucccaaucuucugaugagggauggaaaacaaucugcuguuuccugugcccugcccuaacuacuccuuuuccaugauagaauauuauucaguuucuuccuagcauuacucuauuuaugaugcauuuauauacuuuauuuauuuuuauuuuuauuuuuuugagaugaagucucacuguguugcccaggcuggagugcagugguaugaucucggcucacugcaaccucugccucccagguucaagcgauucuccuaccucagccuccugaguagcugggauuacaggcacacgccaccaagcccagcuaauuuuuguauuuuuaguacagacaggguuucaucauguuguccaggcuggucuugaacuccugaccucgggugaugugcccaccucagccucccaaagugcugggauuacaggcgugagucaccgcacccagccuauccuuuauucuuuaauuuuuugugugucuuuauggugguugucuccuacuauguaucccacuuguaccagcaagggauaugaauacaaaagauucauaugaagaauguuaacaugauuuguacauauaauuuaagcauuauuaguauguuacaucccaugcccacacucaagaaauuugcgcgauuauagaagacaaauguggguauggugggaaaaguaccaaaauuagaaucaaaagagugaaguuugaacauuagcaacuugcuugauuuauggccuuacaggggaauauuuaacuuaucuuggucacuguuauccuauaguaaaguaaggcucauaauauuuaucucaaggacuguuuugagauuaaaugagauaauugauaugaaagugcauuguggcugggcgcagugguucacgccuguaaucccagcacuuugggaggccgaggcgggcggaucaccggagguugggaguucaagaccauucugaccaacguggagaaaccccgucucuacuaaaaaaauacaaaaaaaauuagccaggcgugguggugcaugccuguaaucccagcuacucgggaggcugaggcaggagaauugcuugaacccaggagguggagggugcagugagccgagaucaugccauuaaacuccagccugggcaacaagagugaaacuccaucuacaaaaaaaaaaaaagaaagugcauugugagaaaugugagacauuaugggggauuacuauuuucauagagccuauaaaaacaugaggauauagagaaguuuuuuuguuuuguuuuuugggguuuuucugagacagucuugcucuguugcccaggcuggagugcaguggcgugaucucagcucacugcaacugcccccuuccgcguuuaagcgauucuccugccucagccucccaaguagcugggacuauaggcgcccgcugccacaccuggcuaauuuuuguauuuuuuuaguagagacgagguuucgacauauuggccaggcuggucuugaacuccugaccucaagucaucugcccaccucggccucccaaagugcugggauuacaagcaugagccacugcauccagccuagaguauuuuuaauguucaagaaaacuaaaccaaugggucaguacagagagguaaaaacuaaacuagcuauuggcuuuauucagacaaaaauguuugacuagcuaaugucaguguccagcccauaucccuccggcccacgcuggaggucaacuguauuuagguagacaaugacuuuucaccuuaagcaucccucugccugagagcucucagggaguuaauuuccuggggagcaaacuucaaccaguaaugggcagacauugauggauaaaaacccuugcuuccuugucucuuggaacaauuucagaugugcuuuacaaugugucucagaguguccauagugauagugagccccaauuacucauggcaguaaccuguacauugcauuguacaaugcaaagauaaugcauugaucuuuucccugucuccuuccauuuccuguaccauuucauuucucccucaccauaguuccugggaucaccucuguguagaaaaaaaauaaacucaguuucucccaccauacucucacaccagacgugugggaauuucuccccaccagccagcaagcaaucacuucugcagugaauaccagcuggguguccuccaauauaauucugacaccaccuaccuggagauaguaucagaucccacagguugagggcucaguccccaagacuucucaccuuuugaugcccaucucaagcccagguucuuucaccagugcuucugacugacuagcuauaaacuggagaucccaaauccugguucuggguuccauuaauuugcuagagucgcucacaggauucaaggaaacacuggcuuguuacaaaggagacugcaaaggauacgaugaagagaugcauagggugagguaugggaagggguguggaguuuccaugcccucuucaggugcgccccccuccaggaagcuccauguauuaagcuaucugaaagcuccccauaaccuguccucuugcgccuuuuacggagacuucgauagauaggaauguuagcaacugugagaaaugugauugggcaaaaaguguaugaucccauacuaauagauuggguggagaaacccagcaaggccugucuguccagauucuucuuggccugucggugcaauuuuccuucuuccaggauacggagcaggaccccuuuugaaaugggggucuuauugagauggagcagggacuccucuuaggggucuacuggaagcucuucccccaagcaugaaauaaaggaaaaucuuuaguuucuucaggggaaauuccaggcaccuagcuagcccugagaaguaaaugagcaacuuaacaagcaggacaguaauaguagcuuaaaacaauuggcaagaaaguuacagucaugagaaguuugguucccugcagaagcuaaagaugaggauucagggaaacacuggcuuguuacaaaggagauugcgaaggauacgaugaagagaugcauagggugagguaugggaagggguguggagcuuccaugcccucuucaggugugcgccccuccgggaagcuuuuuuguuuuguuuuauuuuguuuuguuuucuugauacggaguuuugcucuuguugccuaggcuggagugcaauggcaugaucucggcucacugcaaccuccaccucccagguucaagcgauucuccugccucggccucccaaguagcugggauuauaggcaugcgccaccacaucccaacuaauuuuguauuuuuaguagagaugggguuucaucauauuggucaggccggucucccacucuugacuucaggugauccacccgcaucggccucccaaagugccgccacgcccagccuaaagauaacaucuuaacacauguaccugaguuguuuuucagaaacucagaccccuacuaaauggguccaccggcacguagaccucacauaagaauugaggacugaacucugaccacgguucuuuguucuaaauuucuuccugagggaccuggaggaagucaugcccaugggccagaccuaucauuucugucugcugaacucaaaauuuuaaagaaagcuucccuuccucaaccaauuccaaauaaaaaaauuuugaaucuaccuaugacccauaacacgcuacuucaagauaucucaccauuuuaagccaaaccaacguauagccuucauacauuuaugauuuugccuguaauuucugcuuugcugaaauuuacuccugccuuuaaaaagucuugcuuguaagacacagggagguugggucuuaagcgugagcugccugauuuucuuuacuuggcauucugcaaauaaauccccucuguauuagucuguuucacaccacugauaaagacauacucgagacuaauuuauaaagaaaaagagguuuaauggacucacaguuccacguggcugggaaggccucacaaucaugguggaaggcgaaaggcaugucuuaccugguggcagccaagagagaaugagagccaagcaaaagggguuuccccuuauaaaaccaucagaucucaugagacuuacucacuaccacgaguacaguaugggggaaaccacucccaugauucaauuaucucucaccgggucccucccacaacacaugggaauuaugggagcuacaauucaagaugagacugggguguggacacagccaaaccauaucacccucccuccuccugaugcaaaaccucggugugguuguucggccuuacugcauccggugagagggccccaguuugguucagcaacauuaugaccuacaaucagacaauguagucagauaauuucuuuauggccagcuccaagacagaaaggugaggaaagauuagaguauauuuuuaguuucuauggccugccucgaggagaaaaaggagcaggugaaaggaaggcaggucagagagagagaaagagagagacagauucuguuuccuaaggucuaguucugaggccuaaaguauugcaacauuacaccaaaagacuaccuuuuaccuuuuucacccugaagcugcuucaggaaccaaagacaaaaggacaaaaccuugagcgaaagauaugauuauuguuucggccacuuagcaaguaaccagggcuaugggaguuaugagccagggaccgugguagaaaagacuuauauauauauaaauguauauguaaaauaguaucacaaccucccaaauaaacugcuuguacccaaauccuugucucagaauccacuuuugggugaaaucugaaguaagacauuuguuuuucauuuuugaauauucauucuguugcauaaaacuugcuuuacaagcauguguuugugaugguucacauuuuguuugucuuugcuuuuaauuguucuuuuuauaaaagaacacaagaaauuggagaguaggacaggaaggaggaagaggaaaagagguggagaacugaaagcugagcucuuuuucuuaagugaaaaaacauguuuugaaaaaggaaguauuccuuuuuaagugugaauacaaccagucaugaggcagaggugagagagaacugcaugaacugcgagaugggaaggguggaagggaaugucaucguuguucugaccccaguauuccuucugauaggauuuuucuaaaucuggacucuuauugccucuucuggcccccauacuuucuacucugggaauuccucuuucuuaacuacauuucucaucaccaggguaacacaauaaaaucuucaaaugagaaaagagaggaaaugucaagcaggacugugcagaaugcuuugcuuugucucuaaguucugagcuuggacgggcuuccuggagaccagcccaugccuucugacgucaaggacaggccuggaccugagagaagcaagucgggaggaguggggguggggaaguaauuggugucaggagguaggagagacaaaaguguguucaagcauuuauccagagugcuaucacucccauacugaaucucagccuagaccaauaccaauacuaauaacaguccuuagcauuaaccuuuucuuucuuucuuuuuuuuuuuuuuuuuuuuuuuuugagauggagucucgcucugucgcccaggccggacugcggacugcaguggcgcaaucucggcucacugcaagcuccgccucccggguucacgccauucuccugccucagccucccgaguagcugggacuacaggcgcccgccaccgcgcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccccuuuucuuucuuucuguucuuccaaagcaguguaaaguacuccuuucaaagcaguaccacguuacaaaaucugcaaaucccagaagucaauaaccugaagacaugccaggagcagugaagaaaacaagugucaugagagaugaggcaauaaagacagcaagcugaggaggaggcuguuuucaagccacuuaucagaauacacaguagguacccuuuuuccccugguacccaaugucaccaccucaaaggggugauuuuuuuaaucgauggccuaaagaauucuuuucaaaugacaugaguugcuuugaggagagguggaaugagauaggcucaaauacaaagaagaaucuugccaaaguccaaagucagaaaagaacccacugugaaagaggaacccacaagagucaacaucuugcuacuucaacuaauugcgcccauuggaaggcaauggaagauggacuggaaguucacacacacaaaaaaauagaaaaaccugucugggcaugguggcucucaccuuuaaucucagugcuuugggaaguugagccagaaggaucacuugaagccaggaguucaaguccagccugggcaacauagcaagacccugucucuauaaaaauaaaaauaauuagccaggugugguggugugcacuuguaguccuagcuacacaggaggcugaggugggaggaucacuugagcccaaguguucgaggcugcagugagcuaugaucacaccauugcacuguagccugggcaacagaguaccuaccucuaaaauaaauaaauaaugaaagaaaauaaaagccuauauuauuucucaucuagauauuauaauauccucucugagagaccacccaaagagugccaugaaagguagagcuaaauucugucucuggccacuggauuuucaagccaggagcaagggauuggauaacuacaacuugcuuauaguucuucccccaggaacuuaauaaaaaguguaaaaaaagaacaccuaacaggaacucaccaaugccucucacuaggaucuuuccugacuucagcacguuuuauaaaacacacauggauuguuucuucucucagugccuuugaggagacaaagguuauccugguaagaaugaauagggcuuauaaguaggguucuuagcaaggaagagaugggaauauuuaauuaaaggagaccauuugcuggguguacgggacuggcuuuugugauaaaguagaugcucuacauccacucagcccaccuuugauuuuuuuugcugcagcuguaaugcacuuuccuaugcaugcugacagagucccaccacaaguuccucuucaucucucugacauccuuuaccaaggaagcagugggagcuuauaugcuaggagcuuauaaguguacagggcaagcccaaaggagaaauauucccccauuagaaccccagccaguggugccaggggauaaauuguucagccuccccucuuuugcagggccauucucaaguguauuccacaugguuccucaaaggauccucggaaggcuugagcccaauugcccacugcgguaauuaguucaauaacauccccuccuuuuuuuuuuuuacuuuuccaucuuccuucucucaguaagcuuacuccuucauuccuacuuucuggagucauuuugcaaauaaauuaccugaacucaauuccuuaccucaugcucuacuuuuggguggacccaaacuaagacaguaauaucugguguaguuggagaaagcauccccucgggaugguauucuggaacagguuuacucaccagucagaugaaaacaaaagcuccauugcugguaguaauugugguguugauaaccucuggcauaacaaucaaacucucacccgugguggacaggauguuguggaagggaaagcuucacuuauauaguaucuaauacugggaugaaagggggcaaugguaauuauaacaguaguggaauugacuggcuuuugugaaaugccauaagaguuuugaagacugccucaaagaaaaagacgaguucaggucagccaacuaucaggucaagacauucugugaaagucagaagucuuccaugacagcaaguaaagggacuguguagcaaaacggcagucgggccaggcacaguggcuugcuccuguaaucccagcuacucgagaggcuguggcagaaggaucgcuugagcucaggaguuuaaggcugcagugagcuaugauugugccugggcagcagagugagaucccaucucugaaacagaaagaaaagaaaagagagagagaaagaaaaagaaaggaaagaaggaaggaaggaaggaagaaaggaaagaagggagagagggagggaggggaggggagggagggagggaggaaggaaggaaggaaaaaaagaugaaagggcagucugugcuaaaauucaagcuccaaauucaaucuuagggguggcagaauggcaaaggagacugaauauacaggucuucuacgcuaaagaucuaugcuaaagucacagcuuugauagggaaacagugggacucagacuugggaugaaggccucugugaggauauggaugaggaccuuaaauccugggugcucuugaaucagggagguuacagaaaccagucuccugccucuugcuggaggacagcagucuucccuugccugaagaggaugaaaaccuuccugaguugagugucuuggaagauguuacucguccuccuugggaucccuccagugacuccucuaacugccuguagcuugaaaaugugucaaguucuagcauaccguaagagggaagguacuguuucuucuaugggaagaaauaacuugcugaaagaauuacagaaaaauucugacaggaaagaggaaaagaucuaugggaauaaaucugaaaguguuaaauugaauaggauagguaagugagauauaaggcugaauacaggagaguguaauucucccgugacucacgguaacaucccaucaaggacuccuggaguuugucccaacacacugcuaagacggugccuugaaacuuggacaugauaacaauguagagaugccacaguugucuauuuaaaaaaaggucagaaggcucaaggaagugggcauaagagaaugagauuuuuaugugagaccaaucgccugacuguuuccuacuguacucccuccacaaagguaagaaggaacauaccagcauuuuaugaaagguuaguggcaguggccucuaugaauugggguucacagaauaaaauucugccacagaauugagccuucuagggucaaugggaauaaaaagaauucaauuauuugagaguccagguagcugcacuuaaacaucgaaggccagauggacauaauucauguaauaugcaagacuauagggguaaccaggguuuugccaggccccuagagauuugugauaauagaucuucauguucccaggagugagauggauaggcagccuacaaaaauauuacuugacuuucauaaccagaaaaaaaguaaaaacaggugagcaguaggcuaggaucagugccacaguagaaaaguauaauacucuguugaguuuuuagaccagagugaguuaucagacccagaacccaauaauugaaggggaagcaugaucugcucaaggaaaggcccugcaaucacaucauaaacauauauauauauuaacucuccaauucuucccccaaagagaccuauggcuauuuauucagaccuuucaagggcuguuagauacaggaucugaggugacacuaauaacaggggacccaaaugcuaucauggccccauugauaaaggugauggauaauaugguaauuacccugauuugauccuuacacauuguauauacauauugaaauauuauacuguacuccaucaauguguacaauuauaugucaauuaaaaauaauaauuggcugggcacaguggcucaugccuguaaucccaacauguugugaagccaaggugggaggauugcuugagcccaagaguucaaaaccaggcugggcaacauggcaagacccugucucuagaaacaauaagaaauuagccagguguggugguguguaccuguagucccagcaacuuggaaggcugaggggugaggauugcuuuagccuggaaggucgaggcuucaguaagccaugguuaugccacugcacuccagccugggugacaaagugagauccugucccccaaguaaauaaguaaauaagcaggcaaauaaaagucauguggauauacgaauaagaguagaaaugaacaugcacaucuucaugccucacacuaauguucucuggagaacauccaucacugagaggcucuuagcaaugaggaaaagaggcuaccccuuggguagaugucagccagccucuauucuuggcacuccaaugcuagugcaauggacccaucaacauaguagcuuugucagcagguauggaggccaugcaaggccccaacuguauuggcucauucucaccaagcuggcauagcuacuguaucuacaaaguucugacuugucagcaacaaaaaccaauaacacacauucagcagaguaccaaccuucaaggacacuagccaagaacuuaggggcaaauugauugcauccgaucccucauccucccuccagagaggacagugauucauccuuacuggaauuguuuccuguucugaauaugaguuuguccuucuugcucauaguguagcuucuaggauuauuaucugacagcuuacagaaugcuucauuuacuaacguuguuaccuguauaacaucaguuugcacuaaaggacccauagugaaggaggcacaacaagacaacaugggcacaagacuaugggauccacuguuccuaccauauaccacaguauccacaaguugcugaacugauaaaauguuggaaugaacaauuuagagaucggcuaguuuggagacaauacucugcaugauuaggauuuggccuauaggaugugauauacgcauugagccaaugccguguaucuaauagcuaggauacauaagucuagaaaccaagguggagaaguugaauuggcuucucucaccgucauacccagcgacccacuugcagaauuugugcuuccuauguucacauccuuaggcucugcuaacauucuuaaaaaaugcaaagaauuauuuuuauaaauuuuuacuggugguaggagggagaaaaaugacuuguaucaauacguagcauuaguacacagcauuaauacacagcaagaaucucacaggaccuguagcuaugacuacccccugcucacuuuggcucuuuaugccaaaggacuaguagacaaagaaaggcauuuuucauacuggcaagguaauugauccugauuaucauaagcaucuaggauuauugcuaaauaaugaaggcaguaaggaguauuucuagaucucgaaagauuaacugggauucaucuagcucuuucauaccuggcaaaagcacugaaugaaaaauuauagcagccucagccugacauggguaagccaaccaagagcuuggauuccucaaggaugaagacauuuggaucuccccaccaaccaaauaacuuagauuagcugaagugcucaccaaggguaaaaaaaaucuggaauggguggaaaucugagugggaccugaugaauaucaguuauggcccuuugagcaguugcagcaagggacauuugcuugcuacacuaagucucaucuggaguccuuuuaacaaucagaagcuagcuaugaccuuaaagaguuggugacagaaugaauuucauauagagcaaaaauggaucugaaagguaagggauagauuguaggagauacuuuugaugucuugugccacuucuuuugauuucagcugcaaagguguuggacaguuccuaugcaugccacaguuuucccucaagcaccugcuggaucucucugccuuccugacucccacucucuccaaagccacaggaguucacuaagcucacauugaauaaccagacacacagagauguuaauuccccuggcagccauccucgaucagugagugaaaggagacagcagauaaauguguuagccuuucgucuuugcuagagaaaauucugagauucauuuuacaagauucuucagagauugagucccaauugaccaaagugguaaccaacucaacaauguguccuucaauggcuuuuccuuaucucucucauauucuugcuuuucaagaucaccuaucaaguaaacuuauucagucccugcuugcaaaggaagccaaguagauggauaaaccaguuggcuucugguugauugugauauucauagaaaggguuggcuguguuguuagagaaaaagcuaaugauaguguugguugagaaaaugaaguuaacuaaaaauuggaaauaaacauuuauugugcauguauuauguaucaaacauuuuagaagguuuucaauaucauuaucaguugaugauagagaugaguuuucugaauucauggggaagaaacaaaaauaaggaaaaaagagaaagaagcacauagcaagaaaccaacaaaucauagucaaacucuuuuauaacgauguuuaccaauaugcagccaucuagauuaaccacuuaucuaaagaaacaagaaccaccuuauuuaggcuuauuuuguguaccaugcuuuggguguguuaggagguggaagugagaguuggagcaugauugauaugugguauauccauacaaauacaacaaaauucuguucuaaaaauaugaaauaauggcugggcaugguggcucacaccuguaaucccagugcuuugggagguugaggcaagaggauuacucgagaccaggaguucaggaccagccugggcaauguagcaagaucccaucucuacaagaauuaaaaaguauauauucccagcauuuugggaggccaagucaggcagaucauuugacgucaggaguuugagaccaguugaaacccgucucuacgaaaauacaaaaaaaaauagccaggugugguggcagaugccuguaaucccagcuacuugggaggcuaugacaggagaaucgcuugaaccugggagguggagguugcagugagccaagaucaagccacugcacuccagccucggugacagagugagacucugucucaaaaaaauaaaaaaauaaauaaauaaauaaauaaagagagagagauaauuaaaaaaaaaaaauagguguuagcuauuugggaggccgagggugggaagauugcuugagcccaagaguuccugccugggugacagagaaagauccugucuaaaauaaauaaauaauagaaaauauuaaauaauucaacauguaacaugagagagauauaagaaauacucaagaucauuuaguccaaucuccucauuuuacaaaugaagaaaagagguggcuuaguggcaacaugagacccagaauaccaaccaagauucugauucucuuuucauuauacauggaaacuugcaccaagagaagaguugucauuuagaaaauguuuaacucaaaauguuuuccuuauuugugugaagucuuacaaaaagcuaguaugauuauugauuccauuggaguucaguugcuuguacacagucuauagugauucugagucccuuauaccuugcucuauggccuuagauugagucccauucaaauacugaauguuccuaagaggcauaacauugagaugcaaauaaaagaccugaaaaguaccuuugagaucaccuggccaaccccgaagaaguuuuuguagaucuuuaguacaggugcuuuuguagauauuuaguaucauuuuccauugacugccuaacuuggucucuaugauucuucuggccaaaaugggaagaaagaauagaaaaaagaagaaagaagaacauuuccucuaccucuuucuuucaaaucuuauauuuagacguccucuuuagcuaaccaugaccuuggauaggaaaugucuauuucaucuccaugaggaaagcagugaauaaauguuuauugauugauagaacagcauucucugauugucuguucacuggaaugcacuucccauaaguagcaagaguacuuuucaucgaugaaucuuuucuuaauuguggcaaaauauaaauaacauaaaauuuagcauuuuaaccauuuuuaaguguauauuuagugcauuaaguagaugcacacuguuguacaaccaucaccaccauucauuucuggaccuuuuucaucuuccccaguugaaacccuauacccauuaaacaauaauucuccauucccuucuccuucuagccccuggaaaccaccauucuacuuucugucucuaugaauuugaguguucuagcuacuucauauaaguaaaacaucauaugguauuuguccuuuuguaacuggcuuauuucacuuaauguaauaucuuuaaguuucauuuauggaccaugugucauucuuuuuaagauugaauaacauucuguuguauauaccacauucuguauauccauauuuauccaucaauacacauuugggcugcuuccaucuuuuggcuucugugaauaaugcugcugugacaaucgguguacaaauuaucuuuucaagucuuugcuuucaauuauuuuggguauauacuuagaggugaaauuucugaaucauacaguaauucugucaauuuucugaggaaccagcauacuguuuuccacaguggcuguaccauuucacauuucaaccagcaauuucaaccacagggaucccaauuucuccauguaccacuuguuauuuuucuguuuggguuuguuuuguuuuuuugauagcagccauucuaaugggugugaagugguaucucauuguggcuuugauuugcauuuauaauuagugauguuuugaccaucuuuuuauguguuuauuagccaucuguauaucuucuuuagaaaaauaacaauucaaguccuuuguccauauuuuaauuggguuauuugcuuuuuguguugaguuuuagaaauucuuuauaugcucuggauauuaauccuuuaucagaagcauggucugcaaauguuuucucauauuucaugggcuaccuuuucacucucuuguuaguaucuuuugacgcauaaaaguuuuuaucuugaugaaguucaaauuaucuguuuuuucuuuugcugccuaugcuuuugguccauuaacuguugagcucacaucucaauccuaauuuuaauucuuaaccuuaacugcuacugccugggguuaaucuagguuuucuggggccugaaacauacacaauuugggaaggccuaaaaaauacaaagaauguuauuuuuguaaauuuuacuuaauuuuauaaccauguaucgugugcuaggagccuccccuccuuggaaaaaaucaggcaaacuugacagcucucuguuccucagccucaauguccugucuguuuuaccuuauggauauuucacauccauccuuuuuuguuccuacucucacugccuuauuuuaggucagugguucaucaucucucaccagaauaagugcaauagccugcuaacuagucuccuuguuuauagaguugucccauaaucgauuuuccacagucaaaaaaugauguaacuaaaaugaaaauacgauuauuucauguuccugcuuaaagcccuccaauggcucgugauugucuucgggacagagacccaauccucuugucaaggcauguaaguccccuuccauaaguaaucuugauaccuguuccaccucacauucugacaucccucucaaacugugcucuagccauauuacacuacuugcuuuucccuaaauaggucaugcucucaucuaaucuccauggcuuugcccuuaccguccuuagagcuuguaaucuaccuuccuacccauuuuaccugaaaaacucagccuucaggguccauucaagcacuauguuuguaugugugaagcuuucucugacaccccaagucuagguuaagcgacucuuuuggaguuccuuucacacucacccacuuuguagcaucuaauucuucauuugucugucuucacuagacuuuuaacuuccucaggauagagacuacugcccugaagagacuacuuuuuagucaucacugcagccucaguaccuggaacacaauaggcagucaacaaauauuucugcauaaacaaucucaugaaagaaacaggcacuaaguauagauuucuugccuaacuaguuucucucauuuucucucuuucacaugcuaacuuugcuagauuuuuuuaaaagugagguuugggugaugggauuaugggugugauaugguuuggaucugugucucuaccaaaucucauguggaauuguaauguccuguuggaggugcagccugguaggaggugauuggaucaugagggcaaaguucucaugaauggguuagcaccauccccuuggugcuguucucaugauaaugaaugggugacuuauuaugagaucuggcuguuuaaaaguguguagcaccuccccccacucucucuuucuccugcucuggccauguaagacguguuugcuuccccuucacccuccuccaugauugcaaguuuccugaggccucccuagaagcaaaagcuucuaugcguccucugcauccugcagaacugugagccgauuaaaccuuuuuucuuuauaaauuacccagucucaaauauuucugcauaguaagaauagacuaaugcagaaaauugguaccaaagaguggggcguugcuguaaauauaccugaaaauguggaagugacuuuggaacuagguaacugucagagauuggaagagugugaagugcucagaagaagacaggaaaaugaaggaaaguuuggaacuuccuagaaacugguuaaauuuuugugaccaaaauguuguuagugauauggacaaugaaguccaggcugagaaggucucagaaggcgaugaggaauuauuggaaacuggagcaaaugucacuuuuguuaugccuuagcaaauaauuugguuggauugugccccugcccuagggaucuguggaacuuugaacuugagagugaugauuuaggguaucucgcagaagaaauuucuaaacagcaaagcguucaagaugugcccuggcugcuucucaauguaugcucauaugugugagaaaaaaaauuaucugaaacuggaacuuacauuuaaaagggaaacagagcauaaaacuuuggaaaauuugcagccuggucaugugguagaaaggaaaagccuauuuucagcaaaggaauucaagcaggccacagaaaugugcauaaugaaaagaaaagcaaaugcugauagccaagacaaugggcagaaggccuccaagccauugaagguaaccucucccaucacaggccuggagccccaggagggaaaaaugguuucaugagccacacccaggacccugcugcccugugcagccucaggacccugcucccugcucugucuccaguuuuggcucaaagggcuccagacacagcuugggcuguugcuucagagggugcaagccauaaaccuuggugguaugaagccugcggaugugcagagugcaagaguugagguuugggagccacugccuagauuucagaggguguauggaaaaaccuguauguguaagcagaagccugcugcagaggcagagcccucauggagaaccucuacuagggcagugccaaggagaaauucgggguuggaaaccccacacagaguccucacugggacauugccuaguggagcugugagaagagggcugccauccuccagcccuuagaauguuagagccacuggcagcuugcacccugugccuggaaaugccacaggcacuugaugccagcccaugagagcaacuguggggccugaacccuggaaggccacagggguggaacugcccaaggccuugggagcccaccucuugcaucagugugcccuggauguaagacauggagucaaaagagauuauuugggagcuuuaagauuuaaugacugccuugcuggguuucaaacucaaaagaaacuggguuucuuuuggccaaugucucccuuuuggaaugacaauguuuacccagugccuauaacccugauaugguuuggcucuggguccccacucaaaucucaucuugaauuguaaucccuauguguugagggagagaccugcugggaggugauugaaucauggggacaauuucucccaugcuauucucaugauagcgagugaguucucaugagaucugaugguuuaaagugggaccucccccuuugcuuucucucucucuuucucucucucucucuccugccacaauguaagaugugccuugcuuccccuuugccuuccaccaugauuguaaguuuccugaggucuccccagaauguggaacugugagucaauuaaaccucuuuccuuuauaaauacccagucucagguauucuuuauagcagugugaaaacagacuaauacaaaaaauugguacugggauagugggguauugcuguaaagauaccuaaaaauguggaagcaacuuuggaacuggguaacaggcagaacuggaacaguuuggagggcucagaggaagauaagaagaugugggaaaguuuggaacuuccuagagacuuguugaaugaauuugaccaaaaugcugauagugauauagacaaugaaguccaggcugaggugguuucagaugaagaugaggaacuuauugggaacuggaguaaaggucgcucuugcuaugguuuagcaaagaaacuggcagcauuuugccccugcccuagagaucuguggaacuuugaacuuagaugauuuaggguaucuggcagaagaaauuuccaagcagcaaagcauucaagaggugaccuggcuuuuucugaaagcauacagucauaugcauucacaaaaagauuaucugaaacuggaacuucuauuuaaaagggaagcagagcauaaaaguuuagaaaauuugcagccugauccugugguagaaaagaaaaacuuacuuucuggggagaaauucaggccaguugcagaaacuugcauaaguaacaagaagaggaauaucaguugccaagacaauggggaaaauaucuacagagcauuucagagaucuuccugguggccccucccaucacaggcccagaggccuaggaggaaaaaaugguuucgugggcugggcccaaggccuugccacuuuguacggucuugggacuuggugccuuuuaucccagccguggcuaaaagggaccaacguacagcucaggcuguugcuucagaggguguaauccccaaaccuugguggcuuacacaugguguugggccugcaggugcacagaaguuaagaauugacguuugagaaccucugccuagauuucagaggauguauagaaacaucuggaugugcaggcagaaauuugcugcagggguugaguccucauggagaaccucugcuaggucagugcagaagggaaauguggggucaaagccccuacacagaguccccacugggguacugccuaguggugcugugagaagagggccaccauccuacagaucccauaauauuaggucuacugacagccugcaccauguucuggaaaagccacaggcgcucaacacuggcccaugaaagcagccaugggggcugcauccugcagagccacagaagcagagcugcccaaggccuugggagcccacuucuugcaucagcauguccuggaugugagacauggagucaaaagagauuauuuuggaguccuaagauuuaaugagugccuugucaguuuucacacuugcauggggccuguggccccuuuguuuuggccaauuucucccaguuggaaugggaacauuuacccaaugccugaacccccauuguaucuuggaaguaacuaacuugcuuuugauuuuauaggcucauagguggaagggacuucccuugucucagaugagacuuugggcuuggacuuuuggguuaaugcuggaaugaguuaugacuuugggagacuguugggaaggcaugacuguguuuugaaauguuagaaggauaugagauuugggagggaacagggguggaaugauaugauuuggcucugugucuccacucaaaucucauauugaauugaaauccccauguguuaggggagggaccugcugggaggugacugugauacagaaggaaagugcugggaagggaagggcauagucccuucaaauaauacagaacgggggaagggugugguccuuggcuagggcuacacccccaggccuaugcccauggaccuaggugagcacaggcauuuuuguuuuccugcccaaauguugcauuucccaagacuacccuggccugccacccccaccauccugugccuauaaaaaccuggggacccuagcaggcagacacagguggccggaugucaagaggagcacaucaguggaggaacacacaggcagcuggauguugagaggagcacaucagcagaguaacacacagguggcuggaugccaagaggagcacaucaguggagggucacacaggcagcuggacguugagagcaaugcacugauaggcaccagcaugccagcaggccgucgacuggcagaacaacaaggaguuugacuggggcaguuggagaagagccugggcugucgaguggcccaacuccaggggaaaaccaucucccuucuggcuaccccaucugcugagaucuacuuccccucaauaaaaccuugcacucauucuccaagcccacgugugauccaauucuuccaguacaccaaggcaagaaccccaggauauagaaagcccucuguccuugugauaaggcaggggucuaauugaacuggcuaacacaagccaccuacagacagcuaagcuaaaagagcacccuguaacacaugcccacuguggcuucggcuauaaacauucaccccuagacacugcuuuggggucugagccucacagcuugcccaucucugugcuccccuagagguuugagcagcggggcacuaaagaagugagucacacucccauugcacgcccugcgaaggggacaagggaacuuuuccuguuucaauuggaucauggggguggcuucccccaugcuguucuugucauggugagugagcugucacaagaucugauaguuuuauaaguguuugguaguuccugucucucuuucucucuuucucaccugauaccauguaggaugugucuugcuucuccuucaccuuccuccauguuguaaguuuucugaggggcaaaguucucaugaauggguuagcaccauucacuuggugguguucucaugacagugaguuaccaugagaucugguuguuuaaaagcguguagcaccuccccgcucucuuucccccuccugcuccagccauguaaauuuugccugccuccccuucaccuucugccaugauuguaaguuucccgaggccucuccagaagcagaagcuucuaugauuccuguacggccuucagaacugugagccaauucaaccucuuuucuuuaugaagacucagguuuuuuuuuauagcaaugugagaacagacuaauacagggugucuuaccaaccgagcaucccaaaucugaaaacucaaaaucuaaaaugcuccaaaaccagaaauguugagugccaacacaacacucagaggaacugcucauuggaacauuuuggauuucagauuuuuggauuugggaagcucaaccaguaaguauaaugcaaauauuccaaaauccuaaaaagucugaaacccagaacaguuugggucccaagcauuuuggauaaaggauacucgaccuguauauuauguuucuauucauuauuuauaauuaaauauaacuuuaauugugucuuguuuuaucccauugucguggggaaaaauauuaaauucaugaagugacaguggaugucuuuugagcauaguauuuaagaaaaggguccuuuugggcuaugcuacauagugaugauggaaacucaugugauggaguucagagugaauuaccaguggaccaggguccuaacuucucauuaccaaguccgagcuggaagcagcugguaacaccaucucuuuucaguggaagcacuugaggagugaacagguugggugacucaacuaaugcuacacauucauuuccuuauuuccagucuuauucucuuuccacuuuaucauagugacaaaaacaaaaauaucuuuguccuagcaagacuuggcuauacaaauuuagugaaacagagagucuuuugagcauacauuucugcuuagaacguaaagaacaugaguucuaaaaugacugugaaucuuccaugccuagaauuugaugaaauagcacuaguuucuaauucucuuuaauuuuauuugaucauuagugcuuaaggagcaacauuuguaggauauuuguuucuggccauaugcuccauucagaaccucggaacuagacaacauuuuuccuggaaggucuauuuaagggggacugaguaccuagcaucugggaaaagagccaauuucaaguuuccuuucaggaauuccaacagaucuuaaaguauuucaggguccgauuaaaccuucaccuuguuuagauguugucacauccagacaaucuuuguuaaauucggcucucuaguuuguuaauauucucagauuuauauuuuggcuacuugcaugcuaaaaagaaaucacauggaguuggggaauuugguucugcaaaacugcguggagauacgauuuuuaaaaaaacagguacaauucuacguuuuuaaaguauuauccaugcccuaaaaugacucacaugcuucaaugcaggauacaaaaacuuuuuuaaaaaaucauuugacuugcagggguagagauguuaagagaaaaucaguagggaauaacacauuuaugaaggcgaaaaugcacaaguuaugacacauuuuggcccagcuccaaauccuuaaagcacugaugucuuguuccaucuucuguuuuuuuuaccauuacuuucacuccgauccuauucuuacuuauuuccagccaaguaguuucauaucuauuugucuugggcuccaccgcgggaaaguagcuaugcggugcuccaccagcugacugaaaaggagcguucccuccacacauacacucagcacugaacugggggcaguggccgggcacucggggugggagggggcggcuaagacagugucacggucacuugugugccauuggaaggaaggucagggcagggaauccucgcuacuucacuacucaugucucuggauugggcuugccucucuucuuggggaagagccacuucuuggggcccugcacacacgaggacgcauguggaaagggucuguaaaucgacacccguucugcuaaccgaaggugauuacagcaccgucuucuuggggauacuuuuuuuuuuuacgucaggccucacgcucgcugcacggggaucgccgccagggcugggcugcuggauccccgccacacgggggaagcacuggcggcacgaucccggaucgaccucgcgaggcgcccgcacuggccgcggggcugcgggacuggcggcggcggcggcggcugcgcggggcugggcggggcuuggcugcggggaaaugacgucgccguccccgcgcgcgcccugguaacggcggcucccgcguccuccuccauguccccgccuauccccgccgcagcccgccccgucuccuccucccuccgcagccucgccgaguccucggugcgggcugcgagcgggacccgcggagcugcgcuguccucgacgccuccgccaggcgcgggccgaggagccuccaagagcuggcccggcccccggccgccgccgcccaaccccgggcaucugccccgcgccguuguccccgcggcuucgggccggcgggaccgccccgucccuuccaggggugacccgggggucgcgggugggacggcgccugcggccgagucuggggggcgccgggugucgggucgggaagcggccgccgcgacucuugccucccgggcgucguugcuccacgggccugccuccacccgcggggacaggugccccggcuggggucuguugggaagauggcgaccccgggcaugagcuggcagcagcacuauuacggcggcucggcggccaaauucgcgcccucgccggccaccgcacagcuggcugggcacagcauggacuacagccaggagaugcaccugaaaaugagcaagaaaaucgcccagcucaccaagguaaggggggcagcgacggggcagguggcgaccccgugcgggccgcgccggacucaccugucuccccgggaggcagugcgcccugcgcccgcagcgaggggaacucuacuccuccgccgaagcaacagccggagacaccuccaaaacccugcaaacuuugguggaacgcuggcaacaugaauuuaagcuagacagcacagcggcacggugcgcguaagggacuugcaccuccuugcccuuuggggcuaaaccagcacagaacaaauuaggauuuaguuccuuuauuucacaauacuaaaucacuuuacuguugcuuccaugcaucugccagggcuccacgaggcaucacacuacaguaccauuugaaguacaguaccguauuuaccuaauaugacucggaauuaaacaguaucuuacugguuacucaguuaagggaagaaucaacuuucagaggaauguaggaggguaaaacauaccuugagugccaauuuggggcauuuaaugagucauuccuuauccugacaaaaugucaaacaaggcuuauuagaugaaucucacacugugccugcaucuaguucaauguuugucugucgaaggauaauuuucaaagagcaguuagcuuucacauucggccacguguaguuuaggacuguaccuaaauuagugaacuuuuuuucuaauuuaauguugauaaugagaaggaauugguaucugugaagcaagagcaauucauaucuguuauauugcucugcuuagaacucaccagcaaucuagcaauaccuaucgguaagaagugauuuguggugucugaaaguuaagaaagaugauauaccuuaauguguuuaagcugucuccuaacagcuuguuaggagaguugguaugcugaagagagaugggcaucguggggguuacugcuagauagccucugagucugacucaacuguaaaguucucacauaaucccauugcugguuggcacuuuugagagagugaaguaagacaugagauucggaagagaggaaaggaggaaauaggagugaaaaaagguugaaaagagaauaaaaagauuuuagugaagaaaugugauugaggauagaaaagauaacauaaaaggacuacaaaaugagagcacaaauggaagagcaaaagaaaaguuacagguacauaacaguaaaacucaaccaacgucuugugaaguuuucuuuuuugucuuuuguuugaucucagcacugucucagaaauuguuaggugugcgguguuuuguuuccuuuuuugucagaguauugcauucagagaaaggaaaaucuaagaaggaaugauaguaguguaucaucagaacauuuacacauuuggagucuaaaagccaggcuuccugcaguaguguuugaucuuccgaauauugauguccugaaugaagcacgugaauauuuauucugauuuucucuuaugauguguccauaacauccacuguucucauuuuagauguaacccucuagagcccuacuguaaguaauaggaaaacucaguaaacugguagugggacuguguucuguuuaacaaaugcuguugcucuucaguacauuuuuuuucuuucuacuuaacacuuuuucaguuuccuguucuuuuaucagaaaaaaauaagucagcaccacugguaaacguagguguauugaucggaagcugguguuuucucccaugacauuacccaccucauaucuaaugagacaagagggugcucucaggccagugcucucaacaccgcuugaaugccucaucugaucuuuacugaguguuacguggacucucugguuuuguguuuguaguuacagucucuaaacacucuccacccccucugcuaaguacuuaagauauuuaauccuucauacuagguuucucagugucacgcuauugacauuuuggacuggauaauuccuuguugauugugggauauccugugcauuauaggauguuuggcagcaucccuggcacuacucaguggguacuacuaguagcugcccucaccccccacccccagucaugacaauaaacaugccuccagguauuaccaaaauuucccaggagcgggcaggguaguugaaacagaaucauuccaauuaagaaccauugacauauacugaaauaucaagggauuauccugcuuuuauuuacuaagaugaggccugagaaugaaacaguuugauaauaggacucuguuggagccaacaucuuucuguuucuacaaacauauaagacuugcuuucuuuauacaccauuuugaaaguugucaaauuuuauagucauauacacuuauuguaaauacuauaccauaagcaugacaucaugaguguauauaaacauagagagagagggacuguuaugaacuuuacuacugccugccauauagaauuuuuacucaugaagaguuuauucauauuagcagagguguguuccaacuaugguuggaacuugacaauggcuaauauuucauaauuguacacuguaaauguaacaauuaaaauuggauuuuauuucuuuuggaaagaagucaguagaacucaacucuucagcauuauagcagcagcacacuuaagagcagugugggaaccugacacacugaguuaaaauucucacuccaccacuuacuacuauugugaccuugagcaagccaugaaacacugagccucaguuuccucaucuuuaaaauagggaugauaguaccuauuuuacagaguuguagcggcacauaguaggcucuucauucaggcugucacucacugaaaagacauauaccaauaugaguauuaauaaaauauggauauuuuaaaaaugcuucucuccuuuuaaaccauucugcauuuaacagcguugugugauaguguacuuauuuugaggguuuucugcuaaacucuuuaaaaauguauauauaguaguuuuuuuucuccuucgaauaucaaaguuuaaagguuucacauuuauucugcauugugguagaauguucugaaaauacauugugcauguuucaaagguuuggcuggcuaugaaaggauaagcaugaaaaguaauaaagauuauaauuuugcccauagcaaagcucaauauauuuuuaauuaaaaagcagucuuugcuguaugcauauuuguucauauccuauuuccuaagagccuaacauagcugccuucucaugguaaggagaacaccaguucuuuaagcaccuuuuauguaagggagacuuuggaaaauguuacagauacagcagggagcaagacacagucccugccuuuuaaaggaagucuagcauauuugggucacucgugucaaguuuuaagaauuaauauuagauucuugagcuacauuauggcaaguuucugcaaauguuaauggcugaacuaucucaagauaggcagugaagcuggauggauucaauuauguuuuauaagaccacauuuguauacuucugugcucuccacuguguugacuuuucaggauaucagguugaaaagcaggccuugugggauguaauuauaaaagcuuuuuuuuugucacuuucaaauuacuuuuuuucccuuuuugucucuuucaauuuacucuuugagacugguucauccucuuucauggguuaacuuaauuuuucugguugcuuuuagauaauacaaaucauccuucaguaacaaagucacaaaagucucaauuugauuauuaaaauuaaaaugcccaguaccaacaaguaaaaacugcagaccaagccugaaauaaagaugaagcuucucccuuaacuggucucuugcucugucucuugcaagggggaaaccaguaacuagggaaggggguauuauugccuuuuuacuucuuaccugguuuuucuacucuuccugcuuugucuugccaguucugguuucucacccuuccaaaguuggucaaggaagaagugaaaagaguaaagaggagcagcaaacuuuuacuugauuagugaagaagcuagcuggugaucuaguuucagugcuuuuguagccguugcagauguuuaaagcuuauucuuucacuggugaaucuucuaccucccaccucaguggcucuagauuuucaccucaauuccuugacagugagaauucccuuaugcgcugauugguugcuuacuccuuccucagccucuuggagcuagcaguaccuucaccuccacuuugcugaggucugugcaaacucuagauaccccucuugcauggacuugugugaucccaccccagguuguucacucuuccguagaggccacauagggagcacucauucuuugcacaaacucugcuaguggucccaguucagcccucucucuuguucucacaugccucuucaugcagcuucucaucauuuagauuuucuggggauuaaucagguaccagguuagcauguucuucaaagugcuugaggcacaugucaaguucuucaagucauucccucaaagccuuuuucccuaggcuuuaggugugggacaagcaucuuccacccuucccccuugaagacacaggccccuguuaccacagcucuccccagggaaaucucugaaaccuacucuguaaucuucuugaagcaccaccucacuagugguggggguggaaaguaacacaucucagcacucuucuuuagacugccucuugacauuuucgagaauguucuggcagcugcuuuggaaugucauuucuaucgucucugguucucagcagaaacuucccuuuuaauaccuuguuauguuagcugcuuaucaaaucccucuuuaguugauugcacuuuugauacagagucuguuuaucacuuaacuaguauagacauaaguaauauaugguacaguguaaguucccaaacagcaggaaguaguuuauuuuguguuuucugugcuuagcaucaaguccucuuauuuaauacccagcuuauggcucuucuacuaaaacuguccugaccagcuacccuuguugggcuuuccuugcugugcguuagcauugauuguugguaccucuuacuugauacuuaauaaugcaaacuugcaaauacuguuuauuguguuuauaaauauacuuuguuuucauaauuugacuguaagguucucagcucuagggacuguaucuuuuauuacauguaaccuuaauaugaaugguuugcacauaguaccaaagcuuaauaaguauuuacugaagaagaugguggucauaaugauacagcaaguaauuuuguuauacagcagagaaagacaguacuuuuuaggaauuguaucugcuacucuucuggguuaaugauagaucauuucagcugaguuaaauuauuccuaaauauguaaauguuuauugacugcccuuuaaacugcuucaaaaagcuauuuuauuucuuaauguauuuuugauguaaaaaauacaaauauaauguucuuugucuacauuauaaguauuugacacuucagaauguagguaauuaauauacuaguuucuuagcaaauauaaaaaagccuugugaucagucauuuuauacuaacucugcuuuuacuauauccaaaaccagaauguguuuauauaacaccaaaaccagugaauuuuucaaauaauacuauuuucuguacaugaaauaaaugauuuuucacuaauugguuuguuugaauuaucuagauacucuuucauaauaauucuauauugcuuaugacuugagucuuugaacaagaaugguaaguggccucauaaaacauagcaauuggcuguguuucaccuuagcacuaguacaugccaaaugcagcaucucuuuuucuuuguuacauuguagcuuugccaugcuguuaugcaguggcuuggauguaaucuuuuagucauaguggagugguuuggauuaauuuguugcauuuuacuaauggacacaaaagcauaguauccuguuaauuaacuggucacaaacuuauaaagggacuuccuuuagaguuaaagauuuagaguuaaagguuaaagguuuagguugggugcccuggcucaugccuacagucccagcacuuugggaggccaaggcaggcagaucacuugaggccaugaguucgagaccagccuggccaacauggugaaaucccgucuuuacaaaaaauacaaaaaauuagcuggugugguggugggugcuuguaaucccagcuacuugggaggcugaggcacaagaauugcuugaacccaggaggcggagguugcaguugagaucaugccacugcacuccagccugagugacagagcaagacucuaucucaaaaaaaaaaaaaaaaaaaaaaagauuaaagguuuagacuuuagacugugaccaggcugacccucucauuuuauaaguauagaaggugugagggcucggugccauuugaagauuacucaaccuggacucacauucagcucucuagauuggucuagguggggguggccacacuaacaggccucuuuucccugugucuaccuucuuucuaauauuacuuauucaauaagagaccacagaguuauuguuuuuccauguuggaaccauguuuuacuuaccaucugaaucaaauuuuugauaagggugaaaccaaccugugucuccucuguauacuuacuguggaacuuucuggguuuauagguuguauauuuuguauacuaugacuuggucacuuuguaacagagguuuauugugugugcugucagcuaaaugucauaauauuuucauguuuuuauuaacagguuuagucauuccaaacugaaacguauuuaaaauaacauuaacuuagagacugccauacuuggugugaaaauuacuacugugguuauuuuaaaugucuuucuuuugacugcuuucauucuugauuagauuguugcuuagaccccauuccuaaacacaguaaauugcaaguuuuccaguuuuuauugauucacuaucuguuuaguuuaugaaaauccuuugcuagccucuaaucaccagucuuaaaaaguguuaugaaagauaaagauucagcaggaauaugugacuggaguaauuucuucauuuuaauuaauaaguucccuauacuuuaacuuuuaaaauugugauauuuuugaaaauuuuguaucucuuaaaugugagaugggaaugaagaauaaccugggucuauaaagcuaauuaguuuguggaagaaaauaggagguaaugggggccaggggaguauugauaaaauacuguuauuuugcccuuucaauugaucuugugaguuuuuuuuuuuaaagaaaaucuucauaagcauucaaauaaauuugaauauuaugccaugaaauggaaaggaugugaaugacgggaguucguaacgccauucuuuuuauucaccacaggaaguuucuauccugcagcccacuucagaauguaaaggacauuaaguaaaugucagaauuggugccccaugucccuuuuuuggagauagacaccuaugggagacaaucacuaacugauuucaggauuagauaaauagauaaauaaaaacagcaacauugagaucccaucucuacuuuuuaaaaaauaaaaauaaagaaaaacaauguuauaaaugguaguuugauaugggggaaucauaucaaacuauuagguuuauauuuuauaugucaaguguggucuaaaccauagggggcuuuuuagauugaccuagagaguuaaugguccuucaaaauauuggaaaauauucuuuggcugccaaucaauuaauauauaaaaaugaauuuuugaaacaaugauauuugcaaguuggagauugccaguuguauuuugguaugcuuaaccuuuaagaccaagcaaaaauuuuagaaaaucucugauucuuaacuuuuaacuaaauuacaucagugaacaacugucauuuguaaccuuauuucaccaaggauuacaucuuucuuuucuaccaaaacuucaacgagaauguauaaaaaguagugaaguugaauauaugaauuuuuuauccuguaucuuacacuauuaucuugagaugcaaauggaagcugaaacuaucaaaggaucuauaguacauggaaaaacaagacuuagugauuaacaaucauaugugggauuuggauauuuuagacuuggcuaccaugugcuaccucauuuaauuguaaaggagauaguacuuugauuuuuuuaauugcuaauucuguauuuccuuauuuacauguaccaucucuauaccaaaguuugaggaaguuggaaaguaaaacauuucaucuauaaagugcauuacuaauauuuaaauuaucaauaaaauugauaauuuuaguaaaauaacaggguaaauuccuauuuaugcgaaauuauuagagaaugaauuauuuuaguuaacuagaaguuuccauagggguuaauaaguuuucacuuucucauauaguauacuuacauuuacaucauaccauucauauaucacacuggaguucuucaucaacuccagaucauuguuaggaucaucagugcauauauaggaaauuggaccaaacuuaugcuaguccuauuaggccaaauccaugaaugcugauauuuaauuucugaauaaauuguuacuugcccuuuuacuugucaugucuuuuuuacuuauaaaaugaagugucgcauuuggauauuuacaaauucuagacauuggccuuggugguugagcagauuuuguuuauucuggcgaaugugugucuauguguucacagguauuugcauuuuucauccuguagcuccuuaagcacaguuuuaaagauucucauuucuuucagaaaacauuuuaugaccaaaauacuaaauaguauucuuugccuaccuuuagauguuucgccuagugaauuuugggaggaagguguguguguguguguguuuaauggucuacucagaguaauaaaauauacuuagauaugaccgaaguagaauauauaggucuauguguuugguaaacuugucgaaugccuacuuuaugaaagacauugugcuugguacuauuaauuauuuaauacuauuuauuauuccauuucagacuauauauuuagguuggcgcaaaaguaauugugguuuuggccuuuauuuucaauggcaagaaccucaguugcuuuugugccaaccuaauacuucacauauauuuuccaacagacuugagaaaauguaacuggaauauauuaaucauauauuuuaauuacaacauauuuaucaguacauuaauucugacaaauuuuagauguguaaucaugggcaaauuuuucuauuugguuucguucuuuuuggguagaacuuauguacgugcuuuucuuggauaaagaaacuauacugauaccuucuaaauucucuaauaagguuuugaugacucaguugacauauucugguuacaaaucucuaauauauuuggcugggggguagagcggguaaaaggaaauuucagucuuggaaaccccggaguuaauguguuuguguuagguuuagguuucucaugggcagccggagagccacauuguucccagagccaaacggcccagugaggcagcagugcccaucauaugggucagaggugugguucaguaaguuaggcauucccuuauuugaaguucaccuucaccacuuccuaguguuugacuuuuaauacauauuuuaaccacucagggcugucuuguccucaucuguaaaaugagaaugacaaagcguacuucauagaauuauuauaaagauuaaaggagauaauugaugcaggagagagaagucaguuuguacccacuauccccuccccacuugguuaagccucugcugacauacucuuuaacaauaaaguagguuuuuaggccaggcgcaguggcucacaccuguaaucccagcacuuugggaggccgagguggguggaucacacuugaagucaggaguucgagaccagccuggccaacauggugaaacccugucucuacuaaaaauacaaaaauuagccgagugugguggugcaugccuguaaucccagcuacucgggaggcugaggcaggagaauugcuugaacccaggaggcggagguuguggugagcugagauugcgccacugcacuccagccugggugcacagugaaacuccaucucaaaaaaaaaaaaaaaaaacccacacacaaaaaaacaauaaaguagguuuuuauaugucuuuauuuuguuuguuuguuuauuuauuuauuuuuuagagauagagucuggcuauguugcccaggcuggagugcaggggugccaucauagcuugcugcaaccuuacacuccuggggucaagugauccuuccaccucaguuuucugaguagcugggauuauaggugcaagccacugugcccagcuauauuuucuuuucugauggauauauagucuacauuguuggggaccauagcugucaaguaaagguugagcagcaaauaaaauauagucaguucucauuauucguggucguuguauugcauggucuagggagaauacagagcuagguuccugacacccucuggucacaacauuuucaccaacugaucaauguauaaccuuguuuuauguguguuucuguuuaaaacaccuuuuaaaauauauauugauccauuaacagugaagccacagccaaauaucacuauaacucaugccugaacaaagguuauuuagcacaccuugaguguuagauuuugggguuacauguaaauuuuagcaaguaagauaauuuacaaauagggaguccaugaguaaagaagaucaacuguaucuaaaaauggaagcacaacuuugcaucugcuguuuucuuagcuccugcuguuuaucagcuauuguuaggggccuaagugacuaugacucuuauuaccacccuaaacacccucacaugagugugacuuugacucucauuaucucaguaaacacccucagaugaaagggguggaaaggauaauggaggcugaaauacuaaucuuuugugugacuugccagucaccuacaggccacccuacaaucauaagcaugggauaaauucuuuccuuguauguuaauuguaaucuucaagaucuaaacuugaaucuaucacauugcccuacaucagaaaaaggaaaaaaaauauguaaaugauuccagggcauggagcaaaaccuuuaaaaaauaauuuauuuuaguuuaaauaaaaucuuucauagucaucauuugccuaaaacauguuugcaguuacuucuuuucuagcauaaauugucacugugggaguugguuuuguuaaaagucuuugucuauguaccuaaagauaacuugaaaucuuauacaguucgaggcuauagcacauuugguuggauguuucugaauuaaccuuaugcaacauacagaaaacuucugcaauucaauucauaucuguccacacuuucuuguuucaacccccuaguaauuaucagaaaaaggaacccaguuaagaguacuacugugaucaugagggaguuggcaaagauaacuguccuggaauaaauaacaauuugaucuggagccaagcucauuacuauaauauugcucuauuuaggaccauguauaucuuuaaccuucaauccugagucacuguugcuauuugcucucucuauucuuacuucuggauuguggagcauugcuagagaaaauuauggaacuggacuguagcagcacaauggcacccucaaagauguucacguucuaauaccuagaaccugugaagauguuaucugacauuagcauuagcagaugugguuagguuagggaucuugagauggggagauuauccuugacuauuuggaugggcaacuguaaucacaaggauccuucuaagugaaagagggagccaaggaacacagguggccucuggaagcuggaaaaggcagggaaacaaguucuccccaagagccuucagauuuuggcccaguaaaacuauuuucagacuucuaaccucaggaauucuaagguuaguacauuuguguugcuuuaagacacuugguguuaaauuguuaccacaacauggcucucuacaaagucauguaggccaauuuugucugaucacucaguauugcugcacuauaugauguuguucucugaauuguucacagcuguggaccguguguccucucuuccuucccuguacacaugggauggauaagcugcuauuuuacugaaacuaucaagcuuaacuuacuugucugcaaagauacuggggucauuuauucgugaaaagaacuuucuccugauucuuagcugccuuagcucucauguacuacugcuuuucugugucuuaaauagaucacccuuggcagagacagaugggaaucaaggaaauuaaaugggaagcuauuguaauaguauuggugagaaauuaugagggccauggauuaggacaauagugguagagagauaggagauuugagaaauaucaaaucugaggaggagauuugagaaaucucagaucugaggaggagauuugagaaacauuuuggagauaaauuuggcagcacuuugugacaguuuguuguaggagaagauugaggauaacgggucugucauauacuguguacucagguguuuccugaaugaaugagagagugaaugagugacuagauggacuagauaacuauuaacguugacugagauaagaauaaaggaaggacacguguuaguuaccuauugcuggguaaaaaauuauccccaaauuuggcagcuuaaaacagcaaguguuuauuaucugacacuuugagauucagaaaucgaggagucacuuaacugagugguucuggcucggcuucucaugagguugcauucaagcugcuggccagggcgauagucucuguaaagaguugacuagggcuagaaauuuuacuuuugaguucacucauguggcuguuaggagacuuuauuuaccauaugggucuucuuauaguaagugaucugaggggugggaagggagagagaccaagauggaagccauagucuuuucauaacaugaucacagaauggugacaugucaucaucuuugcuguauucuauugguuacauggaccaaccaugguacaguguaggaaauaacuacagaaagauucugauacuaggagauagagaucacuagggguuauuuuggaggaugguuaccccaagagaagcaaaauugaugggagaguucugagaguuuuaguuggccauguacaucuagguagaaacauuuaguaagcacuuggauaugugucuaugcuaaagggagagaucaauaguagaaauaaaauuguuaaagucauuagcauguagaugguaauuaaaaucauguguaguugguuggggccuuaagcagaguagaaaacauuuggaauaguugcugaggaaaagagaaggaaagagcugaccagagacagaggaaagcauccauaagacaucugguugucccaagaggaauugaaacaugguauuugguaucaguuuuuuguuguuguuuuuaagagauggagucucacucuuucucccaggcuggaguccagugacauaguaauagcuuacugcagcuccaaacuccuggacucaagggaucuucccaccucagccucuugaacagcugguauuacagguaugcgccacuaugcccagcuaauuuuuguguguguguuuguguggagaugagaucuuacuauguuugccaggcugaucucaaacuucuggcuucaagcugucuuucugccuuggccucccaaagugcuggaauuacagguauaagccaccaugcccagccucaguuugaaugcuuugcaguuuucugaaaguccuaugcaguccuuuggagaggaccaugguugagcauaugaggagagaagcagucagguuacaaauccagagccugaguuuugccugguagguguagcugaagaacugaagaacugcauuuuaagagaauuaaagagcuuuuguagguaguaauuuaguuaaucuaccauuaguuacuguguaaggaaggaagugagguaggauggagcuaauagauuaagagaaaacuuagggauugagaggacaauugguauguaugaagauaaugccuagaaguugagggauaaaggcaaggagugguagccugagaggaggcuauaugaagacuucagagguggauaaguuauaacaagauccgggguacagucuugagauuguuuaugggggggugaaaauuauuagaauuuagaaucccaaagaacuauaagucugauauuuuggguuccacaggcauuuuugaacucuccaaagauaguaggguugagauggaagagagcuuuaugagucucauggcuaaaucuacacugaugagggcagugacccggaggcugguuuauuaguaugacaaagcaagucaacugauaaagcugaauuauaggaacaguuauaaaauaagacgcauuuuuuuuauuaugagggaggaauacugagucuaauuaauaacaguaaauaccacuuuggagcaacuauuaccugcuauuuucuuaugcuguuuaauuucauccuugccauaaucccaagagguugauacuagauuucaccaugaaacugaauguuagagagguuaagugacuugcucgaggccacgugccagaagagcugggguugaacugcaaacauguucgcaguuacauguuaugaauauacacuaccaguaaaaacacugaacaugcacauucuucuaggucauuuaaggaaggcauauaucaagauagaaaccaguaagacuaacugccuaagacauucuauauuuggauauuggaauuuaacaugcaguauguucugcagucauguggcuaauaauauggaauauaucgucuuagaauguaaagucuuauugugcuuaaguuuuuuuaaacagcaacuagaaaaacacagauauuuaacaaauguuaaacaacacaaauuuuacagcaacaugugauguauuuaagugaguuauuugauuguacugucuuuucuaacugauuauucauuuauacaaaauuuuugcauauuuuaucaucugaaaaauaaugaauagcaugaauaaauauaccaauauucuccuauuuacuagguauauggauuuuugguggggggguuucaccuuuuuggguuucaccuuuuuguugauguuuaaucuuaaaucugaaugacucuucaaucuaaaugucuuuuagaaaauuaacaaugaaguuauuuaacagaaggagagauacuguguuaaauguacccucuagaauuaccaucccugagguauagaauguuguuuuauuuuauuccuauauguacucuuggggacacaagucaagcuucaggagcuugcaaucuaacagauguauaagacagaaaauaccugagacaaagcagucuuugguaaaccucuuaauguuuagcuuuaucugagugaaacugaccaacucagagcauucugaguccuuuuguuucuccuaccaagugcaacugcuuuuaccaugaggugggaucaguggaacuaaccaaucuuuuuuuuauuuuuuauuuuugagauagggucucucucugucacccaggcuggaaugcaguggugcgaucacagcucacugcagccucaaccuuuccaggcgcaggugauccucccaccucagccucccgaguagcugggacuauuggcucacaccaccacacccggcuaauuuuuguauuuuuuauagagacaggauuuugccauguugcccaggcuguuauuccagggcucaagcaaucugccugccuuggacucccaacgugcugagauuacagaugugagccaccaugccaggacaaaacuaaccaaucuuaugcccuguguaccugguuacaauuucuuuggagggccacaucaguaacaacaaaaacaauuaaacugaaaaguguauugugcguuauuguguuaagcacuauacauacauuaugcuguuuaaucaugguacuucuugaaguaguuauuuuucucuuuguuuuaccaaaaaacucugaggcuuagagauguuuaaaauaacuuuuucaaaguuauacauuuguaaguaagaaggcuaacccugaucaccucucaagcauauuuguaauccuguguaaaaucuaguuggcuguguucaaaaugguaagacuagagugugucuuggaagccucaagcaguucaguccaucuugccucauaccucugucugccuggaucccagguccaaaugcaggcucccaaaguguugagauuacaggugugagccacuaugccuugccccuauuuuuuucuuuuguuucaauugacaaauaauuguagauauugaugggguacguaugauguuuugauacauauaguguuuagugaucagaucaggguacuuuuguauccuuuaacaaaucuuucccuaucccucccuuccucaagcccuucccauccucucucaucacguuuuuauaaguccuuuguagagcucuuauuucaugcugaacaaacuucucugcagccacacuucuucauaaauuacucagucuccucacuuuaguugaaaaguaguuuaggugugguggcccauagguugagagaggauugcuugaggccaggaguucaacaccagucugggcaacguagugagagcucaucucuacaaaaaaaaaaaaaaaaaaaaaaaaaaagaaaaauaauuagccaggcaugguagcacacaccuguagucccagauacuuaggaggcugaggcaggaggauugcuugaguccaggaauuugaagcuacagugagcugugauugcaucacugcacuucagccuggaugacacagugugaccuugucucuauuaaaaaaaaagaaagaaagaaaaguaauccuggcucucuccucaggauauugcuuuuccuguggccuuugcaggugaacacagcucauuuucacacaguucaucaaccaaagguccuaaagaugguaaucuuucuucuagcuuuccgauaccgcaacuuguaaacuauuccuccuugagguuuaggccaacuagcucuuuuaccuauaccuuccccuguugcuucuuaauauugaagagacacaguccauggguucacuaacauccuggcuuugcauuucuugacauuuucaaauugugucaucuuuaucuuuaaucaagcuacucauacacauuuccucugaaucuuaaacuccagaacuuccagccacauggaagauguauuaguccauucuugcacugcuauaaagaaaugccugagacuggguaauuuauaaagaaaagagguuuaauucguucaugguucugcagguuguacaagaagcacaucggcuucugcuucuggggaggccucagggagcuuuuacucacgauggaacacaaagugagagugaggagcuucacauggccaggaggaagaaagagaagggggaggugcuacacaguuuuaaacaaccggagcuccugagaacuaacucacuauucaguaccaagagggggauggugcuaaaccauuagaaaccacccucaugauccagucaccucccaccaggccccaccuccaacacuggggauuaccaucugacaagagauuuggguggggccacagaucuaaaccauguuagaagguauuaauacuuguugauuaaaugaaugaaugucuuaaacuuucacuucucccuuuuucaaauucuaccaauucuucaguuucuuuaguguuuuagccucuucauuuucucccuguucaucaugucuguuuucauuucauucuuuaucuguacuagacugugggcuguugcuuuagccacugucuugccaguaccauuagcugccuugcccauguuuuuccacuacacuuucuagaacuggcaaaaagauauuauugaccagauauacagcucguucccuuuucauauaugccagcaagaaaacaguaucccuguagccacuccuguaaggcugagcagggugaaaauagacaugauacuaggagggaaagaauuacaggaaggagcuuugaauuguaacugagaugacacggucaucuaggcuggccucaaacaguaccuaaaaacaguaccugguuuuaacuaaauaucuaccaaaaucuaaacuuuaaucucgaagugacuaaacacuuagaggcagcaggauuaaguuuuuuucugccagguaguuacaaagagucauauacacugugauuuguuagugaccaauuuauaccuauuaaauggaguggcaaguuauaagauagccuuuauuuauaaaaaugcaaugguuugaaguuuauauuaaaauuauaccaaacaauagucuuuuuguugaaaauauuaaaaugugcuuuucuggcaaaauaauacuugugagcguagauauauaaaacucaauauagccauuuucauuaauaaagcauguauaauuauaaacaucugaaguacugguaugauacuuuguuuauaauaagugcugaauaauuauuauaccugacagaauguuuacuuaugauguuuauaguugggugcacagcauuuugcuucaaguaauuaugucuuuagucaugaccuaauuuagacauagauuggaagaaagggugaaaaacugaaauaauuccaguaaguggagaggauguuaagaaagaagcuuuuaaaacaaauaaguuggaaaccaagcccugggaaaugguuuuguuagauguguaaugguuuguaaaguugaacugucaaaauaaauggagaacuuaauaguggauguuuauuauuggcaaaaaaauuaauuggaaauaaaaucucaguaaaauacauuggaagaaaaauguggaauguuuauuaaagugaagagacagacagguuaucaaccuucauuccaguuaccugucgcugcugugguaaucuacugcuuuuacaccacccaaaauuuguauaaaacaacaacuggccaggugugguguuucacaccuauaauccccacauuuugggaggccgaggugggaggauugcuugaguccaggaguucaagaccagccuggacaauauagugugagaccucaucucuacaaaaaauuaaaaaauuaucugagugugguggcuuauugggaggcugaggugggaggauugcuugaacccgggagguggagguugcagugagcugagauugugccagugcacuccagccugggcaacagagcaaggcccuguuagcagaacaagaccuugucucaaaauaagauaaaauauaaaauaaaauaauaaauauaaaauaaaaauaaaauaaccauuauauuaugguuacaaauuauugagguaggaauucagagaagagacagcugugugcuuuauuuggagccucagaauggaagacucaaauggcuggguauaauuggaccugcugggauggaaacagcuggaauuggagaauccucuuccauguugacuuuuuuacucaucugauaccuagaccaggauaacucgaaagcugggcucagcugggaugcuagaccagaggaccuggaggacaguguaggucucuccuuguagcuuaggcuuuucauagcauggcagcaccuggagacuaaguguuccggaaacugagaaagaagcugccaggcuccuacugaccuagacucagaagucauucacuaucauuuuugccacauuuuauugguuacaagugaaucauugaggccagccuagauuuaagagaaggagaauugggcugggcacgguggcucacaccuguaaucccaucauuuugggagacuaaggugggcagaucaccugaagucaggaguuugagaccagccuggcccacauggcaaaaccccaucucuacuaaaaacacaaaaaaauuagcuagaugugguggcgcacaccuguaaucccagcuacugaggcaagaggcucaguagggaggcugaggcaggagaauugcuugaacccuggagguacagguugcagugagccaagaucacgccacugcucuccagccugggcgacagagcaagacucuaucucaaaaaaaaaaaaaaaaaaaaaaaaaagagagaaggagaauuggacucuacuucuugaugagagaguggcaggucacauuguagaagagcaugugggaugggaaauauuguggccaucuuugggaaauauagucugccacaauguacacuuucagggaauagggaaaaacauuaacccauauuuacaguucuuucagugguuagccacaaaguuuuuuuuuuuuuuuuuuaaagccagucauuuaggagcgggggaguuuuauacuaacuucaguaacacuaauguuaauguguucugauaacccacuacuaucagagcagccaccacaaacuuuuaagagaguaaaaaaaaaaaaaaacacagaagagaguugguaauguaaugugauaugcgucauuaagaaagaccucuccuuugccauuuucucuuauuuuaaauuuauuuauuuauuuauauuuagagacaagguugcccucugucaccugggguggagugcacaggcucaaucacggcuuacugcagccuccacuuccugggucuaagugauccuccugcuucagcucccccgaguagcuggaacuacaggugugcaccaccacaccugaauaauuaaaaaaauuuuuuuguacaguugggggucucacuacccugagcauucuggucuugaacuccugaccucaggcaauccucuugucuuggccucccaaaguguugggauuacaagcaugagccacugcgcccagccuucuuugccauuuuaaacacaaauguagaaucucuaaauuaacaggguugcuuuuccucaguccuguagucaaacaaaggaauucuuagauauaugguaguaagaaagacuuuuauauuguaagcauagcagaaauuuagaauuuacacuauauaaucaugugcacuuuggauauugucacugcuuagacacuucccagucuuuuaccuauuggaacaguaagaaagaggaccauaauuucaaggccauuggauuauuacuuccaagauuuggaucuuuacuucauuaguaauaguguguauguguguauuugggcagcagcauuuauugguuucaagauagacuacauuaauuaacucauuuaugccuuuuguuccauuauugaaaugcuaagcaugugaauuauuuauauccuacugcucaaggucugauuccaaaaauucaaaaaauugcaaccuucggcauaaauggguuaauucuuaaacauacuguggaauaaauuucucaauaugauuaaguucuuauuucuauccuguuagcuuguuugagaaacgggcagauggugacaugaguaguaguugugucagaaaggaagaaagucacaucuuuaguacacaguggugagugcccaccagaccaggcuuauaugggauauaguuccuuggcagggagguucuaaggagguuagcggucuagugguuccauuacagaauguuugugaugguugggcuuuucuucucuugucucuuggcuucauucuaucauguauaaaugcuuggcauguugugaacaucccaauuuacaucacuuuggaaaggaaguuccuaguagguuacaugaauagcauuagucuuuggagcuacuugaggauuucagugaguugaugaacugugcuagaaccauuagaaccaugauuuaguagccaguaaauuugaugcccaaugccaaguaauguccauggauaagacaagaaauguauucuaguaagcauaaaauguuacugugggacgauagaacccuagguuuguuuugggaaauuucugucuauuucaucuuuuaugacugucaucucuaccuggaugucugcuaugaccucaguacuacguguccaaaaucuaauuaaucuucuucuucaucagacaucccccauaucccaaauaacaaauaaaccaaaaaccuaguuucuugucucaaucuagcauuucugucugacccuaucuuaaaugaaaucuuuuagaauagaacauuugaauuaaaauuuccucuuuuuucuuuuaaguauuuacacuucuuucuuugaaauaucuuuuagauuuuccuuuuccauuuccccaaguaggaaucaauguagaccuuauuuuugcaaaguuuccuuucaggcucuucuauuucaguuuauccugcuuagugauaugguaguacuaauaaauauacccuguauaaauacucauauucucuuuguuauuuaccacaucaaaucuaaacucuucugcauguguuuaucauaucuguuaucaagauggggagcagagauauaauaaaggccaggccccagaaaaguggagauuguggauuuuguaggaggaggaagaagaggguagauuuauuaggcaaggggcaugccuuugggaagguagccaagacaggagcugaaaaggguagaugaagcccauaauaagucauacccauuacagacaguaucagagggcuaaaaaaguauguugugauacccaaagaaaugcaguauaugagauuuuacaccagagauauauagcauguuuacugugcauacuuucaaagaauuaggucaccaucaguagucauuagggauaugcaaauaaaaaacacagugcgauaccacuucacacacacuaggauggcuguaauaaaaaaauugacaaugaaguguugccacggauguggagaaauuaaaaccccuauacauuguugguggguuuauaaaauggugcagucagucacuuugguaaacaguuuggcaauuucucaaaagguuaaacaguuaccacaugacccagcaauucuagguauauauccaaggaaauuaaaaacauacauccacacaaaaacuuauauacaaacgaucacagcagcauuacauauuuguaauagcuaagaauggaaacaacccaacuguuacaucaacugaugaaugaauaaaauaugguauauccauacaauagaauauuauuugcccauaaaaaggaaugaaauacugauauaugcuacaauguagauuaaucuugaaaacauuaugcuaagugaaagaggccagacacaaaaggcuaaauauuguaugauuucauuucucugaaguguccagaauaggcaaauccauagagacagaaaguagaguaguaguugagagggguugugaggagaagggggagugggaagaaaugcugauggcugugguguuuccuuuuagggcaaugaaaauauuauggaauuugguaguggugaugguuguacaacuuugucaaugugcuuagaacccacugaauuguacacuuuaaagggggugaauuuuauguuacauaaauuauaucucaaagcuguuauuaaaaaaaaauugucacaaggcucaguuacucaagacucaaagcgugaauauuccugaguauaggaccuauaaggcaagaagucuaugugaauuucucugccuacuuuaauuuuauccuaagcaguaacauauaacuucacagauuuggugggccacuuagguuuagugacgguuaagauaaaugcauacauaucaaauaaaaauauugauuaccuaaagucccuucuuaugucacacuuuaggaaauucuugcucuugucuaaauguuuaugucccccaaacuucauauguugaaaucuaauccccaguguaauagaauuaagaggugaggccuugaggaggugcuaaggucaugaggaaagagcccucaugaauggauuacuucccuuauaaaagagguccaagggagcuuauuugccacuucugccaugugagaacacauagaaggcaccaucacuacggaacaggcccuugccacccagucugcugaugaucuuggacuuuccagccucuggaacuguaagagauaaauuucuguuguuuauaagcuaccuaguuuaugguauuuuuguuauagcagcccaaacagacuaaaacaauucugaauuauuguauauaauugcuaagcuagcgugauucauuuugauuguaauucagucauuuauuucagcuucccuuuuaggguuacauacaguguuuucguuuucuguaaaaaauaguggagaugggauaguagaaagauaaauguauugggaagguugucauuaaauuauauaugauuuuuuuuuuucucuaaaggauuugaauguugagaacuuuaagguuuuuucuuaaaacuucauuacauuaacuucauauccuuuuauuauggcacugagauuuucucaguagggagcacaucguaauauucgucucauuaaacuauguguagugccugcugagaaguagauugggacuugaaaauguuuaucaccauaggaaacaacagaaaaguauuuuaaaacacagacgcuucucuaagaauucuguuugggauaauacuacucuguuucagaauucuuaaaaacagguuggcauaauauucuaauaacugaauuaauuuuauuggcccuuaucuuuguauuuaguaaagcaggugguugucaaucauuuuuccacucaguuaccucccuuuguggguguguggguggccauaggauggagaaugggaaugaauguguagucuuuuuaaagggccacuuagugauucuuauacuacauccuaccucuacccuaaauugaaaauauugccauagugaucaaaagguauuaauggaaguguaauauccccuuggucauugggcagaaaagugguuaagcacaauuggcguuaggcuguuacauagagaaauuuggggugauguguuuuuagaugugccugcuuugcugggaagauaggaccuaagaacagagcuauaaacacaggagucagaggugccugaguuauaauagcccauuccagcucagguuuaucugaaauagcaggucacugucugggggguaugugaguaauuucaguuagcaggugcuguacaaguccucuauaacuuguaaaguauaaaccuugauugaagauagaaugaaguuuguagaggugcaugaccucauuaacagacucaacaacugagagagggcaccucuccccuaacuuucaagcaaccaccagcuucccuugcugaguguauguaugacccaaauagcucuucagucagguaucaguucuccagcccaagguuuguguuaggaagcacagggcucuuuuccugagguauuucgaugccuuuggcuguucuuuaaucaaaucucaucuaauacauccuccacagugcaaccagaauuuuaauuucuaaaaugcaagucagaucaaguuauuccucuacuuaaaucccuucacugguucuacauuaccuacaaagaaaggaguguuuacugaauuuggcacaauguuauaacuugacuguuagaugauucauuauauugggguaccuuccuuuaagacaacucaguguauuuagaaauucaaauuccuuauguguuuugcacaaagccucuaccuauacagcuugugugauacuggccucuuucagcuagugcugcuuccucuccugccucuggugguugguuguugauucauuuggugaaaguggcugccagcuuaaaucaggagugggaaucagaucagauacaacucugaaggccacagagaagaguuugacuuuuuuccuccuguacauguguggugggaaaccaucggcaggcugcaagcaaggguucuguuaugauuuauguuuugagaugaccacuuuggcuacugauucaggaaugaauuguggcacagcaugaggggaagccgaaagaucaguuaggagacuacuacaaugguccuaggccuaaugccagauggugguggcuugcauuagggugguugugauggaaauagagguaagugcagacaucaugauguauuuuggaaguagaacuguuaggaucuaauaaugacuuugugguaggaggaggggaagaguacauaauggaggaacucuuagguaacauauuuguaucuuuucauucuuucacaguacauuuaggugugaaaggaagaaaugaagaaaaaaauagaauguaggugucuauauccaaaauagcuaauugaaauuauuuucagucuuugaauuaugcuugaguuagguaacuaauuuaggaauuacaggagaaugugugauuggcagaacauuagguccauucaaggacugacauaauagagaucacuaugugagagacugcagucguaccucaggagauguucagggagucugcaccccagcucaggaccugagucucauacauagauacugcugucugggaaccugggccuccaauggcugcugacucugaaggcucuggcuuuucaaagaggauuucucaccaaauacaaccagagucuacagugcuuauuuucuguugcauaaaauaaucuuccagucuuaccugacucaccucauuaacuuuuauuaauuuccaaguucuuauucaaaaaccuguauuugaguccugcgaucagacaagauaacacauuauagcccucuuauuuuaccucuuacuuuaccucucaaaccaauagcaggauauucuuuuuuuucuuuuuuggcaagauacucucuuuuuaaaaaaaaauuuuguggguacauaguacucguauauauuuaugggguauaugagauguuuugaugcaauaugaaauaagcaugucaaugaaaauggaguaucuauucucucaagcauuuauccuuugaguuacaaacaauccaauuauagucuuuauuuuaaaauauacaauuaaguuauugacuauaguuauccuacugugcuaucaaauaguaagucuuauucauuuuuuucuuuugguacccauuaaccaucccuccuucuuccuaacaccccacuacccucuccagccucuaguaaccaucauucuacccucuauguccaugaguucaauuguuuugauuuuuagaucccacaaauaagugagaacacguaguguuuugucuuugugugccugguuuauuucacuuaaccuaaugaucuccaguuccauccauguuguuguagaugacugagucucauucuuuuuuauggcugaauuguauuccauuguguacauguaccacauuuucuuuuuuuaaacuuuuauuuuagguucagguguacaugugugaguuuguuauguagguaaucucaugucacagguguuuguuguacaacuuacuucaucacccagguguuaagccuaguacccaacaguuauuuuuucugcuccuuucccuccucccacccuccacucucagguaggccccagcguucccuucuuuguguucaugaguucucaucauuuagcucccauuuauaagugaaaaccugcgauauuugguuuucuuuuccugaguuaguuugcaaggauaguaauagccuccagcucuauccauauucuugcaaaagacaugaucucuuuuuuuuuuuuuuuugagacggagucucgcucugucgcccaggccggacugcggacugcaguggcgcaaucucggcucacugcaagcuccgcuucccggguucacgccauucuccugccucaaccucccgaguagcugggacuacagcgcccgccaccgcgcccggcuaauuuuuuguauuuuuaguagagacgggguuucaccuuguuagccaggauggucucgaucuccugaccucaugauccacccgccucagccucccaaagugcugggauuacaggcgugagccaccgcgcccggccuaugaucucauuuuuuuuuuauggcugcauaguguucugugguguauauguacccuuuuuuuaaaaaaaaaacccaaucugucauuaaugggcacuuaagcugauuccaugucuuugcuauugugaauagugccgcagugaacauucgucugcaugugucuuuaugguggaaugauuuauauuccucuggguauauacccaguaaugggauugcugggucaaaugguaguucuguuuuuagcucuuugaggaauugccacacugcuuuccacaaugguugaacuaauuaacacucccaccagcaauguauaaguguucccuuuucucuguaaccucacuagcauuuguuguuuuuugacuuuuuaauaauugccauucugacuggugugagaugguaucucauugugguuuugacuugcauuucucucaugaucagugauauugaccuuucuuucguaugcugguucacugcauguaugucuucuuuggaaaagugucuguucauguccuuuguccacuuuuuaaugggguuguuuuuguccuguacauuuaaguuccuuauagaugcuggauauuagaucuuugucagaugcauaguuugcaagaauuuucucccauucuguagguugcuuguucacucuaaugauaguuucuuuugcugugcagaagcucuuuagcuuaauuagaucccacuugucaauuuuggcuuuugucgugauuguuuuugguguccuugucauggaaccuuugcccauuccuguguccugaaugguauugccuagguuaucuuccagaguuuuuauaguuuuggguuuuacauuuaagacuuuaauccaucuugaguugauuuuuguauaugguguaaggaagggguccaauuccaaucuucuacauauggcuagccaguuaucccagcaccauuuauugaguagggaauguuuuccccauugcuuguuuuugucagcuuugucaaagauuagauggucauagguauguggucuuguuucuggacucucuauucuguuccauuggucuaugugccuguuuuguuuuguuuuguuuuuauuuuauuuuuugagacaaagugucgcucuuaucccccaggcuggggugcaauggcaccaucuuggcucacugcaaucucugccucccagguucaagugauucuccugccucagccucccaaguagcugggacuauaggugcccgccaccacgcccggguaauuuuuguauuuuuaguagagaugggguuuuaccauguuggccaggcuggucucgaacuccugaccucaggugauccgccugucuuggccucccaaagggcugggauuacaggcgugagccaccgcgccuggcguaugugucuguuuuuguaccaggaucaugcuguuuugguuacuguagcccuguaguauaguuugaagucaaguaaugugauggauccagcuuuguccuuuuugcuuaggauugccuuggcuauaugggcucuuuuuugguuccauaugaauuuuaaaauaguuuuuuguaguucugugaagaauaucauugguaguuggauuggaauagcauugaaucuguaaauugcuuuggucaguauggccauuuuaaugauauugauucuuuguauccaugagcaugggauguguucucauuuguuugugucaucucugauuucuuugagcaguguuuuguaauucuuguuguggagaucuuucaaccagucccccacuaccaucccccauuaucccauuacccuucccagccucugguaaccaucauucuacucucuguguccaugaguucaauuguauugauuuuuagaucuacaaauaagugagaacgggauguuuuguguacagguauucuuagguauuuuauucuuuuuguggcaauugugaacggaauugccuuccugguuugucucuuagcuuggcuguuguugguguauaggaaugcuagugauuuuuguacaucgauuuuguauccugaaacuuugcugaaguuguuuaucagcugaaggagcuuuuggcccgagacuaugggguuuucuauauauagaaucaugucaucugcaaacagggauaguuugacuucuucucuuucuauuuggaugcccuuuauuucuuucucuugugugauugcucuggcuaagacuuccaauucuguguugaauaagaguggugagagagggcauccuugucuugugcugguuuucaagggaaaugcuuccagcuuuugcccauucaguaugauguuggcuguggguuugucauagaugguuauuauuauuuugagguauguuccuucaauaucuuguuuacugaguuuuuuucacaugaagggauguugaauuuuaucaaaagccuuucugcaucuauugagacaaucauguggcuuuugucuuuaguucuguuuaugugaugaaucacauuuguucacuuggguauguugaacuaaccuuccaucccggagaugaagacuacuugaucaugauggauuagcuuuuugauaugcugcuggauuugguuugcaaguauuuuguuaaggauuuuugcacugguguucaucaaggauauuggccugaaguuuucuuuuuuucugugugugucucugcuagguuuugguaucagacuaaugcuggccuuauagaauguguuggggaggaguccuuccuccucaauuuuauggaauaguuucaguaggaaugguaccagcucuuuguuuuauaucugguagaauuuggccgugaauccauaugauccugggcuuuuuuugguuuuuaggcuauuuauuacugauuuaauuuuggagcucauuauugaucuguucagggaaucaauuucuuccugguucagucuugggagaguguauguguccaggaauuuguccaucucuucuagguuuucuaguuugugugcacagagguguucguaguaguuucugauggcuguuuuuauuucugugggaucagugguaacguccccuucaucuuugcaauuguguacgacauuuucuuuauccauucaucuguugauggacacguagguuacuuccaaaucuuaacuauuauaaccggugcugcaacaaacauaaggguauagauaucucuuugauauacugauuuccucucuuuuggguacauacccagcagugggauugcuggaucauauaguaguuuaauuucuaguuuuuugaggaaccuccaaacugcccuucauagugauuguacucauuuacauucccauccauaguguacaaggguucccuuuucuccauauccuugccagcauuuguuacugccugucuuuuagauauaagccauuuuaacuggaaugagaugauaucucauuguaguuuugauuugcauuucucugauaaucaauaauguugagcacuuuuuuauaugccuguuugccauuuguaugucuucuguugagaaaugucuauuuaaaucuuaugcccauuuuuuuaucagauuauuagauuuuuuuccuguagcguuuuuugagcuuuuauguauucugguuauuaaucccuugucagauggguaguuugcaaauauuuucuacucuguggguugucucuucacuugguugauuauauccuuugcugugcagaagcuuuuuaccuugauguaaucccauuuguucauuuuugcuuugguugccuuggugcaggauauucuuaaaaauagauuccacgaucuuguggaugcuaugauauaccauauaaugguuauagcgguaguugcuccuaagaucugcucugcauuccuggccauucagggguauguauuagcaagacuguggugucauauggccuuuuccaaauacuaaagaaauguuagucauaauugacuuuacuugauauacagcacaaagaauucaugcuuuugaugacaggaaauugcaugggcauaguaaaaauuaugguguauuuuugcauaguuuuuuuuuuuauuugguagguauaacaaucacuacaaaauuggucguuugaagaucaacuugguguaguuaacuuuuuaaagcauaccuuuucaggccgaggcagguggaucaccugaggcuaggaguuugagaccagccuggccaacauugugaaacccugucucuacuaaaaauacaaaccuuagcugggugugguugcgcuugucuguacuugucagcuacuugggaggcugagucaggaggaucgcuugaacccaggaggcagagauugcagugagccuagaucaugccacugcacuccagccugggcaacaaagcuagacucugucucaaaaaaaaaaaaaaagguauacauuuucuaucaugaccacaacuuuuaucuuacuuaccaauuccaaauacuuggugugauuuuaaauuuuucuuuguauuucauucccuauauccaaccucuuauuagguucuguuacaaggugagauauggaaaaaagauaacaguuguaauaagauaaaggauggaauguuuuuccuuauuccuuuuguuuuuaauauauuauccaaauuuucuacaaugaauagugauuacuuuaguaaucagggaauauauaguacauauacuuuuccuaagcaucauuuucaauagggauaugacaaaaggaggacauuccagggagaucacuaguaauggcaaagguguagagaaaaagaagcauaauuaguucuuaaauauuuauuaacuucccuaauccagauuuuugcaauauaaauuuuuuuuaauuggcuuuauuguauuuaagaagaaauuuugucugaauugagcaugaaaauauaggaaaucuuuguuauugcagcuuugaguauuuguugcucuuauuaguaauuucacuguggugcauuuugcaucuucuaucuguauaugaggcaggcaggcagucuggucucgccauuuuuguauccuacccuacauccccucuccacuguucuucugccucuuucaauuccaaaguucagucaccaagaagaaaaaucugcuguuaagucacugcuccaagguugcuuugugggugauuuuuucuccaagguuguaaugccaaaaugcauuuuucagaggccugcaugugaccuugagccagcccuaggugaugguuaugucaucugcacaucggguagguuuaagaaggacaauuagaaaacaaguguuuaaaagaagagucuagcuccuauuagggucucuuuccuugauauacguagaugaauagaauggcaaaaaaaaaaaaaaaauugagaaacugauaguuauacuguuuuagcagguagaggaaaacagccuuccuuuucucauuuauuuuuaucaauauaccagagguuucccagcuucuuugauaugaccauagagcagugaacuagaugaguagaugagggaaggaaugucacuuuuggcuucacuucccuucugccuaagaauaucagcaauccuugaauggaugaaggggcaaaagguuggagaacccauaagaaaugcuuugagagcaagcguagguuguauuuacagcauuccaaauuagaagagaucgcuagaauuguguuccuugcucaacauauuuggugcauguuuaccuguguaauguacagagccagguacagaccaacuccauaaauuuuggaagaaaauaaagcacucuaauuccuaaucaccacauaccuuaaugauaucaguagcugucacucucuagaggacuccaacauagaugagauaaacuaagaguuauacccaguucccaguguauuggccauuaaggcuuuccuuuucuucacguuuacaaacuucagucucuauuaacauuaaauuauuuggggcauguaagucacagcaucaguaguacccagguaauuggaauuguuuucuuaauuuuuuuuuucaaaguguucauugcuucauugauaguuuauaauugauguguguugaucuuuuuuuuuuuuuaauuaaagagagacaaguucucgcuuuguuacccaggcugaaaugcagugacaagaucauagcuuacuaugcccuugaacuccuaggcuaaagcaaucuggccaccucagccugccgaguaacuaggacucuaagugcauaccaccacacccagcuaacuuuuaaauuuuucguagagacagacucuugcuuuguugccuaggcuagucuugaauuccuggucucaagugauucuugugccucagagaccuaaggcuucuaaaucuucugcaaauuugcugaauucguuuauuagcucgaauaguuuuuuguugaucauuugagauuuuguagauuaaaaaaauuguaucaucugcaaauaaugauaguuuuacuuccccaauuuggaugccuuauauuucuuuuucuugcauaauugcucuagcuaggacauccagugcaauguuaauagugguaaaagugugauucuccuuugucuuaaucagucuaaggcuugucaauuuuguugaucauuuuaaaaaaucaacuuuugguuucauugguucucucuacuguuuucuauucucuguuucauuuauaccuacucuaaucuuuauuguuuucuuccuucuguuuuggguuucauuuacucuuccuuuucugguucuuugaggugugaauuuagguuauugauuugaguucuuucuuuuucaguguaguuuauaacuacucaauuaugccaguauaaugggaaggcagccauagacaauacauaaaugaaaaggcauaccuguguuccuuuauuuacaaaacagguugcagaccacuguuugagcugcauccuacaaguuuugauacauuuuguuuucauuuacauccaauggcuuccugcccauucucccaaagaguuuuucuuuuuuucucuuuccccagccucacuagguuaucacauuugcccuggggcuaaaggugccgagguggggcagggguagaaaaagaggguuuguugcccuuacccuaguagcuuauggcuuuuguuccuuagaugagaaggaucuggguaguuuuugugcuuucccugcagugggaggccuguuucucugagcaaagcuuucucugucuccuacccaguaaacaguuuuucuugugacuacccacugaggucauagaaaagagacuaugaguaggcaaacuugauugugucuguggcuucccuggguuccauuuucucacacuugcccauguucuuaccuugagcaauuuuuaguaaauuuuugcugaauucuuacccacuuaugugaccuucucauuuuccuucugugcucugccacaggugagccaaugccuguguccugucuguccuuggaggcuuuucuuagagugaaagccaguugguugcauugugaucucagcuuucugauagguucaugaaaauugaugaauuuauagguuauuucauagucauuagguagaacauugcuccauuuauauuucuacauucuagguggaaacuggaaccccaucagauuuauuuuuaauaaauugaacacacccaaaugucaaugugaauagauauuuaauuuucuucagagaauucuuuaaucugcugccugacucuuggcauucagaauuugggcagguguggggagaacucgggacacauuguucaggaugcagauuuuugaaaaauagacuuuacucuuuuagagcaauuuuuaguuucacagcaaaguugagcagaaaguacagaguucccauccccuuuucuccaacacacauggccucccugacugucagcaucguguaguagagugauauguuagaaucauuagaccuacauugacacaucauuaucacccaaaguccaucauuauuaccuaaaguccaugguuuacauuaggauuuguucuugauguuguacauccuagggauuuugacaaauguauaaugacauguguucaccauugugguauuauauagaauaguuccacugcccuaaaaauccucugugcucuuguuagcaguggaagagaucugaauuaccccaaauuauugguggugaauccauauggguccacggcaacuucagucuuugccuccucaaaagaaagaauucaacugaggggcauaaagcaaaaaaaagagacccaggcaaguuccagacuaagaauggaaguuuagaaguaauuuccucccaguuuauuuugaagccaaguaguuuaaaguuuggggaaauuaaacuucccaguuuuggggaaugcauccgaggaacaugcccugcaguguggacacaugauuacccaucugccacuugugaagagagaacagaggagaagaaaaaggaaaaagaaggcauucccccuuucuucccauuauccuggaugaggcaucccccaucguccuggguuccaggcuuuaccgaucuuaccauguacccccgguucuggguucugggcuuaaccagucuuaccauauuccccuaguucuggguuccaggcuuaacuggucuugccauguaccgucaguucuggguuccgggcuuaaccagucuuaacggguacccuugguccuguuaccaggggguccuuguucccagagcucccaagaugguggcgggccgcuuccaagaugguggcaagccucguguucucugaccugggguucuuagccucacggauuccaaggaauggaaucuugggccaugcggugaguguuauaccucuauuagaagccgugggucauggaagagaaccguggaacccagcaacuaguguucagcucgauuaggacgaacccgggcacuuagccgugcaggaccaauggcaagccuuuagcccgauccagaguggcagugggcaccucacuggaucaggagcacaguggacacccugccggauccggagggguggaagucagcggcgggucugcgaaggugacaaacagcaguggggaacugggagugaaagcucagcucuagccguaacaaacacggaccagaagagugcagcugcaagauuuaauagagugaaaacagagcucccauacaaagggaggggacccaaagaggguagcgguugccagcuggaaugucuggguuuauauccugaucauugucccucccgcugugcucucaggcgauagaugauuggcuauuucuuuacuuacuguuuuugucuaauuagcauuuuagugagcgcucuuuacuaccugauuggccgagugugagcuaaguugcaagccccguguuuaaagguggaugcgcucaccuucccagcuggguuuagggauucuuagucagccugggaaauccagcuagucuugucucucagucccaucucaucauaauuuuagcuugggaccacccuucaucucugucccguggaucucuugugucugcggccuugggcuggccuugucgccacgaccuuauaguaacccucacuuggaguauuuuaguaauaaaaugaucaugucuuuucuuagaagcuuauuucuccauuaacugcuacaggggcuggaauucucuccccuagaauaugacuuugaaggcccuguugccuguugagaaggguguggaaguaguucaagaaaugggagcuaaaggaggaaguggaaggaacacgcauggaaaccccucaaaugcuugcaaaaacagcagcccuuggauucaagagugcaacauuuguucaccuucuggaacaaaaguucaaacauaaaucaguaaccccugaggacuugcggcuugggguaagaauuucuccaccuccuaaaguggugcuaacuuaaaaagcaaguggguggaguccuuaaaaagggccagauugaaggucugugcagguggacaagcagcuuuuaagagccauuagaaaacuuagccccgggauauaacaggaacaaaaagcacuuggugaguuaugaaaagccagcaaagccagaguuccaauucguauuugucccggaaaagagccgauuuuaguugaaaaagcagaggaagcccgagacauuacaugguuuaggcuuuagccccaccauuugugcaaggcuccugucaagaagggccauauaaugccuuagauaugcucaguacagacccuaaagucccugccacccuugcaagccacccggcaaggugaccugagaaaucagcugggcggagcagagucacucuggccaagaggaauuacucuggggaauuuguuaguaagcaggaaagagaggaaaagccaugcaugugggucagaugccuccagcugaagaaggugaggcauagaaaucucuuaccacuaggaagguauccaagucacggcaacaaauauguuagugguggaagagaucugagguaccccgaguuaccggcggcaaauccauacggguccacagcaacuucagucuuugccuccucagaagaaagaauucaacugaggggcauaaagcagaaaaacagacugaggcaaguuccagagcaggaauggaaauuuauuuaaaaggccuuagaacaaggugcacuuggaagagacccacgcaggcauaugaagauuaaagagagaaggucgaguccccguuuaaccugaugcuaggacuuuuauaggcucaccuuuuucccaugauuuuucccuaagggugggcugccugcaugugcagagcacgcguaguguguuuagggaguuauacacaugcccaucugaggcuuucuuccuuuuuccaguguagcguacccagaagauacuuugccauuuuugucucuuaaucugcauguccaggaaguugcaucucccuggggccugcauccaauuaacguuuugauguuaacagguguggaccaucaagaaauggccugucccuggugcugcugaauuaucauuuuuagagaggcagugugauaauugccaaaccaucaccugacauuucuagugggggguggggcagagcccuguccagccccagucuugccuagcuaugauaccuguaacacugccuauuccuuccucccucuccucaaccccuggcaacuacugaucuauuuacuaucuucauacuucugccuuuucuagaaugucauguaauugggaucauacaauauguagcuuuuucaauuuggcuucuuuuacuuaacaauaugcauuuaagauuucuucauguuuucccauggcuugaucguucauuucuuuuuaucucugaauaauauuccaucgucuggaucaguuuauccauucaccuacugaaggacgccuuacuuuugagauuuggcacuuuugaauaaagcugcuauaaacaucugugugccaguuuuuguauggacauauauuuuuaacucauuugaguaaauaccaauuccuggauuguaugauaagaauguguuuaguuuuauaagaaaccgcucaacuaucuuccaaaaugucuacaauauucucacaagcaauaaaugagaguucuugcugcuccauauucucaucagcauuugcuguugucaguguguuggguuuuggccuagaucuaauaugugugucgugacaucuuacuauuuuaauaugcaaaucauuauugauguuaagcauauuuucauauacuuauuugccauguauguaucuuuuuuggugagguauuuauugagauauuuugcccauuuaaaaaucagauuacucauuuucuuauuguugaguuguaaguguucuuuguacauuuugguuaaguccuuuaucuuuugcaaauauuuucucccagucuguggcuugugaguuuuuucacugaaucccucugcuuuuuguacucaucccugaccuccucuuguuacaggaaaggggucccgauccagaccccaagagaggguuccuggaucucgcucaagaaagaauucagggccgguccguagugcaaagcgaaaacaaguauauuaagaaaguaaagaaauaaaauaauggcuacuccauagacagagcagcccugagggcugcugguugcccauuuuuaugguuauuucuugaugauaugcuaaacaagggauggauuauuuaugccuccucuuuucagaccauauaggguaacuuccugacguugccauggcauuuauaaacugucauggcgcuggugggaguguugcagugaggacagccagaggucacucuccuggccauuuugguuuugguggguuuuagcugacuccuuuacugcaaccuguuuuaucagcaaggucuuugugaccugucuuuugucaugaccuccuaucucauccugugacuuagaaugccuuagcaaucugagaaugcagcccaguagguuucagccucauuuuacucagcuccuauuuaagaugaaguugcucagguucaauugccucugacacucuguguccagcauccccaagccuacaguuucuuuagcucauuuucucuauuuguuuguuuguuuauuuuuuuuacuaguguaggagagauuacuguccugucugcuugauucaggugacagcuggggguuuaacugcccuuugcaaacuagaaaacaaccuccuguuaucagccucuuaucucggcuccccaccugcuccucuuguguuucuagggcugugcuggacaagucaaauuucuucuuagugauuuuucucucucucaacacuaagguuuuaccuucuuguauucugacaaauuauuucguauuuccucauuugcuuucuguccucacauauugagauucagguaaagaugccucguagauaaaacuuuauccaagauaagaguuuaccuuuuucuuauuuucuuuuuugcuuuggacugcuuuucaagaagagaaaaagguaguuuuugacuucauuuucuugcuuguugauuuucuaaaguaaaauuuugaagguugaaacuuaucagugucuucuguaguauaaaacgcaaaaagaaauggcuuugccaaugcuuagcaaauauuauuuuuacguauucuaaauuaaguuauacuaccacaauuaaccuaugugacuguuauuuuauuauuaauuuuucuuuuuuauuuguuauuggauguugucauuuuuuauuccaaagggcaaaacacaguuuugguguugccaucucauucaagaauauugaugguguuuguauugguuagauagcaaacagugaaggcauguuaucagaauaaaccaaugaacuauuaucaaagccagguguaguggcacaugcuuguagucccagcuacucaggaggcuguggcaauagaucacuugagcccaggaguucaaggcccagccugggcaacauagugaagcccugucucuuaaaaaacuuaaaaacaaacaacaacaacaaaaaaaccccucacaacugcuauccuuuuguccugcugucaaacuaugauauuuaauugacuguaagaugaacccugauuuaagaaauguucaaaugugaaagaaaaaaaucugucuuagaaccauugccuaguaccauuguaggcauacaaacagaaaaauauacagagauucuaaaucuuaaaauuacuauaaagacacuuuuuccaguuaaauuucagggacaaauuaauaacuaggaaguuuuuaacuuuaacugacauuccauggcacucauucucucaguguccaggauuauugggccacaccaaccacaaaaaucauucacauuuugugccuuaacugaaguugcuuuccucguaguucuugacaacugacuuugcccuuuuaugccuuucuaauuacugcaaucuuuauccaguucuuucuacugaaaacuuauuaugccaugucacaguauucuguacuauacagcuugacacuuaauauauauuaucuaaaaauugucugccauuauauuuuaugccaaaauaaaaauauguuuuauuuugagcaggucuauuuugagaaagauuaagaacauucauacuuuucuuugccagaaugcauauaaaaaaguacugagcauucacaaaauguuuguuguuuugauuuuuguuguuguugaaguaugguagcacagaucccauugcacagauccugaaucauagcuguauaguaggacuucugcuugcuguuugagaauucaaguuaaaucuggggaaacagauguauuccacauuaccauacacaaagauaccuccaacauuauuagacuuuaucaauauuuuccaaaagauuucccagcaauaauuauagaaucauacagcgaggaaauauaucuuuaaagacaauuucccaaugcaauuggauuuuaaaguucuuuuaaaauuagaguuuuauagugcccuuggcuuaaguaaaauccaaaugagcuccuuuugugaacugucuuguaaauguuucauuuggacacacaucuguugcugacauucauuugauuacauaauguacgaagaauggcuuuugucuuuugauuuuccuuucuaguuaaaaaaaaaaagacacuggaccgaggggaaaaaaagacgugaaucauuuauggggcugaacuauucuguguagguagcauuuguucccauucuauucacguugaacuccagaucuucagugcaucucucuaguagauccuguucuagucauuaauaggaaauagauaagugacucaauauuuuauauuaauauggugucaacgaaaagagucaaacucuguaaaauauuugaaaagauguauucugagccaaauaugagugaccaauguccccugacauagcuccaggagauccugagaacauaugcccaagguggucgggcuauagcuugguuuuauacauuuuaggguggcauaaaacauaaaucaguacacguaagauguacguuuguuccauugggaaaggugcgacaacuugaaaggagggugacaggguggggguuucuggucauagguggauucaaaaaaaauuuuuuuuggcagcugguuaaaagcguuguuaccuaaagaccuaggagugucuggguuaagauaagguuguggagacgaagguuuuaucaugcagaugaagccuccagguggcaggcuucagagcucuuaucagaccuaaaaagauaccagacucuuaguuaauucucucccggaucagggagaacaccuggaaagggagggggauucuccacacaauguagauuuuccccacaagagacaguuuugcagggccauuucaaaauaugucaaauaaauauauuuuggagugaaauacuucaguuucuuucagggcuugcugugcguccuguaaaccuggcuggaauuuggugucuuauugcuacaaaaagucugguucaucagucuuaaaaucauuguuuuaauguuaauucuugucagcugucccugaauuccagugggaggaggguauaaugagguaugugugacccccucuuccuaucauagccugaacuaguuuaucagguuaacuuuggaaugcucuuggccaagaggaggaguccauucaguucuuuggggaacuuggaauuuuauuuuugguuuacaguggguuaaaagguuuuguuaaaauccucuuuaaaugucuaaccggccaguugcuuuuucuuccacucucacagccuuuuaaaaaaaauccuuccguaguugugaacagucuaauucugaccuuuggcucacaaacuccacucaggaaaagaaaggacaugugguccacagagacagcuguuauuacucaggcgagcccuccuaaagggcuugccacacaggaguacguugguuugucuuagggacuaaaccuuuuguaaacaaaauucauuuucuaauauuuuuucuuaucucuuaauacugagucggacauuacagaagaagaacacuaguuuagcauaggguugggggaaagguaguauaggaaaagcccacugaugaaaugugcccugauaauguauuagauacuguaagcagugguagguaggauggauugagaagccacaauguaagauuuccacaaagagaaacuugacauuaaaaaccuauaaaauaaagacuauaaaaauauaugcauucuagaaaauauccagccuaggcucucuaaaaaauguuaauaugaugaaauaaaaaaacaaaaagcaaagguuuuuuuaaaaaaaaaaaaaacuauauauuaaaacagacaaagaauaugacgacucaauacaaugugggauccuugacuggaucuucauugacaaagaaaagcuauuguagauuucacuauuggcauaauuuggugaauuuaaauauaggcucuguguuagauaauauucuauuaaguuaaauuuccugggaauaauaaugcuacugucuuugaucuuaugaaacaauguacuaagauauuuagugauggguucugauagcugcaacuuauuuucaaaugauucagaaaaaagaaaauucaugcauauguauauacaaaugcuugguggugaaagaguuugggauuuuucuuucuaacauucacuuugcacuaagcgauacucuaugaguuuugguucuugcuuuuuucuuuagaauguauguucguuuaugaucuccucauuuuaauauuuuuucuuucaucuaccucauuuuauuagccugagguacuugggacuauuucuuggauuuaacucucucucucucucucucucucucucucucucuauauauauauauauauauauauuuuuuuuuuuuuuuuuuuuuuuuuuuuuugagacagagucucacucugucacucaggcuggagugcaguggcaugaucucggcucacugcagccucugccucccaggacaagcaauucuccugccucagccuccuggguagcugggauuacagacgcgugccaccaugucugacuaauuuuuguacuuuuaguagagaugggguuuugccauguuggccaggcuggacuugaacuccuagccucaggugauccacccaucugggccucccaaaguccugggauuacaggugugagccaccgcaguggccuaauucuguaacuucuuuaguuucuuucuuucuuuuuuuuuuuuuugagacggagucucacucugucguccgggcuggagugcagcggcauaaucuuggcucacugcaaccuccaccuccuggguacaagcgauucuccggccucagccuccugaguagcugggaauacaggcaccugccacuacgcccagauaauuuuuuguauuuuuaguagagacgggguuucaccauguugaccaggcuggucuugaacuccugaccucaugauuugaccaccuuggccucccaaagugcuggaauuacaggcgugagccaccgcaccuggccuuuucuuauguugcagugauugauccugucauccagauaauuuagguagcauaaaugugugcuguuauugaucaccaguaaaauagguaagaaaauauggaaggauuugugcaauuucaucaccuccgaagcaagccaguuuuaaaaacauuuuauuaacaugcccuuauacaguaaggaugacauauugagauguggugcuaauaccccggcuccaaacagugacccauuuuauagaaacauaagauucccuuaguaagcuacuuagggcucaucaggaauauuuaauaauuuuuuuaauaaauuggauaauuugcaaaaaaauuauauuuauaaggcuggucugggaguaccauugaauauaaauugagguacagagguuuaguguauguuccugcucuggaaccgauagaauagccucuggcagaaggaaguaacccacuguuuuugagaaguuugagaguuuucaauauucuuuaacucugaugucuuauggcucaaguaaccuuuuggugauuagcucaacuagaagaauugaagauuuaauaauacaaacauucucuuuguuuaaaauguaccagaucuauuuuuaaacaauuacugaauccgagauuacucuuuuauuaacuugguaagcuaccuuuugccucauguagugguuauguauucugagggagagucuuuucccacccuuuuucuucccuucccuuuccaccucccugcucccucccuuccucuuuuccucccuuccuccuccuccucccccucccucuccccccucuucuccugcucuucuccuccucuuccuccucuuccuucuccuucuccuucucuucccucucccucucccucucccucuuccucuuccucucccucuucccucucccucucccccucccccacccccucccuggucuggaagggauagagaagcaguauccagaauuuaauaguaaaaaaaugagacugagacuggcagucacuguuaacuuauuaaaaaggucuaauauuuucugauuauaauaggaacauacauucauuauagaauguguagaaauacugaaaucucaucgguaaaaauuugguuuauuucuuuucuuuuuuuuuuuguuuugagacagaguuacuuuguugcccagguuggagugcaguagcaugaucuuggcucacugcaaccuccgccucucagguucaagcaauucuucugccucagccucccaagugucugggauuauaggcacguaccaccaugcccagcuaauuuuuguauuuuuaguaaagauaggguuucgccauguuggccaggcuggucuugaacuccugaucucagguaauccgcccaccuaggccucccgaagugcugguauuacaggagugagccaucgugccaggccugguuuauuucuuuacauaucuauaucuauauaucuguacucacuuuuuccuccuguaaaaugggaucuuauuguauguaacguuguauacuugccuuauaucauuuuuucuuauauugugaaauacucuuccaaaugaaaugugcuuuugaugguuucaugguauuacacuguaugaauauaccaucauuuauucagugauucccuuaccuuagcaauguuaagccuguugguguaauaugcaacaauuaagguccaguuaaaauguuuuacauuacuaagcuaauauauaucacuuuagugaauguauguuauuacaaaugugcuuuauuacucuuucagugaauuuaucuuaugacuaaugaguuagauuuuaaugggaacguauuuacauauugccaagauauuauucagcuugagcugccauaauguaauaaccuggacugaguggcucaaacaauaaaaauuuauuucuuacagucugggagcugggaaguccaagaucaagguagcagccaauucaguuccacagugagcgcucuguuccuggcuugcagguggucaccuucuugaugugucgucacacuacagagagagagcagaggcagucucucuggugucucuucauguaauagcaccagucccagaaugagggcuccacuuuguuggucucaucuaaaccuaauuaccucccaaaggucccgucuccaaauaccaucauauugggcguuagggcuucaacauaagaauuuuugagguaggcaauuugguccagagcaggcauaaaugaggacuauuucagaaacuucuuauuuuaccuaaguaucauguuaaaccuaggaucuagaauuguucacauuuuaccugggggaaagauuaucugauuuaucauaggaaaaaaaagauuuaucauaggaaaaguaaaaauuacuauugcuuauucaucaugaaauacauaguuaaaaguaaaagauuuauaggaaaaguaaaaauuacuauugcuuauucaucauuaaauacguaguuaaauuaugcaucauuggcauaaaacggaacuaugaaauguuacauaguucauaaaaugaacuaugaaauugcugaaaugauuccuauacuauuccaucccaugaauguucauaguuccauaaaaagugcaaauguuucuuaaugucuuuuaaaguacuuuaugaaaagagacuuuaagagaguuuuuuuuucuauuuguaaaaaaauagccaauuuuaugggugauuaugaucauuuacuaaaguuccuuuuaaaauuagucucacccucuccauaaauaaauaauacaacuaauaaggaagucuuaccauguuuuagugccuuacauauauauuuuuaaauaguuacauaacaucaauuuuugaaauuucagugaucaguugaucuuauaucaauggugcugcuaagguagauaauaugaucuuuauuuaauauuugagaaacucaaagcuugaagaaauuaagugauuuuaucuagugucaaaccuuuguuauaucuucuguauguucaaagaacauagggaauuuuuauauuaccuugaucugaaaaauaguguucagagaaggacacuaauaaauaguuaccuuuauaauuacauagaaaaaugaacaauuagaggauacuauauccaguuaagcucaacuugaaaauucauauguagcauucuuacuuaaaaauaaguuaguagugguguauuucaagugaucacuaaugaaagcaguauuaauuuguuauuauguuuggcuucauuuuguuauuucuuuuuaaguuuuuagaaacuuauuuaacauggcuuuccuugggaaauaccaauauauggucagcaugaauauauauucuuuuauaaaauaugcuuccagaaucucuuaauugguuuucucaguguaugagugguaguggaaagaacccuguacuauuuaauagggaguaaaccaagcuauugcaaauuuagaucuuuuauuauuuuuuauuuguggcugccaauuuuggcugauaagauggcuuuucuauguauagauuagaacaggaguuuguaauaagguguuuuccacaacuacucaacuuugcugucauagugggaaagcagcuauaggcaauacauaaacaaguggacauaacugugcuccaauaauauuuuauuuauuaauacaaagacaagcagcagccauauuuggccuacagguuguaguuugcuaacuccugcauuagaaugucaagugaaauaaaagcuccucacuauaauauuuuuuaaauuauuugccauguuuuguuuacuuaaauccuauucuaacuuaaugcuuuaauuuguacauuuuucuuuuuaaauuucaccuuuuugauugcuaccgugcuuuuauaucuucagcuucuuuuuagggucucuaauauccucauacaucuuuccaaccuuaucaagacuccuccaaauuuaauuauauauuuacugacaaucaggagugagugagguaaggcaauggagguucuagauauaaagaaaagauagacucuuauggauuuggguggucauggaagacucauuaaaggaggcaggacuggaacugauucaucaaagcuucgagggaaauuuaauauuagaaaaaagagaagauuauuucaauaaauugucgacaaggggaaacucacauauuuccuccuucccucauuucauccccaaaauaugaauuccaccagggacugguucuuucccagaucauuuccuggaacagaaugcacagaaugcuaaugaugugacuuaguucucucuuuggauuuuaccucguugaauucucuuuuccuuccuuguggcuaggacugaccagccuuggaaaggccugaagccuguggccuauaccaguguugcucuaggcacucuagcaaaugggcuucucucuggcugguuggcuuguuuuuccuuagugucccuauaugagauaggaaaaaacagguuuuccuacccuuacacuggauagaacacauaacaccucaccucuggucaccaaaauguguguggauuuucucucccaacaaccaguucucuaguggacaccaaaugaguauacuauaauucaguucauuucugacacuaucugccugaagauagcaucagauuccacagguuaaaggcucaaucccacaagacugcccucauucagaugccaacugcaaguucuucuggcaaaaaaguaaguagaggguucacacuacccucccuuggguuggauuaauuugcuagaauggcucucagaacucagaaaaacauguuuacccccauuuauaggguacagaagaaguuaguuagagggaagagaugcauagggcagggucugugggaaggaauguggaguuucuuugcauuuuccaggcaugccacccucccagcaccuccacguguucagaaaucuggaaacuugacuuuuguguuuuuaugaaggcuccgcuguguaggcaugguugauuaaaucauugguuguuggugaucaacucaacucuccgaccuugucuccucccuagaggacccuguauggggcuggaaguuccaacuguauagucacaugauggguuccucuggcagccagccccaauccugaggccuucccaagagcccacuaggagucaugucauuagaacaaaagaugcuccuaucccgcaagagauuccaagggauuuaggagcucugcuguuaaagaacagaacuggagucugcucaacuggcacagugaaaacacacaucaagguuuuugcagugacagaaaguugccuauugcagagugcuaagcagggggggaccagccagcuaaaugcucaaaucuggccucccugauggcuugcaggcaaggauuuuuaggcuugcaggcaaggauuuuuaaaggcagggguaaauuucaagaaagcagaagcuacaggcaaaaucauaaaucaauacaaggagguuacacauuggcuuaagcuuaaaagggcaggacauuugaaguggggggcacucacagaugguagguagauucagaacucuucggauuugcaguugauuaaggaagggaagcuuuguuuaaaacauuuaaguucaguagaaaaaugcugacuugcuagagggaaugacuuucucuaaguuccucaggaagaaacuuacuaauaaaacaaaggguaauagcuaaaauuuagucuucauuucccccuuaucuggagucuguaugccagcagauccauucagugggguuucaagccucuaaaagacaacucaaggauguauguuaggauguuaucuuuaguuucuguaggaaaagcaaacaucucuggagcuuuaacuuccuuggcuauuguucugcuaccuuuucguuuaacaaguuacugaauuaccuccggggcuagcuagaugccuggaauguuucuuaaaggaacuuugggguuuuccuuuauuuccauguuuggggguuugcaggucccuaaaaggagagguggggucccugcuauauuucacuguguccaaugauccuaucgcacaggaaauuacaaaagucuuaggagcucuaugucaggaacugggggaagagaccaaauauauauuucuuauguaaaccaaaaaguaugugagacaggucucagucaauuuagagguuuauuuugccaaacuuaaagaccauggucugugacacagccucagggaaucuugagaacauaugcgcaaggugguuugguuacaacuugguuuauacauuguagggagacagaaguuacaggcaaagacauaaaucaguauguguaauguucagccuggaaagugggacaucucuaggugggcgugagggagguuuuaggucauagguggauucagagauuuccugauuggcaauugguugaaagagguaagcccugacuaaagaguugaauucagcauaaagaaaugcuugaguuuaguuagauaaggggguuguggacgccaagguucuugucauguagaugaggccuccagguagcaggcuucagagagaauagaugguaaauaucucuuaucagaccuuaaaaggugucaugcucucuggagaagaccgaguaugggaaggagauucucuacagaaugcaaauuuacuuuacaggaggcagcuuuacaggggcauuucagaauauggaaugucaaacaaaaaaauuuuaggguaaaauacuuugauuuucuucagggcuugcaauaaaauaccaaacuccaaccugacucuugguauaguaucacaugauguuguuuggaauuugguauuuuauugcuaugaagagucuguuuugucagucuuaugaucucuguuuuaauguuaacgucggucaguugugucuaaaucccgaaguauagagugcagaaaagcccagcauguccaauccauaaugaggcaugucugaccccucccuuucagucauggccuaaacuauuuuuucagguuucuuugggguccacuuggcuaagaggaggguccguucaaucgguugggggcuuagaauuauauuuuugguacacuuguuauaucacagauccuuucagucuuuuauggccauuugacuuggugggcggauaugacccaaggggaugggaauaggaagucagucagcuuucuuggcuuauaagcuaccuuuaugaguaaauguguaaaugaaggaguccugcuugggaucuguguuaccuuauugggaacauaauuuggaauuugaaauuaggguuuuuuaaaaacagaaugugaauaaguacuucuguucacauuuuuuccuguagacuuugcaaaaagggauagcauggcaagacagauggguuccugccaucucucaaucuuuuuaccuuugguaugauggcagacuaagcgaguauauggacagggccacuggaucuggaagacaaagcccuauguggagaaagugaugccccuguguugaggcagccuucuuguuucuuuugcaagcacaacugcugucccagacagugacagccuaucuuuagcgagugggaucuggaguuacugugguauuuggagagccagccagucugccacaguuaccucaggcugcaugaauaauuucucuacaaaaaauggcagcaguuuuccaucauaacugcaguuucugguaucugaugcuggaauucauuucuaaagccagaguaauaucacauuaaaaugagcaaaucuccagacacugauuuuuagcugcuggauuuuuugauuguacaguguuuacuucuuuucgcuuccgggggaagaaagugggcucaucucaaagccuuaaauaacagucaugaaaauuucaccgugugaccacaguggcaugauggauggcauccgaggaacagagggaaggaaggagaguguuacugugcagggaauuuguugucauuugaaauuaagguugggacaucucagugaaaucauuaaaaccuaggaacuaaaaugaaaauaaagaccuguacucaaaacucuggcuuaaggaauuggguugcuuggaggcagagagaaaauuagccaaagaguaaaacuacagcauuugaaauaugaagagaaaaaguacaaauuggauuuuauaaagagaucacuagaaacuugaagagagaagaggaucagcuuuagaagcaaacuauaggggaauugggaaaggaaaguuuaaaauuugaaauauuuaaacaggccauuacaaagauaaaaggcuuuugggaagacuuagggccuagggcuucucuucaugugaagccucucguaucucuaggacaccaauauagggcagagucuuacuaugagacuuuuucuccugaacaccccuucacaguccccgguaagcuagauugggacauaugagaacuccuuucucuuaggccaauugccuccuuuguccauuuccucuuugcuguuucauuuguaguaaaaaauagucuuaaauuugaauguuuuaaaauuauaacuaaaaagucuuuaaauacaaaucuuaagacugugcuaagauagaaauuugcuaagcaaaucaaucuaugaguaaaaaaacaauugcaucaagauuccauauuuaacauuagcuguagccaauauuaugugcauagaaaaauaucaauccaaaugaaagaauugacuucaaguuagaaaauaauauggauucacaauccuucucccuucuuauucaaaaccaugcagguaauauaugcuuuaaacacuaaaaaugaugagcaugaaucugcaauucaagcccucaaagaugcucaugaagaagaaauucaacaaauucuugcugaaacaagagaaaaaauauugcaguauaaaagcaaaguaacagaggagcuagaccuuagaagaaagauucaaguuuuagaaucaucauuagaagaucacauaaaaaugaagcagcaggcuuugacagaauuugaagcuuauaagcacagaguugaggacaugcaacuuugugcagaagcccagcauguccaacgcauagugaccaugucuagagaagucgaagagauuagaaggaaauuugaagaaaaauuacggagcuuuggacaacuucaaguacaguuugaaaaagacaaacgauuggcauuggaagacuugcaagcugcucacagacgggagauacaagagcuauugaagucacagcaggaucacagugccucaguaaauaaaggccaggaaaaggcagaggaacuacacagaauggagguggagucccuaaacaaaaugcuugaggagcuaagacuugaacggaagaaacuaauugaggauuaugaaggcaaguugaauaaagcucaguccuuuuaugaacgugagcuugauacuuugaaaaggucacagcuuuuuacagcagaaagccuacaggccagcaaagaaaaggaagcugaucuuagaaaagaauuucagggacaagaagcaauuuuacgaaaaacuauaggaaaauuaaagacagaguuacagaugguacaggaugaagcuggaagucuucuugacaaaugccaaaagcuucagacggcacuugccauagcagagaacaauguucagguaaguaaagaauauuauauucaacacauggauuuuuuuucuuuuaaaaauauuuguuuuguaggcuggagagcagucuggcccacuuagaaucaguggcuucacaccacuuagacuuuuuuuuuuuuuuuuuuuuaacuuuuccugcuuuuccuuugugagaaaaaucaaugacaggauaauuuguauuacccuguaguuguuauuucagacuuucagauauuaggggcccaaaaagacaagcuuaaaaccuugucuaauuauuggcuaggcacagugguacacaccuguaaucccagcacuuuggggggcccaggcaggaggaucgcuucaggccagguguuagaaaccagccugggugagugagcuuagcgagguaauacgcuguuccugggggggggggcggacaauauugcuaauuauuuacaaaaggauuuuaauauugggcuuaaaguuuaaauacauuuuuuucuuuuccuuucacuaauaaugguuugccugcuagcugauauuuagaauuugaucaagaaauugcuugcuuucuaaaccugaauuuaauagggguauugcacaagucugggggaaaaaaaugccggaaguccacaaguuuuguuuuguuggcuuagaaaauuucauagccauguuuuuaauaucugugcaacauuagaauggauuagaaaguguggaauagccuuuccugauugggucauguuuaugaaaacaucaaguuauaaaucacuaauacuuacagauuuaaaaauugguauauaguuuaguaugacuucugaauaagagaaagcugacccuuauaauuuaaaugaauuauuuagcuuaguauuauuccugcauuuuaacaauggcuauuuaaucuuucuuagguucuucaaaaacagcuugaugaugccaaggagggagaaauggcccuauuaagcaagcacaaagaaguggaaagugagcuagcagcugccagagaacguuuacaacagcaagcuucagaucuuguccucaaagcuaguaugugugaccacaguuuuugauguaaugcuuagcuaaaaucaacacuuuauuuauuuauuuuuuuggagacagagucuugcucugucgcccagacgggagugcaguggcucaaucucggcucauugcaaccucugccuccuggguucaagcaauucuccugccucagcuuccugaguagcugggacuacaggugcccgccaccaugcuuggcuaauuuuuuuguauuuuuaguagagauggaguuucaccguguugcccaggcuggucucgaacuccugagcucaggcagucucccugccucagccucccaaagugcugggauuacaggcaugagccaccacgcucggccccaacacuuaaauguuaauuuaagguagcauuuauuuuuucuucuaacauuuuaaaacuauuuagacuguaaauaaguuaaaggacucaauauguuacuaauuacuuauaagauacacaaauauuuuuuauuuuuaggaauauauuuuuauagaaaacuugagaguuuuccuuugugaggaaaaauaccaauagcagguaaaauaccaauaaaguagucacuaaaagaaaaacgggcugggcaugguggcuuacaccuauaaucucagcacuuugggaggccaaagugggcagaucacuuguggccagagguuugagaccagccugaccaacgaggugaaaccacaucucuacuaaaaauaacaaaaauuagcugggcauggugguacacacuuguaauuccagcuacuaaggaggcugaggcaugagaauuacuugaaccugguggcagagguugcagugagccgagauugcgccagugcacuucagccugagcaacagagcaaggcuguaucaaaaaaaaaaaaaaaaaaaaaaaaagaaagaacgaaaaaugaagcacacuuuucaagagguguuguccuuuaaaaauauacauuuuauuuuauuuuauuuuuugagacaaggucuuguucugucaccuagacuggagugcaguggcaugaacacaacucacuguagccuggacuuccugggcucaagugauccucccacuucagcuuccugaguagcugggaccacaggcaugcaccaccuuggcuggcuaauuuuuuaauuuuuuguaaagacggggucuugccauguugccuagggugaccucaaacuccugggcucuagcaguucucccaccuuggccucccaaagugcugggauuucaggugugagccaccaugccagcauuuauuuaguuuuuagagaugggaucuuguucuguugcucaggcuugagugcaguggccugaucauagcucacugcagccuaaaacuccugggcuuaaguaauccucuugccuuagccuucccaguagcugggacucuagguaugccacgggcuaacuuuuuuaaagaugaggucucacugaaaaaauacacauuuuaaagugcucaaauuaguugaaguuuguaaauuacagcaguucauuucuuagggcuuguuacuaagguucauuuuuacauacuaaagcugacuugccuauuucucaaguggcugguaugcuuuuucacaaccauuacuggaggaagugggugacuugugucaguucugaaguuauauuuugucuaaguguuuagugugcccaggaaggcuguuugagcugguucuuugaggaucucauuugauuuugauuggcuuaucagugaaucucagauuuuccuuccucuaaaauaguuguuuuuaauagccuuuagugcacauuggagugaccugaaggguuugugaaacuacagaugcugggccccacccucagaguuucugauucacuuuuaggucuggggugggucacauuucuaaccagaguucccaggugaugcuggugaugcugguccuggguacuuugagaaccucugccuuaaacuauccuuucuaugagaccuuuuucuucacucacuuuucaucucucugucucuccucauuuuucuccaccuucccugcuuuuugcugucauuuaagagauucuuucauaaccuugcugucuuuaucugugucuuacaucaccuuaguuguugguugguugguuguuuuuauuuggagaugaggucucgcuauguugcaggacauagugcaguggcuguuacaggugcagucauagcucacugcaaccuugaacuccugggcucaaacaauccucccaucucaaccucccaaguagcuggaacuacaagcuccacuuuaggucuuuaucuggccucuugccugaaacaaauucaauuucaaccaaacugcuaucugccaucuuuguuuccuacauacaaacuucuuccuuuuuauguuagaauuugaaaauaaauuagaaaagaacgaaucacucauuuuggcgccacagugucagucagugcauccucuccguccuucuuuuauucccaggagacuuucuuaugaagccuacugaggaguugcgccuacuucaaccuguuuagcuugcaaucuuaaaaaaacaaaaacaaaaacaaaaaaaaccaguaaaacgguacgaggugcaggaagcaacauuaaucaugugaaaaugacguuuuaauuuaaauuauucuagugcgcuaagaaguauuuucauguaaauauuuccauuuuauguagugaagaaacaaaaggaaaauuuguacauguagaccauuuauuuuacuuaaguauaaaguacaguuguguuauuaaauguaaacuguuuaucucauaguacaacugauuuuuaaauugaagggauuuucuuuuugggggauaggucauauuggaaugcuucaagcaacucaaaugacccaggaaguuacaauuaaagauuuagaaucagaaaaaucgagagucaaugagagauuaucucaacuugaagaggaaagagcuuuuuugcgaagcaaaacccaaagucuggaugaagagcagaagcaacagauucuagaacuggagaagguaaaaaguaauggacacuccauuccccccgaaagaguuccguuuuucucuuuuucacauuugaaguauuuggaguauuucuugcuacuccccaguaacaauacauuuccuacuuuaguaguuauuuuugguucuaauuuugaggaaauggguauauagcuagacuauccuaugcuguauguauguucaaaauauguggguaacaaucuauauaauauaaaaacuuuaagacauuucaaccuauuucaagccagaaauugaauaaacucuuauuucaguggaguguauacuuauaaucauuauucguuuucuauuaaugaaauauauuacugcauauccauguaggaaauuucuguagaacugaaaauaugacaagcuucaagcucugaaaauguauaccaagauaauugaauuucuaguuuaacaagugaaacaucauuuauagaguaauugcugaauauguauuccaguuuuucagaugcccacaauaccaagugggaguuuuggacauacuuuucuuucucuuucccucaacgucuaaguauuuugaaaauaucuauucucuuugcucuuuacuuacuuccauucauuccuuaaccuggugcaguccucucugaccaucaguccacagaauuugcuuuugccucagcccucagugccauccugauugguggacuugguggaucauaucuuacugugguacuuacuacccacugauuuacaaucucucaucucuugguauuucacauucuuucacauuuuucucguaccuccuuggccuuacagucuucuuugugaacuucccuccuccaucuguucccuuaccauugauguuuccaguauuuucaucuaauucuacgcacucauucauuccaguaacaucaacugucacuuauucagugauagcuucuaaaucuuuagguccaggccagacauuuucucugaauuuaagucuuuuauccuuuccacuagauaucuccauuuauguuuuucacaaacaucaaguuaccaugcccagaacuuucuccucucaaaaguacuaaguuucuuuuacuccuuauuucaaccaauagcaccacugucuaucuaguugcuaaaucaaaaagcugaaagucauucuugauuacuguuuucucagccccuuuaucuguuacagaguccuguugguucuacuuccuuaauauauuuuuauuccauccuccccugcucauacccauuuauagauccgagguuuaggcacgugucauugcuugccuggauuauagucacaacugccuagcagcaaucucugauuucaguuggcucaccagccugcuuccaagaugauuguuuuuaaaaguauauaauuugcuuaaaacuucagugauuucucagucccuucagaagaaaauucaaaguucuugguguaaaagaccccaucucauuauuuuauuccugccuacuucugagccccgucuuucaccacuuuaucaccuuguauccuguauucuauccagacugcuuagcugcacagacuuucugucucccuaaacuuucccaucugguuagcuacuugccaucuuuccaaugcugcacaacaauagaaacaguuaugaauguaggcuuuugacaacagaccuaggcuugacauuuucuuaucauuaauuuccucugggguuguuguaagaauuaaaugagagaaugucaucaccagcucagaugcuuucucuucugaaaagccuucccugauaucucucugucucugucuuugucucucucucucugaaacacacacacacaugcacacgcacaugcacuuucucaccgcguccaaguuaggcauccuucuaauauacucccauaacacgggauauacaucugcauuaguucauuuugcauugcuguaagggaauaccugagacuggguaauuuaugaagagaagacggauauuuggcuugcaguucugcgguccgugcaugaaauguaguacuggcaucuguuucuggugaggccucaggaagcuuacaaucaugcuggaaggaggaggggagccagcaugucacaggacaagagagagagcgagagagaggaaggaggugccaggcuccuuuaaacaaccagaucucacauaaacucauagagugagagcucacucauuauugcaaggacagcaccaagcuauucauaugggauuuacccccaugauccagacaccucccacuagucacaucuccaacauuggaggucacauuucaacaugagaucugguggagacaaaaaaauccaaaccugugucaacaucccuuuuucauagaacuuauaaaacuauauugccauagucuuuguauuuuuuucauuauuagaacugugaaugcccaaaagguacguaauuggcauucaaaauuguauugagugauauccuuugaguggguuaacugguaagccauuuuguguacuauuuugacauaaaaggaagcccuuuacucuuuuuuuuuuuuuugagauggagucucgcucugucgcccaggcuggagugcaguggugcaaucucagcucacugcaaacucugucucccaguuucacgccauucuccugccucagccucccaaguagcugggacuacaggcacccgccaccgcgcccagcuaauuuuuuguauuuuuaguagagacgggguuucaccguguuagccaggauggucuugaucuccugaccucgugauccacccgccucggccucccaaagugcugggauuacaggcgugagccacugcacccggcccagcccuuuacucuuaagcuugcagauguauuaacucacauuuggucuaauaugauaauagucuauuuuaucucuugcuuuaacauuuuugauuuuguauaggcuccccuuucacuuucugagaacacuaaugauuuguugucauguuucauagucuagaucccguagcacucaguuuauucaagcuuccauauuuauaggguauucaaauuacccuaauaacaguaaugaaaaaagcaggugccgauuauugaucuuuguuuuaauuuuagaaaguaaaugaagcaaagagaacucagcaagaauauuaugaaagggaacuuaaaaaccugcaaaguagauuggaagaggaggugacucaauuaaacgaggcccauucuaagacuuuggaagaauuagcuuggaagcaccauauggcaauugaagcuguccacaguaaugcaauuagggauaagaaaaaacugcaaauggugaguaaaaauuuaauuuaucauugcauuguaaauugaugauauuucuguaguaguguguccggaauugguggguucuuggucucacugacuucaagaauaaacccacggacccccgcggugaguguuacagcucuuaagguggcgcgucuggagucugccccuucugauguucagauguguucggaguuucuuccuucugguggguugguggucucacuggcucaggagugaagcugcagaccuucgcggugaguguuacagcucuuaagguagcgcgucuggaguuguucguuccucccagugggcucguggucuugcuaggcucaggagugaagcugcagaucuucguggugaguguuacagcucauaaaagcagcguggacccaaagagugagcaguagcaagauuuauugcaaagagugaaagaacaaagcuuccacaguguggaaggggacccgagcggguugucaaugcuggcucgggcagccugcuuuuauucucuuaucuggccccacccacauccugcugauugguagagcugaguggccuguuuugucagggcgcugauuggugcauuuacaaucccugagcuagauacaaagguucuccacauucccaucagauuaguuaguuacagaguuucacacacagguucuccaaggccccaccagagcagcuagauacagagugucaauuggugcacucacaaaccuugagcuaaacacagggugcugauugguguguuuacaaaccuugagcuagauacagagugucgauugguguauuuacaaucccugagcuagacauaaagguucuccaaggccccaccagagcagcuagauacagagugucgauuggugcacucacaaaccuugagcuaaacacagggugcugauugguguauuuacaaucccugagcuagacauaaagacucuccagguccccaccagacucaggagcccagcuggcuucaccuaguggaucccgcaccggggcugcagguggagcugccugccaguuccgugccaugugcucgcacuccucagcccuugggcggucgaugggacugggcgccguggagcagggggcagcauucgucgggggaggcucggguugcacaggaacccacggaggcgggggaaggcucaggcauggcgggcugcagucccgaggccugccccgugggaaggcagcuaaggcccggcaaaaaaucgagugcagcaucggugggcuggcacugcugggggacccaguacacccuccgcagccgcuggcccgggugcuaagccccucacugcccggggcccgcagggccggccggccgcucugaguguggggcccgccaagcccacacccacccagaacuccagcuggcccgcaagugcugcgugcagccucaauuccugcuugugccucucccuccacaccucccugcaaguugagggagccggcucuggccuuggccaguccagaaaggggcucccgcagugcagcggcaggccgaagggcuccucaagugccaccagagugggaacccaggcagaggaggcgccgagagcaagcgagggcucugaggacugccagcacacugucaccucucaguaguccagugugaccuauauuguagagcaaugauuugcugcugcugcugcuuuucuuuucuuuuucuuuuuuuuuuuugagacagagucucgcucugucucucagucuggagugcagugcaguggcacaaucucggcucauugcaaccuccaccucccagguucaaacaagucuccugccucagccuccugaguagcugggacuacaggcgcaugccaccacaccuggcuaauuuuuguauuuuuaguacagacaggguuucaccauguuggccaggcuggucucgaacuccugaccucaagugauccucccaccucagccucccaaaaugcuggaauuauaggugugagcuaccgcacucagcugauuuccuucauuuugaugguuucugucuuguaaucauucuugaagucaugguucaaagaguaacauaccugguaguucuugaaaugagauauagcuuauugaauuuauuuaagacauugcuacuucauauaagccauaauagaaacacuguuuuuguucuugagcugucucuucaugagacaauuuaauaggugugcucuucaggaagccucaacuaguugaaaguauguauucucucguagauaguuuucuucuuugagaaaaugauuuauguuuuguuuuguuuguuucuuccacaauuaaguauucagcuugcuaauaguaauauaugacagacagaauugcagaguagaaaaagcaaaguaucugacagaccuuggccuuacacugagcucuuugccuauuaacuguauuacuuugggccucaaaagcuaugccuuaggcuccucaucugacaaaagauaugauucaacuuaaaauguuccuucgaggauuaagucagauaaaguguugaguaccaagccauguucuagcacaugaugauaaaaauuaguuauuaguacuucuuacuauguaccacauacuacaguaauguuuugcaucuuuuaaaaaaucuaauucuuaugacacuuugguuugauuucucuacacauuuuacugaagaggggaugugcucaagcacaugcaacuaguaagacucagucaggccuugaacucagguuccagaucugucaaaucccagacaucuaaauaccaucauguaggcauuuaguaaugaugguuguuauauauuucacuaaugguacuuuacaguuuacaaagagcuuuuuuauauauaccuuaauacuuacgacuuggagauuaaagucauuuuuauuauauagaugguaaaauagguuuaauaaaccucgaugauuucgugagagccacagcgcuauuaagaagagauaggauaugaauugagaucugccucagugugcuuuccuuuugugacaugacuaguugggaaaaauauuuaagaccuaaacuuaauuuaaaauucaaauaaaacuucccauuagaauguuauuucuuacuaaacuuacuacuauauguuuauguagccagagacaaaaauuaaugacauguuauuucucaagacucugacuguaguauucucugugccaggucacuauuccagaaccaguuugcacagcauuaguuagugaggcaugugcaugcuuagcaguucugggugccuguaucacguguucagaguuuuauagaaaaguguuucaugguaacugcuucuucuguacucuguuuccuagcuaucuuuugguauuacuuuucauuucuacauucauuuucacuguagccacuuucuuucuuauuggaauauuuaaauugcauauguccugccuuuagccuuuauuccucucuauuaaguuauaagugcuagaauugaggcaucuuucaucaacgucauuuuuaccucauuacuuuacuccucauuaucccuucaccugauuaaauuuuaauuuucuagcaccugccuuaagcuaauuaaauuucuuaaagucuuucuuuaaaacaugguugccguaagacagaugacaugaaauuuccuauaggugaauauauucaccacccuauugcagcauuauuucuacccuucuuuuuuuuuuuaucagaguaacuuguguaucacuugcucuuucuuccacucuugccugucuaccucaugucugaaccugagcugaaaccagccuccuuccaaaauagucuuccucuagugucagauucucucuuaaggaacauuuagcugaagacgacuucuauugucuuauuauugaguuaucaaaaaggauuguacuguccauaacuguaguugacccaccacaacugagagugaauauacagagaacccaugcagaaaacuguuaacauaggaggcuugaggcuaccauccuuagaaaggcaaguuggcccuuggcuggcaucugggaacuuggauuucuggagauccccccauucccuaauaagaaugacucacuggccuaagcuguggccuaaccacacagccaaugugguuuaugcugaacaccugcuuuccuucugggaaucuggaauuuugacaugugacaggaagaugguaccuguaugaucaguugccgauaaaaaaccuggguacuaagucucucaugagcuuuccuaguagacaacauuucacacaaauugucacagguugcuggagguauucagccugucuuguauaaggacaacauuucacacaaguuguuacaggugucuggagguauuaaguguguccugugugagagggcuuuuggaaacuuuguaccugugucugguuucuggcagacuucaccccaugugucuuuuuccuuuguggugugugcuuugaguccugugccauaaucacagccaugagugugacuauacccgugaauguaaaucaucaaacuuggguuugucuugggguccucugacacagaacccuauugauucuucuucucauuuuacacuacagaaauauugaacugcuuguaacauacugugcuccuuugucccuuuguggugugaaaaagccuuagcacaugcuuuuucccgugccuagaaugugauguuccccuccugcuccaucaccuuuucuuccuucaaaccaugcuuaggaauugcuuucucucuaaagguuucccugccaagcuagacguuauuaguuccccuuccauauacucccguacucccuaugcaugucuaauuuaguuaauauucuuuaauuguuugauaccaugagcuuauuaagggcaggcuccauaucuuauugccuuuguuacccaaguguuaaguagcaugccuggcaaauaguaagugaucuucaguaauuaucaguuuuaccaguuuugcucuuuaauuugccuucauuuuauacuugcucauucucuacuguguuccagugcuagaccacugauuuguagaagugucacuggauuucauuuuuuaugcaaacauaaaagaauuugagggaaaaaaagaauuuugaauucaagagguaauuagaauuuuuuaucucacacuuuucuguuuuuggacuucagcuugaucuaguccagucacauguucucaccauuuaaaaaaaguauaacuacauuauaaaugagucagaaugauagaaucuaagccacuaugggugucacuguuaauucagauauuguuaauuaaggguaaggcuaauuugaagagcaaaguuucaaaauacaaaacagaauagucuuuuucuuagagucuucaaaguauauaauacuugcaauuuuguuaauuuuuaaaaaauuucuuuuucuaaggauuuggaagaacaacauaacaaagauaaacuaaaccuggaagaggauaaaaaucagcuucaacaagagcuagaaaaccuaaaggaaguacuggaagacaaguugaauacagccaaucaagaggcaagaauucuuuagaccuguugccuauguuauagauuuuaauaauaauaacuuauucuggugacauuguauagguagguaagucucaguaaagguaacauaucuagaauaaaaauaauuuaaaaacuuuaauugguguugaauuuuucaugacacucugauuauguuccaccagguaaaauuuacugucaaaaacauuaaacuaaggugcuguuguggggagaagcaaaacagaauaucaccacauaggaaaagaacaagagagaguucucuacccuuuugccaaaaaauagcuuauuauucucuauacugccucuuuuucuacaauuucaacagaaacugaggaugguagcuagaaucaguaggcuuaauuugaauuacagucugugacauugcccuuuuaagacuagauauaaaugaaagaggagaaaagagggaaguuagagcucuucuucaaucucauaucggcaaaguuccagguggguuaaggauuggaauauaauaugaaaaucauggauaugaauauaaauaaaauaugaaaacaaaaaugacaaaccugaggacagagaaggcuguuugaacaugauaucaaaguugugaauugaaacauggaauauuuguacaguuaaagcuaaaacuucuuuauaucaaaacacaccauaagcaaaauuuaaaaagaggaaaaacugggagagaugaagagacugacaaauugaccaaugaagaguucaugucuuuaacacuuuuaagaguauuuacaaaacaauaagaaaaauacagacacccagauuaucuuuuuacaagcuaaaaauaagcaggaaaaaauaauuuguauaauuuaagaacuggaaaugaaaucaaugagaugccauuccaucaccauaaaauuaacaaugauaaaaaaauugagaccaugcaguguuaauaacgauaaagaaauaagcacucagaaacugcugauggggauucaaaauuguauaauuuuccucgaaagggauuuaucagcacauaugaaagccuuaaagacaggcauguccuuuaacucaacaguuucauuuuuuuguguauuuaaccuaagcagauaacuacggauuguugacaaaauuucagcacuguuuauaguagaagaaguauagaaaaacuuaaauuuucucugaagucugcugccuggaagaaagggagucuucucccaguucacacaaguuuuguuugcuucucuuuccauguucuggggcugcuuccacacugagggguauugccuuuuuccugcuuagaggcacacauggccuagcagcugccuugguacaauacaaggucaagaaagugaaggcauuuaggguccuucuaggaguuaaauacuuucauucugagauguuaaagagauuuuauucuuaauugcuaguaaguauauacgaaguuuuucuguaagugacucauucauuuauuuaauaaauauggaaugccuauuagguaccaaagcacuguuacacacugcgguuucagugauaagucagucagacauggucccuacuacuauggacagacagacacaaaaacaaguaaacacaagucugaggcauauuacaaagggugguaaguaauuaacaagggcucgucaaaauaauaaauuuaggaaagcuuaugcaaacgcucugaggcaugagaaauuucuaggaauuguaagaauaccagugguauuagucuguuucaugcugcugauaaagacauaccuaagacugguuaauuuacaaaagaaagagguuuaauuggacucacaguuccacauggcuagggaggccucacgaacaugguggaagacaaggaggagcaagucacaucuuacauggauggcagcaggcaaagagagagcuugugcagagaaacucccauuuuuuaaaaaccaucagaucucaugagacucauucacuaucacaagaacagcgcaggaaagacccaccccauaauucagucaccuccuacuggguuccucccucaacauaugggaauugugggaguuacaauucaagaugagauuuggguggggacacagccaaaccauaucaccagaaaaaacggagugugauagcaacuauaauaauauuuauuuagugcuuacugagucccagacuuuguuuuauauagccucuuuauacuguucucuccuuuaauccucacagcaacccugugcaguagguaccaguuacuaaagcauagaaaaguuaaaauaacuugcccaagucagcacauaauaaguagguaaagccagaauuccauuucagguagugugcuuucagaacucaauucuuaacccuacucuuucucucaauuaguauauaaagaccaagaagaagggaugccaugcugagguuggagauuucagcaggggcuauguuguggaggucuuguaagccccaugaaagauuuugaaaguuauccuaagggcagugaaaaacaguugaaagaugauaaguauaaauauguggaugcuugugcaguggauggggcuuaugcucguguccauauuuguaauuuauaaaaaacucacuguaguguugcaaggagaguggauuagagaagaacaaauagagguagacggauauuucagggaggagguuucuacuuacuguauucccucaguuuguacauuaauauggagaaucugaguauuuauuucuauugcaaaugacagaaauccuaccucaaacuagccuaaagaaaaaaaaauuuauugacucaugugacuguaaaguccaaggauaauguuagcaucaggcaagacuagauucagaacugaaauugugacaauggaacccagcuuuucuuuuucucuuaaauuggguuuguucuuguguugacuucaugcuucaaucacauauucccugagguauacguggagcuggcaaaaaaccuuuucugggagcuccuuuuaaaguccugagaucacugugacuagauaagcuuaaaccaugugccugccccugaaccaauccacauacaaacaaaaugagaugaccuuauugguuuacguuucaaugaagcacuucauucuggaguuuaaguugagcgcuuacuaagaccacauggaccgauagagaaggcgaguagaugccccaaaugccauaaggagauuuuguuauugggagacaauagguguuuuccccauguauccauuuuuauuguauuuaagaaaacaaacugaucaguuauguucaacacuuauuugcuuuuuauauuuuauuacauuuaacuuugcagaaguuugaaguuuuugccuauuuaaauauucuaucucuagauuuguaauugccuuaauagaccuucucuuugaauucuuuacauuguuacuagaauacuguuuuuuuuuuuucuugaggcagagucuugcucuguugccaggcuggaaugcaguggcacaaucucgcucacugcaaccucugccucccaggugcaagcaauuccccugccucagccucucagguagcugggauuacagucgcgcgccaccacacccggcuacuuuuuguauuuuuaguagagacgggguuucgccauguuggccaggcuggucuugaacuccugaccucaggugaucagccugccucggccucccaaagugcugggauuacaggcauaagccaccgcgcccagcccuagaauacuauucuuuauaauuuauuuaauggaagaauuuuaccaaacuuuuaaaaaacagguaauucuuuugcugugaaaauauuucagagcacagaaaagauguguagcuccccuaauuaucuuaugagauuagcauuccuuuagagacaccaccaagauaaaauacuaccaccaccaguauugcagagcauauaccugcauagagaggggacaggaaggccgugcacuuggggagggaauugugggucagagaaggauugaaggagaauuuuuguauuuuuuuuuuguaaugucuguauuuacaaggaaaaauagguauuauuuuuaaauuaccaauuucaacuuuuguagaaauuucauaggcuuggccauuuuauaagaaugcgguuuuuacuuuauagcauuguccuaaauaauuugaaauauuucauguauguauuuuaguauucauaacuuuaugguagggauaugcuuaaucagcaauuaucuauuagcuucuaauuucgaguguauaaauucaacucuuaaagauuuaaugagaaauuuuguauggaaacacaggaaucauaacuuacucuaguuuauaauacauuuaccagcuuaucaauauugaccuaaauuuauccccuuugcaaauagcaggagauauggacucaaaugaaauaugugauuaaauuuuaaaggaugguuuuuaagauauuuuuaucuaaaauuuuguuuuacucuuuuauauaaucuuuaucuugcuucagcuucuuauagguauuuuauuauaugguggaacuaggaauucucuuuguuaaacaaagguauaucuauuccuuuacaugguugucaugaaaaaagaagaucuuaaaugugaaagucuuuucaaaacacagcagaagaaagcugucaugguuauuugagugcuuuuuccaaauuaaucaggaaaucauccauucaguaaaauuacaacuaaauaaaaaacuuuaggaagaaauuguaagacuauuuugcuauucuauuacaaugaaauauauuaaaaguacucuauuuacuuacagauuggccaccuccaagauaugguaaggaaaagugaacaaggucuuggcucugcagaaggacuuauugcuagucuucaggacucccaggaaaggcuucagaaugagcuugacuugacuaaagacagccuaaaggagaccaaggaugcucuauuaaauguggagguaauuucauaauucuacugcaaucuaaacagcggcaaaauaaaaauagaauuuagccauuugaccuagagcuauuuaaacagcacauuguauauaauuaguauauuaguucuuagaacuaccauaacaaaguacuacaaacuggggaauuuaaaacaacagaaauuuauucucucauagcucuggaggcuagaaguccaacaucaagguguuggcacagcuauguuccuuccuaaacucuaagggaagauccguccuuguauuuuccagcuucugguagcaccaggcauucuuggcauucggcaacauaauuuccaucucugccuaucuucacaucuuaaaaggauaccaggcauauuggaacaagggcucauucuacuccaguuugacaucaucuuaacuuaauacaucuguacugacuguauuuccaaauaaagucacauucugagguauugggaggguaggacuucgguauaucuuuuuggggacccaguucaaccgauaacaauuggaacgugcaauucuuuuacuaguaagagguagaacucucauauacagcaacuaagugcuucucugugucugcagauuucagaaagacucugccuuuuuucuuccacucuuaugaagcacagcaaagauuuagauugucuuagauaguagagaaaaagaauccauaaaacuggguguauaguacccaggaaguucuuaaucuuuuccuucagagagaugguuuagaguauaggcucugaagucagguugguuguauguaaauucugaauccaccacauaguguguagcuuugugcaaagccucaccuuccacaucugcacaaugaaggagaggugggggguaauaacacucuucacagcacuguuguaauaauuaaaugagaugaaccauuuauagcacagugcuuagcaaaauaguaaacacucaguaaauacugccuuuuacuaauauuauuucagauuuucuuuuuuaguucagaauuggugacauuucaaaagcauauaaacaaggacacuuuagugaauuuaccuuguguguggggcauacauaauucuauuuauauuuuaucuaugauauauucugugugcauugaauauuuaccuuccauuuugaauuaugugacaauaaauuacuucauuuuccucgaaucauuuccuuauguuuaccuuucuccgguggcugugugauaugacaguguuaauauauaacaagaaauaauuggaauuuagagcuaguauaauauacaacuugauauauuuaguuucugugaugccaaauauauugacuauaaucucgaugguagcauucuguggugugaagcugaacucgaugaccaaacuauauuaagagguguuuuuuccauugucaacaaauaaaaggaaaaugauauuuuaagguaauacaaauauauuuaaaaguagacaguugaaauauuucuaaugaauguuaauugaauauagguuguguuuauaugguaucauggaaguucugucuugccuuggugcgcacccaguuccugacuuuaagguauuuuauccuggcugccuuucccccggcuguccuggcacugaguauugggcuuacugauucaguuucauuucuuucaggucuuuuuucauauuuacaucguacuucuguccaguaguagaaaauaauaaacacuuuaagcaaaacucuaucaauucuucauuuucuguucugcuggagaauuuuaacugacaaaauauagaugcugcauccugguuuaccacaacucugcguaagcuccuuaagaccaaguguuuuuuugguaccucuuuuccuuuaaccuaccccaauaaugucuaaugauguacuuugcauugaggaaaagaaauacauuuuaagcagucuacuccguuuaauguugccuuuggcggaaaauuaaagaauuacuagaggcaaaacacuuagugaaaagaacaguuggcuaagauggcugccuucaauucucaauacuuacugcuuaguagccaggccaacaauguagaauggcaauuucaacauuggcuuguuuuuuucucauuaaucuggguauacccuucaaaaacugccacaccacaugucauuagcaaguggaugaucuagaaagggucauugugauaacaggaagauagaccaucaucugcuccucuucugccuugugucccaagagcagcugcucugcuggcaggggccgaugguugccacuguuguccaaacaggucaccucuauccccaggcuccacagagccacuugauucaugcuaaucuacaggaauuguguauauauugcagcauauugccauaacaaugaacacacggaccacuaguuugcaguuacauaauaaaaacaguagccuaaauucugcauaauuauuuuuauggugucagguacagcuauauacuuaaguuuugagcaaguaacauacuuuugaauauaagugaauuugaauaacauaucugucuauguaauggguguacagguaaagguaauuggauaaucagucuaccguuagauaccuaauauauggaaaguguaauuaagaugauuaaugcugacuuuaaacuauuuaaauaauuugugauauaagccuuaauaaaauacaguuuagacaagaacauguaaaauauaaaauuuguuuuacauauuuuauuuucagaaaaucuugagucauuuucacagauagcauuaucaaguauugggcuguaagaauuuaaaauuaaaaguuuuaauacaagcacuuuacuuauuuaaaauaaccagcaguguuuguuuuugaaguuuagucuucauugaaaaguuuuuauucuucagggugagcuagaacaagaaaggcaacagcaugaagaaacaauugcugccaugaaagaagaagagaagcucaaaguggacaaaauggcccaugacuuagaaauuaaguggacugaaaaucuuagguacauuuuuuauucuguaaucuuaucaauaaagacaugcaagaaaguuuuucucuuguaugacucacauuauccuauuguuaaagacauaguagcaguauuuuaaauuaaaauuuccugugauuagagacagagaaauuggauuuauuuuccguuugaauucagauuuacuuuuugcauuuccuugaauauaaaauaggcaguaaacuaaccuaaagucagaagacuuauuuguucugguaccuauucugcuguuaauaaauugauaaaugagugauauugggguaaguuaccaauuuacuuuacagcccuuaaguaaauaaucugcuuuccucagcaucauagacuuuugaagaggauuaauuaagcgcuuaaaaaaccuguagacucuauuacagucagugaaaggaauaauucucuuuacaaaguaaaugcaguuguuuuauuuuagacaagaguguucuaaacuucgugaagaguuaaggcuucaacaugaagaggauaagaagucagcaaugucucaacuuuugcaguugaaagaucgagagaaaaaugcagcaagagauucauggcagaagaaaguagaagaucucuuaaaccagguaauuaauaauguguacaugaugaaguuucaucucccuugacauucucuggcuaggcaaauauuguaaaacucuguuaauucacugaauuuuguuauuuuucaugggacaaacuuaaaacuucuaaaaauacauaaaaccaggaagauguauuuauaaacuuauaaaacauuuugcuaaaucauuguuauauaugcagucugaauaccgagaagaauuuauuaugauuuuuuaguuuaauauuugaccugaauauauuuaagauuuuaaaugggaaaguuaccuauguuuugaaagcauaaaaucuuuuuucauguccuuagauacuguuugggcaacagaggguagaauuuauuauauguaucaugauuaccuaaaaccacuuaccaaaaaugaacagcuuacuuuucucaccaaaggagcguugccugcuauccuucaaaaugcuuuaagccccuuagaguauaacauaaacaaaaggugguaguauuccuaaaucuguguucuuauguuaugcuugcuuauuuccauaacauuuguaacuguaauuaaaagaauuugcacauuuucacucauuuacacaacuuuuaaauuuauuaauucuuaacauucuuccgcagagcaagucauuaaauaggauuaacugcaugaaucaccaguugauaagcaagugcagaacuuagacaagaagcagcucaauaauguaguuccagaaaccuaccauuaucuuucuauuugugagcaugaugaauuucaaaauaaauaggauagacuuuuuguaagaucauuuguuacauagcuacauacaugcagugucuuucaagaauacuuggggccugccaauuugugucuaguaucucauaauuauaauguuacucugaaaagagagaauacauauguauguuuacauuuguguauauaugagcuuuugucagucacuugaaacucagacaaaaaaaagaacaagggaacaacuuuuacuagaauuuggacaccacauuagcauugcuuaugauagacuuauuuuacauuccuuuuagggacccacaaggacagauuuuacuggguagggugcuacugauccccuauuguuagacgaguaguaagauucugcccguagaaagauuaaauuacuuugauuauuuaauagagauauauuuuuucaaccagaaaguauugaacauagacaguuuucggcuggguuugcacuguaaaguggcccaccgcuucuccugccgauuuucuaucaaauuguuuuauuuguuauuccuuuaaucucuuguauuaguuugucagaugccauccauacaucucugaauuuuguuuucuucuuuuuuucuuugggugucuauucugcaguucuuuccugagaggaccuaaugcuuugcaucuugugguucuguauaucauaaaauaauguauuacauauuagcuccaguuuuugccagcuuuacagaauuucuaaaucaauuuucaaagcagauuaaccauaaauaucaagauaaccgggaauuaauugguuccaaagguaaaacuauucugugaugcuccaugccaucagaccauuuccaagauuauaauaucuuccuuuuuccacacuucugaauuguuuaggcacacgcauugccauagagaaacuggcaaguagcuguugcacuccaggauugucuaugccugaagaaaauuaagaaaacaagugcacaaaaagaugccccauuaaaguaaaaauggguaugaugcuaucaagguuucauccuuucuaggcauacuagaugacaaaaaauuauaguaggaccagugguucuuuuuaaauggaacgucguuauggacaaaaccuuccuucuuggcucuggaucuuguugucucgacuccuuuggauggauuucuagagccugugcucuaaagccccucuaccaccuucuacuugccugccccugcugcuaagcccuguuccccauaaccuccacccccagcccuaccccuaggacccuuucacugccuucacuccuacuggucucacucauuuccuuuagccccgcaaggccagcagcauucagcacauaagggaaacagacauggcuugggauucaugauauuaaaggaguaagacaggaauagaauuggaguggcuagggcuuaggcagaggcauaugcuaugaaaaaguaucagaggaugugcguuuucacauauuuuaacuauuucugagugaaaaacaugagauuuuuauaccuuaacauaccugaauuucauccuauuuagaggaaaggagugaaauaacuugucuuuccuaugaaucucuugagaguuaaauuagauuuaagccggccaucaugggcugccuaucuaaaaaugagcauuaaaagcauaaaauuuucauuuuacuugaaucagauguuuuucacuucauggaauuuuccaaaagcuauuauuuucauucugugcuacgauucagucaauuuuguaucuuuuaguuuccuuuuaauauuucauuguguucucucuuucuguccaaugauuacacuuuaguccaaggcuaauuaugcuucuuggguugaucaguguauacauuugaauucuuuaaagcgaaaaaacuacauucuuauucuucaacucuauccaaggaaaagugauuauauagaguuuucugugaucauauuuucuauuugugauuuuaaaaugccaucacuuguuccuuucuuucaucuuuuuuaaggcagauuuuauuuuggguccaauauaaugauuuacuuauucagccuuaaagcauuggacugaaaaauuaagggagaugcacagaccauugagacacagaacuauggaauuuuacaguuugagucugacucuccauuuuguagaugugaacuuugagacaaagucauuuagcugauuauagcccuguaucugacacaauguuuauacuucacaaauuuacaaucuaauaggaagauuuauauauagguacuuaaaagucacugugcaguaggugacuuuaaaaaugauccaagcaguuuguacugaguaaugauguguuggugcuggcuccuaccagcucaucauagcuaauugugcaccucucuuaccagcaccacauugggggacaucauguugaugacuugcagucuccugugguaguugcauuuauaucacagauaucagcaaaugcuacaaaucgggucauugcuuuucagagagcuguuaaacauuuaccagcauacaacuggucaggaguauaaagucaagaaacaguauaauauagccagugugcuuggggaagguuucauugaggaggccagcuuuagugggacucaugaauagggcaaaggaugaacacagaggagugacaaaaauauaaagguuuuuauucacuuaguaaacauuuuauuaaacauauguguauauuucccaggcauuacgaggaauacaguaauaagaaaaacaguguugggggcaguuuggguagagguuauuguggaaaaccuugacuuccaagcuuaggaguuuaaagauuacuugguaaacuaugagauucugucaaagguuuguggaaaagagaauaacauguugaaaauuuuauuuuaggaagcuuaauaugacuuuuauauugaaguaagaaugaaauagagacauuucaauuuaaauaucuaaauuaaaguguuuggaacugaacucuugaauggauaccauguaccgccagcuccccucaaccucagccaaacugcucuuucuagaacuagcguccguucacuguuuacugcucagccaucuuggacuccugucuuguacaccagacaacuaguucaucagcaguccccacugcucuaccuucaaaauagauccugcuucucccuacuaccucuaccaccaucugauuccaggacacuuguaguucuuuccuguacugcaacuguuaccuuguuucuacucuuuaccaccuacagauuauuuucuaaccagccaaagugaugcucuuaaaauauuaaguuggauuauauuacuauccuguuucaagaugccuggugacuaccuaccacaauuagaauacaguccacacucaugccauagccucuaguacgcucaugaucuggucucuggcugcauugccaacaucaucuccugucacucucucccuuucuuuuuuacagccaugcuggauccuugcaguucuuggaacacacacaacaagcugaacccaucuuggggacuuugcaccuaccagucccuccacauggaacccacuuucuagagaucugcacagcuuuucccuucacuuaaucaguuaucuacucaaaucuuaacuccacaaaaagagcuuucuuuacuuacuuucucuaaaauagcaccaucaucauucacuagccuccuaugcuuuguucuccuuuguauuccuucagaacauuuacuucuacacaguauauauugauucucucaccuauucacauguaaguuccacgagaccuggaccuuugugguauucacuaggguauccccagcaccuaaaacuguuccuggcacauaguaagcacuuggcaguuguugaauagagugaacagaaugaggcacagagaccaaagacguuuucagauacaugaaauacaaauaauucugcccaauuaggaccuggauuaaguuuaucucacugcaagugcaagagaaacuguaaaaggaucaaucaucugcuuugguagaagagaagaaaauauuaaaguugacuuggguuugagccagacagaaaggaaaucaucaucugagacaaggaagucaagaugagcuauuuauuugggguggggugugggugacuggggagaugagaugguaaguuuucucuuagauguauugauuuuacaaucauagaguauuuuagaauuuuucauacucaguaggaaagggcaaugacuagacuaagaaacagcauuaaaauaaaugcucuuuaucaagagcaguugaaaagccaguuucaguaagguuuguuguaaacugcuuucugauuuuuagaccaaugcuauccaauaugauaguaaguauccuuucuuuuugcucuuuuaaauaugguuacugaaaaacuuuaaauuguacauguggcucacauucauguuucaguuaaagagcacugaugcagacuaucuagaucaugaaaauauugacuaaauuuggcauuagagcucaguacucauucugcuguuguuuuuguuuuuuuuuuccccugagauggagucuugcugugucacccaggcugaagugcaguugugcaaucucagcccacuguaucacugcaaccuccaccuccuggguugaagugauucuccagccucagccucccaaguagcugggacuacaagugcaugucacugccugguuaauuuucguauuuuuaguagagacgagguuucaccauguuggccaggcuggucuugaacuccugaccucaggugauccaccugcuucggccucccaaaguccugggauuacaagugugagccacugcgcccggcugcuauucuuuuucuuagcuuugaauuuucauuauguuagcaagaaauguauucugucucuuuuaauuuuuuuuuuuuuuuuuugagauggaguuucacuuagucacccaggcuggagugcuuugaggugaucuuggcucacugcaaccucuggcuuauuuuuauauuuuuaguagagauggguuuugccacguuggccaggcuguucuugaacucccaacuucaagugaucuguccaccucugccucccaaagugcugggauuacaggugugagccaccacgcccagccauaccacuaccuuucaacuuucaauggaagaauagauggaaguagauucugagguagagggaauagcaagauaccuagaauaaugaucucuuccuguuugggucugguggcucacgccuguaaucccagcaugugggaggccgagguggguggaucacuugaggccaggaauucaagaccagcccggccaacauagagaaacccugucucuacaaaaaguacaaaaaaaaaaaaaaauuagccaggcauggucaugcacacguguaauuccagcugcuugggaggcugaggcaugagaauggcuuaaacacgggagacagaggcugcagugagccgagaucacaccacugcacuccagcuugggugauggagugagauucugucucaaaaauaaaaucucuuccuaagauaacucagucagauuccuugacagguucccuaagcagugacagcagauagugaagcugacccugaaggcucugaguccucucucuagccgucaggaaagcaagaaccuauguugaauguacauucagagcccugggggaaagagauggcuggaguaagauaagggaaagucauaggagagagaaacaaaaagacuaaagagaaauaguguaugaagaaaagagaaaagccagcuagaaaggaaagugagaauagcuggcaugaccuaauuucacuuucuuagaaaauguggaauggaauuaaagucuaccaaaaccaauccaaguccaucauccuuauuuuuccuacgccaaguccugaauucaaaguuaauuggugauauuuuccuuuaaauaugaaaguuuuuaauuucucuucaaucaaaaaacugaaugacauuauuacuuuggcuacauuauauccucuuuuaucacacuuaugugguuaguauucuuccucuuaagauuuuuucuucuaagauaaaugaugcuaaauuguuuucugaauugaucuaaauaauuuuauuaugaauuaauauuuaauuuucuuuucccuacccaaaacucccuuauuagaauuuaaguccauccaguucuuaaauugucaccuuuaggagaagagaaugaagagauggaacuaugaaaucuguaccuagcuuuaaaagagagugugcguuaagaauacugggcagucuuuaaugaauacugagcaaaaucuguucuaugaaguacuguaguaacaccugugaugaaaugcagaacagucggugacuucagaggugcugcagcccaggacacacuuaaaaaaugcuuaagaacauuuagacagcauuauaguaacaaaucaacuuaaucuguuucucuuucaugugaugagauacuaaaaauaauuaaaauauuuucaaucugaaaggguucagugaucauaugauuaugaaguuauguuagaccgagucucugagaaaaaguauuaagcauaaccuaacacauuagcuuguuucuaccuucauuuuauuuguaugaaugaaauucaugucauugaauuuuaguuaaauaucgaacaacaguuugugacuuuuuguuuugggaaauuuucagagcuuugaaucccacuucuguaucuuaauuuguugcuuuccucuagauauuaguauacuugaaauuaacauuagaaaaagaguuuacauaauuugcuuugagaaguuauaguguuguauuuuaaauguugaaauuggacauuuuuuuucuuuuuuggagacagggucucacucuguugccuaggcuggagugcaguggcacaaucauggcucacugcacccucaacuuuucaggcucaagugauccucccacuucucagccucccaaguagcugaaacuacaggcagguaucaccacacucaguuaauuuuugcauuuuuuguagauacagguuuucaccauguuacccaggcuggucucgaacuccugggcucaagcgauccacugccucagccucccaaagugcugggauuacagacaugagccaccaugccuggccugaaauuggaauuuuuuaaaacuuuaauguauuuuacuugaauuacaauguaagacuaguaucaauauuguuucaaggaaguuagaaauuuuuuaaaugacacagguuuugucaguaaugagaauuccuuucuauugcuucagauuucuuauucaaaguagaauugaaagucgagcaauaacaauuauggaaauucauggauauaugcauguguaauaucuuguacguguaaagcauuaguagugcuuuuuauuaagcccuauggcaauguugcucugauuacacaauaguauggugauucugauaaauuauaauuagucuucugggugucuccuauuucccacucccaguauucaguguggcuucaaaggcuuugugugaugauaacccucuggcuuuuuauuuauuuauuuauuuauuuauuuauuuauuuauuuauuuauuuauuuagagauggagucucgcucuguugcccaggcuggagugcaguggugcaaucucgguucacugcaaccuccgccucccggguucaagcaauucuccugccucagccucccaaguagcugggacuacaggugcgcgcaaccaugcccagcugauuuuuuguauuuuuaguagagacaggguuucaccauguuagccaggguggucucaaucucuugaccuugugauccaccugccccagccucccaaagugcugggauuacaggugugagccaccgcacccggccaacccucuggcuuuuuaaguggcucuaaucuuggcccacaucaccuccauauuuauuuauuuauuuauuuauuuuaacucgagguauugaaaucaguaguaagaaauuacuuuugcauguucuuucaugcauuuauccauuuauucagucaaaaugaagugccucugauaugcuaggccuugugccagaauaguaacuggcucagagugaucuuugccuuccuggagcuuacaaucugaacugcaaauuggguguuaaauugcaacugugguaaacauucauguguaacuuggggaaggcgucucuaaauguggaauucuuuaccugagaccuggccagaagaacagcauucugagcagagcgggcagugugugcacagccccugaggaagcccugaugacaccuuuauucuggagagugagagcuaggaagcuggggagguaagaaggaucagaucacgccaggccuucuuugccuuguuagggauuugggacuuuauccaaagagcagugaacuguugaagggcuuugaucagcaggagggugaaauauucaaauacugugauuucaaaacuggcugcaguguggagaauagauuaagguaggacaagcuaggugucacucaaugaacauugcuuuccucuuagaagccuuucuguguucagauuuauauuuuccggacaaauaauauguuuucuuuuuagcaaucuagaauuuucucuuucugcuauuauuaggagagaauuaauuuagagaguagcaaaaacuaaucaauguuaagaguucauaucauucauuaaguuuuugaauaaacauuuguuaaucauuuacccugugccaggcaccaguuuggaugcagaaugugaauaagacaggcuucuguccucuaaaagcuuacaauucaauggauuucaguauuuguauaauaacauguuugcaaauuacaagcauguaaaaccuuguccuauuuucuaaaugauuaaacugagguuuagaacaauuagauaacuaagaacauuguuuuuuauguaccaagugcuaaauuucuaauuaacugcagcaacuuuuuuuaguuauuguaaauuuucuuccucacuuaucucaacgucucauuauaucuauccuucaauaauagaauuccugaaauacauucaguaaacucacuaugcugaagucuccaagucuucucaguugaaaaggcucucuuaaggcucuuuucaugaaucucaaaaauuaacaagaaauuuaagaugcuuuaaaacaaauugacuauuauauaggccaucuuuuuguuaacauggaucuuacucauauagaaugcuucccaaauaaguauuuuuacauacaaauguuuaguuuauccaguauuuauuuaagcagacauggugucuucacuuggacugcaauaacagaauaccauagauuggauggcuuuaaaacaaaauucauuaauuaaaauuuacuuuaugauuuuuugagauagggucuugcugugucucucaggcuggagugcaguaguacagucauggcucaguguggucuugacccccugggcucaagugauucucuaacuucagccuucugaguagcuggcacuacagguacaugccacuaugccagcuaauuuuguuuuuguuuuuuuguagcaacagggucuuacuuuauugcccaggcuggucuugaacuugugagcucaagcaguccucccgccucggccuuccaaaaugcugggauuacaugagccacugugccugcccacaacagaaauucauuucucacaguucuggauucugggaaguccaagaucagggugccagcagauuuggugucugaugagagccugcuucuuggugcauagacagcuaucuucuuacuauguccucacgugguaaaagcaccaagggagcucucugggauuucuuuauaaggacauuaaauccauucacaaggguacugcccucaucaacuaaucaccuaccaaaggcugcacuugcuauuauccucacacuggagguuaggcuuucaacacaugaaucugaggcuaagggaacacuuuuaguccacagcgcuuggggaucucaaccagucugugguuuaaauaccauccauaugucuuuccuuuacuucccauguaauccuuuaauccuauuuauuccaccuccaaaacauauucuagcucuauuugcuuucaucuucccuaguaaacacuaguccaagccacuguuaccaaggucugucuccugucuguccucaucaauuucacuuuucuuacagcacucaaagugaucuuucaugauguaaaucagauccugccacucccuugcuuaaaauccucucagggaggcugggugcgcuggcucauaccuguaaucccagcacuuugggaggccgaggcaggcggaucacgaggucaggagaucgagaccauccuggcuaacauggugaaaccccgucucuacuaaaaaaauacaaaaaauuagccgggcgugguggccagcgccuguagucccagcuacuugggaggcugaggcaggagaaugacaugaacccgggaggcggagcuugcagagagccgagaucauaccacugcacuucagccugggccacagagugagacucugucucaaaaaaaaaaaaaaaaaaaaaaaaaaaaaguccucucaggggcaccccauugaauccaggcuguuauuccguuauuccgacucucacuguccuacuaaaccuuaagccagcuggccccuuuguguaucuccugucucauuucagcuaacugucccucacuaacccuuucuccgcucccacacccacuugcucccagcuugcuuucaccuucaggggcuuugugcuagcugauccacuugccagguacucuuuccccaaaguuaucuccuauuugcauuuaccucaguuuaaauguuacacuucuaaaauaucuuuucuggccgggaacgguggcucacaccuguaaucccagcacuuuaggaggccgagguagguggaucucauuugaggucaggaguucgugaccagccuggccaacauggugaaacuccaucuuuacuaaaacaaaaaauuagcugggcaugguggcacacaccuguaaucccagcuacucaggcggcugaggcaggaaaauugcuucaauccaaggggcagagguugcagugcgccgagaucgugccauugcacucagccugagcgacagagcaagacuucauucaucucaaaaaaaaaaaaaauuaaaaaauaaaauaaaauaucuuuucuuaccaucaacucaauaucuccuccagucauucccuaucacaccagccuuuuuaaaaaucauaauacuuuuuuccuuauuuuuuaauuuuuauacauuuguuuuaaauaaauguauaaaauuuauacagggugagauacauaguugaauaaguugauacaucuuacucaacucuguaucucacccugcacuuaggauguuuucuggaacauaauaguacucuaauuuuuuauuuguuuauuuauuuugaguuggagucucacucugucacccaugcuggagugcaguggugugaucucagcucaccacaacccucgccucucgguucaaacuauucuuuugccucagccucccgaguagcuguagcuggaauuacaggugugugccaugacuccuggcuaauuuuuuuuuuuuuuuguauuuuuuguauuuuugguagagacgagguuucgccauguuggccaggcuggucucgaaauccugaccucaagugauccaccugcuucggccucccagagugcugggauuacaggugugagccaccaugugccuaauuaguauuuuuaaaugaaaaagguuacuucaguuauguauuaacaaacagugguauugccacccagcagcacuacuaugccuuuaccaauugccaugccaggucugugauguaagcucacuugaggucacagcuugggcacuguaccgauuggauucaauauuuucauggccugcaacuggguguggacagagguagugaccauaugaguuuagauuucaaauauauuucugucauauaaagccccaaaucuacaccuagggaagggaugauuuggcaugucacucugauuuggcauauucuaauuuaucaaauaauucaggaaucuuaaauaacauacauauuuugucugaugacaccuuaaagagugaaaauaaaaucuacuucauaaguaaaugguauaaauuuuaguuuaacuucuaguacuaggacaucaguucuaagaaauaaaaagauguuggcugggcgcuguggcucacgccuguaaucccagcacugugggaggccgaggccagcggaucacgaggucagaagaugagaccauccuggccaacauggugaaaccccgucucuacuaaaaauacaaaaauuagcugggcaugguggugggcaccuguaaucccagcuacucgggaggcugaggcaggagaauggcuugaacccaggaggcuuugguugcagugagcugagaucgcgccacugcacuccagccuggugacagagcaagacucugucucaaaaauaaauaaauaaauaaauaaauaaauaaauaaauaaauaaauguaaaaauacuacaacuaaaaguucuuccaauuuucuuaaguuuugugaagucuggagaaguugucucucauuauuguauaaagaauauugaguaugagaaagaauaaaguaaaaaguaaaauuaacuagugauguacauaaaagcaugagaaaguugagauugagaaguuaugaagucaacauagaaaauuaaucuuuuuaucucauauuugcaacuuuaauaaguuauaucauuggauaucuuagucuaaguuauuaguaaaaauuauuuuccaauaaaaacuaucuuuagauugugucacuugaagaaauaauugcaauaugcaaaaaauggaaacaaaagaaaauugcauucuuucugaaaauuagcaauauaaauauaaaaauauagcaauauaaauaaaaauauuauuuuguauuuuuggaagguaaaaaaugaggugauugaaaaugaaauuauauuuucauuucccccauauuaggagggagggagggguauguagguuuuuccaaugguuuaucacuuaaaaucauguccaggcugggcgcgguggcucacgccuguaaucccaagcacuuugggaggcugaggugggcagaucacgaggucaggagaucaagaccauccuggcuaacauggugaaaccccaucucuacuaaaaauacaaaaaauuagccgggcgcaguggcaggcgccuguagucccagcuacuugggaggcugaggcaggagaaugacuugaacccgggaggcggagcuugcaccgagccgagaucgugccacugcacucuagccuggguaacagagugagugagacuccgucucaaaaaaaaaaaaaaaaaaaaaucauguccagaguaaaaaccauguuaaagcaauuuuuccauuuaaauuagcaauauaaauuuaaaauaucauuuuguauuuuuggaagguaaaaauaugaggugacugaaaaugaaauuacauuuucauuuucccccauauuaggagggagggguauguagguuuuuccaaugguguaucaacauaaaauuucaaugaacuucugaaaaaugagccuauguuguaaauaauuuugccaaauauauccuaggaaauaggauuaaaaagauauaagggugucucuucuuccuuucccccuaauauaaaaccagauuauuauuaaauccuuaauuucuagugauuaugucauauuuauuucuggcuuccaaauuauauggucagucaaguuaguguuggcgguuuucaccgcaacucauuucucuuaagagaaauucuccgugaaccuacagcaaagugggcauaaugcuuugaauaguuaucuuguagcuuucugggaggaauuuagaacaguaauauccccucuuggucccucaguaaccaucaucuuuuaaacugaacucugauuuauauggccuagccuuuaguaguuuguauagguaagucugcaagcccacaaauauaucagacauuguuuuaagggauuauagauaauuuagacugugugucuuuaauuucuuuuuguuuaguuuguuucuuagaacuguuuucaacuuguuuucucuugagcacauuauaauuaauguucuguguuuuacucucccuucuuauuccucuuucuuucacuuaguugauuucugaauguuucccuuuauuccuguaaucuuuucuucauagcggcagucucugggugaagcuuugcauaaaucuaucagcaauguaagugagcggcacuuacaauuuguacacaagggcauguugcacuuuucauuuugcauaaacaacaucacugcuuuaaagcuucaacuuauauaaaaaauacuguuuggcauucaauaagauauauuuuguguauggguaauaaaagcuucuaacuuucagucauucauuuguguaugcauacaucuaccacauguauuaauaagcauauauuuauuauaaagccaauugagauuuuauaucucagacauaaauuucauuauuuuuauguuuacuuugaaagauauaguaauauuuuugaaaaacuauuaacuaguugaaucauaaaaauggaaauaaauguaaaauuuuuuuguuguuaaacuaguuuauuuuuugaaaaacuagcauuagugacuuccuuuuuuaaaaguacuggauuguuaugaagguuuaugggaauuagaacauauuuuauacauuguaauguuauaauuaucaacagaugaaaagcaaaauagaguaaaucccuuuccuaagcauugacaaagugaucacucuuuacuuauguacacucagguaugcagaaauucaucuucaaaauaauauuccauuuaacacucauuuaaaaacauuuuucuuuguauaucauaagaaaaagugagauuuauuuucacaccaaacccauacucaacuuguccuuuaaaauuagaugacacagaauugaacauuguugaauauuuuucuugauguccuaaggcagaagucagcagacuuuucuguaaaggaccagauaguaaauacuuuuggcuuugugggccagacaguuucuguggcagaaacucuaugccauuguagugugaaaauacuuauagacaguauguaaacgaauagguaugacuguauuccaguaacaauuuacaaaaacagauuguaguuuacuaaugccagcccuagagaaaucaaagcuuugagccuagagauguccugugaaauucugauacuccuggaaugaaacuauuuccucauaccccauaaguuuuuccuacuaugcaagaaaauaaaaauuuuaccuaguuuucauauucagucuuuuuucuauguaaaaaauaauuaaaauaugcaaauacauuuagcagcauuuucuuucaucucuuaaaagaaacaacaaacauuuaucucaguguugcugaaauaggcuauauuuagaaauucuuuuuagcagugacauagagcauaguacaaauuuuggcaugauagcuauaucaauauagacauuuugacauaugugcuaauugggauagaaauaagaacccaaauaggauaugauuauuuuuaaaauuaauugaauuauacuuuagaauauuugugacagcacagucacauuuucuuuaacaguuguacuuuuuauucauuaaacaaaaaccaccuuauugaaauugccuauuaauaacuagaaugaaagugccuugauucaucuccuacaaaaaaaguaaaaggggcugguaacacaaugaaaucucuuuuauaacauuauagucauugaggaucaccuuuuuacucugucaucauccacagcaaaacaugacuuugucagagugccgugcucugcaggaugagcaccugcccacucccucuguacaugguguguaccccagcuuuccauacaagaauucagugcuuagcacauucaaaaacaagugacuguuauugauacaucuguccuucauagauaacuuucuaauuaguuuuaguuaauaauaagaggaugauuggggacauauuccacaaauuuuuuuuuuuuucggagacggagucucgcucugucgcccaggcuggagugcaguggcgcaaucucggcucacugcaagcucugccucccggguucacaccauucuccugccucagccucccaaguagcugggacuacaggcgcccgcugccacacccggcuaauuuuuuguauauuuaguagagacgggguuucaccguguuagccaggauggucucgaucuccugaccucgugauccgcccgcuucggccucccaaagugcugggauuacaggcaugagccaccgcgccaggccaaauuuacuuuucuuaacuagccuccucaguaauagcacauuagugauuaaagaagaaaaauaaaucauauaauuaaaauauuugagcaccuuuaaacauuuuacaugaccauuuucguuaagucauuggcauaauaauaaguuauuccuacuguccucuacuaagccuagguuagcaguuuuuuuccugagaucugcucagacugauaggcuagcaguuuuuaauguuuuauauauuugaaaggauuggaguuaauacuuuagaauuagauuacuuucuugucccagucauaauucaucuguaggugcuacgagaggggcuuaccuuccagggauuuccauuuaaucccugaauaaacccaggcagccaacugggaagaaaggaaggagggagaacagcuguuguagaagugagggacagugccagcccuaggaagucuaugugguuauuaaaaggaaugggucauaucugaauaucgugaguaccuuauaaaugccacuuugaagggaaggaaaaaacuacaaaaacacaaacuggcuggccccucuacuggaaaaauuauuaaacaucauuaaaucccuuggcguacucaucuuggaagauauauaaaguugagugugugaaaaccaccucauccacaucugcaggucaggacacucucaugguuucacauuugaagugguguuuguuucucuaugugauacuuacaggaugucuguccccaucagcugccccaggugucucuguuucagcugcuauggacauuaagcacugaucuuuugaggugugcccuggagccuuuguaacuuuuguauauaaggcauagccagcauuuuaucagauauaucucuacauuugguaaaaucaucuagccauuuacacaugaucuagguaagaaagcaaaagaaaacaaaacggugaauuauaucaagagagaccuaagccauuacagucugcaguaaggcauaccaaaauauuaacaccaguuacccuuagggauuaagugaggaaagggaaugaaggagacuuuuccuuuuauuuauauguuccuguauuuuuaaaauuuucauaacgaaccacuuuuuacuuugauaaauaggaauaaaaauaucuuaggcagccugggcccaauuccagaccugcuaaaucagaaucucaagggaucagggcacaggcaacugucuuuaugaaaaucugcagagaugauucugauacacagccagguuugagaaucacagauuacguuuacuaucucaagacaugcuuuauuuggagaacacaucauuuguauacuuucuguauucuuucacuuuuguaacaaggcucaaugguuuuugaagaaaaaacaccgauauugcaucaaaaaccaaagguuguagguaagauguagauaauuaaugacaugucucauauugacauucugucauacccaguaccucagauuugauguuucacuuuuuguuuugagagaguucuuccacaaacaccauuauagagguacagagucuuugugaaacuggucuguaaaaaguaggcugggcacaguggcucaugccuguaaucccagcacuuuuagacacugaggcaggaggaucgcuugagcccaggaguucaagaccagccugggcaguggagugauaccucaucucuagaaauaauauaaaaucaguuggugcaugucugcggucccagcuacuuaggaggcugaggugggagaaucacuugagcccaggugguugaggcugcagugagccauauauauaaauauauauaaauauaaauauacaaauauauauaaauauaaauauauauaaauauaaauauauauauaaauauauauauauauauauauuuuuuuuuuaaauggaguuucguuaucauugcccagguuggaguguagugcugcgaucucggcucacugcaaccucugccucccggguucaagugauucuccugccucagccucccgaguagcugggauuacaggcgcccgccaccacucccggcuaauuuuuuguauuuuuaguagagacaggguuucaucauguuggccaggccggucucaaaugccugaccucuggugauccacccgucucggccuccuaaaaugcagggauuacaggcaugagcaaccgugcccggcccauauauuuuuaauuuuuucuuuuugaaauuuuuauaaaacuuuaauauuccauuuucaaaaagacuguaaaacuuuauuuucaaaaagacaaucauuuuuuaaaugguagagacaggagguggcaauuacuaucagugcaguuugaccuuuaaaauugucucuaaaaugucuggcaccuaucaaccaguagaauauauuucauaucuaaauugcuaugcuaagaauuuaaaaacuaaagauuaaauuauuuucugaaauaaaauauuuugguuuauuuaaacaaaauaagaaauagaauuuuuuaaauuuuaacgaauguauagaaacuaauaccgugcacuacauaauuugaauauaauauauaguuugaagcaacuacuuguucucauucuuuauucaacacaagccuuucuagauauucuauaauucuguaauaaaaauacuuaccaaaauugccuaaaccuuuuaaagcagagguuuuuuaucuuuugaguuaaaguuuuacauuaauauguauuucuauugauuauauuaaacucagcuguuuaaauuauagcuauaaaaauuaauucacuuuacauuacuuugcucauugucuuuuaaagugccauguacuuuucaugcugaauaaaagcuauuuauugcaauucugcuaacuuguuuuuaaaaagaacaaaauaaauuuugauauugcauugcaugauuaaggcuuucugcauauaauucacauuacugucuugagcaugaauucaaagauuuucgauggccuuaauauuauuuugaugugcuuucaaaguuaagaauacaaaauaucuaaguauguuugaacacuaaauugcaugaucauaucuuucugcacauaguuuauauuauuuucuugaguguagauacaaagauuaaucacauauccuaagauggaaaguacuauuuuggaguucuuucaagguaaaguauauuacaauguaaaauauuuaaguguauuuuauuuuagcuggagaaauuuaaaacucuguagauuuuaaauauguaacuauuaugcacugugguacuuccagucauucacuuuaaauauugcauuucuucauaaguuucaucuguuaauaggucaaacgugagucaaauuaacguaugagaggucugucgauucagcaaauuuugaaguagguauugcagaaaauaagaaacaccacugugagcugauugguuuccuacuaauugaaguacacacuaaauuugaggaugggauccagggccacugcuagccuauauggcaccuuugugcaaagcagaaaaacauguccauucuuuuuggauggacacagaucuguaccagggcagacagcuuggugagcagaaugcuggguagacuuuaauccccacuuggucaggugccaaguaauagcuuugagaauauuguuauucugcaugugacacacccuuuccagcuuucccguauacauuucaacaaguuauccucagaaacaaaaaaggcagucccauggguccccaugcuuaggcugggacuaggguugaacuuccaaagagaggggguaggugcuuucucuauuucaagaaccaacuugcugggaagagaacggcucuaccgguuacaaaucaguguucacaaaugucuauuuuuguucuuguuacccuuuugugguuuauuuuuucuuucuaggcugucuucaauauucguuuuauccugauuuucauugcauaaaauggugagaagucaugugguauaauuuaucauauuccacaaguauggccuuagcuguggcugugagauucuuaugcgcauaucacauucucacauuugcaggauuuauuucagucuguaagucgugggugcugcugccauuuagagguauaaggaguugugauauuugguaucagaggguugcaguuccaccuuggcuccaaaacuuuaaaauaaccucugaaaccuuagguuuuuguagaaauuaauaagcagaauucauaaaguuugaacagguggagucacuuauucggaaauacauuaaaacagauuacaccuagauuguucauacgauuucucaccagugcuugacuguuuccauaaagccauaugcuaaccuuuauaacuaacucugauugauaacuuuguccagaacccuucuggaaggcuaaucaucacccuaagcucacuacagucugugacuguuccugcugcuuuuuaaagggauaugguggcuugcuuucgaccuuuucuuuuuccaauuaaugauucuuuccuccguucuucucuugcaugucuagugauuccccgccuuuucucuuucuuucccagguaccuuucuuugugacgcaugugaggcaacuuaugucugccuuccaucaauuaaaagagaguauuuucccauuuacaaaaacucacuuuaaaguuuccucuuuucauuggcuuuuuuggccgcagaaacuguuuuaccaguauauaaaagcauagaguguuuuaaguugcuuauggaacacauuuuacaacuuuguaucugguucuccuaaguuccucuuagauuuagacuucuuuuagaauacagauacguaguuucaaguuacaauauccuguguaugagaauagaaauaggucaauuaaaugguuuuaucaaaugcauauaugaacguauauaauacauacauauaccuguuuuauguuuuuauucuucccaaaauacuuaauuuuaaguauauuaagacaucuagaagugauacagacauacugaggcugaugucuguuuucaaaaggagugacaaaucaguuuuccauagugaaagaaaagcaccugacauuauuauaauggcugaauaaaagauugugggacguuugagacauuuuagaaacuuaaagguuuucaauaacuuugaguuaaaugaaaaauaaaaauuuacaugaugauucuaaauuauaaacugauguaucuuuuaaacaguagguuuuuaauucucaaauaaucuuagcuaauauuuguugaaugcuuaguacaugccagagucuguucaaagugagcuauauguaguaacauagccuggugagguguugauacuaacaagugacagagcuaggauuuuaacucagagcucacacuccuauuucacuuuacuacuuuacaaauaagugguuuaacauacucuuuccucaaagugacuauaaccuaaugaauauguuaguugucuucuguuuuuauuucauauuaugaauuuuuauugaaacuuaagacagauauucauuguauucuaaaugugggcugcaguguucuuuagacagucuauaaacaauauaacuaaacuauuuucagaauaauuacagaaaguggaauuuuaaauggugauauuaaaugguuauuuuuaugauauauuuuagaauauuuuaaauggaaacauuaaggcaguuauuuuacuaucauuaauaucuuugaaaugcuuuucccccuuugcuggguaguuugugaacuaugccuuguauuuauucuucauuguguaccauucuggggcauagauuuccuugcugaaacagaaucuggagauacagcuuucccagucucagacuucuuugcaacaacugcaagcccaguuuacgcaagaacgacagcggcuuacgcaagagcuugaagaauuagaggagcaacaucagcaaagacacaaaucauuaaaagaagcacauguccuugcauuucaaacuauggaagaggaaaaggaaaaggagcaaagaguaaguuuuaugugacauacguucaaauguaacccaacugccuaauaauaauuagucuucaaauuaaaaaaauuuuuuuuucuauuuuuugagacagggucucacucugucacccaggcugaggugcagcagcacaaucauggcucacugcagucucgacuuccuagacucgugauuuuuccaccucagccuccugaauagcugggacuauaggcgcacaccaccaugccuggcuaauuuuuuaauuuuuuuuuuuuuguagaaacagggucucgcuauguugcccaggcuggucuugaauucuggggcucaagcaauccuuccaccuuguccucccaaacugcugggauuacaagggugagccacugugcccagccuguucaauauauagacaaaauacauugaaucaaauugguuucaugaugauuucuuuauucuacugaaaugacccuaauuauuuuuucuaauguugauuaucuuaugucuaguuuucuugaaaaugaaccuaaaacauuuuguauuucuuaaauaauaacugaguuuuaguaacuguuuucuauuuuguuugcauuuuccuuccuauauucuagcauaauaauuugaauuugucuuguucuaggcucuugaaaaucauuuacaacagaagcauucugcagagcuucaaucacuaaaagaugcacacagagagucaauggagggcuuccggauagaaauggaacaggaacuucagacucuucgguuugaauuagaagaugaaggaaaggcuaugcuugguauuuugaaaagauuacaaucuugucauauucauauguacauuuuuaacauuuuuuaaauucaacauaaaaucaccaaguuuuauuuuaaaauuuugaaacgucaaaaugaauaucuaaguguacugcauauuuuauuugaaguuaccacaugaauaggcaggacacaaacaguaaagugaauuccccucagcucucucuguacuccagcuaugcaagcaacaccacugguacucuaaucuguccuuuuuggacuaaguggacucaggacauugaggugucccagaaaucaaucacugcucaguagaaaggacauggagccacauguccuuagacugcauggucauaugguuuuuuacacuucaagauuuuguuuuaaugggaaaagucaguauuaggucugacucuucuguugagguauauauuucuuugagauuucuaccuaugagguguucacaucauuacuuuuuauaaggagguagguugaguuuugaagaaaaacuggauauguauuuaaagauuuguuuuggguuuuguuuuuuaugucauucaauaacuuuuuauucuuaccaucucauuuuccuucuguuuggcuuuauuccaaauuaugcuaauauuuuuaacauguugucauacuucaguggcacacucuuuccaaguaggaauuuggagcaaagaagacugaaguguuaucaauauuuugggccucaaagggaaagccgucugacccuguuucucaucgauaauguugcugggagucccagaccaagucguuaaagcucuccucuuccuccuuuaaaacccacuaugacugcuagcaugaaaaucagauuaaauuuagacauuugucaaagauuugugaaaagccuuuucaugugcuagagauugcugagcaaggagaauuaaaaaaugaacuacugcccugucuuugcacaggaauuguagugaaauguagaggucgccuuuauagaaauguggccaaaagggaauacacauuccacagcuuugucagggcaggcaaaaacagucccaguguuggaacuauuguuguuuaguccauugaaacaugcuccacuaaacaugauucaaauaugucuuuguuggccgggugugguggcucacaccucuaaucccaguacuuugggaggcugaggcagguggaucaccugagggcgggauuuugagaucagccugaccaacauggugaaacugcaucucuacuaaaaauacagaauuagccaggcgugguggcgcaugccuguaauccuagcuacuugggaggcugaggcgggagaaucgcuugaaucuggaaggucgaguuugcagugagccaagaucacaccauugcauuccagccugggcaacaagagcaaaacucugucucaaaaaauaaauaaauaaauaaauaaaauaugucuuuguugacaaaaagaguuuugggucuuuaaaaaaacuuuuauuuugaaauaauuguagauucacaugcaguuuuaagaaauacuacagagaucucuuuaacuaguuccuccagugguaacaucuugcagaacuaugguacaguaucacaaccaguacaaugacgaagauucugucaagauucagaacauucccauuaccaugaagaugacucauguuguucauuuauugccacaccuauauucccaguccuccccuccuauaacaccuggcaaccauuacccuguucauuucuaugauuuugucagguuaagaaugcucuaauuuuauaaaugaaaucauacaauauuuaaccuuuuuggggagaagggauagggucucacucuguugcccagguuaagaaugcaguggugugcuaucagcucacugcaaccuccaccucccggguucaagcaauccuccugccucagccuccuaaguagcugggacuauaagugugugcugccacacccagcuaauuuuuguaauuuuuguaggcaggguuucaccauguugcccaagcuggucucaaacuccaggccucaagugaucuacgggucucggccucccaaagugcugggauuacaggugugaaccaccacacccaacaauauuuaacauguagagguuggccuuuuuucacucggcauaauuaucugaagucaucuagguuauuguguguaucaacaguuuguuucuuuuuauugccaaguaguauucagugguuuugauccaccguaguuuguuguccuuugcccguuaaagaucaccugagcuuuuaguucuuagcuguuacaaauaaagcugcuauaaacauucacguacaaauuucauauaaacauaaguuucauuucucugggauaagugccuaggagugcgguugcugggucauauggcagcugcauauguaguuuuguaacaaacugccaaacauuuucuagagugauuguaccauuuuccaucccuacuagcaucauauaaauuuugcucacauccucaccaacauuugauguugucauuauauuucauccuuucugauaggaaugugugauaacucauucugguuuuaauuugcauuuuccuaguggcucaugauauugaacauuuuucaauaucaugagaacauugaccagccaggcuccuuuagggauauuuuugaagaauucuuauuugggugagaaguugccuccuaaauauuuguuaugguaccauuaaacucuaaaauuucauucuuuuuuuuuuuuuugagauggagucucacucuguugcccaggcuggagugcaauggcgugaucucggcucauugcaaccucugccucccagguucacgcaauucuccugugucagucuucugaguagcuaagauuacaggaaccuaccaccaugccuggcuaauuuuuuguauuuuuaguagagacgggguuucaccauguugaucaggcuggucucgaacuccugaccucaggugauccacccaccucggccucccaaagugcugggauuauaggcaugagcccccgugcuugaccaaauuuuauuauccuaauagugaaagagacgaauuaaaaauacuucaucuccauuagcacuuuaccugcauacugaaagcauguauaaaaauaccuugauccgcuuaaacauuugaaauauuuuauauccucaucaaagcuacauuaacuuuaaauucaugauaguauauuguagucuguaauauuuaaauuugucauaguuuauaaucuauuaauuuaauggacauacacaaguguucuaauuuuugaaauaauuuuuuacuucuauaauuuuuaucuaaaguauugauaauauuuuuuaaaugugccaaauguauuuuugccuugcaauuccagcuuccuugcgcucagaacucaaccaucaacaugcagcugcaauugauuuguuacggcauaaucaucaucaagaauuggcagcugcuaaaauggaauuagagagaagcauagacaucagcagaagacagguaaguaagaguauucuguacucugaugauuucuuaaauuugaauagauugaauguucauaauuuccugaaaauuauuuuguaauaacuuauuuucacuaguuaucacauucuauuuauauugaagagcuuuauuugauucaguuauuuauuuauuugagacagggucucgcuuugucacugaggcuggaguggaguggcacaaucacagaagggagcuuaacugucagauaacugcuagagcagcacuaaacuaagucugcuuuguaagccaugugauguguguguuuuaggagggccuccuuagaugcacuuucucuuuagauuauaggcaguggugccacaauuauucuucaaaaucauguaaaacuuacugaggauguaagagcacuguguucuaaucucaacuaauccacugauuauaaaucaucuuuggguauugguuuccucaucuguaaaaugagagagauguccuuugaccuuuuggguucuuuguaaucugacauuauugaagcuauauccauauacacacuauauguguggaaagagaacaggccuugagguuuucucauuucagcaguuugcuuuugaagaagcaaugucagaaugauuacauuugacauuccagugugucauuuucuuucccgcagauaaacacagaaaucaaauauguagaaaacuucuaaaaaugacuuuuuuuuuuuaacagaguaaggagcacauauguagaauuacagaucuacaagaggaauuaagacacagagagcaucacaucucugaauuggauaaggagguucagcaccuucaugagaauauaagugcccuaaccaaagaacuggaauuuaaggggaaagaaauucucagaauacgaagugaaucuaaccaacagauaagguaugccauuaaguacaacagaaggaauaugcagugucaucugaaaaacuguugugcugauauuuaguaaucuaugcuaauuuugugacuagacuggcucucuaguaaaauauugaagaccucuuuuuacuuuauuugaugacuauguuauaaucuagaacacagaugaaauguuuauaucuugaaugauguaacauguauucauucacuuuggaaauuguauauaauuaacugaauucuuuuuaaaauguuauuugaaaaagcauuaaaggagacaacuuuaacaaagccagaagcuuauagcagaaaguaaguagcuuaauuuaggcuguuuacauaaauuuucuauauauuauaccaaaaaccauuucaaaucugguagaauaauagaaaguuuugaaagcuugacuucagaauaacauuuucuuaacuaaaaauaaaucaaacagguugcaugaacaagauuuaaacaagagacuugaaaaagaguuggaugucaugacagcagaccaccucagagagaaaaauaucaugcgggcagauuuuaauaagacuaacgagcuacucaaggaaauaaaugccgcuuuacaagugucguaagucauauuauauaagaaaauucauauguggauaauaaauuuaggagcacuguguuuaaccucagauuagcuguuauuuugacucuaauaaaaaggauacuuuaaaaagaaaauuuuagugcuguguuacagaugguaauugcagugcuauauguucuuuaauuaggaugaggcaguugaaugaugauguuuuaucaacuaagacugcaccaguucugcuagaacaguaaucuaaagaauguuccuuaggaucaugaacuaucaugccauggugaaaacugaaaauauggcuauauauaauguuaaguaaaaagaauauauagugaacaauaggaauacuaugauccuauauacacacuaauaauguauauuuuaccaaaauaucaaaauaucuuaacaaauaccaaauuuuaaugguaaugguucccucaagagaauggauuaggagguacuggagaugagaaagagcaauucuuucuuuuuauuuuauauacuccacuuacauauuguuuaaauuccuacaagaagcaucuaauugucuuaugauuuuaaaaaucaauaaaggggaaaacauuacaaauaaaguuaccgcucauacauaguaacuacaguauuguuaaaaccaaaguuucuaauucuuauuuaauguucuuuggaaacauuuaauaacccuuccuuuccuagaugcuuguaaacugauguagcuaaugcaguuuguacucaguccaucucuguggccuaaacccugguccaacauaaguuauuucagaauuaaucuacucuaagcugcugcuaguaguuuauucaccuuuagucucuccucuuccaaucaaauauauauauauccacauacuucaguaaagucacaauuagugacuaaucccauuauccuucaugucaaagucaaauguaaacuuaacagcuccaaugugccuuauucuacaucauccaacagcaacccuuauuucuuauucugucuuuuuaucagccuaguggaccuucuugguuuccuguguuguccucuacagucuagaauaaccuccuguguuguugccguuuuaaguauuguccucaaaucuaaaaauuaucuucuuuuauuugauuuaugugaccaauucaaucuuucgguaaagauuguuacauacauaggcaacaccacaacacacacauacagacgcacacaugcacacacauguauucacuuaagccacagcagaaaacagguccccaguuguuauuuacuugaguaugcugugagaugaggugcucuuucugaugggcauauucagaaucguuacauuaguuaagcacucagugaauguuucaugaaugaauuuuaugauucuuucuccaucauauuuaccacuuuuugaaguugccuuugaaauggugaggaaacuuguguuacuucccuggucacucugaguuugguguuugcuguuauuagaggugauuuuuaaauccuuuugggccaaguaugagcucagguaucugccuuguauaacagcucauaaccccauacuuuugcagaaaugauuuacaauagaccucaauuccuuggcuguccuuuuuccuggccucagugguacuccucagacagagacugaaaucuuggcaucccccacuucaugcuccgaaaaaacauagucacagaaagaauaacgucagucugucuguguguccugucuccuuaggaauguuaauuuacaaagaguaaagguuguguccuuguuuuuccuuuauucuguugcauaugguuuugcacauuaugaaucuucaguagguagcaaauaacuuaguuuuugauuuuaugaucauuuuuaauaaucaaagaauuaguauuugcuuuuaaguaaacuaccugcuuuucuagacucuccuuucauuuuaaugcuuccacuuggguccaugcuaaccaauuauguuucuuuuuucaccagaaacuuacugccaccagguaauuacccccuagcuuuagguguuuacuccuuuaguuaaaaacaaacacacaccaaauuuauauuugaccaacacuguccaauagauugugauaaugaaaauguuuuguaucugcuuuguccagguuaguagcuucuagcuaaaaauggcucuugaaugcuugaacggugauuagcauaacugaggagcugaauuuauaaauuucauuuaauuuuaauuaauuuaaauguaaauagccauaugcagacuaauggcuacaauguuggaaaacauaguuuuagacaauugguuguuucuguuucauauccuuaaaugcagccugcuuggaucugcugaaugguuuggauuuagacagguagugagcagggagaguugguuccaacuuauggagcugugggaaacaguaucuguacuguucccaaggacuaggggauucuauugaaguuccuaaucagcugcacccuggcuuuaaaacuuugaaaucagaagaguccuguggauuccuggaaggcaguggugcugggggcugaagggacauggugcagccugacaggccacagccugccacugaggaagcuugggggcagaggcagcuucuugcuucugcuccugccccaaauccuguugaacucccuuccuggagagagaaggguggggcaacacauguaaaggaugggaaauacccucuaagucuguaaguauuguagaaguggugaugaguucuauauugcuuauggaugaugauuauuacaaauccgcuuuggugcuggaaguuaaaguuuuagauuuuucagagaguucuauagaaauuuuauuuuucagugauauaguaguaaaaacuuuauaucuaauaaaaauguccugauucugguuucuuuuagaaacaaaugagaaaaugggcuguuugauuuuuuuuuaucugaaugauuuacucuguaaguaaagaaaguucaagcuaaaugaaaacauucucuacaacuugaggucauggccgauuuuuaauaugcaaaaagaugguucugagauuacugauuguuuagguuuauuucacaaaagaugauuucuucuugagagaaauguugaguuucuauacuuagauuuuaaauagaucaguaauccccaauugaaaagaagcacuccgccacaccugaauuacuaauuuuuuguuuaaguuuugaguccuuucaucuauaauacccaaauaacuuuuguuuuuguugucauuugauuuuuaauuuaccauucagguaugguuguaagcuuugugagguacggaaguagucuugucacaaaucagagucugugcguaauuuaugggaaaagaaagguucagcguuaaagugcuucaauugcuauauuuccuuuauuuaagaguuuagaaaaugaugauauaggaguuuuuucaucuuuauaaaaucaaaguuauaggauauaugugugcauaauauacuauuguuugguuaugaaacaauaguauaccauuuuugguucuaaaauucacugauuuuauuuuuuuauccuuuucuuuuucuuaacaagacuauaacuuggaaacuuuguauacagcuuuuuaggcauuuguaauuuaggccuguuguccaugaaucacagacauugaccuguauauugucagagccaaagaaagcagggcaugcaugccuggugagaauccaucaguggcccuaauuaguaauuuuauauguucuacuucuccuuucuccuuuuuucccccuuucucuucucucuucuauuacuuuuaauggaaaucuguaaaauuugaguaaaaggcuacacuugugugguauucucaaggcggcauuucccaggcuuuaaucauccuugggaugaucauauacauccuugggaauugggucauuucuggcuacguauauuauuuucuuaauauuuuuaauugacuuauuuuaacuuaaauauuuaauaggaaaacuugauaucacuacaguagaacauuuaucacuacugaaaaauuuuauccuuuauucuaaauaaaagcuaagcuauaauuauaugaauguaaauuuugugaaaauaaaacaauguuauuagauucuagcuagcauuuaugcugaaguccugccugaguguugugaaauagaguaaugaacauaaguuaugaaggcaauuuaagauauacagacccggcugggcacaguggcucaugccuguaaucccagcacuucugggaggccgaggcaggcggaucaccugaggucaggaguuugagaccagccugaccaacaugguaaaaccccgucucuacuaaaaauacaaaaauuagccgagugugguggcagacacuuguaaucccagcuacuugggagacugaggcaggagaaucgccuggacccgggagguggagguugcagguaacugagauugugccauugcacuccagccugggugacagaacaaaacuccaucucaaaaaaaaaaaaauauauauauauauauuauauauauauacacccaaacaauuuuuuuuucuugugauuagaaagauuaaagaaccaacuuaaaaacagcuguguaugcaggaacaaaaccaaacuccacauguucucacucauaagugggaguugaacaaggagaacaugugggcccagggaggggaacaucacacaccagggccugucacgggguggggggcagggggagggauagcaugaggagaaauaccuaauguagaugauggguugaugggugcagcaaacccauguauaccuguguaacaaaccugcauguucugcacauguaucccagagcuuaaaguauaauuaaaaaacaaaacaaaacuguaucaccaguuguucacaccuggacuaaauuuuagaagcagugcugguuaugagagcugccugcggcaacugaagaaaagaaaaauauugacuagucuuggcuugaaauggauaucggaauaguaucaaguuuucuuucuguaaaaauuuugaaagacuaguaauuaaugaaauauauuugcaaguuaaaucuauaucauauuacuuacuuguucucuccuuuaaugcuuuccuguuuguguuuauauggauuauguuuuuucuauuuaaucaauuauauuuuccuauuuaauauccagguguuuuucuuauuaaacauuuuugaugauguaaaaauauuguauuaguccguucucacgcugcuaauaaagucaugcccgagacuggguaauuuauaaaggaaagagguuuaauugacucacaguucagcauggcuggagaggccucaggaaacuuacaaucauggcggaaggggaaguaaacacauccuuauucacauggugacaggaagaagaagggccaagcaaggggggaaaugauuuucccuuauaaaaccaucagaucuuuugagaaguuacugucaugagaauagcauggggauaacugcccccaugauucaauuacuucccaccagguuucucccaugacacauggggauuguggggacuacaauucaagaugagauuugggugagacacagccaaacuauaucagauauuuuauagagaagauuaacugauaauaauucuguaggcaaaggauguuuaagcuaaauaaaaacacugcaauuuggauucagggauagaccuuuauuaugcaaaaaaaagugguucagagauuguaacugauugcuuuagauucacuuuaccuuaacuucucaauuaacaaaaaaauagaaauaauaguuuuaaauaaggcuuuaaauuuaguuguuuagcuaccauuuauaccaaguauucuugcucagcugcgggaagcaguucauaaaucuuguacuuugcuuuuaaugauaaaagaaagugcuccagugaccucuugugguuucuccaacauaaaacccaaauugccauuucuuuuacuaguuuaguauuucucgacucuuaauguuugcccauaaaauacuuuaagaguuaacucugccauauugggauaaaaugcaaggucacuuuauuugaguuaacaaaucacauuauuuuucacuuggucucuauugucacaaaagaacaaaaguuaaagauaguggaacuuaacacauuguacagcaagguuguucaacccacggccugcaggccauaugcagcccaggacagcuuugaauguggcccaacacaaauucguaaacuuucuuaaagcaugauaagauuuuuuuauugaguuuuuuuuuuaagcucaucagcuaucauuaguguuaguguauuuugugugcccgaagacaauucuuuaaauguggcccagggaaaccaaaagauuggacaccccuguuguacaacuuaccucgcacugaucugaugaaguccuagcugauccugagacaaucacuuccucacuuccucaucaccuucauaccucccaacacucuaauugagaacuuuagccaggggacuggauagagggccuaauauguuaucuccaaaucuuuagcuuaggcugaguuuuuggagggauuuuaugguacucaaauacacugagauucagguaccucucuaggguuuugggugggaauaggaauguauaacugauuucuggaagauagaucaucuacaaguuacucaguauucaugagugaauaauuuuuucuaagaaucuuuauuaaccauaauuuuauugaauaauguuauugaaauuuuaaguucuauccuuuauauccugaaaacaagauuuuuaaaauuguucuaaguauuugcauuuucuaaaauugaaagugcuuuuucugaaacuaagccagcaguuuccauuuguauucucuucagucugccccauccuauauucuuagacucagcaggaugugucaccugcuuauaaaaaguggccuauauuuuaacguucaaggcauucaggccuauuaccaccucauaucauucaggacagaauaggcuuagaagggaacauaauucuucucuuaccugaugaaacuuuuuuucaguuuguauguauuggcugauaauauagaauuuuuaaacuuucuuuucuauaaaccaggaaaaaaugacgucauacauguguguccuuuguuuugcuuucaucuguauuuguuucuuguccuuuuuauauguuaccaagccuuguguuaucacacaguauuguauugugauaagcacuuguaauagugagccugccuuucuaguaucaaaccuguuauuugucagguuaguaucauucaacauauaauuucuucugcagagcuuaucuccagauacugcucaccuuuucuccaaauacucuggaaugacuuaaaaugagugacuucuucagaaguaaccugcaaagccuuucauaguaccaucuaccccuuuaacuccuuuaaugcaacuacugcucuugaagcagucaugucauuaugcuuaaaaguuuuaaggaaaaaagaaguuuuguuucagauuuuuguguguguucaacuagacuaauuuuuuuaauguagguauuacagaagaauguaucugagugauaucaaugagcuaaagucuuucuuguuuucagauuagaagaaauggaagaaaaauaucuaaugagagaaucaaaaccagaagauauacagaugauuacagaauuaaaagccaugcuuacagaaagagaccagaucauaaagaaacuaauuguaagauauuuugguuuuagucuaaccauguuaguaaucaauagauauugauugggaaaauaugggacaaucuuuuuaaguaaugcuaagugaaaauagaaaacacagaacaugugcauugugauugaaaguucauugaaauguuuaugaauaaaguaauuuuuaaaauuuaaauuuggcauuaggguaagggaauuguacgucuuucauuuuuuuuaaaagaaagucuuuuugauacauauugaauguuuaauaauaugucacugccaguauacaauuaauauaccauugaaguguguguauguauguguguugcacauguaguauuaggauuggcuagcaaagaaaagccagcacauucaugcauuagccuguauuguacacuaacagguugagcauauugauuuccuaaaauguguccuagcaaacacuaauccaaaauuuuuacucuauagaaaaaaaauguuccauaaucuagccacagaaaaguugcaugcuuucucuuggacggucaguaacacugagguucucucuuggaaagucaguaacacuggguucuuaauggcucugaaguuuaucagcuaagaaaauacggauuuaacaaugaauauacucuuuaaccauucauaucuucagcugaagacuuuggacuuuagcaugcaaaaagagcauaagagcaacauguauuucugaaguccuuuuuccuuaaugcaucucuguuugcauuuaggagaggcagccuguugucugagacuagaaguuccugcugaaagcaacagguagcagauuggggaucacagguagaauccaggagcaggcuuuggagagaugagugugugcugcuucaauccaccagccacccaauuuucuacauauugugaacaugagcacaggccuuauagauugcugcaucugguagcagcagacucauggaaaauuauauuucacacaugaaaucagcaagcauaguaaauguauugaaacucuguuccauauaaauagcuauuaauucccaguucuuacugaggagguguuauaauuguauuuuguccucacagcaaauacaguaaagcaacuuucgaaagcagcacagcucaccagggaagagccaggauuguaggcaaggguuguuccauacuccuuccacaacagccugauuccguggacugugaggcacauaggucaagauuagugauuugaaugacaguggugacuaagagaggcauaaagaauucuacuagauuucacuagaauguaguucugcuagagcacagcccugcauucucccacacacuguuguauuuacuuauggccuucccacauucugcuuacucaauuagaacaucuuguuggugaagccaaagguaaagguuuuaucucuaugugggcaaucacuuuuucccuguucuuugauuaccauugcuaucauagauuaauaucucauauuagaugcaaucgaaucuauuuacaguacugaagaauaaugaggccggauaugauggcucaugcuuauaaucccagcacuuugggaggccgaagccagaggauugcuugaggcuaggaguuugaguccaaccuggaugauguagugagacccuaccucuacacacaccaaaaaaaaaaaaaaaacaaacaaaaaaaacuuagcuggguaugguggcacaugccuauaaaaagaaauggaaauaaagauuaaugauauaguuucauccuuaucuguggaaacaauucagucaugcccagagccccaugaauguaaguuguaaaccugcccaaacugcauagucagcccugugaaacagcuaggaccaaauaaaacauuuagguccacuuuugaaggaaaagggucaagugcucggguaugggguuuaaaagguguugaaaacuuaucccccaacauuccuuaagacagcagcaaucaugucaagaaaucuuuaaacaaaguaucuaaaucuucauucagguuuuauaguaaauuuuaaaugaaauggcguuuauacauuuauguuuuuaaaauauuccauagaaaauauuuaaaagauguuuauaauucuuuugcauaggaggauaauaaguuuuaucagcuggaauuagucaaucgagaaacuaacuucaacaaaguguuuaacucaaguccuacuguugguguuauuaauccauuggcuaagguaugugccguaaacacuguagaauaggaaugugguuuaaaaguugguuaaaaauuuggugaaaauauuuggagcagcauaguuagauaaagcucccaaaaaauguuuucuucuauuuaauaaucuagcacuaaaacuuaugaauuauuuauauguucauuuuaagaaugaaacugaauacuacucauauuccuuuaaauauauuuuaccaauauuauaaaacuugauucuaccuuuuuuucauauuucugaagaaaacuaaccuucugacucugcuuaagacuauuucuuguuguuuucuuauuguucacaaucuucugcuuaugguccagaaagagacuccagcccuggauacccaacagcuguuccugguuuaaggccuaacaucuuaauggaccuuggguuggacauguauuuuguugccuaccaaucgucagagaagggcuuuacuucucucagccuucugaccguucuuuuugguuugguuugguuuuuuguuuuuguuuuggagauggggucucacugcguugcucaggcuggucucaaacucuugggcucaagcgauccuccugcuuccagcucccgaguggaugggauugcagguguaugccacuuugcccagcuuuaugaccguucuuaauuaaaauugaguaugacuuauuuugauauuuguuacucucuugggacaaaaagaagagccuugaaauagacauggccaagucuuauaaaucuuuguacccuagcuucccauggcuccaaucauguuuuggguauaguagguauucaguaaauauuuguucaguugcaaaauuucaucacauucccuauaagccaccacaaauuauucugugaauaaaggaagucauaaagaauaaaugauuauauauauacauauauauauauauuggcuucauaggaauuaugaaucuuauggcagaaaucaguaguagaauaaauaaaagugauaguuccaaagcuguuuuucaaauucagauuuuauuaaguuucacgucaugccuaauuuuuauuaggacuuuacccagaaauuuuccuuuccuuucacagcucguaaaacuucucuauuaagaacacugaaucuauccuuccuuuacaaguuaaaguguuccaaacuuuaaacuugaauguuuucuaaaauagaaugacuguaguggcauguagcuguaucucagagucuaaaauacugccuggcagauagaaagcucugaguaaauaauuggugaaugaauaauuauaauuaguuuuaguuuuuuaauucauaauuuagggugaaauaagauuuuaauuauaaagcaagauuaugagguuuguggaaaaaaagauauacuaaaaauacuccuuuucauuuauuuauuuuauuggaauuaaauuuuuuagcugcaaaaugauuacuguagaacuuuaccaguauucuuuugauuucuuaaaauagaaaccuuaaguagguuuaauuaugcccucuggugacuagaauaagaaaaugcaaaagauacaucuuuguaagaacuuucaaacuacuuuugacuccuaauagugacuuuaguuuucacaaauaguucugaggaagguauuauuauuauuuucuuuuucugguuaugcuaaaauaggauuuucaucagagacucuacaagucacagaauaugacagaggaaaauguuuagacaaugagauaaauaaaaauaaaaguuccaucuuguauauuaauugcauuuuuucccaaacucgaguuauuucccuaaaaagcuuacaaauuuaauugguauacaucuaauuaguaaaauaugagaauauucuaaauaucuaguaacauguuaauuuuuauuucucauagcaagaugaugaucauugauucuagagaugugaauaaaauacuuugagacuaaaguuagugaauugcaagcugauagauuuugauaaucugcaguggaauuugucuuuuuaucucuuaauuuuaaagacacauuaaaaaaucagcugauuacuauuguuuuguaaccuuuaaaguuuaaaaaauaugagccaauuaaugauacugccaaguaauauggaaauuagacuuaauuaugcagauauaacuuucucucuucagaaagauagaugucacagugaauuuaaaaccagauuauuucucuuaagucagcuuuaggucuuuaguagaaaugugcaauuuguuucaaacuacauugccaagcauuuucucauuccuuuuuuuuuuuccaggcaagaacugccucccuuugacagauggcuaaauuucauggacucucuuuuaaaauuauguuuaacuuuaccccuucuccuaauuuuagccuaaauccauuuaaccuucuaucugcaagacuugcucucuccccuaauccuuuuucccuuuucuucccaaaaggguauucuuuaccccuuggcacucuuuuuaccuucucucucauuccucgugaaugacuccuaaauguuucuuccucauucuuucugcccugguagcaugucugucuuugaggauuccauguagauaaaaaauaccuccaaggauucccagaccacaguuuggguaacacugguuaauuaacauuuuaauuuaacauaaagcuuccaaaauuuucccaugccaaauuucuaucuucuaccauuccuauuuucucauuuguccucaugcagggacuauccucacauguauuauuuuuaaugcagcaaaagaagaagaaugauaaaucaccaacaaacagguuugugaguguucccaaucuaagugcucuggaaucugguggagugggcaauggacauccuaaccgccuggaucccauuccuaauucuccaguccacgauauugaguucaacagcagcaaaccacuuccacagccagugccaccuaaagggcccaagacauuuuugaggugagacccgucucaccaauguuuuuuucuuuucuuuuuuaacuugagaaauuuaccuucuuacauugcagaaaucacuacuuuaagaacaaccuaagaaaaauuacuaugaaauauuuucuucaaaguauauuuauccccucucuagagaacuuccuuuugacuguguuaaaaagauuuuuucuaauuuguggucaucagucaauuuucuaaguacuugaagagguguuaauguaauuuauaucauuagaauuuuaauauuaugcacaauuacuuuauuuuuaguauugucaccaauuuuuaaauuaacaauccauccuuauuguagaacuuuaaaauaauuuuuuguuuacuaagugguuuuuguuuuuuauauauguuuauuuuuuucccuuucuuguuuaccaagauuauuuauaaauauauauauauauaugcuuauugucaaaauagaaacauacguaaacucugggaacuuaaauauacuuaugcaaaaacuaaauuuagaaaaaauaaauaauuuuaaaaauuuccauuccaauuuuuuaccuugcaguuguugauuaaauguauuagcaaauuuugaaugaaaugcaaauuucauuagaaauuuagccauuagauaaagucagaaaguacuguuguuuuaugcucaucuuacuauuacugauuuuuugcugcuuuauguuuuuuuucuuauucuuacuaaaucuuagcagugucacuaguaauagucuuacaaaguaggcagguuuuuuuaggcuaagugauuagugacauaguuaaugauuaacaaaaaaaauagcaagaaugaaaauuagucagauacaccucugaauuugucuccugcuaaauauuuuguguugcuuauuuucccuugugcauggguauguucagguaucaguaagaugcaugugcaugagcucaaggaacaugacuacuggaguuuccauuacacauuguugcgugccuuguaauuuuccccaaagacgguagggauucuuuuguuuucuuaaguagcccaaagaaucuuuaguuagaauuaagaaaaguauaaacuauauaacaucaauaacgggggaaauuauauuuuuaguguucucccuuuccuggaguauuugcauagggaauuaugaaaugaaaauuuaauguaaaaugcauauaguaaaaaauacuaguaguuacuuuaguuauauuuaaggacacaucuguacgaucagcuaaaagagaaaaggugcugaaagagaggaccauuauuuuauucucucguuucccacaauucuuacugaauuuuuuauucaaagaaggugacauuuuugcaguuguuuuuuguucuuugugauuguugugauguggcuccuccuuaacugacuucauuugagcugcugaugcacucuuaugcucucauggaguggagaaccgauucuaguauagaggggguagcaaaucuuuaaaacacgacuuacaacauggggaacccguugugguaaucuaugcugauguuuuaugugcuuuugccuucauuuugcaaaaugacuuaaugcuggguuacaugucucucuuuuuaugaauucaguccugcucagagugaagcuucuccaguggcuucuccagauccccagcgccaggagugguuugcccgguacuucacauucugaaagaauuguguuggcacagcucuguauagacuguuacuaagagcaugacuuuauacagauuguuauguaaauaggcuuuccuaugucaaacacugugaaugagaaaguauuugucucuccaacuugaaaaugcacuguauuuccugugauauuuauuggaaucauucuauaagguacuauauuauguguguaauuauaacuguuauuuuuauuugagauggaagagucuuuaaccuuuguaauuacugcauaauaaauuuuguuagaaucaa

SEQ ID NO: 192138 - RNA, 8025 nt, Homo sapiens
guuuauagcauaguccacugggacugccgcucugacaaagacugugucacuacuuuguggaauguuauuuuagaacuuccagaaugccucaguaaauccugacugccauguaacuguguacugugcugcugagcucuuaacaugaagcagcagcagugacccuggcgggccaggcugacgugcgugggaacagugggagugacccuggcugggaagcagggaggccuggauauuguuucuccuggcucuguguccugccauucucaucccugugcucagagcucucaagcacccacgauggccuucucaggccgagcgcgccccugcauuaucccagagaacgaagaaaucccccgagcagcccuuaacacuguccacgaggccaaugggaccgaggacgagagggcuguuuccaaacugcagcgcaggcacagugacgugaaagucuacaaggaguucugugacuuuuaugcgaaauugugagugucuccucuccuggagugcccucuuccagguccagcguucuuggcugucuguucaggagccauccugagcuggcccauacaauuuuauugacuggacuuugggugggaguuuuccagggugguagggcuccgaggggcucgcagcgcagcauguuuagggagacaggagacugccuugucgguaagacaugcagcgacacgcagaugggagggaggugcugcccucacugugagagcauggcggccccgucuucaguagguuccugaucacuugguaacuaacugcauuuucaucaugucguccgcaagggaggcuuaguguugucauugucaguaauuacguuagaaaaauucugcagucuaaaacggcccaaagauaaggggcagauggguugggacagugaaaaaaacaaauuacagacuguugguaaagauaaauauuuuuguuuuguguaauaaucaacaauuugaaguaagcuaacuggguuucuuaauugaaugaauaaauauauauaucguauaaguagcagcucaauacacauauagaacauacuguuaacucuaaaaagcuaggcuaauuuauauuauuaaauagguuuuagcaaacacauuuuuuuaagaaaaugcagaguagccaucagaccagcucaagauuauugaccucauucaaaguugugagcuuagaauuacugcguaucccaaauuugucaaguaagaguuaaugagaauuuaacugacccgguucucuacuuccauaauccgugcucugugguacagaugucacuuaucuucacaacucacagagagcucuguuugacaguaacuggggaauuguaauaauacaguaaccaauauuuugacugcuuggugaacucucaagaagauuuuuggauuuauacauugcugcauuuuaggaccaaacaauuuguuuugcauacuugaauaauggaaagcaagauaucaguugugcugugugagguugauuuguggaaguggaucagcuucaucagucaugccuggccugacuuuuacauauaaauaucuaucuauagauagauagauagauagauagauagauagauacucccccacuuacauauuucuugucaucaacacuuuuuagugaaaaucuuuuucuaaaaaauuagcuaauuaauuauaacuaaucugaugguagcuauaacugucacuaaugacuuuuuuaaaguaauuucugucaucuguaguauuaaauauaaaaucaacauuuaaaaaaaaaacaacaacaggcauugugccagagggucaaaggcaaaagaggaaagggaagccugacugguucagggggcagcaaggugauuguucuguuuccuuuuucccccugcuugugaugaaaaggaauacuucuugcaaaauauauauuauauuaccucuaaaacuagcggauuuuuccugugugugggaaguaacugugugcuuguuuuuaugauguaucuaccuauuuccuaauucuacuugaguauuugaacuuaaguagaaacaaucuauauuauaaugaguuuaaacuggucagugauaaucaaacguuuuaaucuaagggccucuuaacacucuuaaaaacuauuaagguucccaaaggacuuucauuuaucaguauuuaccauaugagaaauugaaacugggaacaauuuaaaauacuuauuaauucauuuaaaaacaacacuaagcuuauuacguguuaauaauaguaaauguuaauauuaauguugucaugaaaaauaacuguuuuccaaaauggaagaggcuuagaggaaaggauggcauugcguuacauuuuugcaaaucuuguuaauaaaaguuucucagauuuguuucugcauucaaccuauuacagucuauuguuuuagaugaaauauaugaagaaaacauggccucccacagagauguaguuggaaaagaggacuuuucugccuccugaaagggucauggugacgcugacauuuugaaaacgacugauuuaggugauaaugauccaggacauucuagaauauucuuuuugggcuuuuuuagagucccauuaagauuguugagguuuggugaaucuuuugagaggguuuagaauuaacaacagagccauauauuugagcagcaucuuacgguuuccaaauagcuuaaaauacuuuuuccucagaacaauaaugagaacagcacugagaaugaccaggcagauguggagcuuaccgugcuccuucauccaggaauaccuguggacuuuggucagaaagagggaagaagcacaaaccccuccagaguuuuguaaaacugccacaaucaucuggcuuacggcaaagcugggcgaugaugagaauuuuacagauuuuuuccccaaccuacaguaacuuugaaaugacaaaauggaaauucauuuuaacaugaggcuugggccagguuuacugagcagugaaggugcuucccuuucucccuuccuuccuuuuuuuugugacauuuuaauucugcauucaaaccuguuaaauaaaguugagcuuugacuggucugaagugaugaacauggugugucugcacgcaguuauuuauggcaaggcuacaaaacaggaugacuguuuugugaaacauuuuggggagaaaggcaaagggaaaguugucuuccagagguguggaggggagugaagcaaguaaguggaaccacuuuugcuaaggaaacagcaaaacuuggaaaccaauaggggcaaggcaguuaguuacucuguuuauagaauggagacugucuaccugucugucucacuaguugguugugaaaauucaggagaacauugguaauaacuucaugaaguacauugauuaaauaucuggaaggucagaagcuguaccagggaacuagacacacagguguagagcucaugcuguggguaggccugugaaaauaaacuugccaaaaauugaaggaccgcuuggcaugggggaccuucuccauuucuaggacuuuuaagaaauaaauaggucuucacgugaaauccucaucuaauuguaugccugucaaagccauguugcuuuucuuuuccuuuuucuuuuuugaaauggaguuuuguucuuguuguccaggcuggagugcaguggcgagaucuuggcucacugcaaccuccgccucccagguucaagugauucuccugccucagccucccaaguagcugggacuacaggcaugugccaccacacccggcuaauuuugaauuuuuacuagagacgagguuuuaccauguuggucaggcuggucucgaacuccugaccucaaguaauccacuguccucagccucccaaaguccugggauuacaggcgugagccacugcagccaucugccauguugcuuuccuucuuccaaacugcacagugguuagagccugagauuauuuauugaaugccuucuguguuuuaagguguagugaggcuaccgaugggggaauuucccacgucaccagccgcagcagugguuacuugacaacuuggugucacuuuccuaaccuaugaaacguggugguaucccugucauguccuuucaaguguuugaaauucgugguguaaucuguuuugauugacagugugauuuuaugagcaggggaccuggauuucuaguccugcaccuuccuuuaacuaauuagccuugugauguuggucugauccuuccaucucugugaaccuguuuugccaucuguaaaaugaucuuuauuauguaaaauucugugauuuuaagauacauuuuauaauauugguaaucagguucgucuuaccgauuagguaacaggacuggggcaucuuggcugguuuuaaggcuacuuaagcaguuguuuucuacgggauuuaaucaaagggauaacccgugucuagguuauaugacauggcauuuaguugacaugcauuuuagauucuguucucagaagggaaagaaacuggccuugagauguugacuuuuggauauuuuaauuaagcuacuuauuaagcuauaaacccaauuccuugagagcagcuuguaacuuucaucucugucucaggugccuaacacauaguaggcacucacucauaguauauucagcaagaagaaugccaaaaauguuagaaacagaaucaaagugggacacccuuacagagccucagaugcuacgguaaagaggcugaaguguccgaguucagagcauguaaggaacaagcaagaaauugagcuuuuuagauaaaauaggguuuuugugaucagauagaauuugcugcucgguucuuaguguuguuugaucuucgaucuaagaaguggcugacggucugcaaccugcuguucuuugcguguuacagcaacauggccaacgcccuggccagcgccacuugcgagcgcugcaagggcggcuuugcgcccgcugagacgaucgugaacaguaauggggagcuguaccaugagcaguguuucgugugcgcucagugcuuccagcaguucccagaaggacucuucuaugaggugaguugcacuggacaaaagcagggaggugccauuccccacccucccgcuuccugcccuucuuuccugaggacuccuccuucauguucaguuucaugaugaaagacugaagugccacaugcaugccagguauuugauagcugugaggucagagguggcaucucuauggcccauaugggcaguggcgugauugggacacccucacagacccugcauuuguauugcucaguucaucguccuauuucagaacccagagucccuuaugacagagccuuucagaccuaagcagcucagcuccacauagaaaauucuuuccgagucuucagccacacucaggccccccacacaccucacccacuccugucucugugucuuucccccuucucagaggaccacuggaccugcucuaaaggagagcgugcgguguacgucacccccuccacaacuucccagccucgagccaggagcguccaugcauuuauuuucuaagggaaaaaaaaauaaguauuuuagggaacuauacugucuacauuuagcucuccugggugucuauguucuuuucuaaauauuuguuuuucuugauccucggguguuagcauauggucugcacuuccuuuguaguguauuugguauucucaacauuaccgaaaccacuuucuuguuguuuuuuauuguuuuguuuuguuugagacaaagucucauuguauagcccaggcuagaguguaguggcaugauuauagcucauugcagccuugaacugcuaagcucaagugauccuccagccucagccuccugaguagcuggggcuacaggcacgugccaccaugcccgacuaauuuuauuuuucauagaaacggagucucccuauguugcccaggcuggucucaaacuccugggcucaggugauccucggccucccaaagugcuaggauuacacgcaugaaccuccaugucuggcccacugaaacuccugucucacaguaaacauguauuuugggggauaaucuagagaugcugaccccaggcuauaaaugacggugagagugagguguauguguguguuagaucaaauagguaauuuacuuuuaccaccuuacuucuuacauauuuguacguaaaugcacaucuauauaugauaauauauguauauagaauuauuuuauagcuggagauggcugcucuuugauuucuucuuuugccuagcagauuuuuauguuucccuguuauauaaaccaugcuugagcaaggaaagguaguugacaaagaucauugguaaguccauuguaugccacuccggcagcauuuucccauagaaacaaacaugagagugggguucccaggccagcccacagaaaagcuguuuaccccaucauggguacaugaaauacagggcuagcaaguauguaauaaugucaacuuggaaacagcuuuaaggguuuggguuaaggaaugcuauuuuauucacuagcacacauuuuuuuaagcuccuauuguguccccaaaacacacauucccaacaacaaaaaccuuagcaguggaaagagguuuucguuuucucuuuucuucucguucuuuuuuuuuuuuuuuuaaguuuauuucuuuaggccuccaaacaugcucuauguaucuucuuacaguucuuccuguucuuccugacuccuucccugggcagugggaaucuuuuggacaaggaugauggauuuagggaugggcaaaugacaguugugaagauggacaggagcaggagaggccaauguaccacagcagaagagggcaggagaggagcuccagaggugugaauggaggcaucaggcauagagacccccuaccgaggcuauagguagacugugauuagcuggugaggagaaggaauaggaaaucccuaggugcugcggcagcaagaagagagggcauuugcuggugguagugguggugagccaugacucaauucaguuaaagggaccugaggaccugcuucuaccucggcaccguggaggccuggugggacuauggcaaggaaggaggugagacucccaaggcacauugaagggaauucuggaaagcuggcuuggagagagcauggucuucucacuauaugaauuccuucuguaucccucccuucuuuuuuuuuucuccuguaguccagagagguugaaaugucugauaacauagcagguuugcgacaugaaagagaugagaaccuagcuggucuccuaguauccaauacaauauucuuucccuuacauauucuuuuuaaauauaagauauuuuuauugaaaugggugauuaugacaaaggccuuaggagagcucgguccaggggagcaauagagaagaacucagagaaaaagacaggcuuuguuuucccaaacauuuuccuuauaucccuggcuugcucuuuccccugugagcacccuggagcuccagcccuccgucaccuucuuucucccauuuugccugugacuuaggaacgaacgugaugguuaagcuaccuucauuaagcagcaugaccgcuuccugagcuccugcugccgcauuuaggcccugucagcugugaggccacuggugcugagucagagggaaaagcucagaacagccuugagcagcgaagaauaaagcaugacucaucucguccugcccaccccucacacuggacuauaaauacccucccugggucugugugcuguuauuccaaaagaugcgaugaauacccagaacuaggcuauucaugggcuguugcccaguucaagcucuauuggguccugaggaagauuacuauuuuggcuacauuguuuaucauuaaaaccagcccagggauguguaaaccugcaucuggagaauaagacauuucuuuuugguuaaaugauauuagagaaaaaaaaaacuauccaaggcugcuaacaaauaaucuucacuuucaauuauauccagcaauaaguuguucuccagaaaagaaagcuuggaaacuuacccaguuugccuuccauuugggacaugacugaugugcuucagucuuuguauaauaaaugcaucuucgccacucua

SEQ ID NO: 192139 - RNA, 89753 nt, Homo sapiens
ggggcgcuggugugaucgagcucacguagcgagggcugcagucgccuccucccuggcgcugccaucgcggccuagagguuauaaaagggcuaacgggcucccucugcugcccagucgcgccgccagcgggcugaggguaggaaguagccgcuccgaguggaggcgacugggggcugaagagcgcgccgcccucucgucccacuuuccaggugagacgcucccucgaucccggagacugaggccacugggcagccguggaccuucucggacggcugcggcgauccauuccuucccgcuguggugguacuucuggggcggggguuccccagguuaccacagcagccucgguuccuuccccucgggagacucggccccucucccugcgccacgcgacucccggcgcccgcgcuccuucgugccccccuucccaccucugucccuagugcgccucggaccgcuggggcugcugcagccucaguccccgcccuagggaccaggacuuucuugaauuuuccuucccggggaggaaucacucuguugcuuuuuuuuuuuuccaaguuccccugcaccugguccucccuaacgaggcuaaggggaacgcaagcgcggggcgugggcuuuuggccgccacagccgcagaugguucgcauguggcgguggagagcggauuuuaaggcuuggagcuggauccgcagcgcgccaggcauuuuugcccuaucgaaagucgccgggagcuggggggaccuccccagaaaguuccggcugaacucaucuguugcgcgcagcggugcagcauuagcugccagacguagcccggggcgccgagcuuucugcucguagcgccgaggaaguaggcucucaggucaccucgucgucagggaagcuuccuucccucuucuuccccauaacuuuuuuuaaaaagagacaagagcucuucucucaaucucugucucucugucucucucugccgagaauuugcagcuuuuaaaaguccacaucaguccaacaaauuccaugguugugugaggauuuugaguuggauuacauggcuggcccccggauguauguuucaauggggaggaaggaugguaugauaacugugagacucuuucuccuaaauaaucgacucuguuacauacaaauucaauguuuagacacuaacaucuuacgcguuccggauagagugaagacucuuggaauuuugcacuguuuucuuuaagaaaggguugaagaagcagcuagauccucuuuuaggaauugaucuaaaaggccaaagagacuugccaauuuccacuuaacuguuucugguuucuccgagagcagugguucucggacuuucgcuuggaaugcacucggaggggaugaaauagccacuacgugaaggggggaggggcaaagacguggcagcagcguucuuucaucaauuuuuuacucuuuuuuuuuuuuuuuuuuaaaguucugguuagaaacguauuuccccuuuuagguuuagacguagcuuaugaaugaggcuagucuuuuccuaaaauaaucagaugaagaauucagucugcauagcaggaacguuggaaguuaauuuaaaaaacauuuuaaagggauuuuuagaaucaaguuucuauggagaaaaucgguauccuaagacgauauauucaagaagcugaaagugaacaaccucaacuauauuuugucuucaugugaaaugugaauacacaccccgugauuuuuuuuuuuuuuuuuuuuuuuuuuuagcuugugagcguaauuuaagaaucugaaaugugaacuucaaauuuuacuuuuuucuuuaugugggaaaagagacuuuaucacuuaccuuuaauaaaauucauagucaguuuugguuuugggacauugugccuuaaguccugccauuguuuuugauagcugaugacaaauguuucuuagauuuacauagacuaacuaggaaaaggacuauuucugucucuuuuaaauggguagugcuguuuuuauugacauuuugaaaugaguuuuauuuugaaguacugaaaaucaggacuuugguaggcggauaauuacauuggccauuuuguguuuugguaacuuagaugguaaaacaguugaaaaauguguacaacuuuuaauuaugccaaaaaaauuagugcaaaagacuauugaaaaaaaguuuuauauugccuuguagucuggguuguugcagaugaaucuuggcuuuuuggcaaggagcuguuaaccuuuucuauuagugcagaauaaguuguauacugaaaagcaguguuuuucaguagggcaauuaaguucaaacggcauuuauuccagagaugcagcaagagcugggacagccauaaagcuugugagccuuccuuucuguggaaggaaugcuuuauuuuacuuagcaaccaguuaucaacuaggauauaauuauugcucuugaauugaccugugagauacauaauagugguucucaaacuauuuuaaggucaugaaauccuuugagaaucugaugaaaggugugguccuaugucagaaaaugcaaauacacccuacauggaauuuuguaugucacuuccugcccccccacucaaguccauucaugaacuuuauuauaagaaccccuaaaaaguaagagaugugaaguuacucucuaaggguaucuaggugucuugaggcaguauugaauguuucugaaaaucgagcugggcauguaagucugacuggacuuguauaugugggugacccuaauacauuuuugccaaaaggguuuuaacaaaaguuaauagguuguuagaauuguugaaaugcuaaauugucuagucugugaaaguauaucacauugcaugcccucuccuauauaugguaacuuaacuuugguuuuccauucugaaaguggaacaggcuuggaaguaaacaaaaauaaauugcauaggcucuuggcauuaaacuuuauugcuuuucuugcagugagaucuugaaucuuguaauuaaaccauaauguguuguguguguauaaauauaugaauauauauaaaaaauccaaauaaaaugaguauguguguguguguguguguguauauauauauauauauauauauauauauauauauuuuuuuuuuuuuuuuuuuuuuuuuuuuuuuugagauggaguuucacucugccacccaggcuggagugcaguggugcaaucucggcccacugcaagcuccaccucccggguucacgccauucuccugccuaagccucccgaguagcugggacuacagccgcccaccaucacgcccagcuaauuuuuuguauuuuuaguagagacgggguuacaccguguuaaccaggauggucucgaucucuuuaccucgugaucugcccgccuuggccucccaaagugcugggauuacaggugugaucacgccaccgugcccggccaaagcuuuguguuucuauucaagaaaauuuauuuguauaaauugaagcuguccugucauuaggacagcuucaguuucucuaguugaauaaguauuguaccuaaagaaaagcuuuggcaauucaaaaggacucucauuuagguuacuccagcaguuuuuaaacucgguguggugaaaaacauucuuuuuccuggucuuccuuuggaugaucaguaugacuguuaguauauuugauuugacauuugcuaaaaauacauuauagagauucagacuucuuaccuaguugucaucagugaaugaguucuauauugggccuuucucuuccucauguuuaguguuucauaaaaauguguccauauuacucauuucuuucuuaaauaguaauauuauguggaauuaguacacucagccuuacucucucuuuuuuuuuuuuuuuuaagagauaggaucuugcucuguugcccaggauggagugcaguggugugaccauagcucacugcagccuugaacuccugggcucaagcaauccuucugccucagccuccggguguagcucgggguacagaugcaugccaccaugucuagcuaauuuuuuaauuuuuuguagagaugggaucuugcucuguugaccaggcuagucucgaacuccuggccucaagugauucucccaucugccccacaaaguguugggauuauaggugugagccaccaugccuggucauccuuacucucuuguuggacacuugagcuguuucuccauuauaaguagugcaaagagaggacuguaauuuagugguuuauuuuaucaaccuguauaauuacaguaaacuuuaaccaauuuuuuaauuuuuaaauuuauauuuaaauuuuuuuuuuuuuagagacagggccuuacuauguugcccaggcaugguggcucacaccuguaaucacagcacuuuggaaggccgaggcaggaggaucacuugaggccaggaguucaagaccagccuggucagcauagugagaccccaucucucuacaaaaaaaauuuuuuuuuaauuaagggggcaugagguugcaugcaucuguagucuaacuacuugggaggcugaggugggagggucgcuugagcccaagaguuggaagcugcagugagcuaugauagcaccauugcacucuagccugggugagagugcaagacccugucucuaaaaaaaaaaaaaaaaaaaagaaaagaaaaaaaaauuauuuacaauauggccaguagacuguaggaaaaucaagaaugaugagaaauguuucauaggagaaguaggacauaaaaauuacaugauauagcaccauguggcuaacauuuuacuagauauuaaaucuguagcacugaauggaaaugcauaucuagauucacauccucuacaaccaugaauucauuuuucccuguucuaguauacauggucuuauuuugucucucuuuaccucaacuugagaaauuuggaucuggcauuagaguaaacagauaauugaagacuagaaagagguagacuggguggaaauaaaaguggaauuuugacagaauagccuugggagggaugaagcugaguauaccugggccucagagcaauaauccauuuuuuaggaggaaagggacugcuaaagccagcuuuugaguauucuacucugaccugaguggccuuggucugaauagcucauguucagagauaagaguauauuuaacuuuuuuguacuaagaauaguauuugaguaauguuauagguacauaugagaauuuggccuucaucucugccgagucaguuaaacacaaguuucucuagauauuuccauuacaagaaucaaagcucuuugauuuuuggaacuucaguaaaacccaagaaugaauagccgagaacuaucauacaagucauaaaauuaaaaggcauugaacaguguaugaagcaucagauauccuguuacaugugucugcaacaauaaauuaaauauugauuaacugauuuuaaguaggcucaagacuucucuuacaguucuaaucuuauauuaacuagauuugcauaucuaauuucuccaaaaauaugaucaagaaauguuuauuuuagucuaggcgugguggcucacaucuguaaucccagugcuuugggaggcugaggugggaagaucucuggagcccaggaguucaaggcugcugugagcucugauuguuccacuccacuccagccugggugacagagccagacccugucucaaaaaaacaaaaaaaguugguauuucuaaaaccuacugguugaauuuaggaccucaaaauguuacuugugugugugaccuuuguucuugcccuaugguucugacaaccuuccuccuuuuuauuuauuuauuuauuuauuuauuuauuuuuuugguaaacucaggcaacauauucauagucaaagguuacaugaagacauucucaaauuuacaugauuucaaaauuuaguuacuucuuuuuuuuuuuuuuuuuuuuuuuugagauggacucucacucugucacccaggcuggagugcaguggcgcaaucucgguucacggcaaccucugccuccuggguucaagcaauucucugccucagccucccgaguagcugggauuacaggcacccgccaccacgcccgacuacuuuuuuguauuuuuaguagagacagggugucaccaucuuggccgggcgggucucgaacuccugaccgggggugauccaucagccucggccucccaaagugcugggauuacaggcaugagccaccgcaccuggccugcaguuacuuccuuuaaccucaaagauauuuugaaaauagaccucaauuuacuaugccugaauuuaaaaaaccuuaauauuguauuugaaaauagugaauagugaccauugccaccaaguagagugauaguaauaaguaaaacacuaaucuuugauauaagggugauuacuaauaaauugaauaaacugauauauuuuaacgacuuuauugagcaaaauugacaggacaaauugcauauauuuacaguguacaauuugauaaauuugacaaaaauaucuacuuaaaaaaauaucaguacaaucaagauaaggaacauauccaucaccuucaagaguauccucaaggucaggcacaguggcuuaggccuguaaucccaacccuuuggguggccgaggcaggaggacugcuugagcccaggaguuccagaccagccugggcgacauagaaagacuucaucucuacacaaaauaaaauaacauuagcugggugugauggugccugccuguaauccuagcuacuugggaggccgaggcaggaggauugcuugagcuggggagguugagucuucaaugaacugugauugugcuacuguacuccagccuggugaccgaaaugagucucugucucaaaaaagaguauacuuggccaggcgcaguggcucacaccuguaaucccaacacucuggggggccgaggcaggaggacugcuugagcccagaaguucaagaccagccugcgcaacaugguaaaacccugucucuacaaaaaaauuaaaaagccaggugugguguugugugccugcaguccccgcuacuugggagacugaggugggagacucacccaaagccuggagauuaaggcugcggugagccaagaucacgcuacugcacucuagccggggcaucggcaguauccuuaugacuuuuuguaaucccuucuuuugcuccuuacuacccucucuguaucccuaggaaaccauuguuuccuuucuguugcuuaagauuaguuuuuauuuucuagaauuuuauaaaaauggaauuguauauacgcuuuuuuuuuuuuuuuuuagcacggggaaucuccuuacacucagcauaauuugagauucauccauguuguuauguguucauaguuuuuuauuguugaauaguauuuuauuuuaugaauauaccaugauuuuuuuuaacccauuuacccuuugauggacauuuggauuguuuucacuuuuugacuauuaugaauaaagcugcuaugagcauucauguacaaguuguuggagagagauaugcuuucuuuucucuuauauuaaugccuaggagugcaauagcuagaugugauagggaaauauuuuuucccaguuguuggcuugucuucauucuuuaaacagugugcuucaaagagcaguuucuauucacagacaacaugucugugacucuucaaaaaagcucuagugaauagguuaauucagcagaguuguagcuuagaaggucaauauacaacaguaaauuguauuucuauauacuaauaaugaacaauuagaaacuaaagugaaaaauucccaucucauuagcacuaaaaaccaugaaauacuuaaguauuaacuuuucaaaugguguguaauauuuguauguugaaaauuaugaaacacugauuauaucauguucauggauuagaagacucaguauuaagauaccuacucuucucaaacugauuuauagauucagcacauuucuaguccaaaucucagaggauuucuuauagaaauuaaugagccgauucuaaaauuaauauggaaaaccaaaggaacuagaaaagcuaaaacaauuuugaaaaagaauaacaaaguuggaagauucauacuaccugauuucaacuuaguuuaaagcugcaauaaccaagacugugguauuggagaaaagauagacauacagaucaauugaacaaaauagagaauuuagucacacaaaaauugucaauucauuuugaaaaaguuuaagggcaguucaacagaggauagucuggaacaguugaauauucauaugcaaagaaaaaacaaucuuuguuuuauuugggcaccaaguauccacuguuggacacugggcagucccuugcccaggaauuuaugugaauauugggacaagugacaugaauccaccaguggauaugaaauaaaguuuaaucacacaguaaacagcaaaaggacuccucaaggucaaggacuuagguuuaguccaggaugaagcaagagugaaacaggguggguggcuuugguuuuuauugaccagaagguggaacuuguuugaugguccccaugugugguauuuacaugguuucaacuucacaccaguaccaagggagggaauacugguccccaagugugguauuuauaugguuucaacuuuacaccaauaccaagggagggaguaccugggcuuucuuacagacuuacccagaugugggacaaaagggagagaggugugggaccugaaggcaaucugcacucaaacaucaaaaugaaaucuuuuuauuagagccucaaucuguacuugacacuguaugcaaaaauuaguucaaaaugguucguaggccgggucuggucgcacacguuuguaaucccagcauuuugggagguugaggcaggaggauugcuugagcccaggaguuugagacuagccuuggcaagagugagacccguuucuauuuuaaaaaauguucauagauugugaaguaaaauguacagcuauaaaauauuugaaagaaaacauaggacaaaaauauuuuugaccaugggucaggcagagauuucuuggacaugaugccaagaacaugauucauaaaugaacaaacugauaaauuagacuucaucaaaauuaagaaauucugcucuuccaaacacacuguugagagaauaaaaagacuucacagacugggagaaaauauuccccaucacauaucugacaaaaaauagacuguauaaggaacucaaagcugggcaugguggcucacgucuguaaucccagcacuuugggaggccaagacuggaggauugcuugaaaauccaggaguuugagaccagcuugggcaacauagcaagaccccaucucuauuaaaaaaaguaaacaaccuaauuaaaaagagcaaaagauuugaguagacacuaugcaggaagguguaugaacagcagauaaacaccccaaaagguguuaaacauaggccaggcauggugggucaugccuguaaucccagcacuuugggaagcugagguggguggaccaucugaggucaggaguucaagacuagcccggccaacauagcgaaaccgucucuacuaaaaauacaaaauuggucaggugugguggcacgugccuguaaucccagcuaccuaggaggcugagacacgagaaucacuugaacccaggagguggagguugcagugagacaagauugugccacugcauuccagccugggcgacagagugagacucugucucaaaaaaaaaaaaaaaaaauaaaggcauuaaacaucauuaguaauuauggaauugcaaauuaaacccauaaugagauaguacuauaugucuauugugaaaauuaagauauuaagagaaacuaaggaaaaaacggcaauacaaaaugcugguaagaaugggagcaauggaaacuuucauccuuugcuguuggaagggcaaauaguguagcuacuuuggagaaacguuuggcaguuuuuuaugaagguaaauauauacuugucauaugacccaacauucccgcuccuagguauuuacccaagugaaaugagaacuuagguugauuuccucuuuuuuuuuuuuuuuuuuuuuuuuuugagaugcacucucacucuuuuacccaggcuggagugcagugacacaaucucggcucacugcaaccuccaccuccuggguucaagcaauucuccugccucagccucccaaguagcugggauuuacaggcaugugccaccacgccuggcuaauuuuuguauuuuuaguagagaugggguuucaccauguuggccagguuggucuugaacuccugaccucaagugaucugccugccucagccucccaaagugccgggauuacaggcgugagccaccgcucccagccuguuuucuuuuuaauuuuuuuaaaacaguuuuauugaguaauaauucacguaccaugcaauuuucccuuuaaaguauacauuucaguggcuuuuaauauauucacaguuguguuaccacaacaaucaauuuuaaaacauuuauaucacuccaaaaagaaaccccagagccaguagcagucacucccauugucccuugccuaacccugggcaaccacuaaucuacuuuuuguuucuagagauuauuuuacuuaauguuuucaagguucauuuguguuauaacauauaucaguacuucauuucuguuuauagccaaauaauauuccauuguacggauagaccacacuuuguuuacccacuaauggauauuuggguuauuuccacccuuuuggcuauuaugaauaaugcugcugccgugaacauucaugcaaaaguuuuugccugggcauguguucucauuucuuuuggguauagaccuaugagugaaauaucugggccauaugguuauucuguucagcuuuuuugaggaacuaaacuguuuuccagaccaacugccucauuuuacguuuuuaccagcaauguaucagaguuccaguuucucuguguccuugucaauacuuguaauugugugucacuuuuuguuuuaaagagaugaagucuuacuauguugcccauguuggaguacaguggccauucacaggugcaaucauagugcaguuauaugcucaaacuccuagacuccagugauccuccugccucagucucccaaguagauagaacuacaggcguaugccacuguacccagcuagucauuuuuuacuguagccaucaaaguggcagugaagugguaucucauuguggaauugauuugcauuuucauagugaugaaugauguugaacaucuuuucauguacuugccucuuuggagaaaugucuauucaaauccuuugcccauuaaaaaaaaaucacuggccgggugcggugggucacuccuguaaucccagcacuuugggaggcugaggugggcagaucaccugagguugggaguucaagaccagccugaccaacauggagaaacuccgucucugcuaaaaauacaaaauuagccaggcgugguggcacauggcuguaaucccagcuacucgggaggcugaggcaggagaaucgcuugaacccaggagguggagguugcagugagcugagauugugccauugcacuccagccugggcaacaagagcaaaacucugucucaaaaaaaaaaaaaauuauugaguucuaaguucuuuauauauuuggauacuaaaccugaugcuaucggaaaugugauucgcaaauacuuuuuuacauugucuucgcuuucuugaagcacagcaguuuuagauuuuggcaaaguucaauuuauuuauuucuuuggcuucuuggugcuuuaggcgucauaucuaagaaacuauugccuaggcguuaugauuaauugccuaauccaagguuaugaaaauaauuuuuuuuuuuaaaugagauggacucacucugucacccaggcuagagugcaguggcacaaucauggcuuauaguacccucugccuccuggguucaagcaauccuuccaccucagccuccugaguugcugggacuauaggagcaugccaccaugcccggcuaauuuuuuuauuuuuuuguaaagacuggguuucaccauguugccaaggcuggucucgaacucuugagcucaagugauccuuccaucuuggccucccaaagugcugggauugcaccuugguggcaugagccaccaagccuggccaguuuauugucuuaaacuucaaaauggucuuaauguguuaauuuuaggguaaauuuacaguuaucuuguuuauucccagguaauuaaguguugcuguugcaaaugagcuuuuuaaaauuguuuccugugauugguuauucuuuguauauaacggucauuuucuaaagagaaugccaguuuuuuuccccaaauggucauuuuucaaguaguauaacugcuauauaaaauucaaucuuggucugggcacgguggcucacaucuguaaucccagcacauugggaggcucaggcgggaagacugcuugagacuagccuggagguggaguuggagacuagccugggcaacauaaggagaucccaacucuacaacaaauaaaagaaauuuaaaaaauuggccggucgugguggcacaagcccuguaguccaagcuacucaggaagcugagguggaaggaucacuugagcccuggaggucgaggcuguagucagcugugauugcuccacugcacuccagacugggcaacaaagccagacccccaaacaauacaauuagucuugaaugaaguuucaugaaaacuucugaauuuggaauuguuugccuuacuuaacuucauaauuuauauuuaaguuuaagaaaucuaaagugcauauuguacaaaacuuuuaaacuuuuuacuuguauccuuaggguggugaaaaaaccaaagcugucuuaucagaacuucuuguuuaaaucaaaaauaggugaaauuuguuugggaacaaaagggauugauggugguauuaugccagcuagaagcagagcuguggaauucaucauuugggauuuugcuaacucuaugauuuaucuauuuacuuaaacuuuguuuuuuuguuagcuuguuuauuuacagaaauagaauuuuuuuaaauuaaaaauguuuaucaaagaaguguagauguugagggaagagaaaaacaacugugauuccaccucucauuuaacauuuuuuugaguucuuuuaauuauuguauuaaauuuaaaaaaccuguuacauauguaggcaaauauauucuuuuuuuugagaccaaguuccacucugucacuugaacuuuauguaguucaggcauucagaacuacuagaacuuugaauagccauuugguuagggauaagcaucaugcuguauggggaugaauuaaagguagaauagagugccagaaaaagguaaaaggggucaguuucuugaagaaagagaaaagggguggaggaggugucauaagcaaaacauaaguguguguuuuugaaaugaucucaucuuaacguucuuucugacaggaaagacuuaggacuuuggaagaacuuccaaaagacagccuguguagcacuuucaguuaagggcaauaucuuaacuuagagcugacuucuaauaugaaucuugaaaugcuuuucauuuggaauuaugccaauaagugcuacaauacugcucaguacaguucacuacccuaguacagaaagugagggaaagaagcuagcgugauuucugaauuugugauagaaaaguuggucauagcauuaaaguauuuguccaucagauuguaaguacuagacauguagcucacucuucuuuuaagaacagaaguaugacuggaauucauggaguuaaguaaaaacaauggcaauuugcagagggauuauagggaagaacagaaauauaacuaauucuauuaguaauuacucuuacuugucuuggaagauacauccuguuaagauggaaaagacaugccaaguuuugacauaaucugagauuagucuuucuuuuaaaggagauugcauccauuuugacccauuaauuucuuuuucaagcuuguuugaauauuuagaacaggaggcauuuauauuuuauaauuuuugauaaagucauaaugucuuuugggauacuugacucuuaaauguucuauaaugauucucuuugcaagcugcuuucugaaugaagguagaauaaauagaagugagacaccauaagcacauuauaauggccugauuuaggagccugaauuugugguguucuuuuguguugaccaugaaaacugucagaaacauuaaaagucugaaacagauuucaggaggaccaacaguugaauaagggaucuguaugaggaaaaauaaaguuggagccuucuaaaagaagguuuggaacaagugucgaagguuaaaagaaccccuguggaaaauuuuaagugucagagaaaguuuaguuuagaauaucaagcauucuuggcuggaccaagugcaaugguguuuacaacuaauugaucacaaugaguuacagguuucuuuguuuuuucugcacucccauugcuuuacuugacuagcuuaaaaaaagagaauaucaagcacucuuuagucugccuuauuaauuuuugaaugauuugucugggagauauaaacuuuugaaaauuuuacaacuuuuucuuggaagaaaaauauuugaccaaaacgcuaauagaauuauuuaccagaugcccuguccuaguaauucacuggauaacuuguacuuaaaauucaaugacuccucauaacucaauguaaauauagaugcuccuugacuuauggggcuguguccugauaaaccaacuguaaguugaaaauacuguaagaugaacaucauagcuuagccuagcacaccuuaaacaugcucaaaacagaacacuuaaauuagccuacaguugggcaaaaucaucuaacaaagccuauuuuauaauaaaguguugaauagcucauguaauuuauugaauauuguaccgaaagugaaccacagaaugguuguggggucaaaguauguuuuguuuuuguuuugagacggagucucgcucuguugcccaggcuagagugugguggugccaucuuggcucacuguaaacuccaccucccagguucaggcgauucuucugccucagccuccugaguuacuggaauuggaggcacacgcuaccacgcccauaguagagacaggguuucacccuguuugucaggcuggucucgaacuccugaccucgugauccgccagccuccgccucccaaagugcugggauuacaggcgugagccacugugccuggcccaaaguauguuuuuuauugaauggcauaucacuuuugcaccaucauaaaguugaaaaauccuaagucaaacuguccuauguuggggaucauuuguauuuacuauaugguagaacuuuuaagaucuguucccagguuugauugaccuguugagucugugggacuggacuucccuggaauaagaacuguaggaaaguuuuguguuuggaugaauguaaacuucacauuuauuuuuauccaggccuaccugaaaauguuuucugguaggauuucuuccauacugcuuuuuuucuuauaguuuaaaaaauguaauaugcuaccaaacauuauaaguaauauacauguauguuacaaaaauuauauaauaaacacuuuugaaccuaucuaaccaauaaccuaaauauuaucaauaacuuauucauacuguugcaacaccaaguuuuauuccaguguaaguuuaucuuuggaucuuugacucuucuuggguuuucuuuucuuucuuccuccuauuccuccucccucccuccucuuugucuuuuuaaaaauuaagacaagucuuuucagggaugcuaucugagauuagucuuucuuuuaaaggagauugcauccauuuugacccauuaauuucuuuuucaagcuuguuugaauauuuagaacaggaggcauuuauauuuuauaauuuuugauaaagucauaaugucuuuugggauacuugacucuuaaauguucuauaaugauucucuuugcaagcugcuuucugaaugaagguagaauaaauagaagugagacaccauaaggaaaccauuguuuguuuuguuuuuguuuuugagauggagucucgcucuguugcccaggcuggagugcaguggcgcaaucucagcucacugcaaccuccaccucccggguucaagugauucuccugccucagccucccgaguagcugggacuacaggugugugccaacaugccuggcuaauuuuuuguauuuuuaguagagacgggguuucacuguguuagccaggcuggucucaaacuccugaccucaagcaaucugccugcccgcuucugccucccaaaguacugggauuacaggugugagccaccaugcccggcuagaaaccauuguuaaaaaaaccugugauugauacguuuggcuauuaacaugucacuuaaaguuucugaaugaauguggaugaaugagacauagugcuaaaacagauuagagaaccauucucuagaguaauuagacauucaguuguacuuuuacauaagauaaauugaaguaaaaucuauuuuaaaugcagaggugauuucauaggguuguuugcuguauccagugguucucagacugugaucccccagccagcacuaucagcauugccuggaaacuugugcaaauuaucucgacuuuucagaccuuuaggugauucugauagagcuaaaguuugagaagcacugccauauaggucuaucuucauuuuuauuaucuagcuuggguaggcauguuaguuuggaauaauguuguaugggucugaacuuccuauuguaagugacagaaauccaacuugaauuagcuuaagcaaaaaggaauuuaaaggcuuucuuaggugggcugggagauuauuguaguagcuuacagauucaaagcaauaguugcaaagaaucagggcccuggggguugaaacuguuugucucuguaugacuuuguccuguuuauagauccuagacaagugagaaagauggucacaggagagccccaaguucacauccucugagcuuagcaacuccagaaagagcugcuuucuaccauucacaaggccaucccucaaccguuauguuaaugagaaugaaagucaaugauugaccuagucugggucuuauaucuaaguguaggaggaaauagaaugggaaagugugcuacuuuggcagccuaguucacugcuagauaauaggguugcuuucaaaguaucguuauuuuuauuuuuauuguuauuuauuuauuuauuuauuuugagacaaagucucacucuugucucccaggcuggagugcaauggcgagaucucagcccacaggaaccuccgccuccuggguucaagcgauucuccugccccagccuccugaguagcugggauuauaggcgccugccaccacgcccggcuaauuuuuguauuuuugguagagacgggguuucaccauguuggccaggcugguuucgaacuccucaccucaggugauccauccaccuuggccucccaaagugcugggauuacaggcgugagccaccgcuccuggccuuacuguuguuuuuacggguauagagucucugucacccaggcuagagugcgguagcacauucauggcccgcugcagccucuaccucccaggcucaagugaucuuccagccucaaccuacugaguagcugggacuacuaccacaccuggcuauuuuuaaaaauuuuuuauagaguuggggucuccuuguguugccugggcugguuucgaacuccuggccuacagugauccucccaccuuagccucccaaaguguugggauuauaggcaugagccacugcacccaguuuaggcuuaaguaucuuugaaaaagagaaagugaaauguagaggcuuauagaacuacaagauggaacaugcucaaaaccuuauauuauuuguuagcuacucuuuuguuagagaguaauuaacuacuucuuuaaaaguuuaggguaucuuaauaugagaguuaaugcuuuagguuuauuauuuuguacgaaguuaauuuuuuugucacuauaaaaauauauuauaggaggucuggaaaauacagagauauaaaagaaaauuaccagccgggcgcgguggcucacgccuguaaucccagcacuuuaggaggccgaggcaggcagaucaccugaggucaggaguuugagaccagccuggccaauguggcaaaaccccgucucuacuaaaaauacaaaaauuagcugggcguguuggcaggugccuauaaucccagcuacuugggaggcugaagcaggagaaucgcuugaacccgggaggcggagguugcagugagcugagauugcgcuacuacacuccagccugggcaacagaaugagacucugucuccaaaaaaaaaaaaaaaaaaaaaaaaaaaauuaccuacugcuuugcuaaccagagacaauuacacuuuggugaauuuccucugcauauguucuugcauaguuaugacuguauuaugauguuaauuuuucuucguuuugaccaguguuaauuuauuuauaacuuuguguugggguaaugaaaacauaaucuuagucaauauagauuccaccaagguuguaugauaauuuuuaaaucuuguuuuuucauuuaacucuacaaguuaaaggauguguucauuuuaaguuucuuggcauauaacaacauuaaauaauuuugcuuguuaauuguucacuugaugggcaaaaaugguuucuuauuuugugucauuaauuacuaauaaguuugagcauuuuuuguugagcuaacuacuuuuccuuuuugugaguuccaaguucuauaucuacuugucuauuaacaucuuagugguuuucuuauugauuuguaugaacuccuuaaaagugcucuauuuucuuuaaaugguuuucuaguuugaguuuuaaagguuuuuuuuuuuuuuuuuuugacacauaagcuuauuuuguguauucagauuccaucuggcuuuugauagguuguuuucuuucucucuuuuuuuuuuuuuugagauggggucucacuuuauugcccagacuggagagcagugacaagaucauggcucacuguagccucaacuuccuggucucaagugauccuccuacguuagccucccaaguagcugggaccacagguguaugccaccguacccagcuaauuuuuugauuuuuuuuuuuuuuguagagaugaagucuugcuauguugcccggccuggucucaaacuccugagcucaagugauccucuuuccuuggccucccaaaguacugggauuacaggugugaaccacugugcccaggcauuuucuuauuuuuaaguuuagaaauucucugcuuuuagagaucugauaacuauucuguuguugcuauuuguuuuacuuuguuuuguugauuauaacuauuuaauccauccuagaauucauuuugaaacauuauguaagguaaagauauuuauucuuuuuacgauuguuuugaauuuuuauguaggcucugucauucuuaaaauauuuucaagcuauucgaagaaaaauaccaucuuaagcugcuuuuuaguuauuucuguaggcuaaugguuuuuaauuccuugugagauuuaaggacaaugaaagaugacaaaaaaacuuuagugacaauauauuuuagcaauggcaaaauaaccucuuuucugacaaaucuaaacucucuuaucagaguuaaaaguuuagacaacauuugugauuagccuucuguuaacagugaaaacauuuguauuuucugcaaauagcauuuauccaugaagaaaauuagaauagaaguauguuuaaacagaaaauucuagacucuucuucagacagcucaggcuuuucaaaaagccuugugcuuuggcaggagcccaggagaggaagugucuacaucugcuacauucuagaagccuuccccaaaucacuguaagguagccaaaagagcaguguauuuccuuacugugugguucuggaaguaacuggaaguuugcagcaaacucgagggaggagacuagggaguacuuccaguuuuuguggugaucuguuuuuauugagauucaaguuagggggcagugggguuauuuuuuagcucuuguagaacggggagcuuucaauuugaaccugagccuuuugguuuagcucacgucacauaggaagacgagucagaggggccugcacaaagagaaacagguugacaagucaggguaacuaaugggagccuguuacuggggcaaacuauacuguaauguaacuuauucuccuguaagguaauaagaaagacaaaguucauguuuguaggggagaaggagcaagagaagagugcuagcagggcaucugggaaagugagguaaagccuuucuguugguuaguuuauauccucaucugccaugaagaauccucacuagaaaagacggugcuaucauggauauagaggaaaaacacuaaugggcuuugcugccagguuuaaaaaaagaaaagaggccauagacaugucuuaggcuaaguuuuuuuuuacauagaacacaguugauaagagaaacaaaacugaagucuggguccuuugagagaaaauacuaguuuaaauggacauggcuguuuauucguuuuggauucucuacaacuuaaaaaaaaaaaaaaaacaggcacagugguacagaccuguauuuccagcuacucaggaggcugaggugggaggaugauuugagcccaggaguuugaguucaacuuggacaacauaacaagaccccugucucuuaaaaaaacaaacuaagucaaaccaagagaacagugucauugcaauauaauucauauaccuuauaauucacccauuuaguauucaugauucaaugguuuuuaguacuuucacagagucauuccaccaucagucaccacagucaauuuuauuuuauuuauucauguuuuuuagagauggggucuugcuguauugcccaagcuggcuuugaacuccuggguucaagugauccuccugccucagccucccaaguagcugggacuccaggcaccugccacugugccuggccagucaauuuuagaacauuuuauugaccccaaaucuacaacuuuugauugaauuuauuuuaaaaaguuaagcuauauaggaaaaagaugggccgggugccguggcucacgccuguaacccuagaacuuugggaggaugaggugggcggaucaccugaggucaggaguuuugagacugucacacacacacauacacacauacacacacacacacacacuauauauauauauaaaauauauaugaaaaagauggaacaaauuaggaauuuuaaggauuaacagaaagcucugaaauauuuuuccuuuaaaauguauucuaacauuuugaaaauguauugguaauauuuaauauuuaaauugauaaguugguacauuuuuaugagaaagucauaggauaggucuaaaucacagagaaaacuuauuuuucaggcuauaugaaaaagccaccuacuauucaauuacucuaauuguaauagugacuaaggagaacaaacucagcuugaauuuuuaagcauaaauuaucaggugauaacaaacauacauuuuuaucuaauaugggugcguuggcucacacuuauaaucccagcacuuugggaggcugaggcggguggauaacuugaggccaggaguucgagaccagccuggccaacauagcaaaaccuugucucugcuaaaaagacaaaaaguuagcugggugugguggcacacaccuuuggucccaacuacuuaggaggcugaggcaugagaaucgcuugaacccgggagguggagguugccgugagccaagaucacaccauggcacuccagccugggcgacagagacucuguuucaaaagagaaaaacacaaaaaagaaaugucaugguaguacucucauuauaugaaaaacaagauaguagcuauuauuaaacaauugauaauaacuaacaucaauuuuaugggcaaccuuggaaucuuuuacuuuuucauagaaauaauagauaaggaacuuuuccuucucuuuguauuuuuuaaguaauggcugcauuucucucuuucuuuuguaggugugugauccuguaaaauuaaaucuuccaagaugaucugguauauauuaauuauaggaauucugcuuccccagucuuuggcucauccaggcuuuuuuacuucaauugguaagucuuacuacuuguuguuuuuuguugguuuugcauuuuuuaauuuccauuuuuuaguguuuuaaaaucagcaaaaacaaauacaguguauuccuagaguauagguuuauucccugcccccuaaaagguccuuuuuuaauaauuugacauuuucuuuauuuuuuauuacaaaaaugauacauauugaaguuaaaauaauuuaaugcauauacuuagucuuuuucagugcacagauauacaaguaauauacugcauauauaucuaaucugcuuuuuccacuuaaucuacugugaacacaaguuuuuuuuuguauuuauaacuuaaaaaauauuuuaucauuauuauuuugaauagagacagggucucaccauguugaccaggcuggucuucaacuccuggccucaagggauucuccuggcugggccuccaaagugcugggauuacgacaggcaugagcugccacgccuggcccauaaguauuauauacuuaugacucuugauuccaguauauaaaaugauggguucucgcauccuguuauaaauaacagauuauuugaaacuuuuuuaguguggcuuuuauuaauuaaauaaaaauuuaauucuaauuagucucaaaaacaaagguaagguaaaggggaacuaaagaaguaaagguaaaggugaagaaacauuaaucuuuggaaaguaguguugauuugcaauuuaaaaauacauuuguagauauaaagacaauuugcuagcacagucuaaagcuugcaaaaucaaguggcuuaaaaauuagaacuggaacaguugauuagaaaaguuuuuggcuuuauuuugguuuaucugguaaaaaggaagaaaagauagucuccagcauaucugauucaugccaguuaaauugucucauagaaugaaacagucucaaucauucuuauucuuaacauacuuguguugaaggauaugaguauuugauaaccuucuuccccuucuaggucagaugacugauuugauccauacugagaaagaucuggugacuucucugaaagauuauauuaaggcagaagaggacaaguuagaacaaauaaaaaaguaagcaaaauguuugcuuauuaugacucugacucaaccuggauguuuucuuucucaagcuaaaauauucuuuaaguagaaaugaaacccauuuuugagucuuacaaagccaguugcaauggcuaaaauaggaguauagagaacaaguuaggcuugggccaacuuucacauggaagaauauggguugggauaagaauauggauagauaccagccggaugcgguggcucaugccuguaaucccagcacuuugggaggccgaggaggguggaucacuugaggccaggaguucaagaccagccuggccaauguggugaaacccugucucuacuaaaaacacaaaacuagucgggugugguagcaugugccuguaaucccagcugcuugggaggcuaaggugggagaaucacuugaacccgggagguggaggcugcagugagccaagauugugccacugcacuccagccuaggcuacagagccagacucuaucucaaaaaaaaaaaaaaaaaaagaauauggauggauacaggaagcugacugauacauuuuuuuuuuuuuuuuugugacagagucuugcucuguugcccaggcuggagugcaguggcaugaucguggcucacugcaaccuccaccuuccagguucaagugauucucuugccucagccucccaaguagcugggauuacaggugugcgccaccaugcccggguaauuuuuguauuuuuaguagagacgggguuuugccauguuggccaggcuggucucgaacuccugaccucaggugaucugcccuccucagccucccagagugcugggauuacaggcgugagccaccgcacccagccugacugauaaauuuuaaaaguauugcuaauaucuucuauccucuucuaaccucuuagucaagccaccugcugcagcaauuuuccaauucuacuuauccuuuacucccaugguuccauuguagagauuauagugaugguagcguuaguguuauuuaauugauacaguuuuucucaaauaugaauuuauuuuuaauugacucauguucauaguuaauccugaccugagaauuccugucuuuuauuuaaugaguagcuaaguguucaguuuuucauuuuaagauacaguuucuagaaacuggauguaaaaauuuaguauaaguugauuuaaaugaacauguaauugaauuuggguugggcuaauuuguaguuuguaauaaucaguuauuuggcccugggaccuaagucuaaaauuuuuagacuuuuacuggagggauucauucacaacuuuuacuaagacagggagguuccauuuacuguaaccauuugggagaaacaaaauuaaaacaaaaaguccuauaguuguauugauucugccaagaggaugucgcuuuuuaaagagaccgagaccguauacuuuuacuuuaaaaagaaacuacagauauaguugaacucaaaaacuucuagucauuuuuuuucugagcguuucauuaaauuguguuuuucccuaugaaauauaaauauucaguuuuuauguuuuacaucuguagaugggcagagaaguuagaucggcuaacuaguacagcgacaaaagauccagaaggauuuguugggcauccaguaaaugcauucaaauuaaugaaacgucugaauacugaguggagugaguuggagaaucugguccuuaaggauaugucagaugguaagucugaagagauuccugaguaagguaauauugccaccauauguagaaauaauaaaauuaaugauaaauucaguucccaggaaaccaguucaguucaguguuguaacuggauuaugccugggugcauuugguuugaauagaguuaauuuagucaaaauccugaauucuuugauuaaaaaagaaguaauuucuuuuuuuguugacuuguuuugaaaucugcaaaagugaauagauuauuuggcauauagcuucauuucugaggguaaucauuuuuauuuuaggauuaccuucaaacuuuaaaaauuuaugucuuuaucugcaaucaauuuaaaaaaauguugggaguguuacuauaaagagaaguauuagcuguguucuaucuaguauuuugaaguuuagaauuaguuugcucaauguggacaaucaaacugaggcugcaaacaguaaaaaugaguaagugauacaauacaauuuguaguuggagcauugaaauguuuuagauacuuuaauaacagauguagaagacuaaaucuggacuuuauuaaggagguaaagggauuaugccucgccccccgccgccccugcccugccccgccaagaaaagaagaagagagagacggaaaagagcugagcuaguuguguagauaaaauacuccaaggguacuuaccaguguuuguaagcagugaaguaaacuuauuaugcacagggaucaggaagccuugaaaagaaaaauauggcaaguacuugugaauacuucuuuacugugagagggaaaugccugugauuauuuucuguacuguauaacaccuugggaacuuuuuuuuuuuuuuuuggagacagggucucacugucuaacuguugcccaggcuggaguacaguggcacaaugguggcucacugcagcuuugaacuccugggcucaagcaauccucccaccucagccuccucaguagcuagcacuacaagcauagaccaccacgccaggccaauuuaaaaauuuuucuuucuuagaaacaaggucuugcuauguugcccaggcugaucucaaauucuuggccucaugugauccuuccaccucagccucccacagcgcuagggauuacacgcgugagccaugguuccuggccccugaaccauuuuuuaaaggaaaucgauauauuuauucucaaguaaugaacuaaguuguuuuauaaugugaaccuuggcacuuuguuguuuuaaucuguaguagucauucuauaaugcuaugagagaguauauauauuuuaauuuuucuuagaauuuuguuuguagcauaagagauauuauagccuucuauaaaacuuauaaaacuugcuuguaaaauuccauauagagauugcaacugagaguuggucguaaaacuaaaaauauuguugggaacagagcaggucaaaacucccaugauugaucuaauaauggaauuauacugguaaaaagccacugcacuucagccugggcaacauggcaagacucugucucuaaaaagagacaaaacagcauaaaaauaugcuugauauaaacucuagcccucuucuaguuauuuguucauuuguacauuuucauuucacgccuguaauccuaguaguuugggaggcugaggcuggcagaucacuugaggucaggaguucgagaggagcuuagucaacauggugaaaacccgucucuacuaaaaauauaaaaguuagccgggccugguggugggcaccuuuaaucccagcuagucgggaggcugaggcaggagaauugcuugaaccgggaguuggagguugccaugagccaagauugcacugcugcauuccagccugggugacagagcgagacuccaucucaaaaaaaaaaaaaaaaaaaaaaaaaaaaaaaaaggccuggucucuugcuguucaaaauacguagcuggcuggacacaguugcucaugccuguaaucccagcacuuugggagaccaaggcagguggaucguuugagaccaggaguuggagaccagccugggcaacacggugaaaccccgucucuacuagaaauacaaaaauuagccaggugugguggcacaugccuguaaucccagcuacugggaggcugaggcaagauaauugcuugaaccugggagguggagguugcaguaagcugagaucaugccacugccacugcucuccagccuggaugacagagugagacugucucaaaaaaaaaaaaacaaaacaguugauuauaaguuaaugagaagagagggaagucucauaccuaacuuuuauucacaaguaaugauacugauauuaaaauuuuaaaccaauuuuuuauuucuuaaggaguguuuagcauucauucuucuugggguuauauaguuaucaguaauugguuuguuugauuuuugcauacuuuauauaaauccucuaagauuagguuuauauauuguaaauuuugguugaucaacgucauguuugauaauuaaacugauuuaaauauauuuuaguaaacuagcuuugcuguugaucuuaaauauauaguuaauaucucuuccuucuccuugaagaauuccaccaaacuuuauauauuuacauauuuauauaauguguaauacauggaagaaaaaaacaacuuuaagagcacauauuuuacuuaccaucuguuaucuggaaguauaauugauugucaaugaaugucauuucagacccauaaauguguucauuucucaaacuuaguggaugcacuuuguuuucuugcuguguuauauaacuaaaaacucauaacuauuauguuaggugaucuuuaccugcuaauacagauacaauuuauauaacagcgucacaguccuuaagcaacacuaggcuuuuggaagauugaacaaguuagaaguaugccaagucuuauucaguguauuuaauuuuuucuuguugaguauguagaacuuuucauggugugguagaaaauaauaaaauagauuuugaacaauccuuauuaagucucuuuaugggaaguuuaugagguucuacaguuuuuuuuucuuugauuuaucuauuucaaggcuuuaucucuaaccuaaccauucagagacaguacuuuccuaaugaugaagaucagguuggggcagccaaagcucuguuacgucuccaggauaccuacaauuuggauacagauaccaucucaaaggguaaucuuccagguaagaucauucuuccauucuauaaaauaccuaucaccuagcuucucuguugaguccauuaacacaauguuaguauaaaaaagacuugcauuuuaagauuuuaaauuguaguuuguuucauagccuucgaagacuaaagaaucaccuucccuuucucuuagggcuuaauaguuacggguaugcuucuagcuucuagcuuguuacucugaaagcuuguauugauagagacuaacuuaaguagggaauuuuaguguguaaggaaaagaaacuaucauuucaccaaauguuuuuauucagaacaccuaauacuauuugaaagcuuuguauguaaagcuauaagggauugauagucaaaguuuauauguuaaauaauuaaaagccaagauguuuuggguauccacauauguuuaaaguguuccauaguauggaacauccuacuuucugaccuauuuuuggcaaaguccucuuuuuaaguuacaguugcuuucaugauaauuuacuuuugccgucccucacuuuuucaaaguuugugacucauuaccacuacuaucuccuguuauugucagcugcagaaauaaaauauguugucugugucuucacauugaaauugauuuucuccguaagaaaaaaucacugggaugaguuguuaaucaaaauguuuucuugcucaucucccuuuauuugaggugaagguauccguugguaaaaacuaaacaugguauaauaguaaauaaaauuucuguuaagcuggaauauaauuccauuaauuugaacuuccaaaaauguacaaauuugcaaauuuucaguuucuacuaauauuauacauuauaacgcuuuugauaagauuauaaccuuauuuuuaaaauugguuucagguuuucauagauauuaaauacuuaauaugugccagcuauuauguuagguacuggggacacauaaugaacaagacauacacuacccucgccauuaggguauuuaacauucuuacaguauaguaagaugagugcuuggaugggagaaauucaggauaccauaugagcacaucaaaagaaaccuauugcuggaccucauaagggauguaaaggaagaauuccuggaagauacacauuaaaaaaauugagaucuaauggaccaggaauuagccagaaaaaugggggagagggagacaggagugggugugggaaaaguguuucagacagagggaacauguagaaaggucaaaaggagagagcauaucauauucagauaacuaacauguaguuuguauggcuuaauguagaguucaagaggugaacgcaccagguggauauggggguuuggcuuugugagaguagugagagcugagacuagagagguaagcagaagccaucucuuggagagcuuuguaagccauguggaagagauugaacuguccugagugcagugcggagcuauuaaaaaguuuguaagggaaauuuaugauuuuuccuuuuagaaaaccauucuggcugccgaauggagauuggguuggggccaagggacgaagaaccagggaggaggcuguugcaaauauuuaaguaagaggugguaguggauagauuaucaagcuacuuauuagaguagaauaguagaauuugaugauguacuugauaggaauuucuggcuucaucaacuggauagauuccauuuaacaaaauagggcuggcaugguggcucaugccuguaaucccagcacuuugggaggcuaagguggaaaggaucccuugaggguaggaguucaagaccagccugggcagcauagcaauucccugacucuacaaaaaaaugaaaacuuagcuggguguuguggugcuugcuuguaguccuagcuauuugggaggcugaggugggauguauucacacugcuaugaagaaauacccaagacuggguaaguuauuuuaaaaaagagguuuaauugacucacaguuccgcauggcuacggaugucuuaggaaacucacaaucauggcagaaggcacuucuucacaggguggcaggaaagagaaugagggccagcaggggaaaugccaggugcuuauaaaaccauccuaucucaugagaacucacugucacaagaacagcaugggggaacugcccccaugaugcaguuaucuccaccuugucccgcccuugauagguggggauuauuaaaauucaaggugauauuugggugugaacacagagccaaaccauaucacgggaggaucacuugagcccaggaguucaaggcugcagugagcugugaucacgccacuacacuccaaccugggcaacagagugagaccccuaucucaaaaaacaaaaagcaaaaaagaaaacaucccaccucagccucccaaauguguggugguggguaauaaauguuauuuagauuacuauauguguuuuguuuaaaaaaugauuauauucccaucaaaaugguccugaauauuauuuaacccugauuucacuguguuuagucuuaggggcaauauucauucuuucucaggugcuuuuuaucuccuuguugacuuuuuuccucuuuuaucacaguuuugggcuaguucuuauugacuuuucuuucaggcaaauuccuuauaaguagaauaacugaaauuuccuaaucacauuauacccuauaagugguaaaaauaauagcaugaauacuagcauaagaguuuuuaggcucccccaacccagauuauuuucuguuguuaauagucaaauaucacaaauguguucgaaggcuucuugugcaccuucccuuguuuagagguaaugacuauucugaacuuggugcguauccugucaucuuuuuauacuuuaucauauauauuuuccauuguauuguguuuuuaaauuuuaugucaauaguacaucauacucuauguaucuuucuacaaccuuuuuuuaaccuaauauuuucaguaaauuuaucuguguugaucagauucaucuaacugcuaaugugguauuguauaacauuauuuauucauucuucuguggauggauguacauuuagauuuuguccaauuuuuugcuuuaucaaaugaaguuugauacaucuuuguugauuucuuuuuguggccauguacucacgugcaaggcuuucucuuaggguauaagaaaucauaggguauuugguuuuucaucauacuuaccagauguggccagauugcuuuccagagcauguauuuauacugucaccagcauuguaugagaguucccauuucuucauauccuugccagcucuugguuuugucagacuuuaaaaauuuuagcaaucugggugugaaauggugggggugagggaggaaggaugcauguauuuuaaauuuucuucaaacaaaaaagucagagaaaugcuuagugaauuuauauugaugccacaucacuccuugauuaguuucaucuguuucuuuugccucuuugggccuaucuuuugaaaugcuuuguugguauuuuaaugaaaaaucugauagguuacaugcauuuugacaucaguguuguccuuauaguucuuaaggacuuccuucaguuuucagauuguuuguucccaacccugauuuguugaauagauccauaucugccaaagauaucaugcuuuuuuuuaagcugugauuuuuuuuagggggugggggucaguaauagaaaaugucauauguacaaaauucaauuugcuucauguggaaguugaauguucacccuucuggucacuugcaucacugucuugguaaguuaauaagguaacuauagcaaacaguagauucuccagacaucucuggagcucacucagcuaucaguguaccacacugccucagaggugggacauuaacuucuaagugugugcauuuuaaacauaauuaucccuuacaaauuaaguuuugauccauuaaguguucuugugaagugcaagaauuuuuggauuacgugucucucucaguuuaacggaugaugucucucucaguuuaacggaugaaccauaaaaaucgauuucuuuuucuuuuuugacauggagucucacucuguuacccaggcuggagugcaguggcgcagcucggcucacugcaaccucugccuccuggguucaagcgauucucuugccucagccucccaaguagcugggauuacaggugcccaccaccauguccagcuaauuuuguuauuuuuaguagagaugagguuucaccgugucagccaggcugguuuucagcucuugaccucaaguguuccguccaccucagccucccgaacugcuggaauuaaaggcaugagccacuaugucuagcuaaaaauguauuucuaaauaauguuuuuccuauagugccuaugauauuauaguuuauuuucuuuauuuucuuuauuuuuuugagacaggaucucacucugcuaucaacccaggcuggagugcaguggcacaaucacagcucacuacagccucaaccucccaagcuaaggugauccuccuaccucagucucccaaguagccaggacuacaggcaugugccaccacaagcagcuaauuuuuguauuuuuuguagagacaggguuuugccauguuauccaggcugguuucgaacuccugagcucaagcaauccacccccccgcaccccgcagccucccaaaguggugggguuacaggcaagagccacuguaccuggccugauauuauaguuucuauugugacaauaaauuaaaagacucuuuaguguuaguuuacuuucaauuugguuuauuauauucaauuugguauguucaugucagucauccaugccucuuccuuugaaccaaaggaauuuacaacuuauucuuguuucucaucaaacucgguuugcuuuuuauaugaagcuuuuuacagucuuuuucugcccauaccacuuuccuuauuucauuuucuucuuuguuuucuugccuacuuuuucuucucauguucucuacuuuggaaacagccuuccuuuucaaaugcugcauuacuuuugauuuauuuuaaaaucagauucccaggcagucugccuuuaauauuguuaauagaucaguaaguaagacaagcagaaauacuuuaccaaagcagaauagcuaaaaaucuucuacuaucucugccaugcauguucaaauaauguugccagaauaucaagucauguaaaaaaaauuauuggugcuaucugcguggauuaauggcauacugucaucuuauguguuuugcaugucccuaagagaaacauuuauaauugcugcauuaugagcucaucuucucaguuuacuaguucucguaaccgaaaaaauaauagcauugucaaaauuuaauaugcaucuuuaguuucuggaacuaacucauguuaaacuauuaagaaguuaguuucuuagcaucugcuguuguuggacuauguccauccaaaauuuagguggugaaacuucauggccagugugaugguauuaagagguggggccuacaggaaugggauuuaaggcccuuaugaaagaggcuuuaugcagccacuagcucucuugcccuucagccuucaccaugugaggacauagcauucuuccccucuggaggaugcagcaacaaggugccaucuuggaaguggagagcagcccucacuagacaauugaacccgcuggugcuuugaaucuuggacuacccagccucuagaacugugagaaaauaaauuuguuuuuuuauaaauuauccaguccuugguauuuuguuaugggagcauaaaugcacuaagauaguauccuuuccuagaguggaaggcgggauagagaauuauuuaagggaaaaacaucaaaacgugggucuucaucuucauuuuaggaguauacugauaaucaguuacugccuguaagugacuaauggggccagaaaaaaaaagugaauggagaugauuguaugauuugaauauuugauuauauugggucaugugauccuccagugcauacaccuccaagcuuggacucuguuugauacuggaauucaacagcucauugucagaccagggcaugcuuuucuguagucugcaaaugucugaucacuagcaaaacgugcccauaacuuuacuuccuuuugauuuauuucucauaaaugccuuuucuguuagcaucuuuuuaaaaacauaugugaccaccauuggauagguuauagcuaaguccgguucugggcauuuuagugacucuuugaaguguauucaaucaaaauuuauuaaagaaaccacuguuguguuuguuucucuaccaguuuucuuugugauguuaucggacacuuaauaaauauauacaguuuuauguguuuuaucagagaaaauguaggcuagucugucuuugaccaguaguuucuggucaaauacaauauuauacuaguauaauauugacuuagucucagaacuguauauucugagagaaauguuguuggagaagucauauuuucuuguguaggcuuguuguuguuuuuucacauaccugucauuuuuuuuuuauagugucagaaagggaacuaugugauuuucuguguaacagcauaaaaagagcccuguaggacaugacuuucuccuuuuuccauuauuuauaaaauuucuuuuauuauggaaaauaucaaaugucacacauacacaaaaauaaagguaauaacauaaugaaccuaugccaucaccaagcuccagacguuuuaaacauuuugucauucuugguuuaucuacuccuuccacccuuucuuucugucauuuuuguuggaguauuuuaagagcaaauccuagacaucaugucauuuuauccauaaauaauucaacaugcauaucuaacugaucaggucuuuauuaaaauuuauuuuuuugaggcaagauuucacucuaucagccaggcuggagugcauuggcaugaucauagcucacugcagccuugaacuuuuggacucaagccauccugcugccuuagccuccugaacagcugggacuauaggugcgugccaccacaccuggcugauuuuuaaauuuuuugcagagaugugcuauugcuguguugcccagucuggucuugaauuccuggccucaaguaggucuuuguaauuuauuuuuaauuuuuuuuuagagacagggucucacuuuauugcucaggcuagagugcagugguaccauuauagcucacugcagccuugaacucuugggcucaaguguuccuccugccuuagccucccaaguagcugggacuauagguauaagucaccugcgcccagcuggucuuuuuaaaaaaguaacauaaccacuuacuaucucccugcuuaacaaaucgacaguauuuccuuaauauaauuuaauacccagucaauauuauuucucuggugaucucaaaguuguuguuuuacaguuguauuuuuuuaaauuaugucuguuaagucccuuuuauucccuuuuccuuuuuuuucuuucucuuuaugacauugguuagcuggggaaaccuagucauauguuauguggaauguuccacauucuggaguugacuacuuuggugguuaacauguuccuuuaaugccuauguuuccuacacacugguuagagcuuguggcuugauuagauucgaguuaaauuuuaaaauuaacuccauagguggcgcuaugaacuuucuuuugaacugcgugaaccaacaccuaauguccugucccacuuuuuaugaugcugauugaugagugagguucaggugaugagagccugaucccuccauauaaaguucuccuuaaguuuuaucuacugguuuuggcagccuuugaugaucauugccuagaaccacuauuucauuagggguuacaaaaugaugauuuuuuucauuccauuauuccuuuuacuuuuauuaacuggaauucuauaaacaggaacauccuucaugaaccauuugguuacccugaacuauauauaggaaaggcaggguaagucuauaauuagucuucuuuaucaguuuucagaguaaugaguugguguccuaaccauuuuuaguagugaucuguaauuuucaugacauaucaugaauauggauauuauuauuuuuuuuuuguauuucagccuauucaguauuacuuugaucucagauuaucccauuuuaggccaguggggagcaucuuuagauaggcuuguuuuuuugaauugacuguguuauuauucuuugauagagaggaaacuuccuugcuuucuggcacaguuuuuuuuccagguuucuauuccagaguaggaacuaggcauuucuucaaugagccuuggcccuucuuuuuccccccuuaagagauagguucuugccauguugcucaggcuggagugcaguggcuauucacagaugcgaucauggugcacuacagccuggaacuccugggcucaagugaucuuccugcuucagccuucugaguagcugggacuacagguuuuccacuccuugccuggcaaggcuugauugcuuugaacagggaugacauuuaagcagcagagucuagcuagguucuaggggugauuauugcuauauaguuugucauaaacagagacaggaaauauguaaguucauauuguucaaauugaaaaccacaggguuuauauuuauaucucuuuucuucugaaaauuugguuccuaaggauauuaacaugauuauucuuuuauucauacuauuaacucauacuauuuuauucauacuauuaauaacauuaagacuacugaauacagguuuuuuuguacuuuauauccuuaaaauauaucacucuagauaugaucagucaaaaucuuguuuuaaagacaucugagguaauucauuucucuuuguggcuaugcccuuaacauguuauacaguugaguucauuuauuucauuuccucagauuuuuagggauuguccucguuuuuucuuuugauucauuguuuucauuuguuuguuuuagaaacaauaucuuguucuguugcccggccuggagugcaguggcaugaucauagcucagugcagccuugaacuccugggcucaagggauccuccugucacagccucccaaauaguuaggccuacaggcaugcaaguaccaccauaccuggcuauuuuuuuuuauuuuuuauuuuauuuauuuuuauuuuauuauuauuuuuuucagauggagucuugcucugucgcccaggcuggagugcaguggcgugaucucagcucacugcaagcucugccucccggguucacgccauucuccugucucagccuccugaguagcuggcacuauaggcgcccgccaccaugcccggcuaauuuuuuguauuuuuaguagagaugggguuucaccauguuagccagguuggucucgaucuccugaccucaugauccaccugccuuggccucccaaagugcugggauuacaggcgugagccacugcgcccagccuuuuuuuuuuuuuuuuuuuuuuuuuuuuuuuuuuuuuaaauauauugucucauuauuuugcccgggguugucuugaacucccuggcucaggagaucuuccugccuuggccucccgaagugucaggauuacaggcucuagccgccaugcccagccaauuuauuguuuuuaauuauguaaaacuuuuaaauucuuugacaguccaaacuagacuaauaagguacauuaauagaagucucacuuucauucuuauacuuuucaaccuauucccuuccuuuuucuaugugaccauuuuguuaguuuuacuauuuccaguuuuuuaaaauacaagcaaauauauaucuacuccuauauucucucaacauaaacacaaaagauagcguacuggcugggcgugguggcucacaccuguaaucccagcacucugagaggccaagguggguggaucaccugaggucaggaguuugagaccagccuggccaauauggugaaacaccaucccuacuaaaaauacaaaaauuagcugagcgugguggugggcaccuguaaucccagcuacucaggagggugaggcacgagaauuucuugaacccggcggggcacggagguugcagugagccaucgcaccacugcauuuuuagccugggcaacagagugagacuucgucucaaaaaaaaaaaaaaaaaaaagcauacuauaaauacuguuauguacuuuggugcuuuaauuuauugauauaccccagucauuacuucauguauagaaauccucauuucuuuuuauagcuacguguuauuacucuauuuuguggagguucuacaguuuuuuuuacuuauugucaguagaggaugauuuauugggaaacuuagagauggaagcauggucuugggcaguagcaagacagguagaucucugcaccguuaguccccagacccaugacuuaagugucauagggaaaggauguacaugcucuguagggacaaaggcaagcuccagaacaggcaagaaugcuaugcgugucauagccuguaauuuuugugauaacaucaagguugcuuugcucuaaaggcaggauuuauaguggguacauguuccuacacuaaggacagcaaguaaaguagaaaucagcaggcauucgugggacugagguuaaucaaaagugaacaugguagauuagcaugcaagauggagucacuguugucuucacacccaucaguuucuacuuuuuucaucccauuucuuaauaaccaucuaaagauugccacccugcuagagcgcgucccaugaccauccccuuucuuuuuucccuuaguuucaccccuaucaauguugucuuuauucaccuuuuuuuuuuuuuuuuuuuuuuuuuuuuucuggacggagucuugcucugucacccagacuggagugcaguggugcaaucuuggcccacugcaaccucgcuucccggguucaagcgauucucgugccucagccuccccaguaguuggaauuacaggcgugugcuaccaugcccggcuaauuuuuuguauuuuuaguaaagacggccuuucgccauguugcccaggcuggucucgaucuccugagcucaaguaguccgucugccucccaaagugcucaaauuaccggugugagccacugugcccagcccuuuucuuuaauuuagacuggcauuuauguauaccauuuucauuuuucaucauucuuuauuguaccucagacuuuccuuuuggaauuuuccuccuugaaacacauuguuaagaagcccucaaaugugcuuuguuuggcuuggaauucuuuguuuccugaaucugaacuuccaugcauuuuaauuuuggaaauuuuucuaccauuaucucuuuaaauacuaucuuaucuauauucuuucuguucucuucuucuagaauuccaaguagacagacuuuaguuuuuuugucuuuguguguguuuuguuuuuguuuuuguuuuuuuuaagagauggagucucgcuccgucgcccaggcuggagugcaguagcgccaucuuggcuuacuguaagcucuaccucccagguucaugccauucuccugccucagcuucccaaguagcugggacuacaagcacccaccaccacgcccggcuaauuuuuuguauuuuuaguagagacgggguuucaccauguuagccaggaugaucgcgaucuccugaccucaugaucugccugcuucggccucccaaagugcugggauuacaggcgugagccaccgcgcccggccuugucuuuguguuuuaacuagcauuucauguuuuuaucucucucuacugcauucuggguaguuuaugccaugauaauuuauucagcucucucugcuggauuuauuauuuucuuuuuaguuguguuuaaucuauuuuuuuuuuuuuuuucgagacagcgucuugcucugucacucaggcuggagugcaguggcgugaucuuggcucacugcaagcucugucuccuggguucacaccauucuccugccacagccuccugaguagcugggacuacaggcauccgccaccacgcccggcgaaguuuuuguauuuuuaguagagacaggcuuucaccguguuagccaggauggucucaaucuccugaccucaugauccgccugccucagccucccaaacugcugggauuacaggcgugagccacgcacucggccuuaaucuacauuuuaaccagccuaaugaguuuugaacugucguugguuaucuuuaugauuuuuggaaggucuuuuguuuuucccauuccaauaugccugcucuuuguugggguauuuuuuauuuuuauuuauuaauuuauuuauuuuuugauggaguuucauuguuguugcccaggcuggaccgcaauggcgugaucuuggcucacugcuaccucugccucucagguucaagugauucuccugccucagccuccugaguagcugggauuacaggcacccgccaccaugccuggcugauuuuuauauuuuuaguagagacaggguuucaccauguuggccaggcuggucucgaauuuccgaccucaggugauccgccugccucggccucccaaagugcugggauugcaggcgugagccaccacgccuggccuaggauaucuuauuuguucauauuuucuauuuuuaaauuuauuauaauuuucucuauagcauugaaauuaucuuucuuaaugaaaaaugcuauuccauuaaauugauauaucugccuauauauuccuuauuuccucgcuuuuagcuuauuacaguuuuuagcuauaauauguuucagccacaaaaaucuuuuauacaggaagguccccaaccccuaguacuaaaucucaaugaaauaacugaaaaauaguaguauuaagucauagaguuuaaauucuucuuuucucuuauugcugaauuucuuaaaagcaaaguuaccaguuuacauugcugcuuccucccacuauuagguuuugccauuuaauguuauaacaucaggagcacaaacuucuggagguguauggaacagauuccauuucuuacuuuuaaacaugugaccuuggacauauuaguuaaccucuauuuuaguuccucaucuguaauaagauggcuuugaggauuaaauaagugacaaauacuuggcagauaguaagaccucaauaaaucuaggccauuauuuuaaaauauuuuuauuuguggugguuuuaauuucuucagugaugaaugagacuaaguauuuucugaaguguuuucuauuuauauuuuaucucaugugaacuaucaaauaccuccuuuucuuaaaauagaaguuucacugcagaagcgaguugacauaauaacaccaaaagcacaagugcugaaagauuaauaaguuggacuucaucacaguuucaaaagugcaccaucaagagagugaaaagacaacacacagaaugggaaaaauauuuuaaaaucauguagccgagccaggcaccugcaguggcucacaccuguaaucccagcaguuugggaggcugaaguggguggaucacgugaggucaggaguucaagaccagccuggccaacauggugaaaccccgucuugacuaaaaauacaaaaauuagccagcaugguagcacacgccuguaaucccagcuacgugggaggcugaggcaggagaaucgcuugaaccugggagauggagauugcagugagcugagaucgugucacugcacucuagccugggugacagagugagacucugucucaauaaagaacucuaacagagugcaagcaguggugcagucauagcucacuguaaccuugaacucuugggcuuaagcauucuucuugccuuagccucucagcuagccaggacuacagguaugcaccacaaugucuggcuaauuucuaaaaauuuuuuuuuuguuagauaugagggucucauuacguuguccagguucgucucaaacuccuggccuuaagcaguucuccuuccuuggccucccaaacacuggauuacaggugugaaaccaccgugccuagccaccaaauuuuuuaaaugggcaaaagcuuugaaaagguauuuuuuccaaagaagauacacaaauggaaauaagcacacgauaauaggcccaacauaacuagucaccagggaaaugcaaaucaaaaccacaaugaaaugccucuucauacucaccagaaugucuacaauaaaaaaggacaauaacaagcauuagcaaggauguggagaaauuggaauuucauaccuuguuggugggaauguaaaaugauguagccacuuuggaaaacaguuuggcaguuccucaaaacguuaagcguagaguugcuauaggaccagucaguuccauucauauguauauacucaagaaaugaaaacauguucacauagaaacuuacacacaaauguucacaguagcauuauguccagaauaggcaaauuuguagagacagaaaguagauuagugguugucuagggcuggggcaagguggggaaguuaauggguagugacuguuaaugguuacaggguuucuuuuuggagugaugaaaauguucuaaaauuagauuguggugaugguugcucuacucuguaaauauacuaagaacuacuguaaucuuucaaugagugaauuuaugguauuuaaaugacauauuaaugcuguuuaaaagaaagaauccaguugacguauuuaccucuccuccuguacauucaucucuugcccagauuguugguuagggaugagauagauauaucucauaugguggccgggcgcgguggcuuaugccuguaaucccagcaccuugggaggccaaggcggguggaucaccugagaucaggaguucgagaccagccugaucaacuccaucucuacuaaaaauacaaaauuagcugggcaugguggcacaugccuauaaucccagcuacucaggaggcugagacaggagaaucacuugaaccugggaggcggagguuguggugagcugagauugugccauugcauuccagccugggcaacagagcaagacucugucucaaaagaaaaaaaaaaaaagagauguaucucauaugguaauuccuacuguuaggaaauaguauauuucaacuuaauggauguuucauuuugguaugauggcugauaauuucagucuuggguucucuagguucuguguccccuaauaccagcugugugauucuuguuuaucuacauuauauuauagauuguuccauuguuuauaaaauuaggguaauuuuugcucauccagaggauuauugugaacuucaaauagaagugagacagcauuuugaaagcuguguaguccuaaauaaauacacaguaguguuaagauuccuaaaguucucuguauuuucuuuucauaggagugaaacacaaaucuuuucuaacggcugaggacugcuuugaguugggcaaaguggccuauacagaagcagauuauuaccauacggaacuguggauggaacaagcccuaaggcaacuggaugaaggcgagauuucuaccauagauaaagucucuguucuagauuauuugagcuaugcgguauaucagcagggagaccuggauaaggcacuuuugcucacaaagaagcuucuugaacuagguauguuaucugggccuaauuuaagguuauaguuauauugagggauauauauucucuauuuuucugucuuucccucauuuauauaugguauuuucuuacuuuuuagaagucaggagcuuuacuuguuaaauauacauuauucucuucuuuauucucaaaguaaaugauggcugauuuuucucaccuaauagugcuauaacagugguuguguuucuuugcucuauauucuccaggaauuucaaaauugaagcuaacguaacuaagucaaaaauguuuguuuaccauguugccauuuuaaucaguuuccuuugaaggguguuauguuuuauugcauuucauauuuuaaaauaaagugauuuaaaauagaugggcugaaaauauauuuaucauauucaaauguuggaaaaauacaccuuaggagaauuuuaucaguaguacuuugaacagagauguaguguuucuucaaguauggcccaagcaccacgugcaucagaauuacuuggauacuuguuagaaaugaaaauuucuugaucucuacccuagaucugcuaaauuguaaucucuggagauggaguccagaauuuguaugauaauaaguuuagguggccuuugguauauaacgaagcuuuaaaacuuuaaaaauuauuuuuacaaaauaggaaaauaugugcauguuagaaucaaacagcucaaaaggauugaucugcugaaaaugaacuuuggauaauuggguuauuucuuaguuggguaauaauaaaucaagauauugguucaaguaaucuuuuuuccuuucaguauuuuccagugguauuuccucuugacuuaaaauauacuuuguacucauuauagaaaauuuauuaaaacagagaaagauacagaagagucaucuauaagccagucacucaaagacaccuacacauuuguuuccuuuuaguguauacgccucuucccugcacacacuuuuccuuugcuuuuacaaaauuagguuaauauuggauaucguaacauuuauugugagcaguuucugaaggacaagaaauauuuuacaaucuaagccuagguauccuaaacacuuaguuacugucacaagugaagucucuauauauucuucugccuuuuuauuuuuaugugugugugguucuuuaguuuuuuuuuuuuuuccucucagauggguagcguagucaucuuuucuucuacuaaaagguaguucaaaauuaugacuagcaauucugaggcaguuaguggauuccagcuuauucgaaaauuauaucuuuaguuucccuuuuccuucuuacuuagaaauuugggacugaacuucacucagcccuuagaaguaggcuacauuuauaauguaucugugguaaagguugcuuuugaauugcuuauccccugucuuccucaugugauuguuuuucugucuuggaaaaaucuuuuucauuucuuaaaauaaguaggaugaguaagauuuuaaacuucauuugacaucaaauugaacuuaguuccuuuagcugauuaguaaauucucaaaguaaaagcaccaguugccaccuuuaaauaaauagcuguuucugucuccagaacugucuuuuuugagacaggguuucacuccuuuugcccaggcuggagugcaauggcaugaucucggcucacugcaacccccgccucccggguucaagugauucuccugccucagccuccugaguagcugggauugcaagcacccaccaccacgcccagcuaauuuuguauuuuuaguagagacgagguuucacuauguuggucaggcuggucucgaacuccugaccugaggugauccacccaccucagucucccaaaaugcugggauuacaggugugagccaccaggccuggcccagaacuguuuuuauauaggugacuauauguccugauuuacuugggggcaguaguaacuuauaccuauuauuuugguauaauaauuuuuauuagugccuccuuucacucacaacagcaaccugguuuggaagauaaauuauaaugucuccuauuuuuauauuacuauauucugaugcuugaacaagcaugaacuuacccauggacaugcuuuguuucucuucuaauagauccugaacaucagagagcuaaugguaacuuaaaauauuuugaguauauaauggcuaaagaaaaagaugucaauaagucugcuucagaugaccaaucugaucagaaaacuacaccaaagaaaaaagggguugcuguggauuaccugccagagagacagaaguacgaaaugcugugccguggggaggguaucaaaaugguaaaguggaaaagccaauuguguguaugugaauguguguguguauguguuuguacacaguucuggagagaaucaguuauuuuauauuuaagccuaugugauaaaaaucagaaugacugcauaaaauauuacaguaugucagcuuaggcaacauagaccccauuacaaaaaaauuuaaaaauuagcugggcaugcugguguacacuuguagucuuagcuacucaggagucugaggugggaggaucacuugaaccaggaguucaggggcacagugaguuaugauuacaccacugcacuccagccugggcuacagaauaagacccugucucuaaaaaacuuuuuuuuuuuuuuuugagauggagucucacccugccacccaggcuagagugcaguggcaugaucucggcucacugcaaauuccgccucuuggguucaagcgauucaccugccucagccuccugaguagcugggauuacaggugcccgccaccauacccggcuaauuuuuguauuuuuaguagagaugggguuucaccauguuggccaggcuggucucaaacuccugaccuugugauccaccugccuuggucucccaaaguggugggauuacaggcgugagcugcugugcccagccuaaaaaacuuuaaaaaaaaaauuacaguauaccauucucucucugugggugccacauuuaauauguuccaauuauuaguaaaauagcuuuaaaauaaagcuugugaaucauauacuauuacauauguuuggggcaauauuaccuuuuucauuugauccuuccagggugaaggaucaaauaaguuuaaaggaagugauaguuuuuuuuauauuuaaugcaagagagauuucagcaguauuuuuuuuuuuuuuuuugagacagaaacccacccuaucacccaggcuggaaugcgguagcgcagucucggcucacugcaaccuccgccuccuggguucaagcaauucuugugcuucagccucccaaguagcugggacuacaggcauucgccaccaugcccggcuaacuuuuuuguauuuuuaguaaagacgggguuuccuuauguuggccaggcuggucucaaacuccugaccucaggugauccucccgccucggccuccuaaagugcugggauuacaggcgucagccaccacacucaucuguucagcagccuuaauuagagacaauaacacuacucugugcaucuuaugagauacaacagauucaucuauacaauaaucccuuguaguuuugcuccuaguuaaucuucacaagauugcuuagugaaaugcuuuagucuguuuaauacugaaaaugcagaaaguuuucaacagauuuugucuuuaauauuucuuuaaaauauaucuauaaauauuacuuuguuuauuguauauguauuuauaacucagaauuccaguucuauagauguuaauagauacuaggccaaaagcaaaaagaacaaagucuggggaacauuuguuaaacaaaguugaacauagguuuuuguuuagccucaaaacuucucagaaccuuuuuaugauaaugugcauugugauaugauauacauucuuucucaauauuaauugauuauggaaccuuuugaaaaggaauuucaugugguauuaguuuucaguugaacacaggcuugcauagaaggaguuagugaauuuuuggaguaaguacuuuuagguguaaacauuugaaaaguguuuaacauuuucuuuacuacugguaaacucaagcugggcuuugcauuucgauauugaugacuguugacagcuuaaccacuaacagcaaaguauacaauacguauggugacacuuucaauagauagguucauggaguccuaggaggacaugcuugagcuaaugaguaaauacaaagauggugacacuguuagacucauuauuuucuuuuuuuuuucucugagacggagucucgcucuguugcucaggcuagagugcaguggcgccauuucggccccuggguucacgccauucuccugccucagccuccugaguagcugggacuacgggcgccugccaccacgcccagcuaauuuuuuguauuuuuaguagagaugggguuucaccuuguuagccaggauggucuugaucuccugaccucgugauccgccugccucggccucccaaagugcugggauuacaggcgugagccacugcaccuguucccucauuaaacauuuucuuuucuguuucauuacuaaauauuuuaguauguaucuuuuaaagauacaaauucaaaauaacuacaauaccauuaucaccuaaaaauucacaaguuuuguaauaucaaauaucuaguguucaaauuuccgcaguaagcagaaauuuuuauugcucuuaauaacucuuaaggaacaaaauaaaacuguagauauaaaacaaagagucugcuaauuucccgguuuguuaauguaacacauacucaacuuugccuaagaucaaaagaacauucuugccaggcacgauggcucaugccuguaaucucagcacuuugggaggccaagguggguggaucaccugaggucaggaguucaagaccagccuggccaacauggugaaaccccaucucuacuaaaaauacaaaaaguuagccgagcaugguggcaggggccuguaaucucagcuacuugggaggcugaggcaggagaauugcuugaacccaggaggcagaggcugcagugagccgagaucaaggcauugcagugcagccuggguaacagagcaagacuuugucuaaacaaaaacaaaaacaaaaaauucuuuuucucagaauagcuacauucaucucaucauuauauaaaagacuuacuaaaaauuaaagccuuggauuugacucuagguaaagugcauggagaauaaacaugaaucauuauuuguuuuaguauacuauuaguauaauaauugaaacagacuacucauauuccugcuuaugugacauacuuguuuuuguuuuguuuuguuuuuuugagacagcuucuugcucugucacccaggcuggaguguaguggcaugaucauggcucacugcaaccucuaccuccugggcuuaagcaguccucccauuucagccccucaaguaugugggacuacaggcaagugcccucauguccggcuaauuuuuuaaauuuuuuguagagacgagauuucgcugugugaccuaggcugaucuuggucuccuugggcucaagugauccuccuaccucagcaucccaaagugcugggguuauaggcaugagccaccaugccaggccugacauacuuguuuaauuaagagaaguaggcaacaaaauaacuuauuaauauaauacauagaugauugaagggaauuuguuuuguugacugcucuauuuuuauacugccuaauaaaagcaucugggaucuuuguuuaauaacuuauuuuuucuuuuucagagcuauccauuuuuuauuuugcccuuaaaaaaauuccuuuuuuuuuuuuuuuuuuuuugccacaagcauuuaacugugagguauuuaggaaaaccuaguuuuuuuuuucuucuagaaacuuuuugucucugggugcuuuccaguuacuuugugccauuuagagcaaugccaggcauucauuuaauauuuucauaaacauggcuuuuuuuucauauuuaaacauuugaacuuuauuuugaugagugaaggguuaaaagagauacacuaccuuucuccuuauuuaagaccucgccucucucacccagaaaauaaucauuaauacuguauuuaaaauucugaacauccuguuugaggcaaaauauuugcagaguacugcuucuuuuguauguuuuuccagagauacucuguauaugcaagcaugauuauugucucuuaucugcauaggaauagauauuaaaaguauuauuacuguaauauauucaucauauucuuaacuuuauguuuagaccccucggagacagaaaaaacucuuuugccgcuaccaugauggaaaccguaauccuaaauuuauucuggcuccagcuaaacaggaggaugaaugggacaagccucguauuauucgcuuccaugauauuauuucugaugcagaaauugaaaucgucaaagaccuagcaaaaccaaggguaaauaauguuuucuuucuuucuccucaauuuacuguaccuuuguaucaauuuuucuuuguaaaaaaauaggauaauugauauacgaauaaugccacagauuuuuuaaagauauuuugccucagcauaauggaguuacuaaugaugcuguguuuaugccaguuuuuccauuuguuaucaacacaaguaauguacccuuaacuggguuuuaagcacugaauuaugaaaauuauugugagauuuuuauucaccauuaacaaauuuguguuucacugucuuccugauaaacuuuucucuguauuuuggagucuuuuaaucucagaggcuacucaaagcccagcuuuuucacuucuguauuuuuacugaaagaauaccguggaaguauuuuuauucccuuuuaggcacauuguuacuauuauaaaaagauauaauugggcacaaguauuauguuaauuugaaauggugauaguuuucugacuuuaacccacagaauuuaucuuaaaaagaaaaagaaucuaacguaaacccaaucuauaagcuuaguguugagcauaaaaacucuuuagugagaauguggaaaagacuacccuuuaugcucuugccuuuucccccaucagcuuguucuuaaaacauauuuggucuucuugauaguaaaauacaagcugccaucacuuucauaaagagauuguugaauaaauucuaggcaugcuuugcugucuuacacaggaguuggcagauuuuuuccauaaaggucaauauuagauauuuuuuaggcuuuggaggccauaugaucucugucaugacuauuuaguucugccauuauagugcaaaagcagccaaagaaaauauguaaaugaaagaguguggcuauauuacaguaaaauuuuauuuccaguggcagguagcaggcugaauuuggucuguggccauaguuuguugacccuuauuauaucaaagguuugaauuaucuggauaucuauacuacaaaaugaaguuagaauuucuuuuagaguuuuucugcuucuccaaauuggugguuuuuuuuuuuuuuggccaaagauuacauuauaaaugcaaaagacuggucuaacauuaauauauauuauuggugccauccaagguaauuaauucauuucaacuuggagaucaaguuauauucuggagauuccucaauuuggauuguuuuugaucaauaaauuuaauggcaauaaaauuucaugcucucacaaccucagaaucaucguuccauuaaaaaaaauugaaauuauuaucuaggcggucaccucuuucuugcuguuuuuaacauuuaugagcucuuuuccucugccuuuguucucaguccaagauuauuucacuguauauguuaaugagaguggcuaucuugaagggacaaaagauugaccuuaaaaugaauuuuaaacauuaaccugugcaaacaguuccaucacuaaaaaaaauuaaagucaaagguuuuggaauggaucauuaauugcaaauaggcauucuucuuuuuuuccccuucucuccccacccccagauggcuauuuuaacuguaaauuagacuucaaauuuuagauaugucucuuuuucuuacugucauguccuuucaccauugaaagaaauuuaauuuccaaucucuuuuguuuguauguccuccaucuaugcaaaacaaaaaauugaagaaaaaaaaaaaaccccaaaaaccuaaaaaacuaacuggcuuucaaggcucagcacaaggugacuggaaguguauggaguuauuuucucuuuuuagccuccuuuguaaaaacccuggaauucugacugguuggguaaaugugauucaguuuuuuguuuuguaaugcaacuauuuugaugguuggcuucacagcugaggcgagccaccauuucaaacccaauaacaggagacuuggagacgguacauuacagaauuagcaaaagguaagagauguguaugcugcauauuuugcccucuaaugaguguuuuauacaucuuacaggaauuauucauuuaaggaaagugggucauuuucagucaccagcucaagucaccacccuguauauaaacaggauaacgcauggauaaacugcuuuguguuucacaggucuuucuccuucacuagaaguucuguuuuuaaccuuuaauugguauguuauuuuuagggaauuaauaugcuuuuuaucuuucuucagaucaggugucaaauauccaggaaguggccugauacuuguuuucuuuuucccuuuuguugccaaagggggaaauaaagcagcagccuccugaaucugggaguaguagucuucaccuaugcaguuuucucauauucauaaaugcugcggugauucauauccuccuucauggugauuacguuggcauuuguucauacaucuuguaaaauaacauugucauuauguaguaaucuguauuccuccuguuugaguuuuuuauuuaaaaaaauucgcugacucaaaaguuggcaguaggaagaacagaguuacgcuucugagcucugucuuccaaaaauuaguuguaaacuuaguugccuuuuacuuugccagagagauuuaaaaacaguuuuaucucagugagagguuugaaaaaugaauuuaaggagucuacuauuuuuuuucaaaauauuuaaauaacuucuagaucugagaaaguuucugugaaacccagugcuauaaaucauuuacauacagcuucaaaugauuuuuuguuuaaaaaaagugaaaggacaauaaaucuacaacaaaaaucugucaacucauuuucucuugauuuggaaguggcuguucuuacugccacuuuucuaaauguuuuuguggauucgagaccauuacccaccauccagaccaaucugaacccuuccaaucaccuguggcuuggcaaaacaaaacaaacaaaaagcccaaaauugccugcuacuggaguaaguccuuguccuuucucuuuuuuuguagcugagccgagcuacaguacaugacccugagacuggaaaauugaccacagcacaguacagaguaucuaagagguaagggaguaauggagagaacuuuagucauauuuggaccauuucuuucuugggaaucuaauuuucugaaaacucaugauauaguuucuaagaccuaggugguuaggcauagauguuugauaauaucugugcuggaguuuucaugacggacuaauaaacaugguuauggggcaguuaauagggguuuuccaaaguaacauuaacuuacauaaugucuguugaggcuccccaaacuuugauaagugaaauguguucucauauugaacuaagagaaguucccaaauucccuucauuaaacaaggccucuuuuggacucugcaguaaagcagggguuuaaaaaucucagggucaccuaguagcugcagguauugcguaaguaagugccuuuauaacaaagccuuugcaaguuccuugcuuuuaacaguguuuaaagauaaucuuauuagguuauuaguugauugaucacuaaaauguuuuuuaaaaagagcucacuguguaacuuagagcucacagaauugggugacaguauuacaauagaacuccuuuuccaucuacuugugaagguuucucggcucucaugaaaauagaaauaucuuugugcugaauuuuuauucuaacaaguagaauauuuauccacagacacaauaacuaaugaaauauaacaaacauaagccccauccaucucauuaggaacaucuuaauacauuuucacuuguuuauacuugauaaugauuguuuagucauguuauuuagauuaacaaaugugaauaauaauuauaguaacaauccagaagauacuaucuuuaacacagccuuuuuauaggucuuuaacacaggcuuuuuguuuuaggaaauucauauuuuuguuaauuguauaaauauuuuuaauauagauaaguauaaugugauaaauaaaagauuuucaggcauaaaaaugugucacuguaggacaagguuucuuaaccuuaucaauagcacuauugacauuuugagucagauaauucuuguucuugggggcuaucuucagcuuuguaggauguuuaauagcaucugugguucacuggaugccaguagcacccuuccuuaaguugugacaaucaaaaaugucuccagacauugucaaauguccccugauagguaaaauccccaccacuaccucuagugacuccaccccuguugagaauuaacuguucuaggauaagaauggaaugaaacuauaacaucaagaaaaaaaaaaaagauguaaaauguccaaguauuaaaaaauauuuuguucacauauuuuaaguggaugaugguggauaucaaaucauuaugguauuuagauuccaguggauacauuuaaaguaaucauuuuuuagaaauuaccaacguuuucaauaugacaauucaaucauucgaaacuaaauuaugaaaaaauuuaguugucaacuaaaaaauuuaugcaaaggcaaacauagauuuuaacaggcauuuuaggagguacucagagaaauuuugaagauuacugcugucuucaaaaagaaaaagauuaggcuggaccgaauguguugauucagcauuuccuuuuucuuuuuugggcaggaccauaugccuuuuauauauuaaccuuaaacguuacuauacacgucuugguuucuugucucugcuguauaacaccaccugcccuuuugccccaguaagagagaaaaauuuuuuuucuugccuaucacuagcuucauagcugagaccccuauaacaaaagacagauuaacaagagaaaaucauacaaauuuauuuaauacaaaauuuacuugacaagaagccuuuagaaaugaagaccgcagccugagcaacauguuaaaaccccaacucuacaaaaaauacaaaaaaaauuagccaggugugguggcauguaccuguagacccaguuacuugggaggcugaggugggaggaucaccugagccugaggagguugaggcuacagagagccacagugagccaugagcaugccacugcacuccagccagggugacagaguaagauccugucucaaaaaaaaaaagagaaaagaaauagaaaaaaaugagaacccaaagaaacagggaaaccuguguauuuuuaugcuagguuugaugaguggauagucauacagaaguaugaugaacaaaggggauaugaucuaaugguaauaaacugggggaaacuuagcaaagccuguuuguucacauaccucuugguaucucugugucucaggauaaggauguucauuucuuccagguagagagaggauacuucuggauugaaagucuuauacuacuuuagaggaaggucagagaauucuuuuuuuuuuuuuuugggggggggauggagucuugcucugucgcccccaggcuggagugcaguggcgcaaucuuggcucacugcaagcuccgccuccuggguucaugccauucuucugccucagccuccugaguaccugggacuacaggcgcccgcugcugcccggcuaauuuuuuguauuuuuaguagagauggguuucaccguguuagccaggauggucucgaucuccugaccucgugacccgccugccucggccucccaaagugcugggauuacaagcaugagcccgugccuggccuagacaauucuuuuauagccugcuuaaggggaaaagagugggagaaggucagagagaccugcuucugcucaaaugcuacagugccauauuuugggguugaguguccugaaccccauuagaagacaugaagaaaauuuaaauuugccauaauaugauuuucauuuuaaucacaggagcaauuauccuuaaggaacacuaauagauaguaaggauuugcagaaacuaauuugcauagacauguuuugagauaugauuuacagugcuucugaacauugcaauuaacccgauuuuuacauuaagcuaauuuuccauucuauuacagaaccuaauucauaucuacaaaaaaccccuucuuuaaaaaaaauaaaaauuaaacuguuaacagauuuuaucagauuauugcaugguuuuacacauuuuuugucauaaaguuuguaaauagcuaaauccucuagauuugcaugcuucuaggaagcauauaaaacaaaauuacggccaggagugguggcucacgccuguaaucccagcacuuugggaggccaagguggguggaucacaaggucaggagaucaagaccauccucacaaacaugguaaaaccccaucucuacuaaaaauacaaaaauuagcugggugugguggcgcgccuguaaucccagcuacucgggaggcugaggcaggagaauggcuugaacccgggagguagagauugcagugagccgagaucaugccacugcacuccagccuggcgacagagagagauccaucucaaaaaaaaaaaaaaaaaaauucaugaauucgauguuuuggaagacuguuuguuuuuggaaauuuucuauguaugcaaugacccuuuugaagaaauauccagcccacagucaauggacuguugccaauaaaucaaaauaaaucacuguaggaaagugaucuauacacuuaaaaaaaaaaacuaaauauugcuaaacauuucaaaccuauuuuuuaaauauucuaacuuuguagcucuuaagcaguuuuauuggauuuuugagaaagguacaaccauacuuacauauuauaaaugauagcagaagguauuuagcuacuagcauuagaaggccgggcaugguggcucaugccuguaauaucagcacuuugggaggcugaggugagaggaugguuugagcccaggagcuugagaccagccuggauaguauagcuagaccuugucucuauuuacaaaaaauuaagaaaaaaauuagcugagagugauggugcacgucuguagucccagcuacccaggaggcuuagguggguagaucacuugagccugggaagcagagauugcagugagcugagauugcaccacugcacuccaggcugggugacagagcaaaaacucugucucaaaaaaaaaaaaaaaaaaaaaaaaggccaucucaguugccaaauggaagaaaauucguguucugaugucaguuaauuuaaucccuuguagccugggaacaucuguauuuugaaugauuuagaaaggaauuucaaauaucuguauuuagagaacugucuaagcgaugacaucacuuucaguggaaguaauaauuuguuccagcauuucagcaaauagaauuuuuuuggcaaaauauuuuuggaacuccuuuaguauuuaaaaaacauaaaacaggcggggcaugguggcucacgccuguaauccuagcacuuugggaggcccaggcgggcagaucccgaggucaggagaucgagaccguucuggcuaacacagugaaaccccaucucuacuaaaaauacaaaaaaauuagccgggcaugguggcgggugccuguggucccaacuacuggggaggcugaggcaggagaacggcaggaacccaggaggcagagcuugcagugagcugaaauugcgccacugcacuccagccugggcaacagagcgagacucaaaaaacaaacaaacccauaaaacaaaaaaggcuuuuuuuuuuuuaagaggcagggucuugcucugucaucuaggccuaaguccaguggcaugaucauagcucacugcuccuuccaacuccugggcagaagugaucuuccuaccucagucucccgaguagcugggaauacaggugcucaccaccaugcuuggauaauuuuuaauuuuuuauuuuguagagacaggguuucacuauauugccuaggcuggucucaaacucccgggcucaagugauccucccagaguauugguauuacaggcgcgagccauugcauccagccaaaaaaggcuuuacuuauguuacugacaaucuguuaacuuuuggcaagucaucucugucuuuuccacuauuaaaaagcaaauaaaggccgggcacgguggcucacgccuguaaucccagcacuuugggaggccgaggcgggcggaucacgaggucaggagaucgagaccaucccggcuaaaacggugaaaccucgucucuacuaaaaauacaaaaaauuagccgggcguaguggcgggcgccuguagucccagcuacuugggaggcugaggcaggagaauggcgugaacccgggaggcggagcuugcagugagccgagaucccgccacugcacuccagccugggcgacagagcgagacuccgucucaaaaaaaaaaaaaaaaaaaaaagcaaauaaaaacccuaagaauuuacuacagcuuguaaaugaaaaagcuaauaauuuuggguagaucagagaaauggaauuugaaguuuuugaaauguaaacauucaguuuugugcucugaaaagauaguuaagugaacucauaaagucuaguuaaaguaauauaaauaaugaccuaugcaaauaaacaauaaucuguuuagagugguagaaaagcuuuuuugauucuggugggaaagugauuuucauuuuuuuacucugaagugaugauuuccuacaauacgguauuuaugauaucaugaauguaacaugauauauauguauauguguguauuuauuuauuuauuuuauuuuacuuuauuuucuuucggagacagggucucacucugucgcccaggcuggagugcaguggcacagucauggcucacuacagccuccaccucccaggcucaagcaauccucccaccucagccuccugaguaacuggggcuacgggugcacaccaccaugcccagcuaaguuuuguauuuuuguagagaugcgguuuugcuuuguugcccaggcuggucuugaacuccugggcucaagugaucaucucaccuuggccucccaaagugcugggauuacaggcaugagccaccaugucuggccuuaaauauaucauaaauauguuauuuaggcuuaagauuuuguuuacccuuguuacuaaggagcaaauuaguauuaaaguauaauauauauaaacaaauacaaaaaguuuugagugguucagcuuuuuuauuuuuuuuaauggcauaacuuuuaacaacacugcucuguaauggguugaacugugguacucagacugagauaacugaaaugaguggauguauaguguuauugcauaauuaucccacuaugaagcaaagggacuggauaaauucccagucuagauuauuagccuuuguuaaccaucaagcaccuagagaagaauuauuggaaauuuuguccucuguaacuggcacuuuggggugugacuuaucuuuugccuuuguaaaaaaaaaaaaaaaaaaauauauauauauauauauauauauauauauauauauauauauauauagugguuuucgauuagcuaaucauagaauauucuuaugugugugucggguuagaagaagguagugaucauguucaaauuacauuacugacauuuuucuuuggagcuuuccuuacucacauauuagaaguguaguuuugcagugugagaauguugcucccuuacucugcgcauucuagugguauuuuacaaaaucaugaaguuuuuuuuuuuuuuuuuuaacagcggaaacucaguagaaaggaaaaaagcauagaaauguuacucuaauugaaugcacagcuuuggcuucagguccugucauuaaggccaaaaggaacauacuuugggcuauuuaauuuuuaauggaaaaaaaaggacacauauaaaguuaucugaagaaauaguucuuuuuucuccuggcacuaaauuguguuuuauggggaaaaacacuguauaauuaguugacauuuucaauuacaguuauacaaaagauaaaugaucuucaaaugauuuuuccuauuaaaugcuauaacauuaaaaaaaaaucccaacucaguuaaagcacuggguacuagaaagcaaaaccucuggauuucuuaugauuuaaucuaacacaggaauaagacuuccagguccuagaagaauggacaguuaacauacauuacaguauaauggucuccacugaauuuuaguaauguuacaauguaaauucagagcugaguuuuuagauaaccuauuaugucuauaauaaugucacugaagacagauuagcaguaauuguuaaggaugggauccagaugaguaacuugaagauaguucuuaaacuaaggaaagucuuaauguauuuugggccaggugugacggcucacaccuguaauuccagcacuuugggaggucaaggcagguagauugcuugagcucaggaguuugagaccagccugggcaacauggugaaaccucaucucuacaaaaaaauacaaaaauuagccgggcgugguggugcaugcuuguaguuccaguuacuccggaggcugaggugggaggauugcuugagcccgggagguagaaguugcagugagucgagauagcgucauugcacucuagccugggugacagaaccagacuccaucucaaaaaaaaagggaguguuacuauauuuuggaggggauuuuacaugaaagucaaauuaaaugaaauaacuucccaugcaucaguagaauucauuuuccucuguagugacuacaacagaacuacaauuaagaugacaguuugacaguuauuuuuuuuuuaaccuacaaucaacauugguuuuaacugcuaagccucaaacccuucaucaagauuuuuuuuuuuuuuuuugagacggaguuuugcucuuguugcccagacucgagugcaauggcgugaucucggcucacugcaaccucugccuccugguucaagagauucuucugccucagccucccaaguagcugaaguuacaggugugcaccuucacaccuggcuaauuuuguauuuuuaguggaggcgggguuucaccacguuggucaggcuggucucgaacuccugaccucaagagauccacccgccucagucucccaaagugcugggauuacaggcgugagccacugcgccuggccgagauauguuaugauauaacaagaaaugcaaauaaaaacuuaaaaaauuuaaaccauuaaaauauuuuugccuugcuaagauugacaaagaauaaaaggauugaaacuggcaaggguuuuaugaaauggguagguguaaaucauugcaacuguuuuggagggaaauuugacauuuaucaaaauguaaaagucauuuagcaauuccacaucuaggaauuuaucguacagagauacucccacaagugugcaaagauauagcauuuuguuacaauauuguuuauaacagagaaaaauuagaaauaaccuauuauuuaaccaguacuuaauugguagacuuucauggccauuccuggaauuaaaaguuuguggugguguucuguuguuuuuuuaagagaugaggucucauucuguugccaaggcuggaguguaguggugugggcauagcaaccucgaacuccugggcucaagcaauccuccugccucagccucuaaguagcugaaacuauaaaccugugccaccacaccuugcucauuaauuuauuuuaauuuuuuuuguaaagacggggucuugcuauguuucccagacuggucuucaacuccuauccccaaacgauccucccaccuuggcuucccaaagugcugggagguuauuagauuuuuuuuuuuuuucuaaaagcaguaguuuaaaaggcagugagggaugggaauauaaaguggugucacugcuguggaauauagucugccagcuccucaaaaaguuuaggguuaccaugugaucuagcaauucuacuucuagguacauacccaaaauaauuuaaagcaaggagucauauacuugcacaccuauguucauaacagcauuuauucacuauagcccaagguuagaagcaacccaaauguccaucaacaaaugaauggauaaacaugugguauauauagauaauagaauauuauucagccuuaaaaaaggaaaugaauuucugauacccugcuuauaacauggaugaaccuugaaaacauuauuuuggcugggugugguggcucacaccuguaaucucagcacuuugggaggcugaggcaggcagauugccugaguccaggaguuugacaccagccuggucaccaugaugaaaccccgucucuacuaaaaauacaaaaaacuaugguggugcaugccuguagucccagcuacuugggaggcugagguggaagagucaccugagcccggaagguugaggcugcagugagccaagauugcaucacugcacuccagccugggcaacuggaguugagacccugucuccaaaaaaaaaaaaaaaaaccacacacacauguuaagugaaauaagcuagaauugacaaauauuauaugauucuucuuacaggagauaccuagaauaggcaaauccauacagacagaacguagaauagaggauuaccagggguugugaggagggagagaugggaguuguuguucaguggguacaguuuucuguuugguuuugaugaaaaaguucuggaaauggauagugcugaugguuguaagguauuguaaauguacuuaacaccagugaauuguacacuuaauuaaaaugguaaaauugcuguuauauauauuuuaccauaauuuaaaaaauagucuaaauggcuaauuuuauguuacauguauuuuaccacaaauuuuuauuuuuuuagagauagguucucauucuggggcccaggcuggagugcaguggugugauuguagcucccugcauccuugaacuccugggcuuaaguaauccuuccgcuucagccuuaugaguagcuaggacuacacaggcacacgcuaccaugccuggcuaauuuuuaaacuuuuuuuguggagacagggucuugcuagguugccgagacuggucuugaacucaagugauuuuccugccuuggcuucccaaagugcugggauuacagauuugagacacugugcccauccuguuuaacuuuccugauguuauucuuugaagcauaaaagguuuuuauuuggauaaugucccauuuauuuauuccuuuuguugccuguacuuuugaugucauagcuaaaccauugcuucguccaacgucacaaagauuugcuccuguguuuucuucccacaguuuuuauaauuuuagcuuuuacauuuaggucuuugauccaucuugaguaauucguuuuaauauaaugugaagcagagguccagcuucuuucuuugcauguagauaaccagugucccaugaccauuuguggaauguaacaagcauuucuuacuuuugcaguuuuaaaggaguaaagugaaagacuggagugguaauuugcuagaauggcuaaagugaagguauuuuucuugguagcaggagacuucaauaagcaagcauugacaaggaggagauuaaagauaaaagggaggcaauaacugcuggaguaaggcaucuagaguuagaaagcauagaaucaaaagcauagauagaaagucugccucuauaaggcugaaggacgaugauucuaccaaaguacaagaggaaaagauaagacuagauauuuaaaaguuguugguagcagggagggaaguugaagauaucagaagacacguucucugugggugauagguuccaggauggaauaggaacaguuuguucaugaggcauuuaguucgaagcuuuauuagaaugcuuuccaauuuagcauugcaauuaccuguaaaaaucaagucaguaguugguugguugcuuauaaaguucagacauccaucaaauugugcuaggcaggaaagacagguacauugacauauaccagauuaguucuaccaggaacuugggcagaauuagaagaaaaaaauucuuaauauacuuaaucagcuauauucuuuacaacaauaacacuuugauucuucccauuuuugcuacacugaggaauucuguaauacucagccagucccaaaaaauuugcaagauaucaccaagcaaauaauuuuaguaauauaggauaaaucuaagaauccacccuguuugucauguuaguuucauguugguaaugauuaguaaaaacuucuuucuucuccaugucuuucucuuguuaaagaaaaacccacacacucucucuugcucucucucuuacgcuugcucgcuuccuuugucugucuguggaagcuuuggcuucgucuggcagcgggagagguaaaggaaagcuucucuaaagaagugguaacuaaggugauauccagagucuuaauuuugcaaagugaaaaagaauauucugggcagagagaagagcauacgcacuagccuuaggccuagaggaaauacguucuugaggaaauguugcugcuguccugagagggaggcagaauauaguguuggaggcuguaaauuaggagaccaagaaaaagcagccugagauacuagaggaauuccuggagaaugaguguuugagagaguuuccaaaaggaugaguauugucacaaauguuaccaaaggaacaaauacaaugagaauugaaaaaugucauuagauuuagaagcacaauagggcuguggguaagauuagcaagagcaauuuugagggagugauauaagugacuaaagcuagauuacaguggguucagagauuaggaaucugacaaaguuagcuugaagagggaaaagaaagauugguaacuggagggauguacagauuuggggaaaucauuuuuaauuguaaaggcguuuauuugcucuaugaaguaggaaauacauuaucuacugagugaagggagaggcugaagugaguuaggguacagaguggaagaggaaguaaagugaagagcccauuugaaguugguauucaugaauuuuuaguggaacauaucugcccuauuucaugacuuucuccaguaggguuuggugacagagauauacgcuuagauaaaagagauugauccaggauuguuuuugccagacaguugaguuuaggcguuuagaaagaauguuaaaaugaugaacuauggaaucaaagcucagugagaggagaagugaagaaagcgaaggacugauugacugcuuaaaagcauaugugaaaaagggauauagcugaauuugggaguaccauuuaaaauugagauauaguucccguaucauaaaauucacgcuuuuaaaguaugcauuucagugguuuuuagccuugugcaacuauaaccaaugucuaguuccagaacauuuuugucacucaaaaaaaauccuguacccauuaggagucauuucccauuccccccagccccauccccauccccuggcaaccacuaaucuauuuucuauuaucuauugauuugucuauucuguauauuucauagaaguggcauuauauaacauguggccuuuguaucuggcuucuuugacuuaauaugauguuccauccauguuguagcauguauguagagacagggucucacucugucacccagguuggagugcaguggugugaucauaauucacugcagccucaaacucccaugcucaagcggcucucuugcuucagcugccagaguagcuggaauuacaggugcaugccaccaugcccagcuaauuuuuuaaauguuuuguagaguuggggucucacuguauugcccaggcuggucucaaacuccuggccucaagagaccuuuccaccucagccucccaaagugcugggauuacaggcaugagccacugugccuggccaguacuuuauuccuuuuugugacacaauaauauuccaguuuauagaucuaucacguuuuauguauccauugauaaauugauggauauuuggguaguuucuacuuuuuggcuauuauauguaaugaugccauaaaaaauucuguacaaguuauuguauggacauaagauuuaauuucucuuggauauauaccuagaaguaaauugcugggucauuugauaacuguguuuagcauuuugagcaacuaccaaacuguuuuccaaaguggcugccccuuuuacauucccauuagcaauguaugagggcuccaguuucuucacauccuuaccaacaccuguuauuguccauccuucaguagguguguuuggguaacuuuucaaaacuuaagcaguaagcagaauuuuuuucuuauaaaauauuagcauuauguagcucagacuaaagaccccaugacuuccaccauagucaguuccuauaccuuaccuggaaagaacguuguuuuguuugguaugguuuuuuaaagaauuuuuugaaguucucaauguagguggcuuucaauauagccuccuuacauuaauccaacuguuuucauauaagcauuauaauaaauuugauuaguuuuuuccuucccaaccucuaacaguagaaugugacauuuaaaaaaaauuacaauauccauuaauaaagaugauacuaagcaagaaaaugaacuaaaugccuucaguaaagguuuauuguccuauauauuaaauauuauggcuuuaaaaauaacagcuauuagucuccauguaaugaaacauuaucaauaaaacuaauauuccucuuauucuuagugccuggcucucuggcuaugaaaauccuguggugucucgaauuaauaugagaauacaagaucuaacaggacuagauguuuccacagcagaggaauuacagguagguaaucacauuauccuuaagucauuuuuacacuucaggagaugcuugagaggagauuuccugacacugaacaggcaguccucaauuugcaugauaguuugggaccuuaaaaagugacccuguaagcugcaaccaugcaaagugauuuuaauaaugggaaaaauugugauuguucugugacuuuuaaauuucuugucaaaacaugaaaacucuuaucuagggaaaugaaaaauauagaucacuaauacuuacuaaguacacuguaauuuuuuuucuaucccccaggccucacuuugccugucaaguggccaggguggguuuuaaaaaauaguggguuuuuuuccuuuuuauuuauuuauuuuuaagcaaacaguuuuccuuuauuuguaauagugaaacauaggacuuuuuucaucacuucucuuuuucuguuacuuuuaugucuauaaaucauuugucaucaaaaguagcugucccaaaauaauucuucuucacuccgucauaaucacaacuugacucaaaauaucuguaguaaacagguauauauaggaauguuaguuauagggaauaaacauaaaauccauguauaauaaucucacuugguuucaauaguaaaaaaaaaaaacuaagcauaggccuauaaaccagagaaaagaaacagcuuagucuuccccuuugucagcguuauuuacuauuccuuagucuuuuccuguagaaaaauacuuuuuaaaauauuugaguucccuuuucuguauuagauuuuuuuuuugaaguuaucaaaaugugcacuaaaaaaaccaaugccuuuauuuuagccuuucugguugcaauuuuuuuuuuuuuuuuuuuuuugagauggagucugagucuggcucuguggcccaagcuggagugcagugacaugaucucgacucacuacaaccccugucuccugguucaagcgauucuccugccucagccucccaaguagcugggauuacaggcaugcgccaccacacugagcuaauuuuguauuuuuaguagagacgggguuucaccauguuggccaggcugcucuugaacuccugaccucaagugauccaccugccuuggccucccaaagugcugggauuacacaggcgugaggcacugugccuggccugguugcaaaauucuaagacagaugcagucaauaugcagcucauaaauucauuagaaaggugauacuuuugcuucuuuucaaccuuucuuuuucuuuuugagacagucucacuggagugcaguggugcaaucuuggaucagugcgaccucugcuuccugggcucaagugauucuccugccucagccucccagguagcugggaccacaggcacaugccgccacggcuagcuaauuuuuguauuuuuaguagagaugggguuucaccauguuggccaggcuggucuugaacuccuggccucaagugaucugccugccuuggccucccaaaguguugggauuacaggcaugagccacugugucuggccucuuuucaacuuuaaauaauaaacuguuguccgggucugguggcucaugccuguaaucccagcauuuugggaggccgagccagguggaucaccugaagucaggaguucgagaccagccugaccaacauggagaaaccccgucucuacuaaaaaauacaaaaaaauuagcugggcgugguggcacaugacuguaauuccagcuacucggcaggcugagguaggagaauugcuugaacccaggagguggagguugcggugagcugagauugcgccauugcacuccagccugggcaacgagagcaaaacucuguuucagaaauaaauaaauaaauaaacuguuaauuuaucagaagaccaaaauguauucuuaaagacaguuaauucccuuuuucuaauuaaguuuuaaaaauguauuuuguguguguguguguguguguguguguguguguguguguuuuacagugacacgguuugaugccauccuacuccgucuuugucagaacacguggucuuuucuucuguuuuuuuuuccuaucucaaaauuaugaaagcuuuuauuuauaacgcuugcaguuuuuuaaaagugagauucauaaaacuguguucacccaacacacugaauccuaucaugacuuggcaugaaaaacagcaacccacucagaguccaguaacacugugcccuccccugugaugcacaccugccagguuuauucaguguuugacuguuguucaguauucauccaacaacauuuuugauacauguggugcuaaauguugggaaugcaaaccugaauaagguaucguccugauuccugccuaaugguuuuccuggguuucacuggcuaugauuucugauucuucccucccucccucugucccucccucccucccucucucccucccuccccuccucucucccucccuuccuuccucucucucucccuuccuuccuuccauauuuccuuccuuccauguuugcuugcuuccuuccuuccuuccuucccuucccucccucccugcauccauccuucccuccuuuccuuucuuucuucucucucuuccucccucccacccucuuuauuucuuuacuuccuuccuuccucucucccuccccccucccccucccugacucccuucuuuccuuccuuccuucccuuuuuuuuuuuuuauacuuuaaguucuaggguacaugugcacaacgugcagguuuguuacauagguauacaugugccauguugguuugcugcacccaucaacucaucauuuacauuagguauuucuccuaaugcuauuccucccccagccccccacccuccgacaggccccggugugugauguucccugcccuguguccaaguguucucauuguucaauuuccaccuaugagugagaacaugugguguuugguuuucuguccuugugagaguuugcugagaaugaugguuuccagcuucauccaugucccugcaaaggacaugaacucauccuuuuuuauggcugcaugguauuccaugguguacaugugccacauuuucuuaauccagucuauuauugauggacauuuggguugguuccaagucuuugcuauugugaauagugccacaguaaacauacguguauaugugucuuuauaguagcaugauuuauaauccuuuggguauuuacccaguaaugggauugcugggucaaaugguauuucuacuucuggauccuugagaaaucaccacacugucuuccacaauggcugaacuaauuuacacucccaccaacaguguaaaagcauuccuauuucuccacauccucuccagcaucuguuguuuccucacuuuuuaaugauugccauucuaacuggcaugagaugguaucucauugugguuuugcuucgcauuucucuuaugaccagugaugaugagcauuuuuucaugugccuguuggcugcauaaaugucuucuuuugagaagugucuguucauauccuuugcccacuuuuugaugggguuguuuuuuucuuguaaauuuaaguucuuuguagaucuggauaucagccauuugucagauggguagauugcaaaaauuuucucccauucuguagguugccuguucacucugaugguaguuucuuuugccaugcagaagcucuuuaguuuaauuagaucccacuuguauauuuuggcuuuuguagccauugcuuuugguguuuuagucaugaaguccuugcccaugccuauguccugaaugguauugccuagguuuucuucuaggguuuuuaugguuuuaggucuaacauuuaagucuuuaauccaucuugaauuaauuguuauauaaaguguaaggaagggauccaguuucagcuuucuacauauggcuagccaguuuucccagcaccguuuauuaaauagggaauccuuuccccauuucuuguuuuugucagguucgucaaagaucagaugguuguagauguguguuguuauuucugaggccucuguucuguucuauuggucuaugucucuguuuugguaccaguacuaugcuauuuugguuacuguagccuuguaguauaguuugaagucagguagcaugaugccuccagcuuuguucuuuuggcuuaggauugucuuggcuaugugggcucuuuuuugguuccauaugaacuuuaaaguagauuuuuccaauucugugaagaaagucauugguagcuugauggggauggcauugaaucuguaaauuaccuugggcaguauggccauuuucacgauauugauucuuccuauccaugagcauggaauguucuuccauuuguguccucuuuuauuucguugagcagugguuuguaguucuccuugaagagguucuucacaucccuuguaaguuggauuccuagguauuuuauucucuuuguagcaauugugaaugggaguucacucaugauuuggcucucugucuguuauugguauauaggaaugcuugugauuuuugcacauugauuuuguauccugagacuuugcugaaguugcuuaucagcuuaaggagauuuugggcugagacaaugggguuuucuaaauauacaaucaugucaucugcaaacagggacaauuugacuuccuguuuuccuaauugaauacccuuuauuucuuucucuugccuuauugcccuggccagaacuuccaacacuauguugaauaggaguggugagggaggguauccuugucuugugccggauuucaaacagugcuuccaguuuuugcccauucaguaugauauuggcuguggguuugucauaaauagcucuuauuauuuugagauauguuccaucaauaccuaguuuaccgcauuuucagcaugaagggcuguugaauuuugucaaaggccuuuucugcaucuauugagauaaucaugugguuuuugucauugguucuguuuaugugauggauuacguuuauugauuuguguauguugaaccagccuugcaucccagggaugaagcugacuugauugugguggauaagcuuuuugaugugcugcuggauucgguuggauuuuugcgucgauguucaucagcgauauuggccuaaaauucucuuuuuuuguugugucucugccaggcuuugguaucaggaugauacuggccucauaaaaugaguuagggaggauucccucuuuuucuguugauuggaauaguuucagaaggaaugguaccagcuccucuuaguaccucugauagaauucggcugugaauccaucugguccugaacuuuuuuuaguugguaggcuguuauugccucaauuucagagucuguuauuuuucuauucagagauucaacuucuuccugguuuggucuuggguguauguguccaggaauuuauccauuucuucuagauuuucuaguuuauuugcauagagguguuuauaguauucucugaugguaguuuguauuucugugggaucuguggugauauccccuuuaucauuuuuuacugugucuauuugauuauucucucuuuucuucuuuauuagucuugcuagcugucuaucaauuuuguugaucuuuucaaaaaaccagcuccuggauucauugauuuuuugaaggguuuuuuaugucuguaucucuuucaguucugcuuugaucugaguuauuucuugccuucugcuagcuuuugaauuuguuugcucuugcuucucuuguucuuuuaauugugauguuagggugucgauuuuaggucuuucuugcuuucucuugugggcauuuagugcuauaaauuuuccucuacacugcuuuaaaugugucccagagauucugguacguugugucuuuguucucauugguuucaaagaacauguuuauuucugccuucauuucguuauuuacccaguagucauucaggagcagguuguucaguuuccauguaguugugugguuuugagugaguuucuuaauccugaguucuaauuugauugcacuguggucugagagacaguuuguugugauuucuguucuuuuacauuugcugaggagugcuuuacuuccaauuauguggucaguuuuagaauaagugugauguggugcugagaagaauguauauucuguugauuugggguggacagaguucuguagaugucuauuauaauggucugcuuagugcagagcugaguuccaguccuggauauucuuguuaaccuucugucuuguugaucucauauugacaguggaguguuaaagucucucauuauuauugugugagagucuaagucucuuuuuaggacucuaaggacuugccuuaugaaucugggugccccuguauugggugcauauauauuuagaauaguuagcacuucuuguugaauugaucccuauaccauuacguaauggccuucuuugucucuuuugaucuguguugguuuaaagucuguuugaucagagacuaggauugcagccgcugcuuuuuuuuuuuuuuuucuuuccauuugcuucguagaucuuccuccaucccuuuauuuugagccuaugugugucucugcacaugagaugugucuccugaugggucuugacucuuuauccaauuugccagucugugccuuuucauugggacauuuagcccauuuacauuuaaggcuaauauuguuauaugugaauuugauccugucauuaugauguucgcugguuauuuugcucguuaauugaugcgguuucuucauagcaucgauggucuuuauaauuuggcauguuuuugcaguggcugguaccaguuguuccuuuccauguuuagugcuuccuucaggagcucuuguaagacaggccugguggugacaaaaucucucagcauuugcuugucugcaaaggauuuuauuucuccuuuauuuagaaagcuuaguuuggcuggauaugaaauucuggguugaaaauucuuuuuuuuaagaauguugaauauuggcccccacucucuucuugcuuguaggguuucugcagagagauccacuguuagucugaugggccucccuuuguggguaacccgaccuuucucucuggcugcccuuaagauuuuuuccuucauuucagccuuggugaaucugacaauuacgugucuugugguugcucuucucgagaaguaucuuugugguguucucuguauuucugaauuugacuguuggccugccuugcuagguuggggaaauucuccuggauaauuuccugaauaguguuuuucagccuguuuccauucuccccgucacuuucagguguacaccaaucaaacauagauuuggucuuuuuagauagucccauauuucuuggaggcuuuauuuguuucuuucuacucauuuuucucuaaacuugucuucuugcuuuauuucauuaauuccaucuucaaucacugauacccuuuguuccacuugaucaaaucggcuaccgaagcuugugcaugcaccaugacguucuuaugccaugguuuucagcuccaucaggucauucaaggucuucucuacacuguuuguucuaguuagccauucgucuaaccuuuuuucaaggguuuuagcuuccuugcgauggcuuagaacaugcuucuuuagcugggagguuuguuauuaccgaccuucugaagccuacuucugucagcucaucaaagucauucucuguccagcuuuguucuguugcuugugaggagcugcaguccuuuggaggagaggaggugcucugaucuuuagaaguuucagcuuuucugcucugguuucuccccaucuuugugguuuugucuaccuuuggccuucgauguuggugaccuacagaugggguuuugguguagaugaccuuuuuguugauguugaugcuauuccuuucuguuaguuuuccuucuaacagucaggucccucagcugcaggucuguuggaguuugcuggagguccauuccagacgcuguuugccuggguaucaccagcagaggaugcagaacagcaaauauugcugccugauccuuccucuggaagcuucaucccagaggggcacccgccuguaugaggugucugucggccccuacugggagguuucccccaguuaggcuacacgggggucagggacccucuugaggaggcagucuuugguucucagagcucaaaugccauccugggagaaccacugcucucuucagagcugucagacagggacguuuaagucugcagaaguugucugcuggcuuuuguucagcuaugcccugcccacagagguggagucuacagaggcaguaggccuugcugagcuguggugggcuccgcccaguuugagcuuucuggccauuuuguuuaccuaaucaagccucagcaaugguggacaccccuccuccagccaggcugcaaccucucagguccaucucagacugcugcacuagcagugagcaaggcuccaugggcaugggacccacugagccaggcacaggaaagaaucuccuggucugccaguugcuaagacugugggaaaagcgcaguaugugggcaggauuguccgguuuuuccagguacagucugucauggcuucccuuugcuaggaaagggaaauucccugacuccuugugcuuccugggugaggcgaugccccgcccugcuuuggcucauucucuauggucugcacccacuguccaaccagucccaaugagaugaaccagguaccucaguuggaaaugcagaaaucccacaugugagugagaacaugugauauuugucuaugcugggcuuauuuuacuaauauaaugaacuccaguuccauccaugugauaagauuacauucuucuuauggcugaauaguguuucauuauauauaagcaccacauuuucuuuauccauucaucuguugauggacacuuagguugauuccauauguuagcuguugugaauaguccugcaauaaacaugggaaugcggauaucucuucaucaugcuaauuuccuuucuuuuggauauauacuuggcacugggauugcuggaucauaugguagaucuauuuuuaguuuuuaagggaaccucuguacuguucuccauagugauuguacuaauuuacauucccaccagcaguguaugagcaugccccuuucucuucauccuugccagugucuguuauuuuuggguuuuuuuguuuguuuuuucuugagauguagucuuacucucuugcccaggcuggagugcaguggugugaucuuggcucacugcaaccuccaccuccuggguuaaugcaguucuccugccucagccuccuguguaacugggauuacaggccccugccaccaugcccagcuaauuuuuauauuuuuaguagagacaggguuuuaccauguuggccaggcuggucucguacuccugaccucaggugauccauccacuuuggccucccaaagugcuggaauuacaggugugagccacugugccuggccaggaugcugaauuuuuuugaaagcuuuuucugcauuugcagagaugaucauaugguuuuuaauucuguuuauguggugaauuacauuuauugaaccaaccuugcaccccacaaauaaagccuaauugauuauaguaaauuaacuuuuugaugugcugcuagguuuuguuuucuaguauuuuuuugaguauuuugugucuguguucaucaggaauaucagccugaaguuuucuuuuuucauuaugucugugaugaguuuugguaucagaaugaugaugcuggcuucauaaaaugaguuaaggaaagauucguucucaaucuuuuggaauaauuucaguaggauugauacuagcucuuuguaugucugguaaaauucagcugugaauccauccaguccagagcuuuuuuugguuaguagguuguuuuuuuguuuuuuuguuuuuaauuaaaauugaauuucaauuucagaauuccuuauuggucuguucaggguuucaguuuuuuucuguuucagucuugggagguuguguguuuccaggaauuuauccauuucuucuagguuuuuuauaaaaguuugugugcauagagguguucauaauaaucucugaggacuuuuuauauuucuuuggggucaguuguaaugucaccuuuguuauuucugauugugcuuauuuggaucuuuuuucuuuguuaaucuagcuaucuugcuguuucuagaauucuuuauuugucuuugauguuugacaaucugacugaaaugugcuucagaggggacuuuuuuugguugaaucuauuuggggacuuuugaacuuccuggaguuggauacccuuaucucuuccccagacuuggguaguuuucagcuauuauuaaauagguuuucugugccuuuuaccuuucuucuccuuuuggaacuccuguaauacaaauguuuaauggugucccagaagucuuguaggcucucuuuauccuuuuucauuauuguuuccuuuuuuuuuccccucugaguaauauuaaauaauguaucuucagguucagagauuguuuugcuuaaucaagugugcuggugcagcuuuguauuguauuuuuaauuucauucauugaauucuuuuuuuuuuuuuuuuucugagacagagucucgcucugucgccacgcuggagugcaguggcaagaucuuggcucacugcaaccuccgccucccagguucaagcgauucuccugccucagccuccugcauucauugaauucuucagcugcaaguguuuuguuugguucuuuuuuaugauaucuuucuuuguugaaauucugauucauaucaugaauuguuuuccugauuucauugaauuaucuaucuguauuuucuuuuaucuguuugaguuuccuuaagaucauuauuugaauuuuuuucuagcuagguguugauuuccuuuacauuugggccuguaacuagagaguuacauucucagcagugucauauuucauugcuuuuuaauguuucuuguuuccugcauugaugucugugcaucuaguggaacaauuggcucuuuuaaacuuuccgcuucuguugggcuguuugggaaggguguggugacucuguuuccagguagguucaguacuguagucucuuauagccuauucagcugcauucauugucagaauaacugugggugccucaacagccuaggcuggagaaguuugcaguggugguagcuguggaguagauuguuaauaucuucaguggcaagagcuuuuggaauccuuccauucuuguuuuccccacaauagggaguuuuagccagugggagucuucuugguggcaggucuuacauauccuacaagcagcugccauggugcugcaauccaggugcaagcguuuggaguggcuauggggcuaggauccugggcucagggucuugcauacuauuguaacaccuggguguuaggguacagggucacuauuggcaggguuggauguagguugccuauagugccaggaucugugacucugaggcacccucuagcugcuugggaaaagagugucagguuguagcugugagucuaccccugguggacagggcacagcccuggcccaacuccagggaagagaggaugcucuggagguuugagucugggaugcaggguuuggcucuauuaggagccugagccaauagggcuuaguggcaacuccuaucccuggggaugaggcaccaugaugaggugcccuggaugaggcaccagguucuaguagucacucuagaaccuggauugguggagcucagauggaucccagacucugaggccagguacagcaggaacaggcaccccugaauggccaagcaugccuguuguuugggcccuguggggcagagagcagcacagcaaugacuucacucccuagaaagagaagugucucagcagcgcagacucuccagggaagcaggguacuagaguuauuugcccugcagggcacauuucucagcuuagccacugcucuguuucccugggucucuggguacuacuucagcccugggaugugcagcugcucagcuuggccagugcaacaauuccccaagggugaugugcuguuucagcucaggcucaggggacgugacuguucuggguggcccagacaucucaugggaugcaggguucugccaaaguacuauuuucuugggagggaguacauggcugcagcuccugccucagggaguugggggagggguggguagagcaguuccaccucucuugaccccaccaggaaggguguaacagcugcuggcagcucugcuugggaaugucaggccuucaaguaggccuucauuccuggcuuagcuucagggaugaaggggugcuguggcuacuggccccagagcaagacacacuccagcaguuccaguuccaccaguauucuccuucugguuucaucagcagcacucuuaauuauguucuccuuugauuuugucagcauuuuauuguguugugugauugagggaaagaguuaaguaucauucucuucacuuuaacaaauaagaaaacugagaugauauccaaaguuacauuguaauuaagagagcuggaacuugaacucagaccaaauauuuuucuuaaauuuuggugcgucacacugggacauugucguaagcaacugaaguuguuagggcccuucgacaggaauaauuaaauugguguuaauuucuuuccuuuuuuagcagggaaaaaauauguaagaaaagauauuuuauuaaaguggauugcgaguucagcauuuggggcuuuggaaaacauuuuuugauuuaaguuccaaaggaaaguguuuagugaaacaaaauaauagaaaucucaaauuuuagcuuauguauuaaauuuuuaaaaauuagcugggugugguagcaugcaccuguagucccagcuacucaggaggcugaagugggaggaucacuugugccccaaagguugaggcugcagugugcucugauugcaucacugcacuccagccugucucuggugggggguggggagggguacauauguagauauagaucuauauauauagauaucuauauauguagaucuguauagagauauagauaucuauauauacaucuguagauauagauaucuauauauacaucuguagauauagauaucuauauauacaucuguagauauagauaucuauauauacaucuguagauauagauaucuauauauacaucuguagauauagauaucuauauauacaucuguagauauagaucuguacauagauauauaguagcuguccuuuguuuuucaucccuguuuucauaggaacucuuguugauuuuaaauauuuuucauuucucuguaaauaccugaccaugaucuauaaaaguccaaaaaaugagguucauagauuuuuuuugaauaguaaucuuuauaguucuuuucuuucaugcuuugugucuuuccuucagguagcaaauuauggaguuggaggacaguaugaaccccauuuugacuuugcacggguaagugaaaaagaaauggagaaauucacugaggcuuaugcauuacauuguuugucucaaaacaaaacaaaaaaacagucucacucugucacccaggcuggagugcaguagcacgaucuuggcucacugcaaccucugccuccuggguuggagcaauucuccuaccucagccucccgaguagcugggaucacaggcaugcgccaccaugcccagcuaauuuuuguauuuuuaguagcgacaggguuucgccauuuuggccaggcuggucuugaacuucugaccucaggugauccacccaccucagccucccagagugcugggauuacaggcgugagccacugugcccggccgcauuacauuguuaaagaaaaaguuauucuugacacuuguuaaagaugguaaggcagacuucauucaaggggggaccauugcgauagguauagggaccacugcaaaugcagugggauuuugcaguaagggagagagguuaagcccaauuccaaauacaacaaggaaaagugggaauuuauagccaaugagcaaggguggguguuaguagauggaaaauuacuaagagguaagggaagauucuggcuaaacugaccuaacaggauucuugcugaagucagggaagagugaucaucauccaggggauaguggaagaugaagaacccaguuagguuuugagggugaucacauggcaaggacggggaauucuggcuaaccugacuuagcaggguucuugcuuaaauuggacaaugcagagguaaauaccagaagcccaaagucagggccuacuugagaagaaaguucagaggagccugaguaguugggucaaggagagauucuuugucaacauguuaauucuguuauuuuaacauuaaaaauucauagccuauuuggaauuuauggaaauacgguguggcagauauucugugaaaccuuuuuaccaguuaaaaaaaaaaaaccaaacaccuagauacccaauaaaaucacuuaagauacuuuaaaugcauuggcaagccuggaagaaaguaaaggguguuccaaaaggcaaacugaacaaugaucccaaacuuagagaauuaaagaggggacaaaacacagaggcuggagguaugugccuccaggaacuagagcuuugggaauaacagcucuguaagaggaggaucugccacaguguaggcugcugaauuugagacccuggcauaaacucuaaaucuccacaaggauuacaccuucaguaaagaaagaauggguuugaaaauaaaucucuugugauacaggagccuuauggggaacugucuguuuccauccuggcuggggcauaguguguaugauaggggagcuacuucagggaguacuauguauggaauuuuccacuugugucauguuagcacuaaaaguuuugaacuucagagcauuuugcauuuuggacuuuugguaugcucaaccuguauuccauguuacggauauaccacaguuuagccauucacccaucgaaggacauuuggauaguuuuuaguuuuuggcuauuacaaauaaagauguguuuacauuucuaugugaaaaaugcauuuucauuuuucugggagaaaugccaagagguuguauuguauuuuaauuuagauauaaauauuuagauauuaauucuuuagcuugauuauagugcugaaagucacuuuacuagcauuauuagaaaaauaauacuaggggccaggcgugguggcucaugccuguaaucccagcacuuugggaggccaagguggguggaucacuugaggucaggaguucaagaccagucuggccaacauggugaaacuccaucucuacuaaaaauacaaaaaaauuagccaggcauggugguacacgccuguagccccagccacuugggaggcugaggcagaagaauugcuuaaacccgggagguggagguugcaaugagcugagaucauggcacugcacuccagccugggcgacagggcaagacucugucucaaaaaaaaaaaaaaagaaaaaagaaaauaauacuaggaaauauuucaguaggucgugaguucaaaguaagucucaagguaaauuaagcuucaggaguauagcuaagagauggcugucaagucauauuuuuuagaagcuaaaauuguggguauuuguuuuuaaaauaauauguagcuugcagauaauggcugucguuuaggcuaauaagucugcuuuuuauccaguaaucuugucuaaaguauccaguauacaaguucagucaucacguauuugaggccagguacaguggcucacaccugugauccuagcauuuugggaggcuaaggcaggaggaucgcuugaggccaggaguucaagaucacccugguccacauagcaagacuccaucuuacaaaaagauugccugauguuuauagugcacuggacauuacaagggaaacuuuugcgguuguuguuggcauauucuucaggauauuacuacugauguuuaguugccacuagaguauuuguauuacugaauuuuuacaccauugaauuuacuguguuuuuauucacagaaagaugagccagaugcuuucaaagagcuggggacaggaaauagaauugcuacauggcuguuuuauguaagucgucacuaaaauuuuuagauuaaguugggauuugaugacaagauucauuuuaauguuuuaaguuuguucuguguagcucugauucagcauccuaguuuaacauuuuuacaacugaauaaagugaguuaagaauuauuuugcacuugcaacuuuuucaggcuauaagauagauguucauuauagaaacuucuggacaaacuuagaauuuauagugccacuaccugcagauaaucauuaauauuuuaacauauagucucucuguuuaguaauauauaauauguguauauaaaaaucucuauauauuugaauuucuauacauacacauacacauuauuucaguaaacuucugaauuacauuuuuuuauugaaguauaucagaagagugcgcaaauuaaguauuauaacuuaauuuucacaaagugaacacuucugguguauucaguacuaagaugaagaaauagcauauuacaacccccagaaacccuaucucagaguuuuaaaacaguaugaucauaauucaauuuuuaaaauuguuuauauauuuuuauauauggaaaaaaguuuugauuguaguguuuguucuaguuaccccaaauaaagcacuccaaaacucuccuuucugagugguuuaaaauaacaacgauuuucuuaauguaucucuaacaguuaugagguugacugggcucaacucaugguuccugcuccaaaucugacauguauuugccgucaaaugccuggcacugggguaucuugaaggcuaagguugaggcuggcugucagccagaaugccuaaagucuggccaauacauguggcugagcuucuucacagcauagugacuggauugcaagaggaagcaucccaaaagaacaaugcaaaaguacaugguauuguuaugaccuacccucagaagucacagauguuaauuuugcuguauucuguuacagcaauuacaaaggucugcccagcuucaaggagagggcacacagacccuaccacugcagacgaaugucagcgucacauaaaaagagcauguaggaugggacauauugggauguauuauauuuggaaaaugcaaucugccauaaugucauaaccuuuguuaacuuaaaaaagauauuuuaggccaggcacagugacacacgccuguaaucccaacacuuugagaggccgaggcgggcagaucacuugaggucaggaguucgagaccagccuggccaacguggugaaaccccuucuccacuauaaauacaaaaauuagcugggugugguggcacacaccuguaguaccagcuacucaggaggcugaggcacgagaaucacuugaaccugggaggcagagguugcagugagccgagaucgcgccacugcacucuccagccuggauaacggagcguggcuccaucucaaaaaauaaaaauaaaaaaaauauauauauuuuauauguagacuuaauuuugguuauuucaucacuuuuuccauuccuuagcccuauuugaauuacaucuuuuuguugucuguaguaucucacucccuaccaaaaucugucuguucagucuauuuccuuuuucucuuccugcuaccuucccuguuuguuuucuuucccuucuucccuaucuccuuccucuccguaugccuccuuuucuccccaauucccaauuuguauuucucucacaacuccaucuuguuuccaaaaggagguaagguacauuacaaagauucauauaaaaaaagagaaauaccacaaagggaaaaccaggagaggguuaguacgguauacaaauucaugcugcaaaggcuugcauauuuucuagaggugagucuuagagguuguaccaguuuauaucccaauuuuaagugggauauguuugugaaguauguuugucagacuuuuugaucuauguauauuucacuuauuaaauuagcaguuauuguggcuuuaauuugcauuucucuuauuagagagguugagcaucuuuucagauguuuaaaagccauuaguguuuauguguuccugguucugcuuauauuucuuuguuuuaugaauauugaugcuguauuauuuggcccacuaucuguuucucccucuuaauguaaacacccuuccuguuuuucuaaaauaguuguauagcauuuuaauugauuaucauuuuuuccguuauuuaaauaccauucccagaggggcacauagaauaucucaaauuacuuuuccucucaugcacaacuuuuuaauuuccucagaguuuaauuuuuucauugguuaaguguucuuaguucuuuacuauuaguuauguauuuaucauuguaaaauaccuucuaucucauuuaaugcuuuuuaccuugauuuaaacuguaucucauacuaagaucauauccuguuuuccuuggauagcauuugcccaaaaucuuacauuuuuguguucuguguuuguaagucacuuguuuuagaugcagcucugauauaauauguagcuggguuuugcucugugaucuaaucagucuauacauucuacuuauguugcuuuaaaaaaaucuuuaugauccauguuuccuuugccuuguuuuuugugauucuuugguuaauuuaaaagguuuccauuuuuauucuagguuaucuuuaugacuauaacuuuauauaauccuuuaacuuucucacuuuuauuuaauauguuugauucccuuccaugagaaauggcaaaacugaguauuuuuauuuuacauuuauuuaaauauuucuugagcaccuacuguucuugagguacuauuguucuagacauuaaugaucagcaaugaacaaaacagaugaaaauuccugccuccauggagauuacauucuaauacaauaaaauacauauuuauaucuguguauugacucauuaguuuuaagucauuacuuuuucccucuggcuauaaauaaguuccuaucucaaauuauauccccagucuuccauccugauaguuuuuuguuauucauuccuuugcuuuuuguaguuuuuuuacuuauguauauaaaccuaaauggcauuuuauuuuugaaaaacugaguagcauguaccaaccaugcuauauaagaacaaguccauauguucccaauauucuaguauccaauaucaagucuauauaauggcauguuuuacuuuauucuaccagcacuuuugauaacacccucuuguuucuuauagaugagugaugugucugcaggaggagccacuguuuuuccugaaguuggagcuaguguuuggcccaaaaaaguaagccuguuuguuuuguuuuugguuuauuaauuuuuucccuaaggaagagaugcacuuguauucauggucuaauuaaugaauuacauuuuuuuuucuuuuucauuuuuugagaccuguucucgcucuguugcccaggcuggagcccagcaguauaaacauggcucacugcagcuuugaccuccuggguucaagccucagccucccaaauaguggggacuacaggugcaugucaccaugcccagcuaauguuuaaauuuuuuguagagacagugucucccuguauugcccaggcuggucuugaacucuugggcucaagugauccucccaccucagcuucccaaaauguugggauuacaggcaugaaccccugugccugaccaaauuacauuuuuaaagguauuuuuaugguccuugccacgaguacuuagagguaaugaaugaccaggaauuaguauuuaaaauuuuucauuucuaaaauggguucugcauuguguuuuccccuccaucuugcuauguaagauauguuagcuuucuuuuggcaaauacuuuuguugucaaacauuuuuaugguauuuuucauaugaucaaaaacgguucuuaaagugauauaaccauauuuucagaauuauauuagaggaaaauaaaauacugcuauagaguucuuccgcaggaacaaagggaaaauuacugcugaaaacggccgggcacgguggcucacgucuguaaucccagcacuuugggaggccaagaugggcggaucaucugagguuaggaguucgagaccagccugaccaacauggugaaagcccgucucuacuaaaaauacaaaauuagccaggccugguguugcacgccuguaaucccagcuauuugagacgcugaggcaggagaaucacuucaaccugggagguggagguugcagugagcugagaucgugccauugcacuccagccugggcgauagagcaagacucugucucaaaaaaaaaaaaaaaguaauaacuaccgaaagcaauuaccuggcauuguauacuuggggauaauugugaauuguucuccauagggaacugcuguuuucugguauaaucuguuugccaguggagaaggagauuauaguacacggcaugcagccuguccagugcuaguuggcaacaaaugggguaaauauuucauauauucugcgaagauaauguaauuuuuguuucuuauuuuggaacuauuaucugugucuuaaaaacaaaagcccccauguuugcuuaauaugauuuuaacauuguacaggauucagccaaacaagugccuaaucauaauacaaauuugaaaucagaauuuugaugacagauuuuauuuuuaacuauuuuuacuuauuccaagaaacaaugacugacucaaaauugaauaagacaauaucuuccccucaaaggguuaauaaucugauugagacauacuaauggauuauaauguaguacauauuaauacaaaaauguaaacagaagauggugacugccuaaguuuggggagucuucuucaaagcuuuuucuuuaaauuugguccugaagauagaacagcaguuuuccaaacauguuagauaccagguucuaaugugaggcucgaguagcaccuaaugugcaaaauuuaaagaggcacucacucucagucagggacaugcaagugcaggaccacauuuuuaaaaaguaaaaagaaacagguaaaauuaguuuuaauaucuauuaauuagccccauguauccauuucaaucuguguuacuagccacauguugagugguuacauacaggacauuacaagguuaaggagugaggccugaucaggauuuuaaaaucuccccuuaugauuauaguguuuaagaaccacuggacuagaaugaggagaggcuaguuggugagagagaguuuagaaagcuguuuucuguugucuaagugggagaugauaauggccuggauuaaagcaucagugaaaggguuggagagcaaauagauuugagagagauguaaggaaaauugucaggguuugaugaauaaaguguagauacaaggguugaagaaggaaaaagaguuaagaauuaagguuccugcuuuagauauuuugacuggguucuaugguaccagagacaaaaaaaaaauagaaaauuaacugcuuuugggauacauuuuuacaugguauacauuuuuuaaagguauuuuggaaacuugaugagcauacaauagcaaugguugauaagagaguuguuccuuuagagugcaaaguuuguguucauuauugucuuuguauuuuggaggcuguacuuugaaaacaauacauaaagcaauauucuacucuuaccuguaccuguaucuuagguccauuugugucucauuucaagccucacauugaacauuggaaacuguaagaaaugcacauagacuggcaaauauacauguguauacauacauguauguacauacacgcacacaaguguguacacauauguauauagguauauaaaaucuguguuuucagcauuuagccaaguuuuuaaguagcaucugccuuuauccgguuuugguguugaacuuuuaucccaugaugaaacuuuguuauagaccuagcuuuuagaaacuaauuaaauacugauuagauuaagggggaaaauuaauauauuacuuuucucucacaguauccaauaaauggcuccaugaacguggacaagaauuucgaagaccuuguacguugucagaauuggaaugacaaacaggcuucccuuuuucuccuauuguuguacucuuaugugucugauauacacauuuccuagucuuaacuuucaggaguuuacaauugacuaacacuccaugauugauucagucaugaaccucaucccauguuucaucuguggacaauugcuuacuuuguggguucuuuuaaaaguaacacgaaaucaucauauugcauaaaaccuuaaaguucuguugguaucacagaagacaaggcagaguuuaaagugaggaauuuuauauuuaaagaacuuuuugguuggauaaaaacauaauuugagcauccaguuuuaguauuucacuacaucucaguugguggguguuaagcuagaaugggcugugugauaggaaacaaaugccuuacagaugugccuagguguucuguuuaccuagugucuuacucuguuuucuggaucugaagacuaguaauaaacuaggacacuaacuggguuccaugugauugcccuuucauaugaucuucuaaguugauuuuuuuccucccaagucuuuuuuaaagaaaguauacuguauuuuaccaacccccucucuuuucuuuuagcuccucuguggugaauuaaacguacuugaguuaaaauauuucgauuuuuuuuuuuuuuuuaauggaaaguccugcauaacaacacugggccuucuuaacuaaaaugcucaccacuuagccuguuuuuuuaucccuuuuuuaaaaugacagaugauuuuguucaggaauuuugcuguuuuucuuagugcuaauaccuugccucuuauuccugcuacagcagggugguaauauuggcauucugauuaaauacugugccuuaggagacuggaaguuuaaaaauguacaaguccuuucagugaugagggaauugauuuuuuuuaaaagucuuuuucuuagaaagccaaaauguuuguuuuuuuaagauucugaaauguguugugacaacaaugaccuauuuaugaucuuaaaucuuuuuuaa

SEQ ID NO: 192140 - RNA, 35028 nt, Homo sapiens
gggguuagcgccugcgcucuggacggcuuuggggcagggcagauuuauaucugcgggggaucagcugacgcuccgcauugcagacugcggagucagacggcgcuauguacgcccucuuccuccuggccagccuccugggcgcggguaagcccugggacccucauccuggggaggaggugccucgcagcguccaucugccccagaaugggcugugccgggccuggccccucugcucccccugcccuaguuggcaagggggcgcgcgcacugcgcaggcgcguucgcuggcuuucucuggcuuucucugggcggcugggggcugcggggggcgggcugcgaaaaugcccccgggaggacggcccaggcccugggcagcaucuccuucggggcucgaguggguuccugcgcggcuggggccccgaggccuucccucaggcugcgcuucccacugugggggugggugagucuuguagggugaccccuugggcagcuguguugugccugugcugggcgcacgugaucgaggugggcuggagccccgucccgcaggacacuuuggccguuggcuucaguugccuguuuguaaggguagcgaagcugcaggaagcacauguguaucaucuauauugacguuugcauauguauuuacucuggauucuagguguugacaaaacgagucaaacucuguaaaaauauuuugagauuuauucugaggcaaauaugagugaccauggcccgugacacagcccucaggagguccugagaacaugugccuaaggugguugggauacagcuggguuuuacauauuuucgggaggcacgagacaucaaucaaauacauuuaagaaauacguugguuugguucagaagggcgaaacaacucaaagcggcggggggcuuccaggccauagguaaauuuaaacauuuucuaguugauaauugguugaguuuaucugaaaaccuagaaucaauagaaagaaaguauucaaguuaagauaaaggauuguggagaccaaguuuuauugugcagaggaagcucucagguagccgacuaagagagcgagcacguuguaaaauauuucuauggaaaugaaagggugacuggcucuuaguugauuaucuccuggaucuggagaggaaggaaggaaaacauaggggaaaggggauucucuauagaauguggauuuuucccacaagagacuuugcagggcaauuucaagguauggcaaggaaauauauuuugggguuagauauuuugauuuuuuuuuccuugucuuauaaaauguuaugccagagucagauuggaaaguaagucacgauauauggggucaaauaaaacccaucugaugagaguuuaugguuuguaggguaugauuccuacaccccuuagauaggaauuugggcaagcuaaaaaaaaucggagcuuaauucucauagguauugaaggcgauauaggguuuucugguccaguuauuuugccaugggguccucauuucacuugcuuugaaaugucuugcaucugggugcgguggcuuaugccuguaaucccagcacauugggacaccgaggugggaggaucgcuugagccuaggaguuggagaccagccugggcaacauagcaagaccccaccugugaaaaaaagaaaaagagaaaagaaagucuugcacgcuauuggccguuuuuuuuuuguuuguuuguuuuguuuguuuguuuguuuuuugagacggaguuucgcuguuguugcccaggccggaguggugcaauggcguagucucggcuaacugcaaccuccgccuuccggguucaagccauucucccgccucagccucccaaaguucugggauuacaggcgugagacaccgcacccagcccccaccacaaugucuguuuuuuaguaacuauauguaguuuaagggcuggcugccauuuuuaaccuagcuacccaaauuuuaauaaaaaguaacaaaguggaugacaggguugaugcaaaaccgaagaaaugaguuagcuuucagcagcucucaagaauguaucuugacccuauacgaagcucuuaaauuuguuuuacuuguacacaaugaaagaugaucugcuuauaaaaaaaucauuuugauuuuauacucaagcuuauacugcaguuauuccauggucuguauaauaaacuaaugcuggucucuaaauuuuuuauacugauucagggcaauuuuuuuucuuucuuuuuacauuauccauuguucuuguugacguugagucacuccucacaagacccuuaagaguucugauucauucacaucacccaaaagggacucaaucgugucucgggaaauauaaaauccaccucugguauauaugggcuuaugguuaaccacaauauuuaguuaaccaagggacccucuuccgugaacacucggguaaaugggagguauuguaauggccuugguuuaacuuugcuguccuaccuuuaggauuaggccaaagucagugcugauaacaguguuugaaugcucccuggccuucacagcucuggccccuuugugauauugugaaaauguuacuccuaaaauuucuagacaugauaaugaguuuuguuagugaaagugccuggugacugcagccauugucugcugcccgagaggcacuuagaacuuucuucgugacacugucguaguacagaaugccacccugaaucgggaugggcuuuguauuuuguguuucagugauguccuggugguagagacacuugcuuuugaguuacuuuucugcccauccagcugccccuccuuuuuccccaccuaaaagcgaaagcaaagccauggcaccaugagagaauuggagagcauguaaucugaccccuuuguaaggaaugaagaccuggaggugcccagaggugacucucccaaaucauagaccauuuacuggggaugccaggaccagaacccaagacuccacagugcucgcuuuuuccauaucccucuguccacauggaccucuuaacuuuuaaaaacuuaguguaaguuacauacguggacgauuaaguagacaacuugaugaauuaccacaaagugagcagcccccgagguuggggagcagugcaguagcauccagaggccccuguucacccauucacugcccugucccacuugccccgaaggaaacauuguuaaccuuugaacaccauagaugugaaggcugcaguuucgaucuuuuacaaaugggaucauggaggguauugcuguuaggugaguccucugguggaaaaaggagcguguucaucagcuagguguaaggcaugagggauggugccugggauguggcaggugcucccugaagcuuagaugcccugauagcugucagcugugugguggcuagccugcugaauguugucuacaccacgcuaagacaguuauguuuucuggggaugcuagaagguguuauauauauucuuucaauaacaugugaauuuauagccuggccugcugaauaucaguaggaacuucaggucuuggccugucagggauuuuggauaaaucuccuguuuauuaauaguaaaucaguuuuauucugugaaaauaagaguauaauuccugaagaaagaaggguuuguuuuaacaaaucagugauuugucaaguccuugaaguacauuugacagguuguuuuguuucuuuuuuuuuuuuuuggagcagaaaguuuaauaggcagaagaaaggagaaaggagagcagcucucucuugugagagagaggcauccgaaagggagaagccugacagguuguuauugagaugggagucuugcucuguccccaggcuggugugcaguggcgcgaucucggcucacugccacuuccgccuuccggguucaagcgauuuucccaccucugccucccgaguagcuaggauuauaggugcccaccaccaugccuauaaaauccaccucugguauauaugggcuuaugguuaaccacaauauuuaguugaccaaaggacccucuucccugaacacucggguaaaugggagguaauuuuuuguauuuuaguagagaugggguuucaccauguuggccaggcuggucuugaacuccugaccucaaguaauccgccugccucggccucccaaagugcugggauuacaggugugagccaccgcacccggcccugacagguuguuuugagaacaaacuaugagaguugaaguguguuggauugauugguguggcauuuuguagaugagggaaaggagaacuuggucuuccauuuucuuggugagugagaccaugggauguccaggcagcuguggggaaguggaaggguagggcgggguguugcuggcugggaacagcaccuaaugaggcaugcuuaggaaguucucaaggccaagaccaaagccacuuagacaggugugcauggcagcuuuggaggcagcuucuagcagagauucuagguuacuggcuaccaggcuguaagccuugcuuucuggcuccuuuuugguucugccaccaggaaggagggucuggauauucuucagaucaaugaaagagaguacuaauuagaauuacauugcccugcuugccuuuuuuuuuuuuuuuuuuuuuuuuugagacagggucuuacucuguugcccaggcuggagugcaguggcaccaucucagcucacugcaaccuccaccucccggguuuaagugauucucauaccucagccucccagguagcugauagcugggauugcaggcaccugccaccaugccuggcuaauuuuuguauuuuuaguagagaaaggguuuugccauguuagccaggcuggucucaaacuccugaccucaagugaucugucugccucggccucccaaaguguugggauuacaggcgugagucgccgcaccuggcuuuuuuuuuuuuuuuuuuaagggcuuuaaaacaaugaugauaaauacagugauugggaugaagauuuuggcuguugcaaaaguacuaauugcuuuauuuuuuauuacaugaaguuccaaaaaaauaacuuuguggcauuuguaauuuuguauguugggacaagaugauaauguggaguggaaguuucacauuaucucauugcugacaguagccguacgaccuugggcaaguugcuuaaacucucccguauuucaucauuuguaaaguggcauuacucaucuauuucacuggguugcuguuuagcuuuaauaaauuagguuaauacagaaaagggcuuaguuaguauucuuuguugcuguaccacuaauaaaaguaauguauugucaauaucuuuguccccaacagcacagcggccuauuuucugcccuugauuuugugauuuccuuuggcgucuuuaauuucaaaggacguugugacuuuaacaaaauuaaauugacuuauuaaaaacauacaugcuggguauaauuagugagucaggaaaacaagccaggguagguagacagcaguuaggagggaguuggcaggcaguucauagucuagguagccaaacuagguuuagcugccaggggaucuugacaucagagcagcccagcagaucagagcugguuccugguaacccgaaugcuugggucuagaucuguugucacuaauccuggaccugagguugucuguuccagcccccuaguucgguuuccccauucguaaauggaggcgagcuguuuagaguagauaauagauggacgugggaagccaggucagucaguagaauggaguauagaguacaagguuugucccugccacugcuguccccaggcccuccccaaacagccugguagcagcucccuuagaagcuugcagagguacaucccaugugugaguuccuucugccuuuuuucuuuuuaacacaaauaguaguauauucuacugacuguuuugcuuguugcuccuuaaauugugaaacauuugaaaaguggaaaagugauuaucauaaacauguguacgcaacacccagguuaagaaauggaaccugauaacccagcugcccccguagagagccaccuuccuggacuuguuuuuccuccccguuaggucuuuuuccuuccauacaugugacuggaagcuucagcaguguguauagaguauuguuuuggauauuuuaaacauuuugcaaauauuguauccaauaaauagucuuucucuuuauccuuggggguuauguuccaagacccucagggguugccagaagcugugggugggaccaaaucuuauuuauauauguauguuuuaucuuaugcauacauaccugugauaaaguuuaguuuauaaauuaggcacaguaagggauuaacaacaacuaguaauacagaacaauuaaaacaauauauaauaaaaauuaugugaauguggucuuucucaggauacauuuucagaccacauuugacugugggaauacauuuucaaaccacauuugaccguggguaacugcaacgguagaaaaggaagcuaugguuaaggagggaccacuguauauuguuagguuaguuuuuuguuuugcuagggagguuuuucuauguugaaaauguauagauuacuguuaugucuuuuagaauuugucuagaaggcuuucugguuuuuacuggaaagcccccuacaaaaauauguaggucuauuucauuuucacuacaauauaguauuccauuuauguaauuucuuuuuuugacacagagucuugcucuguugcccaggcuggagugcaguggugugaucuuggcucacugcaaccuccaccuccugaguucaagugauucuccugucucagccucccgaguagcugggauuaugggugcacgccaccaugccuggcuaacguuuguauuuuuaguacacacaggguuucaccauguuggccaggcuggucucaaacuccugaccucagguguucugcccaccucagccccccaaagugcugggauuagaggcauaagccacugagccuggccuguaucauuucuguucuagugauagacauuuagauaauuucuaguuuuuucuauuacagccugcuucuguaaaaauucucguacaugucuccuuguguacauggaaaacauuuaucuagggcauaugucuaagagcagaauugcugaguuguggaguaacuaacaauuguagaagugcucucaaaugaucuuggcaguugccauuccauaacguauucaguuuccaguuacugcaugcccuuguuaacauuugauauuguuaaaacuuucaauuuugcuaauuugauaggaguaaaaugacuuagugguuucauuugcauuucuucuuguuuucuuaaacaauauauccuagagguaauuucaugcuaacacagauagauguacuuaaauuuuaaaauuugagauaauguuagauuuacagaaaaguuacaaagguaguauacugaguuccuguauacccuucccccagcuuccccuacuguuaacguguuguauaaccaugguacauuugccaaaagcaaguaauuaauaucaggacacugucaguaucuagauugcaaacuuuauuuggauuuuuaccaguuuuuccacuaaucucauuuuuugguuccuggguccaacccaguaugccacauugcccuuggcugucaggucuccuuaaucucuucccacuucccagcugaguauuucauuguauggaugugucuuuuuaaucccuauugauggacaucgacgucuaauaaacugcuaggugaauucuaaugagacuugcaaauguaaaaauuguaaauucuggccacauuuggacagauacugccuuuaaaaaauuauuuacaugaguggaaacgucaugacuaagauugaagaagacgcagagaaaguucuuuuggccaguauuugucacguuacuuaugacucucucaguagcugugaugggaugcuguucuguacgaguaagucucuuuuucaggcauugauaccagagggccauguggcuuccuauagcacuaggaauaaaacucaaguguguccgcaaggucgccugucaccuggugauuggccaccucucagcuccucccccucucuucugucuggccugcuguccagccuucuggccccuuccuucuuggugcucagagauuuuccauuuugaauuccaccucucuggaacaucuuccucccuggguaacccauggggcuuccucucugugcauucgggucccugcuugauguugccuuaucagaguuccccacugaugugccugaaauagcugccccaccccaccuugcuuuauuuguagcacucaccgcuaccuggcguugugauguguguguugucuugaucgcuugcugugucugcagcaugugcggcaguuuuggcacauaacaggugcuuagcauugaugagugccaggagguguagccagguagacuucagcuguggaaguguaggcuagugugccugaaacuucauugcuucauagugccgagucuuugucaugauuagauagaauauuaucuuuuauuuuucugaaauuaauuuuaagaaauuguuuuuaggaguuaugaaauuaagagugacuuugggcgcaaaugaaguguugacuuuuauaauaguugaugauaguuugggaccugccccucccacaccuuuuggggaggguucuauguaggugauagguacagggaagucuaauauaauuuagauguucaugguggcucugauuugagguaaaucugaaaagggaagcagcuauaaguugaggaaauuaucccucccacuuuugguuucagaaguugguuguucuccagauguuuagcuuggaggcucucaaacuuuugguugcaggaucccuauauacuaauuaguuauugaggaccccaaagagcuuguguuuacgugggcuguaucuaucaauauuuaacaucuuauaaguuaaacugucaguguuuaaaaauuaaugcuuugaaauauugauaaaccauuacauguuaacauauauauauuuauuguauguauuauauuuuuaaugaaaaaauauuuuccaaaacacaaauauuuagugagcagccuguuuuacauuuuugcaauccuuuuaacaccuggcuggauuauuagcugcuugggcauucagucuguugcaaugucaugucacaugccuccgcagaaacucaacuggacuuuugugaaugagcaaaauggcaacugaugucuugguuuuaucaugaggauuuugcccucacccccugaaagagucccugggaugcucggcguuuuggaccacacuuugagaaccacugguuuagaugauuugcagaaacuacagaaauuauaauagcuaacccaugcggagauguucugcuuuuuuuuuuuuuuuaagacggagucucacucugucacccagguuggagugcaguggcuugaucucggcucacugcaaccucugccuugcagguucaagugauucuccugccucagccucuugaguagcugggaccacaggugugugccaccaugccuggcuaauauauauauauguaguagagaccagguuucacuguguuggccaggcuggucucgaacuccugaccucaaguaauccacucgccucggccucccaaagugcuggaauuacaggcgugagccacugcaccuggccauuuuuuguauuuuuaguagaaaugggguuucacuauguugcccaggcuggucuugaacuccagggcuuaggugaucugccugccucugccucccacggugcuuggauuacagaugggagccacugugccuggcccguuuugcuuuuuauugaacauuaauucauuuaauucucauaacagcccucuguggugaaagcaacugaaucggaauucugggccagucugauauccucccgugacccaugcuguggucugaacauuuuagauuucaagugaaggcaguauuccuauaaaguacuaacugaaggaagccaaaagugacauuuauaguagacucacauauaucuggaacuuuuaaguuaguaaacaguagaugagacagguucagaauacugaauuucuuuaaugagguuugcaugaaaccuuuuucagcauaugauuaucuucugcaaaugugcagagaccacgcagcuggucagcaaugcucagugugggagccagcaccaguuugugugggugccugugccaacugcggugcagcaugcuggaucugcaguggagcuuucucgaggauggggagccaugcagagcccgccucugaccccugccuccacuugcucacuuggcuggaaucuggauaguccugccaagggcuaguuuuucagucauggauuaccauguaaucuuaucuaaggugaucuaaguucuucuuugaucaucaccugauauguugaugcuuuggaagaaaagcuuuguuaggaguuuuuauuggacuacaguacccuugaaugaacuaguuaggaauuguccccaaauuaauuaagccuccauugcauacaaucugagaagauugcauucuuguccccagccucagucauuacugcacaagguaauuucccugaggacucuguugccuucuccguguagauaauguccugcccuggaaucaucuggcuuguaaggaaaauuaagaagcgaggcuguagcagcagaggagaagcagggaagaaaggaccuuugucuuaacacuuugaggccagaggugaugggaugucagccuagugagcuuaagagcuuuauugccacugauuucuuaugugauaugaggacucuuggaccuuaacuccuccaaaucaagggagacuaccucugagcguauacuauucugaaugauucagugagcuguguuuuuauucugcucugcagacuguuuuccaaaggcaggauuaucuaugaggaagagacaagugcucuuugccauagaagauauuuguggcaauagcuguuugaguagcuaguguugagugcauugcauuaucuccugcucuuaggggauggaagugcaugaauuccucugagaaaugcccugcgguagaagccgcuccuccagggguuauccucucuugguuuccuagcaaccugccuguugccauggugccgccuuacccaggcagcagaucugcugcccuguggaauguaggcucugauugucagcacugggaggcugcaugcauuuucuguuaccucuuuuuuuuuuuucugguagcuagauucaaauuguacuuagcauguuacuaaaauauuuaaaaggaaaagcauauguuguauggcuaaaauaaugagacugauuguuuuaucacauucuaggaaauguuguccugucauuuuaagauugcuucagaaaaucuuuggugauuauguuguguacugggcuuuucgguauccucacugggguaagccaggaaacacuuguugggagaccuuucuguaagcgaggucguugauuaaguauguauauuaguugggcuuagguuugacuguaaacaacaaauacauagaauaauaauggcuuauuuguuuuucuuauuuuugauggagucucgcucugucgcccaggcaggagugcaguggcgugaucucggcuuacuacaaccucugccuccugaguucaagcgauucuccugccucagccuccugaguagcugggauuacaggcaccugccaccacacccagcuaauuuuuguauuuuuuguagaaaugggguuuugucguguugccaggcuggucuugauuugugagcucaaaaugauucuccugccucagcuucccaaaguacugggguuacaggcaugagccaccgcacauggcccugaaaucuaugucuuuaaaaaagucccauuguggggccaagcaugguggcucacgcuuguaauccuagcacuuugggaggccgaggcggguggaucacgaggucaggaguucgaaaccagccuggccaacacggcaaaacccugucucuacuaaaaauacaaaaauuagcugggcaugguggcaggcgccuauaaucucagcuaguugggaggcugaggcaggagaaucgcuugaacccgggaaguggaggcugcaguaagccgagaucgugccacugcacuccagccugggcgacaagagcaagacucugucucaaaagaaaaaaaaaagagcccguuguuccaagcugucuugccaggcccuugaacuaagaagugaagugcucaauuugccccgagugcuguucaugucuuuaugacacauuuaauuggaaaucuuuaggaggucaaacauucuaagaacuuuuuuggaguucagcauacugccucagagaaggaagcugguauuuggggguagggugugggaggaugagaauagagauuaaaggcuuugcuggccacauguuuugagaaauaacucacgagaaaguguuuuuggguaguguuuauuuauuaguuauaaaugcugaaaauguuaucugccuuguuagagugaagacuuggagcuccucggagcucuuuuaguucagcccaccacugaaaggaucccucuuauauagaauugcucauaaguuaugcauuuuguuucugcuuguuugcuuccacuguuggugaggucaucaccuaaugaugccacucauucucucuuuuuuuucugagacaggcucuggcuuuauugcccaggcuggagugcaguggugcuggggcacuggagugcaaccuccgccuccugggcucaaucgauccucccaccucagccuccuugguagcugggacuacugaggcgugcaccaccacguccagcuaauccguucucuuuuuaugccccuggguggauguuaaaugcauucuuuaccuggagcuguggucugcuuccuugcacccauuguucagagaucuguggucuggagccacucauaccagcuccacacccugguggaagguguacgggauucucccccuccuuggagaugaccgcgugucucugaaacauuccuucucccgucacucauccccaguccuccaggggacucucuggguggggccccaggcccuccccucccuggccucugcugagcagcucacguugcucaugggcgugucucuccuggugcuauuggcccuugcuguucuguuuucccuuugagucugcacaacuucucauggaacccuguuagugccauuugcccaucuuguucucuuggacucuguguuagccucucuuggcucuugcugcuuccauuucucauguggacguuuuugaauucgccuuccaguuaggugccugacauugguaucucccaccuccucuucaguucugccaccuugugccugggugguugagacccacacaugagcuugccuguccugucccucccagaaaucccugaagcuuccugcaguaucgcccacgggguugagcccucaccuuaggguguguggggcaggugagaccauucccccaagcaccugagaucugucugccuuugcagccuggcugccgcuacuucccuuggcuucgcuccugaaaagacaggacaguuucuucccuuccccacagagaacuggacuccuuuggaauguucuggaauuccccacucccucuccacguagccagccuuuucugucaccaucuugcaggugccaauuccaauuucguuuugaggaaggcuccguuagcauugccuugccgcucccauucccaccgaugcgugggaucacacaccauuacuuagaugucuguuccuccugcucuuugggguaaagaaaaucgugacuguucauuuguucuuuggccugagggccucgggcucugcgcagucaguggagcugguagccaugccuucagcuggguuguuuaccugcuuguguggagaaaaaccacccuugccuguagagcuuuaugauuaauccacagcugggaccugagaaguuccucaagugcuaggagaaauguguguguaauaaaguuucugggaaagggauccauguccccaaaagguucugacccacuguuugauccccucuuaggagaucugcucugggagugggcuuugcaccucuuggcggcugggagcuccccagcaccacccaguggugccugcccugaggacacgcagucuaugaacguaugucaucaugucguucauccugggagauggaauccguugcauaccacaggcuguuuuuguaacaugcaccuuuauguuuggcuugugguuggagguagaagggggugucuugcuaagaaggcacuuucuaggaguuggaauuuacguguuacuuccuguguccacggaaaucuguuuuacgcuggaacuugacuuuauaggcguaccgaauucuccaccaugcguaucuuuuugccuccagaucugaggaagaggccugcugccauucaguaggucauggauugggaagugacagucaguuuguauuagcugggccaguuucagauacaaggggcugcccaagauuauuuucaguccagguuggccggaccaaaacaaguaacaaagucaucauggaaaacgauuauuguuucacauuccuagaggaaguaggcagccuacaaaguauucucacaugggccugugagaguguguuguguuccggaaacacucuagauuuuggucagcuguagcuaguucccugcugagagggcuggagaaaguagcuggguggacauuacacuggaugagcauuuuuaagaaucgggggugcuggucacuugccccugcuuuugguggugacuccucugucuuggcucuggucuccugaggucugagcccauccucuucuggcuucccuguguaucacucugccuuccucugccuagagacucauuugguagccuccuguucaucuugauuuggagguagggcuaggcaguguaucauggugucaucauggguccuuuucagaguccuaggggcccagggccugcuaggguguggugggagucaucaggucugggguuccuauuugugcugucucugugaccgcacaguccccagagcccuuacccucaugacucaauucugccuccccuccaccgcuccccugagauuuauaacugaggcuggcgccagccaugcuuggcuacacugcgggcuaacuaagcuuuugugagccaucuggggagcuugguacugauuugcaucuggcacauguuuuccccuggaaacuagaguccaaaccagcagccucuggaauguggccagcuugguugagguugcgaacuggacguguuugugauuuugcucccaggggacagggaaggcuauaaucugggcagcagaugaauaauucauuugcuugugucugaaggggugaaggugaucugacucgagcuuugugggacucagucuuugugugaguagcuuguggagguaguaaugaaagaaagcaguucauuccuuacccucuccuggaggaagaacacguacugaccuauacaacacguguuuccuauguguguuacacacguauguagaauuggcuuacagagggaagcagcauacagcaagauuccugagguucuaaguguguuucucaggugauuguguuuuguuuuuuuuuuuuuuuuuucugucucagacuugggucaaguaucuauugcagcaaaaguuuguucaacccuacugagaugccuguuggaguuugacccucaugccaccauccucuauguguaguccgauguaaucucuuguuuccuagcuaaauaauugggcuagaagugagaugugaaucugaggauuuuuuuccccauuuuuuugguucuaaaaucaaggaccuguuuuaagaaacauaggcacucucaaggcaguuuauaaaauauuuuuagggcuagguaugguagcucaccgcuggagugcaguggugagaucucggcucacuacaaccucugccuccugggcucaagcuauccucccaccucagucucucgaguagcugggaucacaggugcgugcuaccaugcccggcuaauuuuuuguagagaugagguuuugccauguugcccaggcuggucucgaacuccuggacucaacugaccccaccucggccucucaaagugcugagauuauaggcaugagccaccggcagcuggccauuguuuuauguuauaaggguaugaauuuuuuuuaauuuuaauuuuuauuuuauuuauuuauuuauuuauuuauuuauuuuuugaaacggagucucgcucugucacccaggcucacugccagcuccgccucccggauucacgccauucuccugccucagccucccgaguagcuggaacuacaggcgcccgccaccacaccuggcuaauuguuuuuuuuuguauuuuuaguagagaugggguuucacuguguuagccaggauggucuugaucuccugacgucgugauccacccaccuuggccucccaaagugcugggauuauaggcgugagccaccgugcccagccuguuuuucuuuuuuaaaaaaacccuucauucuacaguuguuauccauuuuacagaagucaaaaucuucccuguauuugaauuuguuagucuuuucuccuaugguuucuuuuguuacuuauggaaacauuuuaagguuaugaugauaccuuauuacuuauggaaacauuuuaagguuaaaguucugauacucccugauacuguuuaaagguagcuagagaggaugaacgugaaccagauacaugagucccuucuagcccugugacagacaagccagcuucuugaccgggacaggcguguaucuguguggcuggugucccauacagcuuggugaggggcugaguagcagaguccagcucaaggacagucgcccucagcccuggggaaauaagucaggucgaccugguuugcuacaaaaugggccaccuccucacguugguuuucauuuuagcucuagccggcccgguccuuggacugaaagaaugcaccaggggcucggcaguguggugccagaaugugaagacggcguccgacugcggggcagugaagcacugccugcagaccguuuggaacaagccaacaguggugagugccgcugcccuccagucccagccgcagcacuccucuuggguccccuuagaacagcuguaacucacugccauauugacagagcacuuuuucuugccuuguuuuguuuacuucucacugugacucugugugggaggcaggaccuauuggugaauguacccauuuuacagcagaggagauggaggcucagagagguuaagguuucacucuccugaggcuaccugguuucuuguggcagacaggaugaggucccccaugccugcggcuccaggugccugccccaugcugccucugggccucugugcagaucccacuucucaccuuagauaagaggccaguggguuggcagugcccauucccaccacugggcacaugggcgcggcucuauccuuggucacucacuccaaaaaguaaaugcugagcuuuucagguacuuucugccuguuucauauuuuguucucuccucacuccucucaaacaggcaaacugcugauugagauccuggagugcaguugccauuuaaaauugguuuccagcuguaaccacacugaggaagcuagcacugauuuuucaucuaaauaaugcuaaauguagcguauuaauguggggcauggucuaaggcgacaagccauggguguguuccucacggucccaagcccucucaggagaugcucugcugaccaugccagcucaacacagagcugcugcccugggcucacuuggggcugugccggccaucaugugguacgggcuguguuugacugaguggacuuuggguucuaaaaaacuugucaguggccacuacugcuccuucaguaagagaagaaagcuuagcaccauucuuuuagaaacaguuugugaauuauucacuggaaaacugccuucuguggccauacuugcccuuuuuuuuggaggcagggucuggcucugucaccuaggcuggagugcaguggcacaaucauggcucacugcagccucaaccuccuaggcucaagcaauccucccaccucagccuccugaguacuggaaccacagauguggaccaguaugccuggcuaauuuuuguauuuuuuguagagauaguguuuuuaccauguugcccaggcuggucuugaacuccugggcuaaggucauccuccugccucccauagugcugugauuacaggcgugggcuaccacgacuggccugaaacuacuuucagauuugguuucuaauuugccuucaaucuuguuuuuaauacuacuuccuguuuccagguuuaaugugugucccguaaggacuuuaaaacuugauuggcuggucuugucauggcccggccuucuguuuuuguuuuuuguuuuuuuuuuuuuuugagauggacucucacucuguugccuaggcuggagugcaguggcacgaucuuggcucacugcaaccuccgccucccggguucaagcaauucuucugccucagccugccaaguagcugggauuauagguguacgccaccaugcccggcuaauuuuuguauuuuuaguagagaugggguuuucaacaugcuggucaggcuggucucgaacuccugaccucgugaucugcccgccucggccucccaagugagccaccacgcccggcccggcccucucuugauaugguuccaugcacaguacccuugacccucuguuuccacaaauguugagggcugucuguggaacuugagcauccugggguuuggguguccauggggguccuggaauugauacccccucagauaccaaaggaugacuguauuagccugacuagguucaaguugguuucucuaaaugcagcuaaguucauagguguuccucagucucacccagacauguuucuucuccauggauggaaagucaguugacaucaagaagggagccugggcauucuuccccaagggccgcaggaaccaauuagaauuuccauggccucugguccaggugggggccuuggugccaaucagaagauuggcuuugguguggucuugccuuguuaacaugccugggaggcaggggaugcgcaggugaacgguucagugugggugugccuucagagguggguggggcguuuguuucucugucccacccaccucucugccauacugaugugacucugauuucaccugagccucaguuuccucagagguguugugagcauugaugugaaauugaccugugccacauggggugcuguguggguaugagcaaagguucuguguccuguaacucacaguguguucuggugagucacaccucuucccucccugccgugccccagcgcugcucaugcaggguggagaaccaggaugugacaggagcgcggucaugaucauaucccugguuagagagaauagcgaaaaggccauggggaguuccagcuguguggggugugaauuuguguccugcaaauacaaauuucucguauucuuucucuuagaaaucccuucccugcgacauaugcaaagacguugucaccgcagcuggugauaugcugaaggacaaugccacugaggugagcggcggugaguggggauggugcuugagccacgggcacgugcacugguuccuaagagagcugugauuccgggugucuaaagaggaaugguguaggccugaggguggcaaaugucuuccacaaaggaucaaggagaaaagauuuuaggguauaugagccguauacugucccugucacacagucucuuuuuaaaaauguaaaaagaauguaaacaccauuccuugaguucuggguuguacagaaauaagcugaagggccuacuuugcugaccccgggacuaaaugcccaaaguuaauugagauguuguauugcaugccacuaauaccuagguccauuuuggccaucucugcuuagaauucccugugccugcgagacugcagguccagggauuuucauuuugaaugcucaugucugcuuuugccugauugaccuaauagagccauagguaacauggccaaguccuuuucccugagggcuggcuguuuuccaggcuugguuuuucugggagcuauugagggccucuugccuucagcccauuuauuuccagggaggaaagccuaucgugauucugacccugguguccucucguaggaggagauccuuguuuacuuggagaagaccugugacuggcuuccgaaaccgaacaugucugcuucaugcaaggagauaguggacuccuaccucccugucauccuggacaucauuaaaggagaaaugguaagugauggggaauaggcuuuuccuugaaggugcuucuggggcccaggagaggcaguggcccagaguagauugauuaaaauggaaagucuguucuuagcucuggaauuccucaacagcauuuugcuacaauuugacauccagaauagcuccuuuggcacagcaggccacucuguauguaacuugcccugggguuagcgagggugcggcugcuggggacuggucggacugcugaaggaauguaaaccggcauaaccuucagagaugugaguuggauacaucauguccaaucuuuaacugaccccuuugagcaggcacaaaaccucacuucugugaauuuauuucugugaacuuauaaucaaggaauaauucagggaauguauuggggucuuucauucaucaaguauguauuguacacagacacaaacccugugucacagacuggguuuuuagcaaagaacacggagcuagcuuuguggaauuuggaaaggccuugacaaagaagagguguuuaaguaacugaagagggccaguggggcaggacuuucccaagacaggaccaagguucuggugaggaaggcagggguugugucauacacagccuccuaggccaucuucaaggauugcaagugcagccuuggagugucaugauuguaagggcauuugucaaaggguuuggucuaggucuaggucccauugagggaagcugcaaguccggaagcugacaggacccucaggaggucauugcuuugugagugagaugugauguggacaguggaaauggcagaugcagauucucuuuuggaggauuaaauggacuggacuugcucaugagggggauguauaggagaggaagagcuauaaaugucucccugguuucugagaagauaaagguggaguuauuugcuaaaauggagcuaguugggcaggauagaaugagggguaaguuugagaugucugcagggugggcaugauuacagaaguuaaacacuugggagccaucagcauauggaagguguugaaagccaucguguuagcucauuuuguggggaagugacuuagaauugcugacucuucuccuccagcaagaagcuccuauuccuuuauuuauuuauuuauuuauuuuuuugagacugagucucacucugucgcccagccuggagugcaauggcgcgaucuugacugacagcaccucugccuuccggguucaagugauucucccaucucagccucccaaguagcugggaucacaggcacccaccaucaugcccggcuaauuuuuguauuuuuguagagaugggguuuuaccacauuggccaggguggucuugaacuccugaccucaggcgauccgcccgccucggccucacaaagugcugggauuacaggugugagccacugcgccuggccuccuguuccuuuaaagaagagcugaggggaaagagguaacauuuaggaagccuguauuaguccguuuucaugcuacuaauaaagacauacccgagacuggguaauuuauaaaaaaagaaaaaaagguuuaauggacucacaguuccacguggcugggggggccucaaaaucaugguggaaggugaaggaggagcaaagccacaucuuacauggcagcaggcaagagagcaugugcaggggaacugcccuuuauaaaaccaucagaucaugagacuuacuaucacuaaacagcaugggaaaacccgcccccgugauucaguuaccucccacuaggucccucacaugacacguggggacuauggcagcuacaguucaagaugagauuuggguggggacacagccaaacugcaucauugccuaauaggagaauugaggaagcuuaggggccacugugugguuaggcacucggauuggguaauuuugucauucuugguaugcugagcaguuugaauuuagacaacagguuuguguuucuuuuaagggauuuaaagagagggacuaauucagaggcacuagauggccugucuuauuuuccccuggggagaggauuuucagcaggacuucuuuccaucccaccagagccguccuggggaggugugcucugcucucaaccucugcgagucucuccagaagcaccuagcagagcugaaucaccagaagcagcuggaguccaauaagaucccagagcuggacaugacugaggugguggcccccuucauggccaacaucccucuccuccucuacccucaggacggcccccgcagcaagccccagccaaagguaagacaacgggcuggccacugaggacccauuuuugguugcacuggagaugagagaccaaagggacagagagggcacgugugguucuuaaacuggggcuuaucccugugcgugacucugcagucacaugagccagccuuuaaaugguuguaccaugaaguuucuaaagaaugggauauuuaaaauaugcaaagauuaauccccuuuaaaaaaauuuacuucuuuuauuuuugagacagggucucguucugucacccaagcuggagugcaguggugugaucaugguucacugcagccucaaccucugaggcuuaagugauccucccaccuuagccuccuaaguagcugggaguacaaaugcacaccaccacaccuggcuaauuuuuguauuuuuuguuuugccauguugcucagacuggucucaaacuccuggguucaagcgaucugccugccucggcuucccaaagugcugggauuacaggugugagccacugugccuggccaaccuuuuuauuuauacuaaacccccuuuuuauaccauacuguuacuauaaugaacacuuaaucgauuuuaagccuaucaguaauuugagagccuguaaagcaucuuaggaacuggucagcaagugcccccuaaugcugcagcccugaguauauaaggacguuuuccuaggaauuugaguccucuuaaguugcaaaccuaacugccucuucuguaggauaauggggacguuugccaggacugcauucagauggugacugacauccagacugcuguacggaccaacuccaccuuuguccaggccuugguggaacaugucaaggaggagugugaccgccugggcccuggcauggccgacauagugagccuuguguccuugugcauuggggauguucugggccugggaguugggcuguggaggcuggaguagggcguucagacaacauccuucucuuuuuucccagaaagcagcuugaauagguagugcagacuugaaucuauuuugguuaauggcaucuggauauguaacaaaacugggaacaaaaaguaggagacuguuucugggaagauuuuguuuccugccaggcacccuguguauuaggaacacuguagaaauacuuuuugcccccauuuuuuuuuuuuuuuuuugagacugaguguugcucuguugcccaggcuggagugcaguggcgugaucucagcucacugcaaccucuaccucauggguuccagggauucuccugccuuagccucccgaguagcugggauuacaggugugugcaaucacgcccagcuaauuuuuguauuuuuaguagagaugggguuucaccguguuugucaggcuggucucaaacuccugaucucaagugaucugcccgcuucagccucccaaagugcuaggauuacaggcgugagucucugcgcccggccuuuaccccauuuuuuucuuuucuuuucuuuuuuuuuuuucuuuuuugagacggagucucgcucugucgcccaggcugaaaugcaguggcgcgaucucggcucacugcaagcuccgccucccggguucacgccauucuccugccucagccuccugaguagcugggacuacaagugcccgccaccaugcccggcuaauuauuuuuguauuuuuuaguggagacgggguuucacuguguuagccaggauggucucgaucuccugaccucaugauccgccugccucggccucccaaagugcugggauuacaggcgugagccaccgcgcccggccauuuaccccauuuuugaaagcuuggcuaauguaugugacacugagaauuccagcugugcuccugcagcaagcauggucgcugaccaugguucaccuggaagccucccuuaguccugugggcucagaaacucauuuucuuggccccuuacuuagaucguuucauucugggacccuauuccaagauuauuaaucacacucagguggauguguaaaaccaaaaugccauuuuuaguaccugacaacugaagaaaccugcuagacuggcagcugagaagcugguuguaauuacucuguccuuugggaucuagcgaggcuuuuuggguggaguggccggcucuaggagaugaggccuucuccauuuuuuuuuuuuucuugagacaggguuuagcucugucacccaggcuggagugcgguggcacaaucauagcucacugcagccuuuaccuccugggcucaaacaauccucuucucagccucccaaguagcugggauuacaggagugagccaccacgcccagcugaggguuucucucugacuuuccguuaggaauguuaaucaggugaacauucauucauuuugaaagccuaggaauccuguagccucauuuuaagugucuuugcauaacaccauuuaaacagguuucccaguugaacccucucugagaggcuguaucauguuaccuuugguccucucucuguagaagcuccccaaauacaaggagcaauucuguggagucuacuggaaguaucuagauugucugaaaauaagcaguuaaaaaucauuauaacuugacucuacuggauuuaagcuuuauaaugccaucugagauuguguaaauggcuuugaaagguaagcuccaguuccuaagcaguguaucuccuagcugccuucucuccaaauugccacugaauaguugcugugugauccuggggcacgugagguuauaagauaaaggagacaggaggguggaaucuuuaaggucccuuaagaaacauuuucaaaacgucuuuugcacacauuuccuauaaaugauagaguaaccaaauugucauuuucaucuuauuaaagcuggcccagagcagacauucauaaaauucuacuuuagaaacuugcuugauagucaccaguugacacuguuggaaaugcugggggguuuuuguugguuggguuuuggugcauuguugcagugauuuguuuagcaaucuguuucucucuccucagugcaagaacuauaucagccaguauucugaaauugcuauccagaugaugaugcacaugguagguggcacggaggccccuuguuagcauuuuucuuuguuuuucagguuucgucauuucuaggaauuuugaaaauuauaugguuuaguuucccuuuuuuaccuuagagugcugaauugggcuaaaucgaccccucuggcuaggagacucuccacuugcaaucucaguaccuccccuguuacgggagaggcaggcugaagcaucuugaucccaggacugcccugguggcuuccuggcaauuuguuugccucugcccguucaggccagccaucagguuucuaggucuggcuuuaacccugggaucuguagaagucaagugcucucuaacuaagccaggccugagaauggcuguguugccaccugagucgggggaauacugccucccggaguuugucccgugcauggcagcagcguccgcugaagcugcugcuugagcugguaacuccugagcuggcuuuggaugcauucagguggcagggggcauuccuucauuagaaucaagaauacccauucaggaaaugagcucgcuaguccacgcagagcagggcggccugcucacguugggaacgggcacugccuccuuagaucugauuggcagggcugaguggguggggggcaccuuuucccugucugucaugcuuucugacuacuugagauugacauaccagcguuugaguuuguucucugauccaggggucagcaaacuggcccaucauguuuuguacuuaaaggguauuuuuuuggaacacagcgacgccuguuuugugcuacagcagcacaguugaguaguugcagccagaucuuauggccaaggagccugaaagauugacucucugaccugcuguaaccacucaagcaagcugaggaggaguaguuuauuugggauuauuacucacacccuaccauguucuaaaaacaguuaaaaggcagcuuacagagacaugcaccugaaguagguaaagauaagcauugacgggauuuaaucucgugaaguacuuccucauagcuaacuuaaaauauuuuucucauuauaaaaguuauacuguguagaaauguguugaaaauauggacaauacuucccacacaaaaaucauuuggaguuucagaauauaucaacggguucauauauacuaccuuguacuuuguaguuugcauuuuuugccuaaaaauauguuggccauugaauauucuuguacaaaugacuaaaugcuugcagaauaaucaccuguguacauagaagagaauuuacauaauugguccccgguggccggauguaucuagguuguuuucagguuugccuuugggaagaugaauauccuuauagccaaaugcauacauauaugcauaucccugccuuuccccuuauuauagagaacuaaagcuggaacugcugaauggaagcaugaggcuuuggauacauuguuaaauuggccuuccaggcugccauuuggccaccugcaguagauugcccuaggaucccuuaccccucagggaucccuuaccccccuuacuugggcagcccugugucuuguucuguggugcugcuggucacuaaccugugggaaagccuugugggcccggggccagugugggcuccugaguauggagacccuucaucaagcauuuucuggggcucuugcuacacaguguuuugagugugauuuaguguguaagaccuggagauggugcacacagagcaggacagcccccaaauggucuaucccugcagggccaggaaagcuuucagggcccccuuguccgcaagauagcaggaacaagguagguugcuaagaucugauugcaagagcauuuccccugaaccucuugggacauccuuacaccugguuaacugcuugauuguuguuuuaauuuuucuuaacuguuguguccuuuccuuucucuuauuuucaccuccgauuuccuguuuuuuuguucaacagcaggaucagguaugugucggggaaucugcuugcaguaguggucugcugcuuccucuaguuacuuugcuuuuuuuuuuuuuggguauggcaugauuagcucugacagauacaaggaaugguuacgagaggcaggcucccucucuguuaauaggcuggggagggcuucugcaucucuccccuguaauucagcccuugagguuuugggggucucaucuccccuucgggguccaguaaaaugaagccagcagagccuugugcucuggucacaguccacauacagcauacguacaugcaggccaccagugugacaauggggaaccauggguggcccaggaggugccucagccuccuucaacguaggccaguuaggaaguccaguguaggucuggcuuccccagggcaccuugugucugucacaacgcaaguaggcauugcaugucuuuagugcuguuuuucauaaacacagaaaugcuucugcugcaugagcaaacauuugcagacagccagcagacuguuccuggcuguuggauccagagaauuggaaacaaucucuugauuguggcuucugccccucuggguaacaggguccuuugggaucuagagccacaucagauggcaugcuacaagaaccaaaugcccaguccauacuugcucugagccaguguccuucggggccguccugaacacugccaccucugagcguuggcauccaucugcuaggauuagcauuggagcuuuuuuugaagguauuuugaagucuaaugggagaggacuuugguugaaauaccugaauuuuuaccuaggccuccucaaggaguuggaacaaagcugaucgaggcagaagcagcccuauaccuccugaauauuggcgucuuuuuuuuuuuucuaaaaagcuugcuguaucuucagcugcguucuuauuauuuauuuauuuauuuauuuauuuuucauucuuaagguguggcagagacaggguauuugggauauacuuuucagacucccccggucuuauuaauucucgaaccuucuugauauuaaaacaagaugagccauagucauggucuagcucuuuucccuuaacagguccuguuuuuagcacuuuuguuccugcugcuuuaggguuuggugcuggaaggcaaaugcacucaggcucagagcuaguugcugguugcauuuauuuccacaauauacagagucuauacacuugucucacucuuggccaucagagugucauggucaggaugucuagacuaucuagugcucuguguuuggugucuaaauggugaaaggggaucaaucuggagaccuuguggcuuaaaaugauucauccauuuggcggguuggguuuucaugugcacugugugcagcuugaacauagaaugugguuuuuuaaaaagccagcauuuccccuuaaugcaucauuuuaaaugguccugccgcugaaaaaucuggugugguuuuauuucuaacacauuuggcuuucuguuaguuuaugggcaugguaguucccccucuagaaaaaagcauagcuuaguuccuaccuagagugaccugaaaagacacauucuagaacagaccagguguccuuggagauguggaaggugcuggggagucucccucgugguggcccuggauggagacucuguuugauguuccuuaggagcuuuguguggucuccuccccgagauguaacuggcacauaugcacugcuucagacacgagcccuuuaacauggaaacuggaaucugccccguugugggagggggagagggagguagccuugaccugggcccagggugcuguccagcucccuguccucuggcuggauugggacugaggagcagugggcguaggcuugcugcugacugguuguucugugcucucuucagcaacccaaggagaucugugcgcugguuggguucugugaugaggugaaagagaugcccaugcagacucugguccccgccaaaguggccuccaagaaugucaucccugcccuggaacugguggagcccauuaagguaccuggugucacuuuguguccuggucagggcugugcaaugccacacuacucccugcugugucacaucacaucuuacgagucacuuguuucuuucgguucccugccuggcuccuaaaggucuuugaguuugugaucacugguuuauccuauccccuauacuaaugcagcccccgacccugaguucuuuugaaaacauuuuauuuccuugguuguaaacccuaauguucgugggaucauuagccuguguauuuucagcaugccauucaaaggugacuuugcagugccuggcuucagccucaccuucucacaugcacugucuggguccuuccccauccuguggcccugacagacuggauguucccagcacaccccucagaguguacggaagccucacugggccugcagccuguauacuaaguacaugugggugucuauuuuauuuaacuaaaacaccucacuuggugaagauuagacuacuucaucccauaauaaauuuguauuuggcauuuauuaugggucaggcagcauguuaggggcuguggugaacagaugaugucauugugcccguggggcuuacauucuaguucuucaaggccugggcugugugaugccuuaacacguggcacauguacacgcuucuuguucuagaacaucccacggcacuugacugccagcuguuggucucucucugcugucuccucucugcaugugcagagugugugacccaggggccaggccgaagugucagcuggaauccaggaagcacugcuucuugccuuccucuccaccgggugcuccucagcuccagccugcugaccaaagugacggccagagaaagugaagaguuauagcucgcacuccaaccacaugugacuacuuaaauuuuaaugaaauaccauggagcaaaauuaaaaauucagccccuuggcuacaccagccacauugcaggugcucagugcacagguagcuggagcuuauaguggacagcagagauagagaacauuuccauugccacagaacauccucuguaacaguauugccuuauuaaagguggguuccagaagagcauucucaagugcuaaugagacaugggagacacacgagcagaccugaaguguguucaacauucugucuucuagauaguggaccgauagugagccccucacuuugcuuuugguccuucauccuccuccccaaaaugaacccugaaugaugaaaugauuguaaccgaacacaucaucaggacagcucuucgggguggggaagggacuuucugucuccugaacugugaauuccuggguuuuguuuuggugggguuagggggaggugggggugguagaggauuggggaagggggugaauguaaaaauagggaauuaacuuggauauuagaagccacacgccauuuggaauucaggaggcaguggcccuugaugugcuaacccacccuggucucuguguccccuuuccuuuaggggagcaagaccaagggcugugagucccagcauugaaaguacucuccuucuacucuuuccacagaagcacgaggucccagcaaagucugauguuuacugugaggugugugaauuccuggugaaggaggugaccaagcugauugacaacaacaagacugagguaugcuguccuccuggcagagggagggccucuccugcccccccgagccugaaugucccagugggaaagucccacaggagagagggcuuggcccagccuugacauguguacagccauguccccaucucguggaaggcaauccucaccagugggaccucuaggcuggcggggguccggggagguggacaccauugcccugcuuuguaguuugguaguuuuuuguggguggaaacggcacccaccauugacucauuuccuggccauguuaguauuuucagaaugucccccaacccuuguccggccucccgucuucucacacgauccucucguguguuucagaaagaaauacucgacgcuuuugacaaaaugugcucgaagcugccgaagucccugucggaagagugccaggaggugguggacacguacggcagcuccauccuguccauccugcuggaggaggucagcccugagcuggugugcagcaugcugcaccucugcucuggcacgcggcugccugcacugaccggugagcgcuggguguggugcgggagaggauggugccccucuugggucugggagggcccugccagcguugagcccgcugcccucuuauguaguucacgugacucagccaaaggacgguggcuucugcgaagugugcaagaagcugguggguuauuuggaucgcaaccuggagaaaaacagcaccaagcaggagauccuggcugcucuugagaaaggcugcagcuuccugccagacccuuaccagaagcagguacgccccgggcugggcugcgguaggccagcauggcagaaccugaugaaguaugccaaggcugggguacauuuugauggaaaaccagcuguuucugccuccgggcauggaguccaaugaaguuuuacuuggaggugauuuguuggcuuaagaugagccacugggggaagcaaccugaaguagagaggccaaauguagauagggugucuggaaagggaggccccaggacccagugggcugggaaugccaggagcucucagggaacaguguauccagggccugccuggccuuuugugccccacuaugcucggacacccccagagcuggaccuguguccccacuuuccuuuauagugugaucaguuuguggcagaguacgagcccgugcugaucgagauccugguggaggugauggauccuuccuucgugugcuuggugagccucacuggguggugugguccucucgggcagcuguaaccuggggggcugcagagacccggaaggguugcucugagacuuggccgugggguggagucucuggguucugcugcgggagagccaagaagguagggagccagccccccaagccccaucgcuuuccucagcaacccugauguucugaaagagcgugguggagcugugauccuagcuccuucuggaaacuguuuucuuaguuuugaaagcgauacaucgggcagcucucauucucccccuuucuucuuuccuuuucucaccauauagaaaauuggagccugccccucggcccauaagcccuuguugggaacugagaaguguauauggggcccaagcuacuggugccagaacacagagacagcagcccagugcaaugugaguagcucagcagacagugucaccagccugucuugcccugggguagccugugugagaauccugcuuuaaugggaacccagugaucaacucuccacccugcuuuuauguuaucagaaagcugaggcccagagaggugguuaggcuuacucaugguccccuagaaaagacagggugaacuacacucuuguagugaagggugggguggauuuuauuuauuuauuuuuuuuaguauuuuuuugcuucugcuuuguugcuuuugucuucauuucccuugugacagugucagacuuguacaaggucacuccagggauuguacaaggucugugggauucauugcccagagcuuugcccagguccugucccccgggaacauguuugcccuugcugaagccgggcccgaguccucacucaaggcccugagaacuggccccugcccagcagcccuagggcacuguggcccuggccuggccuggcagccaccaguugggugacuugugcugcuucccuggguggggauguuugguucggucccuguuacuuaauguugcuuugugcaacuuuuccuuccucaccgggcuucccugugaccaugucaguggcgguugugucauuucggaccacugcagggaggggcagggggcccccauucuggccauguccagcucuuuccuccagcuaggcuccagcccaucuccaccgccagccccaccccacagcugguucugcugcuguccuggggaaaugugggccugcuucucaaggcccgagcugguguguagccuaacucaggcaaggagguucugccugggaguuagugugcaggcugcuagcaggacgcugggugccgggugcagguagaugaaggguccugagcccugccugcguggguacucaucugcaaacugcugcaggcaucugcugcucuggacucgugccuuagaaguucccaaaacucugauggccacguguucccuguuuuuaagugagauccuguccugggucuucagcaucuggugccauccagcugaccuaggacaagagaacagguccuguuuuggggugauaucugauacauugaugggccgggaacggaguuuuucauccgaagacuaaacucagcuuccucucuccuaccaggcugucgagcauugcaaacgccauguguggaacuaggaggaggaauauuccaucuuggcagaaaccacagcauugguuuuuuucuacuugugugucugggggaaugaacgcacagaucuguuugacuuuguuauaaaaauagggcucccccaccucccccauuucuguguccuuuauuguagcauugcugucugcaagggagccccuagccccuggcagacauagcugcuucagugccccuuuucucucugcuagauggauguugaugcacuggaggucuuuuagccugcccuugcauggcgccugcuggaggaggagagagcucugcuggcaugagccacaguuucuugacuggaggccaucaacccucuugguugaggccuuguucugagcccugacaugugcuugggcacuggugggccugggcuucugagguggccuccugcccugaucagggacccuccccgcuuuccugggccucucaguugaacaaagcagcaaaacaaaggcaguuuuauaugaaagauuagaagccuggaauaaucaggcuuuuuaaaugauguaauucccacuguaauagcauagggauuuuggaagcagcugcugguggcuugggacaucaguggggccaaggguucucugucccugguucaacugugauuuggcuuucccgugucuuuccuggugaugccuuguuugggguucuguggguuugggugggaagagggccaucugccugaauguaaccugcuagcucuccgaaggcccugcgggccuggcuugugugagcguguggacagugguggccgcgcugugccugcucguguugccuacaugucccuggcuguugaggcgcugcuucagccugcaccccucccuugucucauagaugcuccuuuugaccuuuucaaauaaauauggauggcgagcuccuaggccucuggcuuccugguagagggcggcaugccgaagggucugcuggguguggauuggaugcugggguguggggguuggaagcugucuguggcccacuugggcacccacgcuucuguccacuucugguugccaggagacagcaagcaaagccagcaggacaugaaguugcuauuaaauggacuucgugauuuuuguuuugcacuaaaguuucugugauuuaacaauaaaauucuguuagccaga

SEQ ID NO: 192141 - RNA, 335791 nt, Homo sapiens
gcggcggcggcggcucgggagagagggacgcgggcugcaggcgcgaugcuuggcuagaggacgcguccgacggcggccggacgcugagguggucggggcuagucagcccggccugggcauggagcgcgggguggcagagccucuggacguuuggggcgcgcccaguccgagcccccggcgcgccugaaguugcgagcggcgagcggcgagcggcgagcggcccgcggagacccaggagcugccggcacgccgcggaugagccuucgcgccggcgggaagacgcggcgguggccagggccagagcaggcggcccgcgggggccgauccggcggagagcagagcccgaggcgaggcgaggcgcggcgccgcugcacacacgcacacgguacccggagccacgcaccgccucuucccuccucgcuucccucuccuuccccucgccguucgcccgccgcgcggcggggaaguugguggugaccgcggcugccgaaccacuuguucccagcgcggccaucgcccguggcgggcgcucgcggcauccuucggucccaggccccuggcccuagccucgcgccccgcuccgagcuccccgacgcgcggcaacuuugauuccugggaacucgaauuccauucgcguuggccuugggaggacaggcaucccaucccccauccccgguccugggaccgcgaacauuugggggcuuugcucucggcgcuacggagaggguccaggucugggguggagagauuuucgagaguggagcgcguugggauccaauccccuccccuucugagcccuggguccccauuuggacaguggggaugggguggggcgcaccccuacugcgggcugggcagaggcgcugaggggaacuaaaggcacguaguucuccccuccccucaucaagucccugugcccgcgggagaccccaggggacuuacacauccucccaaauucgguccagcuaugggaagacgcgccccucgaggagccgggagccuuuugcggcucucgcuucgccuuccuggcccuggaacugguccgcuacgagcggugcuggcugcccccaggagcuggcacccgggagcacugccccucaucuccaccguaggucagcccaggacucgagcagagcccgcguguuccaaggcagugacggcgccagccggcggggacucugccuggcuuucucggagcgggcaccuagagaggcugccuccgugcugugagcggagauccgaugccagccgccgccccacugcgaccccagccccagcccuagugcugucagcgguccacugggaggaaauuagccuuuccucgguaguaauacucccccauccucccuaguaauucagaaagcagagccuucuuuuucuacguccuuugcccucucagaccagagcuggcauugacauugaccucgccuuccagccccuugggaagugccccaacccuaauuuggauuuugaaauaagcuagagagacacaggaguguguguguguguguguguguguguguguguguguguguguguguguuggguggagucagacccucacacagggaagaauuagguuguggggugugggguggggcgggcuuuaagaaccuaguuggggccaguugcauggugaugaugagucagcccacgauggggagagcuggcuuggaguuagugcuugguucguggugcagggguaggcgcacugcggucagcaccuacaggggugggggcacuagauguuacucugccaaggaggagcugggaaggggccccuugccugggggaauagcaaggcuugguucuggcugccagggcuggggagggcaggaaggcagagugucucgugguagagggugggugucccccgugaguugggaagguggcacacagaagccacuggugugaaccaggaagcucugccucgagugcuggaggacagcagugaggggugggaggcccagagcuagcauccuggccccgucugugcuggguccgcauauacuucucagacuuggccuuccucaccucuaaacagcugggcuccucacgucugcuuaccaaagggcuugauuugaggguugugauagcagaugguccugguugccucuggaauagcucccccacucaacaagcuaccuuaccugcaguuucaccauuugagguucauuuauuugagccaaguauuuuaaagggcaccuuccugaagugcucauuuaaaaugcacauucuucugggaggugaagguguagcggaaccuugcuccucagaguguggccuguggacaugcagcgucggcaucaccuggggacuuguuagaaaugcagacucuugggccccaccccagaccuucugaaucagaaucugcauuugguaagauccuugggugacucaugugcucaguaaaguuugagcugugguccacagugccuucucuaagaggcauugcauaguuccuuggugcagaguguuguauagggcaguggauaagaacacagagaugagaaugagauuggagcuucucucuuuggccaguuuugcuaggcucggauuaauaguccaccacuggccccuucggguuguaccaugcuaaugccacaagaguguuuguguuuuaggguuuuuuaaauagauuagaauaacaucucagcuuugugugcagucaaaacuguacauggaacugggugcaguggugaacuccuauagucccagcuaauggggaggcugaggcaacaggauugcuagagcccaggaguucaaggcuguagugugcuaggaccgugcuugugaauagccacuguacuccaggcugggcaauauaaugagacccugucucuaaagaaaaccaacaaaaaccccugcacaugggccagaaagaggugaguggagggggcaggguuuccggaagcuggguguacacacucugccucuaggacgccugagacggagacuagaugcugucccucaagcagaaggaauugagcaacuacucuccaccucaucugccccucccagauggguggaucagccaauuaauaacaccucucagcggccuuaggacuuaugcagaggggaggagcaugagagccaauuuggaacagccuccagaggggaagauacugaccaagcucuccccugaccccagccuggacuggacaucccacuucuacugcccuaaggugguucgaggccucuagcuucaagauacagggaugaugccgaggcaugguggcaaguuauaccccugguccucuggaugaugacccugaaggcaucaaggcuggccugagaguaggagauuugaaacacugcuggagagauuuggaucagaggccugguguagccgauggugucacaggugaaaggucaucgcauggcucaggcaucccacccugcccaaagaggcaguccuuccccuaagcuagccucuuucccagagagagggcagcucugccaggggacaaggugaugaggaggaacuaugggagacacagucaugggccuuacaaagagcgagcuaaugugaagacauucagacaucgauuugaaaaucagugaguucaaaaauaguuagguuaggcugggugcaguggcucacaccuauaauccuagcacuuucggaggccaaggcagguggaucacuugaggccaggaguuugagaccagcuuggccagcauggugaaaccuggcucuacuaaaaauacaaaaauuacccagacgugguggugggcaccuguaaucccagcuacgugagaggcugaggaaggagaaucgcuugaaccuggaccauggagguugcagugagccgagaucaugccacugcauuccagccugggcgacagagugagacuccaucucaaaaucaaucaaucaauaaaaauaauagaaauuuaaaaauaacuagguuaauaagucucacuguuuucuugaacccccaggucuuaauguguaaagaugauuguaaaaauugaccuaauuucccauugaacucauuguuuucaaauucaguuuuaguuguuuuuuaaacauuguauuuuauuuuauuuugagccuugcuuuggguuccucuuggcgcuggggcaauccuguuuguccaugaauagaugagcaaggucauuuacaagucgaacccuacuggauagguuauuucagggugggaguacuuuugcccucaguagagaagugcagaucagauuggguucuucuguauuccagccuccugugcauaaugugggugacacugacgcugcucaggagucgucaacuccaggaagcccuccugaguccucgggugggguggcuggugcgggugggcugccccuccagccugugccucccucgcucacgguccuuccuuggugcuucuuaccauucugcauggcucuggccucucaguagccacugagcuccuccagggcacaggcugcaucuuuuuccuccacacuaguggaguaguuggugcucaguaacuguucauugacccaauggcuuaucccugggugaugguucucuuaccuucuccagcccuauucuuaagugaucauuaacacaccaaccguuugcugugccuauauccaguuuuaacucuucauggugguacuuuccagauggguggugaauguccaccuugcuguacucuggacucuaggcaucugcucucggacauuugcaugccuagagaggugaggaugcagacaaaagaguaaagcauguaacacaauagggagugguggggacuggggagaacugaaaagcauaggccccauagagaaggggcaaaacccaucuacgugauggaagucagaauaaugguuauucccgggggcauaaugacuggggcacaggggugcugcuggcgugcugcacauuucuaaugcuugaucugaaugucugcaacaguggugaaugaucauuuuugcaaaagagccaauucggaaaacauuagaacauuuauaggccauguuuauuuggauucaacaugaaaauggcuuuauugaaucccauagggcagaaaaugcauauucuuaccaaccucauugacgagaaaggugucagccagaaaacuggcauauuuaaaacguagccacauggagacaguuuucuagucuuucagugugaaaguugaucaggaucugucaauggugaguggggugggccgcugcugccgcccacagcuccauauauuuggggccucaggguuugcggucuuggggcccugugucaccucgauaauaaauguuggcauagcucaauguauuggugaggggaaugggaauaucagacagcccuucucagccucaggggcugcaggcuguguugcugagagugacacagcagguucaguuuuagcauucauauuuuuuacauauucuaaaaccccaggcaaguguugguuauuauuaugaucauaaugcauucacuucgugauuuucauaaggcaguuugcaggccgacagacuugauauugagcaccaguucuuccacuagagcucugaagccuugggucuggcuuaguuuucucaucuguaaaaugggaauaauuuuucaauugcccuauaggcuugcuaugagcauuaaugagaggacaacuuuacaaggcauuguguaguaccuggcgcacaguauacaugcaaaauguaguagcuuuuauuguaucccuuugacuuacuuauauguuaggcacauuguauucuaguaaagaggugaaaacucuucuuauuuucagagcuugacaaucuauacauucauaaauugaauucuuccugagugugugugugugugugugugugugugugugugugugugcacgcgcgcgcgcgcacaugcgcguuggauggggguuguugugguuuuucuuuuguaauuacuuacugauaacauuuaaaaauccagcuggccaggcgugguggcucacgccuguaaucccagcacuuugggagacugagguggguggaucacgaggucagcagaucgagaccauccuggcuaacacggugaaaccacgucucuacuaaaaauacagaaaaaaaaaauuagccgagcgugguggcgggugccuguagucccagcuacucgggaggcugaggcaggagaauggggugaacccaggaggcggagcuugcagugagccgagaucgcgccacugcacuccagccugggcgacagagccagacuccaucucaaaagaaccaaaaaacaaaaaacaacaaccaaaaaaaaacaaauccagcagucuguauaaacaucuagacuucuggcauugcugauuagaacuggcaacauuguguccauguucccaaucaacaguugaacaguuguugguuggagcugaguugccgguaccccuuucauuugcuugcuuucucuuucucuuucuuccuuccuuccuuucuuucuuucuuucuuucuuucuuucuuucuuucuuucuuucuuucuuucuuucuuucuuucuuucuuucuuucuuucucuuccuuccuuccuuccuuccuuccuuccuuccuuccuuccuuccuuuccuuccuuccuuccuuccuuccuuccuuccuuccuuccuuccuuccuuccuuucuuuccuucuuucuuucuuuuuuuuuuugauggagucucucucuuucgccaaccuggagugcaguggcgcaaucucagcuuacugcaaccuccgccucccggauucaagugauucuccugccucagccucccaaguagcugggacuacaggugcacaccaccacgcccagcuaauuuuuguauuuuuaguagaaacgggguuucaccauguuuaccgggauggucucaaccucuugaccucguaaucugcccaccucggccucccaaagugcuguuuucuuuuaaaaauuauuuaaugggccaggcacaguggcucaugccuguaaucccaguacuuugggaggccgagguggguggaucauuugaggucaggagcuagagaccagccugaccaacauggugaaaccccgucucuacuaaaaacguaaaacauuuagcugggcaugguggcacaugccugcagucccaguuuuucggaaaacugaggcaggagaaucucuucaacccgggaggcagagguugccaugagccgagaucgugccacugcacuccagccugggcggcagagcaagacccugucucaaaaaaauaaauaaauaaauaaauucacggaagaauacauacauaaaauaaugucaacagaucuuaaguggaaguggugaauuuucgcauauauauacaccuguguaaccgccucacugccauggagauacagaacaucuccagugccuuggcaggcucucuuaugcccccucccaccccauguuaucccacuccagaaguaacuacucuucugacuucacucugauuuaugucgccccugugaguuuugccugcagcugccuuuuaaauuuacgugagccugcagcuugcaguucuccacagucccgaccauucccuauugccucacuuuggaccccacuuuauucauuuccgauacccccuugcuccuuuagccauuugaguuugugaccuguacucaaggucuggaaguguucucagagaccagcuagucuuaccauuuuacaaguggugaaacugagacuuggagucagagaguaagcuuguucaaggaacccagaugaagcugagccugaaugcuggccagucaagggcagagcccugcucuucccgcuccagcacaaggaguguugaggagggcgggcaugccuugucuuucagaccccagcagccccgggccuggcccugcaaucagccacccagagccugccacaggccaaucagccgaagagggugggaguuuuuuucuagccugugucuuccuggagaugcaucuuccuugaggcaggcgguuagcgauaucaccuuccucuuuaaaggccaugcuccauuuggagaggaccugagaugccauuugugacaagggccaugcacaccaccuugauugugucuguuucugaaagaaggcuguaauuugggagccagcgaaagcaagggagggagggaaguagaggagagagcaagagagagugggagggcagaaagggaaaacaaaaagggcagccgcgacucugucuggguuuccauuuguaucacuaauucuguccccgaggaaugcuggcuuucccuggcuucggguuagugugggcugagucccucugagggaugcccuuuagcucugcccacuuuucuucuguucuuugccuacacagacaggagauuagccauccugcccuggcuuauaagggacuuuauucuccuccagcaccccauguuccuucuccugcuccgaacugccccuggcccgggaggaggcugaucuugcccuucuuuccuggagccaggaucacugaugucaucuccagggaaccaguggcaauggaacucugggcuagaccuuucucagacacucuaugggggccuaaggcuuugucuuagagggugaggcauggguagacuaucuuuuuuuuuuuuuuuuuuugagacagugucucucccugucgcccggacuggaaugaguacaguggugcaaucucggcucacugcaaccgccaccucccagauucaaacaauucuccugcuucagccucccaaguagcugggacuacaggugcaugccaucacgccaggcuaauuuuuguauuuuuaguagagaugggauuucaccauguuggccaggcuggucuugaacuccugaccucaggugauccaccugccuuggccucccaaagugcugggauuauaggcaugagccaucgugcccagccacggauggacuuucacuagaaaaccagaacauaacugggugguggggugggggauccuuccaaacccauccugucugugcuuuaagaucucacaucuacuguuggggaggccauuccucagccaauacugagcaucaccugugucccaaccuccgucuaguuggugggacuucaagcugagaguccacagcugcacugcccaguagaaaaauaaugcaagccacaugugcaguuuuaaauuuucuaguguccacuuggaaaaaguuaaaaaaagcagguaauuuuuuuuuuuuuuugaggcaaggucuuucucugucgcccaggcuagagugcaguggugagaucacaguucauugcagccuugaccuccugggcucaagugaucuucccaccugagccucccaagaugugucucccuaucucugugcucuuucugugagaaggauaaguauuaaauucaucuuucuguugcuuuuugcuuuugggaguuuuccaagcagggagugacacagccuagaaagcuaaggaaguugcagcaacguggaguguuugaggcuuuccucuggggaagagggucuggccuguccacagcagagggggcuuggaugccagaguaucaugggcacuuagcagaccuggggcaaucucugggggcagaagcccuggggccagguaaaugcaaacuuuccaugcugucugcacuucuccugugauauacccugggccaagggugucaggguucccccaggaggcauucagguggcuccaggguccagacaacugggaagacacuguggcaaacugcacauacuuaccucggcuaaugggggccccugcuacuguuuggucuauguugcuaagcagcaguacagaacagcuuuuaggcuugccggacacuuugauuuuucaaaagaaucuaaacaucgagauuaaaaaaaaaucuuucuauuugagauguuagcaacgaauuuaauauuugaaaacacagcgaggccauucauucauuuaggaaauagucauugaacccuuacugugugucaggugcuguucuaggcccuuggggcccaucaguggccccuacccuugugaagugucuaugguagggaaaacccuuuggcaagcugcauguggcccauagauggccaguuuaugaccauagacuuagugucagagcugacaguaguaaugagaaacauuuauuaaguacugugugccaggcccugagcuuagcacuucaucuaaaauaccucacuuaguccuuacaacaacccuacgaauuagggucagcuguuacucuuauguuacaggugagaaauaugaggcacagagagguuacgcaauuugcccaaagucacauagcuugcaggcggugaggcagauuuuugcaugaaggcagucugauuccuugaucauuacuuuguacugcacuuacagaaggccagagccaaaccuuucacuauacagauggaaacugaacucaagaaaggacaaaagucccaccugggauccacagagaggcaaugacagagcuggggcuggguucugggacacccccuuucuauccagcccugccagguguguuuauuacaguccugacuuccccuauaauugauccugggcugagguugaauguucaggcgccuccagcauuugggcaggggaugugagagagugaggcuggcugggauuuaaacauccaugggagugaaugagguggaugguuuucuacccugagcagguuacccccaucugggaaggccauguaugucagggucucugcacuugccuggaccccagcccuucccaucuguaaagcuagggguuugcaugcaguggugucuauaauuuaaccccaaccccacaccuuuccccgccauuggccaggcuggcucaggagcucuuggguauuucuggccgugcaucuuaguccuaagcugaccuuagccugggcuuuccgggucucgacccaaguaaccuuaucagagcuuguaguuuuaucauguugcuguaugggugguaaucaugaggcagugaaauaggugugaauaaugaagaaaaaugccccuggcaagugugugaagacuuuagugauaguccuuucauugacccaagugcuuuaauucucugagccacaguuuucucaucuguaaaauaggggaaaaauccccuucugaccaaucacuugauucagugaguaggggucucucaugagagacauaaaagugcucagcaaaaugaguugcgauaaccuaaaaaucgugcuaugcaaauaguaugugucauuguaauuaauuuuuacuaaguauuaaugacuugaauuaugugggauuuacgagauauauacaguuggacauuuaaauaacaugacgaucucgaaaccccaggagcaaugucuuugcaauggcuugauguaacucuuuaugcucacucuuaacaauuugacauccaucuuuuuuggauuuguacaagucaauugauauuuauuaagcaccuacuguuugcaggauacuaugcagggcacacugagauacagaaguagacaaagcauggcccuugucccccaugagcucucacacuuauucagagugcuguauucagggcaaucaauucaggauguguguguguuagaagaagagagagagagagagagaaagagagagaauugcaucuccuuaggaaauaucagcaucucgugccugaccaaggccaagguuuuccuucucugaucuuccucacugcccccaaauucucccccucaccugaagugcuggugaccgcugggucugaguuaccaugggauggcuacauccuaggaggggcugggacaggcaugggguguagagaguggggguggccaugggcuaggaccugccaggcagcugaucugccaagcugugucugcugccugccugagggcuguuggaaacuggagcucaggccggaagaagggagcccaugaauaauacagcgggagagaggcuguuaacuaggugaccucguugcaccuguguguuucacagcuuccuugggagccgcuguggagggccugggugucaggggcaagggcagaggggaaugggaaaggccagguguagacauaguuuaucuguuuuuccuuccuacuuuccuuucaacugccuggcucagaaguccgugguacuaacuugcugccucuccuuucuaguguugaugcagacggccuuggccaugugugcacgugugugugugugcaugugcaugcauuggcugauguaagggugggcuuucucuugcacccugccccuuggccugaucacaagguuuguuugcugaacuggauaucaggccugccccuagucucuggaacagacgugugaugucacuuuuaaguaucuggcugcuguagacuaagaaggcuccugggcaggacuuuuugucuccugaggcuuuggccucugaccaaggggcccuguuugauguaaggggcaggggauucccugguguucccuucuaaugugugggguccgucaugaagcucuggcuaaacucauccagaccugacacaaaggggcuggugaaccccaguaccucucagguagacaaagaaagucucugagcauaggugagggccucuuccaagggcaaugagcuuaaacucauuguuuaagagcaaagggaacugagaggaaacuguaccgggagggguuaaaggcaaacccaaggaaaaacuuguuaugugguauguuggguaagggacggaggauggggaggcgcuagaauucauucccagaguagacuggcuuuaccuuccacguggcuguuuccugacugcuggccugggggugggauggaugaaaugauuugggaguggaaagcagagggcacccgggcagugcuugggacaggaaaaggugcccuuggugucuacuuccuccuuuguucugagugcugucagcaggggccugaccccugaggagcuccaagacccucuucccuaggacuagaaagggacuucucuccccagacccaugcugcagccucaaccugcuuccccaggcuuaagagcccagucccaugggcuggggccugccugcugcccugaagucuuagaaccaggcuuucaggaggguacacaccucaucgcuguccacagacacacuggccugccuguaagaaaugggaagcaucucucccuuugugccuggucuggguggguguggccagggcucugagcagcaggccuuaccucugggcccaaacccuaaaugagaggaaguguuucuggcucuggagccagaccacccagguucaaauccuagcucuuucacuuaugaacugugugggcuucuggcaauuuaauuaaucauuacucaucugugucuuguuuucucuuccgcaaaaugagaauaauaguacccaauucaaaggguuauugggaggauuaaaugaguuauugcacauaaaaugcuuagaaaaagugcuuggcacauaguaaauguucaacaaauguugcuauuguuuauuauuaugcuacuguuauucucagcuucugcauucugggagcucacagucuugcaggcugccugggggugccaagaguaacuaucauaccuaugagaaaggcuguagguugagggggugcaguccuggaagauuuccaggacugggaggucccuugcccugaggcugcagcuuugcucuaugcccaccagcacugugcuucccauggcaggagggcaggaagagaggcaaagcaggacagcuguuaguagcacugauguuggugcuaagagacuucuuaaggcaacuuuuuaaaugaaguauaauacaugcagaaaagugugcaaauguguuuauccugaguuguugcaaaagggccaugcucauguaacugccacccagacuaagaaaaaagugauuaccagagccauuacccgucauccucugaaguuaacuccuauccugacuucuaauacaguagauucauuuugccuauuuugaacuuuauauaaguugaauaaugcaguggguucucuuugugauguuuccuucugcuuaacuuguuugugggagucauccuguugcguauaguuaauguguuucucuucauugcuguguaguauuccauguugugaauauaccacaauucauccauucuacuguuguuggacuggcggguugcuuuuauucuuggcuauuacaaaagaggcuguuaagaacauuuguauguguguccuuugguguacauauagguauaugcaauucuauaaguauuugacuauccuuuuaccaacacaagcuuuagagcuuaauuacuauagcuuuacagauguagucuugauauugccaguguaaauucuucaguuuuguucuucuucaagacucuuguuuaauuuuggcuuucugcauuuacauauacauuuuagaauuggcuucugaaauuccauaaaagcccugcugagauuuugauugagacugcaucaaaaauauguaagucaauuugaggaaaauugacaucuuuacaauauugaguuuuucaauccaugaacaagauauacuccucuauuuuucuaaguuuuaauacauuauauucaauaaugcuuuuuaguguagcauucuuauauuuuuaaaacuggauuuccuucuauguguuuuauguuuuucgauacuauuguaaguaauucgaaauuuuuucauuuuguauuauuaacuugucauauagaaguauaacugauuuuuucauugauuacacaaccauuguuaaauuuacuuauuuauucuuauagguuauugcauuuuuugauuuuuaaaaacauauaugauuauguuuucuauaaauaauaacaguuuuauaucuucuuuuacaauacuuauaucauuuuucuugcuuuauugcaauggcaaggaguucuagcauaauauugaauggaagugguaauaauaagcauacuuacuucaauucugguaucaaggagaaagcuuucaauauuuuaucauuaagugugauguuugcuguagguuucuuuuaauagcugucauuuuucaaauuaggaaaguuuucuucuaauuuuuucaaaauuauaguaaaauguacauaacauaaaauuuaccuuuuaaacccuuuuucagugugcaguucaguggcauuaguauauucacaguguugugcaacuaucaccacuaugcauuucuaaaacuucugcaucaucugaaauggaaauacuguacccauuaaacaguaacuccccauuccuucucccaucugcccauguaaccuugauccuaauuuauuucucuaugaauuugccuauucuggguaucugguaugaguggaaucauacaauauucauccuuuuaugucuggcuuauuucacuuagcauaauguuuucaagauucauccauguucuaguagguguaugaauuuaaggccuuuuaaaagcugaauaauauuccauguaugaauauaccauauuuuauauccauucaucuguuaauggacauuuggauuguugccaccuucugguucuuaucaauaaugaugcuaugaauguuggucuauaaauaccuguuugagucucugcuaucaauucuuuugaguguauaccuagguguggaguuccuggauaauaugguaauuuuauguuuaauuuuuugaggaacugccguacuguuuuccauuguagcugcaccauuuuauauucccacuagcaauguacaaggcugacaauuucuccauuuccuuaccaacacuuauuauuuuauuuuauuuuucagagaugguugucuugcuguguugaccaggcuggagugcaguggcuacacuaaacuguagugcacaguucuaaacuacacuacacaguugugcacuacaguuuagaacuccugagcucaagugaucuucacgccucagcuucccaaguagcugggccuacaggaguguaccacugcacccagcuaauuuuuuguuuuuugauaauagucauccuaaugggugugaagugguaucucacugugguuuugauuugcauuucccuaauggcuagugauguugagcaucuuuucaugggcuuauuuguauaucuuuuauggcaaaauauuuuugaauuggguuguuugucuuguugcuguugacuuguaggugaucuuuauauauuuuggauauuaauccuuuaucagaugugugauuuacagauauguucaccguccucuggguggcuuuuuugcuccauagauagugugcuuugaugcagaaaaaauuuuaauuuugaugaaguacaaauaccuuuuugcuguuguuguugccugugcuuuuggugucauauccaauaaaucauugcuaaauccaauaucgugguuuccccuguguuuucaucuaagaaguuuauaguugugguucuuauguuuaggucuuuuaucuguuuugaguuaauuuuuguauaugguauaagauuagaguccaacuugauuauuuugcauguggauagacaguuuucucagcaucauuuguugaaaaaacuguccuuuccccauugaaugaucuuagcacccuuguuaaaaaucaauuguuuguuuaugugacaguuuauuucuaggcucucgguucuguuccauuugucuguaagucugucuuuauguaaguuccaccuuuuugaucacuguagcuguguaguaaguuuugaaauagaaagugugaguacuccaacuuuguucuuuuguuuuuucaagaucguuuugacuauuuggggguacuuugagauuccacauaaaaucuuagaauggguuuuucuauuucugugaaaaacaccauugagcuuuugauaagaauuacauuaagucuguagauugcuuugggcaguaguguaucugaacaauaguacuaucuuaacaauauuaaauaugguaucuuaacaauacuaaguuuuccaguuuaugaacaugggaugucuuuucauuuauuuaugucuucuuuacuuucuuuuccuuaaaauuguuuuuuuuagagaugaggucucacuauguugcucaagcuagaggcaaacuccugggcucaaguugauccucuugcuucagcuucccaagcagcugagacuacaggcaugugacaccaugccuagcuuagcaauauuuguuaguuuucaauguacaaguuguuugcuuccuggguuaaauuuauuucuaaauauugucuucuuuuugaugcuauuguaaauggaacuguuuuccuuauuuccuuuucugauuguucauuauugguauuuagaaauacaacugauuuuuguguguugauuuuuuguacugcaauuuugcugaauuuauuagcuccuggguuuuguguguguguguguguguguguguguguguguguguaauuguuagaguuuuuugcauguaugaucaugucuucugcaaagagaaauaauuuuacuucuuccuuuccaauuugcacaccuuuucuuucucuuucuugucuaauugcucuggcuacaacguccaauacuauguuaaauggaaauggcaauagaaggcauccuuguuuuguuccugaucuuaggagaaaagcauucagucuuuugccauuguguaugauacuagcugugggcuuuuccauuuauggccacuuuuguuccuuuuuguuaagaguuuuuucauaaaugugcauagaauuuuaucaaauguauguuugugucuauugaaaugaucauauaauuuuccuucuuucuucugcuaaugugguaaauuacacugguugauuuucaaaaguuaaccaaccuugcauucuuggaauaaauccaacuuugucaugauguguuauucuucucauaaccccuuaucuguuauugcaauagcuacaacagcuuuuguuugacuguauuuuggcauaaaugaauugcuaauguucugcuuaagauuuuuuucaucuguguucaugugauuuuuuucuuucuuguaaaaucauugucagauuauaguaucgaguucugcugaccucauaauacaaauugggaacuguuccuucuuuuucuguuuguuuucuggaggaguguggauaagauuuguguuauuuuuauccuuaaaaguuuagaacaauucgauggagaagccaugugagguuagauuucuuaguaggaaaguuauaaaguacaguuucaauuucuguaauaaauauaggaccauuuauauucuuauguuuuugugugucaguguuaguacauugcauuuuuuagaauuuuauccauuuuaugcguaauuccaaaagaauugacauaaaguuauuuguaaaaucuccuuaauuguccucaugcauuuuuauacucucuauagaaucuacagugauaucuuuucauggaugaaauugguaacuuguaucuucucuuucauuuuuauuucuuuauuauuauuguuauuauuuuuuagauagggucucacucuagugcccaggcuggagugcaguggcauaaucacagcucacuacaaccucuaccuccugggcucaagcaauccuccugucuuagccuucucaggaaugcacuaucacaccuggcuaauuuuuaaauuacuuguagagaugaggucucgcuguguugcuuaggcuauucuucaaauccugggcucaaaugauccuccuuccucuaccuccuaaacugcuauuacaggcgugagccacugugcccagccauccgucucauuuucuuugucaucuuauugaucacuggauuaaucaauuguauugaucuuuucaaaaaaacaauuuuucaguuuuacugauuuuuguguauuaaauuuuguguucuaugucauuaauuuuucaucagaauuuguauuucuuuucuucaguuuuaauuuacuucuuaaaauacuuuuugagauacauacauagcucauuguuuuauagauuuucuucuuuucuaaaaucugaacuuaaggcuguaaauuuucuuuuaagcacagcuauuaguaugucacaaauuuugaugucauauuuuuauuguugugagguucaaaguguuuucuaauuucuguuauaguuuccucuuugauuuauggguuuuuaaaccucauugcuuuauuuccaagcauuuggggauuucauacuuuuuacaguuguuuuuaagcuuaauucuguuaugaucaaagaauauacuuuuacugauuccaguucuuugacauguuuugagaguuacuuuauggcccagcauggggaauuuuuauaaauauuuuucauugucccacaagaauaguguuuauucuguuauuguauacuguguucaauuuuaucaaugagguuaaauauguacaucuuaucauucagauauugguguccuuacugauuuguuuuucaccuuuucuaugguuauugagugcaguggcaugaucuuggcucacugcaaccuccaccucccagguucaagcaauucuccugccucagccucccaauuagcugggauuacaggugcgcaccaccaugcccggcuaauuuuuguauuuuuaguagagaagugguuuuaccauguuggccagguugcucuagaacuccugaccucaagugauccgcccgccuuggccuccugaagugcugggauuacaggcauaagccacugugcccagcuauagccuguauucuuaacuuauuagaguaauuuuuuucuacuaucucuuggacaaagcuaggacuuuggaacacuuuaacuccacuuacuccauuucuaccuuuaguguuagugguuguuauaaauuuuaauuguauauauauuuuacauccauaagacauuauuuucuuucagccagcauucguuugcuuacauauuuacccugauauucuuuauucuucauuguauuuuacauuuuccuuuggaguaauuuucucauugucugaagaugucuccuuuugguguggaucugcuauugaauuuuugcaguuuuugcucaucuuugaauguauuuauuauaccuuugcuuuuuauuuuuagagacagggucucacucugucacccaggcuagagugugcaguggugugaucauaggucacugcaaccuugaacuccugggcucaagcgauccucccaccccagucucccaaauagguaggacuacaagcaugugccaccaugccaggcaauuuugaaggauauuuuuacugaguauaaaauuuucuugucacacuaaagaggucauucauuucauugccuucuggcucccauuguuuguuucaaaaagucaccuauaaguuuuauuagcacuuuugaauuaaugugucuuuucucucuggcuccuuuaaauuuuuuuucuuuuuuuguuuugccuuugguuuucuuuuuuuuucuuucuuucuuuuuugucuuuuccuuucuucuuuucuuuucuuuuuuuuuuuaaauugagacggagucuggcucugucacccaggcuggagugcaguggcacgaucucggcucacugccaaccucugcugcucggguucaagugauucuccugccucagccucccaaguaccugggacuacaggcgcacaccaccacacccagcuaauuuuuguauuuuuaguagagacaggguuucaccauguuggccaggcuguucucaaacuacugaccucaggugauccgccugccucggccucccaaagugcugggauuacagaucugagccaccgugcccgaccuugccuuugguuuucuacaguuauacuuuuauuuauccuacuuuguauccuuaggauuuauccaaucuuuggcuugauauuucaaucaguuucaaaagauuuucggucauuuuauuuucaacuauugcuucugacuuaaucucucucuuucuucaggacuuaaauuauacacauguacuagauauuuucaccaugucccauauaucucuuaagcuauuuuaucacuuucucaucuguccuucuuuuucuuugagacaaguucugucucuaucacccagguuagagugcaguggcacaaucucagcucacugcuauuuccaccuccagggcucaagccauccucccagugcagccucucaaguagcugggacuacaggugcucaccaugaugccuggcuaauuuuuguauguuuuguagagaugggguuuugucauguugcccaggauggucucuaacucaugagcucaaaugaucagccugccuuggccuuaaaaaugcuggaauuacaggcaugagccacugcacccagcucauuccaguuauuuucugcgggucuauuuucaguucacucaucuucucuucaacuguaucuaauucacuguuaaacccaucuauuaagauccugauucuaauuauuauauuauuccuuuugggaauuuauuuuuauuuguuuugaaguuucuaguuccuuggugacaucauucaucuuuuuucaacuauugucuugaacauauuaaucacuauaauuuuuaagcccauauuugauaaucuaguaacugagucaccuaugggcuuguuuuuauugacuguuuuuuucuuucuccuguuuaugauauagcuaguaauguuuuaaugaaugucagucauuucguaugaaaaauuguagaggaucugaaugaugcuguuucuuuucagggaagauucauuguaucauccagcaggcagcagagcagcugaucaucuuaauccagucagggccugagcugacuccagauucgguuagucauuguaaugcuucauuuucaucuaguucauccacaguccaucagcaacucuccaggggucugaguucaugucucugugccucccuccucucugggaucugggauccucaaguccuugcugccuuguuagccccaacucaaucuugaucuccccaggcucacaggaaggccaacauucugcccgcucuuccauucucauucugugccaaagcucugagugcaaaagaggcucucagaagucugggcuuacuucugggagauuccguucucuggaucgucauaccguagcuucugucuaaccugacgguucucugguaccuucaaguggauuuuuauuuuuuggacccaauuuucuagucucauggagauuguugaccugccaugguuauuaaaucauaauugcaagugguacccaauugggauuuaaauccugguucacuguuuacuagcugaguaaccuuggguuaaugaccucuucucucuuagucucaaucucuuuaucugugaaauggguauaguaauaauugcauccuccucaucagauggcugugggaacuaacuaauaaacacaauguuugcauguaguaugcacucaacaaaggauagcuacuauaauaauacauuuuuagcuuuguuuuuguuauuguacuaucaaguaagaaaaaacugugggaagguguuagggguuucauagcaugacuuugaggggacugaggguuaguguuccucuguggccucagcauggauucagccacccacuuccucucccugcccucuaagacauaugcauacucuccccucccucuauggcucccuucccuucuccuugcaauaccuuucuucuccuuaggugggccugucccagagcugcuugugcuacaggaauggacucucugaagaaugaagugaccuugagggggaauggagcaacaucccuuagccucugcucucccccugcucccuguccaccccaguacaucacugugcccuuuccagugggggcugguaugagaaaggcccuggaggcaacacccaggcccuuuaacauggacaugcagggacauuaccccauggaaagucucuagcccauaggaaaagggcacuggagggacacucagaugugaaaaaccaccuggagguuuggugguuuugaauucuccuaauuucccccuaacauuuuaauuaauuuuugagcaugcagaaaggucaaaagacuuguccagugaaccccuagguacucaccacuggaauucuauagaguacauuuuguuacauuuccuuuacuuuuucuaucuauucacuucccauccuuccaucagaccauuguuuuggaugcauuucagaguuacuggugaacagcagcucacuuuaccuguaaacaccucagcauguguaucaguaaguggugaacucaucuaauuuaacaaucaaaaguggggaccugaaacuuuauucaggcaggagaacagcuguuuaggggagagugggccaagaaggggagcaggugaugucaccagggguuucacuuggggcaccugggacccagauggugaggcugagcaugucucucaccugccaggcuguagggauggagucugucccggcuacugcuggaugccuugcacucagcagcuauagcuggugcucaggaaggguuuauugagccaaugaauuacuuccuuuaaaaggcggggguugacugugugacuccagaguccagaaauccaaauagggagggaaaguuacuggaaggcagauugggguacauuagaagagcaauuugucuuucuuccuuucucuuuucuaaaauaccaaauuaucuuuuuuuuucacuuuuauuuuugggcaggcaauaauaacauauguagaaaauucaaaaggcccaaaguggaauccagugaaacucuucucucccaccucucuccuccagacaccuaggcuucgcucccagaaguuguccuuuucugcuuucucaguguccucuccaguagucuaugcacacacaugaugaugauggugauggugaugaugauggugauggugaugaugaugaugauggucauuaugauggugaugauaaugaugauggugaugaugauggugauggugaugaugguaauggugauggugaugauggugaaggugaugaugaugaugaugauggugauaugaugauggugaugaugaugaugaugaugauggugaugauggugauggugaugcugcugcuacuaauaauagcacuuauugggaacuuaauauaggugaguuuguauuccagagauuucacaaguauuauguuauuugauacuuauaacaacccuaugaaguagguaugacuauuaucuccauuuaagagauuagggaaacugaggcacagagcagcuaagcagcucaugcaagcucacauagcaaguuuggcagucagccuggcugcucucuuggccucugcuuuacucacuucagcauuucucggcaccacccccauccggaagguaccccccgucgccuggcuauaguaaccucacagagcagcaggcuggcugaggaggugcugagcucccugucccuggagagcauucaaccauaggacccccagaggcucucugcaaauagcuuuguuccuuuccccccaacccuugguuucugcugcuccccugccuguggggucugucauucucuccagacuucagaggucuccagguucuuauacugcucucuuuaacccccagauaggagcccuuucagcuccucauaggaaagaugaagccugugauccccucuuuguuugcaggaggcaguguuaggcccagagugggccuuggguaaugcccggucagacagcaaggcuguguccagccaggagcgguuccacuccugcucccugcccagcccucugccuucugccaccauguuuauuuaaccuggccuguuggcccccugcccuugcgccccaccaccugccccaccugaggagaaccugugugccuggggagugggugggggcauaugagaaagagccgaguaaaauucuucacugggaacaaaucucauuuucaagaaagucuugacaaaaugaggcauuaaauuacaauauuucggagagcgucguaauucuauugcagacagcccuucaucauggaaucugaaagcugggaaaauacaaaacucauuagauuaaaauaaaccaccuacugcucuggagaaaagcuuauuuaucaauaucaauuuacuuaugauuacucuggccugcaauuuguuauuuuuaaaaauuaugauuuguguauugcucaugcagaugugaaauauuuuuucuuaaauugaguauuuuaaaaaagauauacuuguccuuaguaaagguuagaaaguaguuacuggggaagggcaggagggagaaggcuagaaaauaaauuaaaagaggcuggugugguggauugugaggaagcgugugugugugugugugugugugucugaaugggggcaaauguggacacagugaacuaggagucgugugaagcuuuugggucauuaaaagaggaaggguguuaagaggaaaggcauccuuauuaaccaaguuguccaaaagauggaauguguccugaguagguagugagcuucccaccccuggauguauacaaguuuggguugaaggucuaugagggaggaugcuauaaagcacaacaguuagaugaggagccaacuauaguaaucuccaaucaugguguuuaaugauuuucugaaucagacacauggcagacacaugggucuagaaggugggacauuguggggcagcccuacaguguguacagaagugagcacuggauugggugucaaggaaccaucaucuugaaaucacugguucuggugguccuggcuccagggagccuuugcccuguggugccaugcaaagagcuuggucuuuggagccagagcuaccuggguucgaauucugccauugucacuuacuucugugagaccucagucaacuagacucuuccugaguccccauuucuucaucugcaaagugggucagcaagacccccucacagggaguggugauauuuaugaaguucuauagaaaguuuagcacacaguaggcucacucagcacaugccaauauccuucccuucugccuuucugggccucaguuuccccaucugugaaaugagcagcaugcugaggaucuccaagcuucuucuggcucuagauuucugucacugguuuuuagcguuccuuguauaaggaagaaaaauuguugaggugaggagcuaggcccccugggaucucaaggccuccacaggccugcccaacugcuuggaccuccuuccucaccaccugcaucaauguggguggcuuuccuagcugaaggacccacuguaagcucuccaugugcuugaucugccaucaggaaacuggaucuccauuucaugggugggaaaguugaggcccagagaggggaagaacaguaugcuuaccugcugcuaccacagccccaugacuccauuuccugggcaacuucacugggggagggcagagcagaggggcaaagccuuuggaauucuugagaguuugguuuugggaggagggguugugcuuggccucccucuuucccucucucuccccuuccauuuauguuuuuauauuuauauuauguuuuauauuucagccacuacuauugaacaccuccuauguuaugacggcccuuguguuaggcucuggagcaaucagggugaaauaggcaugcccugauccuaggguccuccaggaguuuaagguccagugaaagagacaggcgugugcacacacacagugcauggaggguucgaacggggacaucuguuugucagaaacacagugggguggaggaaggccugaugcagccuagcugguaaaaucagaggagacuccaaaggaggugauggccaagcccuguugaaggaggagaaggaacuugcuguggauuuggugccucuacagggcuguggcuuggcaacaaucaaauguccagcugugcauuucaccugaggcuggauuugaaaccacucccugcugcaggcucugggcaaguccauugccucuggaguaggaaggugcuccuuggcugggcuccugugaggagcacaguuuagggggagguuagcaauagacaggcaggagauagagccaaccagcagcuccaggggggugaugcauuugcuggagaaugggaugaggggagggaggcagagaagcugguggcaggaggugacagcuuuaggggagacucagccuaagccccaaauuucuaguucugucagucauacuggggccucagcacugcaggguuuuagggucaugccucuauccucucugagguucauuuucaccauuuggaaaaugaggugguguuccugccuccaaggccagugaaggccaagugaccugagaggcugguggugcucgcugggcagggcaggacggguggugcucucugcucuguucuaagaucgccuggucugggucugcccugccugcucucacagaaccugcaguccaggugucgggugcuugugaugagugcaacaagggugacaugcucuacauacaacggagcaugguugucacuaugacuguuggcuugagaauugggcagaagagguggggacugggaagaggcaaggcaagaggacgcuuggguggacuggacacgcaucgcgugccaggugcaccuguggguguucucaagugugccgccuuugaguccucacuauaucccgccacguaggugcugccuccgucagcauagagaggaaacugaggcuaagcagggauuugaaacuggaucucgcuccccgccugaugguucccagguagacuugucccuuucucuccaccugcaguaagguaaccuggugggaccuggguuucccacugagcucucaggagcccaaagcuccuucuggucaagcccccacugcaugccccuugcuccuuuuagaagcugugauauuaacacgcguaaaaacaauccaaacagcaucucacacaauuauguggggaggaaguggcugucacaggcaaucuggaaaagauguaucacuuaacucaaagggaaaaugaucaacuugcuguuagagagcgugugccuugcccugucuccucgauacccccacucauccccacagggauccccuucccccagcugagggugugccuggcagcuggcugguggggcugugcccaggccuucccugcaacauagugucaggcuguucacacuugaagggaccucguuccuuuauuuuguucagucauugauucaugauucauccagugcucacugugcaccuacuguccgccaggcucugggcaggcuggggggaagccugcagcauagacagugacacugucacacacagcagagcuccagcugcaccacacuaggcucaaaagcagcaugagucacaucucagagaccccagacacagaguaaagggacugcuucugccuggggggcugagaggagcucagggaaggcuccucaguccccgcaugcccagugggaggaagggcaucuggucacagggcccugucuaagcgaaggcggaagcugugucccaaguggcauuuugcagacaaggacgcugaggccuggagagaucugccaccuugcccagggucacacggcugacccauggcucugcuuggggugagaacuccuauuuguaccuaaugucagugaagagggacugagugcagaaggggugucugugaagacuggagaauguuguggaaggugcccuggagugggugaggguggaaggggaggaaaccggcuuggcuaaaaucacaguggggcagagagagagagggagagagagagagagagagagagagagagagagagaggaaggaaggaagaaaggaaggaacgaaggaggagaaggaagggaaggaaaggaaagaaagaacaaagaauagucacaguggggcagagagaaagagagaggagaaggaaggaaggaaggaaggaaggaaggaaggaaggaaggagggaaggaagggaaggaaagaaagaaagaaaaaagaauaggcucccagguuauuagaucacaugggagggaggagccugagagaggccuucacuuuugagugugacuggucuagagccagccccgcccaucugcaggacagugcuaccccagcuggggguuuggagcuccuguguggguaggagcacagcugggagugggcaguugcaugcuguuugccucacuuucacuccuugcagccugcaugggguucugugccaggaggaagcucucucuucagaugagaggcccagacucuguugcugacucccuggcugauccucagggucaaguugauccucugagagcucagugccccuaucugugaaaugggcauaacaucacccugucuagauuugcagucacauguacagaaagauuuugcagaguuaaagucaucacggagguguucuggcagcuguguggaguuggaggacacaggauggaagcugcuggguucucagcauugagauuccuuuugggaagguuuuggggugcaagggaugagagcagagaaagcaaaggagagaagaagguggagacuugggauacuugugaaccuuucuauugacuggggagaaggggaaauaagaaaggauguccuggcuccccucccaccccucugucuuggggagggcaggagggcuuggcagugaauuagccgguggaaguugaacaggcggacacuaggaguggccuuggccucacccauaguucuaucgaccaccugcauggccccugagcaaaugguuuugacuugggagcagugauggggucagcauccgagaggcugagaagagcagaguugaaaaugccugaggguaccaagucugcucugcacuuucagaggggggccaggacuuucuaagggccauccugugagagaaugggggacaggcccaggaccuggggucuuccuuuccauccuuggcucuuggacugauggucugaagacagggaaggcagccucugugagccuuguuucccuugucugucaaaugagcuggcuggcacagguuggcucaccacgggagauggacuucaggugaggcaggagggggcuaggugaggccaagcugacuuucuggcugggagugagagguggggcccagggaggcaagugggggcugcgaggaaguaaggggacuggaagggggucugcaccaagggugaacuuggcaguuuaccucacuuaguuuugauaagcuuugguuucuacacuagcuuuauuuauuuguuauugaauucauuuuuuaauuuuuuaaaacuguucuauugauauguuauucacauaugauccaauaagcccauuuaaaguguacaauucaaugguuauuagggcaugcacagauaugugcaaccauagucacagccuauuuuggaacauuuuaucaucucacaaagauaccuuuagcugggcgcaguggcucacaccuguaauccuagcacuuugggaggcagagauggaagaauugcuugaguccaggaguuugagaccagccucagcaacacagugagaccuuguuucuacaaaaauaaaaauuaaaaaauuagcuaggcauaguggcacgcuccuguagucccagcuacucggaaggcugaggugggaggauugcuugagcccaggagguugaggcugcagugagcugugacugcaccacugcacuccauccagccugggcaacagagugagacccugucucaaaaaaaaaaaaaaaagaaagaaggaaggaaggaaggaaagagaaagaaagaaagaaagaaagaaagaaagaaagaaagaaagaaagaaagggaaagaaagaaagagaaagagagaaagaagaaagcaagcaagcccauacuuuuuagcuacccucccuccccguuacccccagccccuggcaaccacagaucuacuuucugccucuaagauuuaccucuucuggacauuucacauaaacaaacucauaauaugugguccuuggugacuggcugguggcgucagguucucaggguucauccuuguugaggcaggcgucagucuccauuccuuuucauggcuggauaacauuucguugugauauaccaacggauauaccacauuuuguuuauucauuugccugcugaaggacauuugguuuguuuucauguuuuggcuauuaugaauaaugaugccauaaacauugguguacaaauacagguuccaguuuuugcuuucaguucuuuuguguauauucucagaaguggaauuccuggagcauaggguaauucuaugcuuacuuuuuuuuuuuuuuuuuuagauggagucucacucuguugcccaggcuggagugcgguggugcaauccuggcucacugcaaccuccaccuccuggguuaaagcgauucuccugccucagccuccugaguagcugggacugcaggcgcaugcugcuaugccuggcuaauuuuuguauuuuuaguagagacgggguuucaccauguuggccaggcuggucucaaacuccugaccucaagugauccuccugccuuggccucccaaagugcuggaauuacaggcgugacccacugugcccggcccuauuguacuuuuauaaagaacugucaugcuacuuucuccaguagcugugucauauuauagucccaccagaaaugcacaggaauuccaacuuuugcacaugcucaccaacacuuguuucuuucuuucuuuuuuuuuuuuuuuuuugaaacagagucucauugucgcccaggcuggagugcaguggcacgaucucggcuuacugcaaccuccgccuccuggguucaagcaauucucaugccucagccuccugaguagcuggaauuacagggaugcaucaccaggcccagcuaauuuuuguauuuuuaguagagaugggguuucaccauguuggucaggcuggucuugaacuccugaccucaagugauccgcccaccucagccucccaaaguguugggauuacagaugcgagccaccacgccuggccuccaacacuuguuuuauguguguguguguguguuauaauagccauuuuagugaguaugaacugguaucucauugcgguuuugauuuauagcucccuaaugguagugauggugagcauuguuucaugggcuuauuggccauuuguauaucuucuucuuuuuuuuuuaaucgagauggagucucacuccauugcccaggcuggagugcaguggcgcgaucucagcucacugcaaccuccaccucccugguucaagcaauuccccugccucagccuccugaguagcugggauuacaggugcacgccaccaaguugggcuaauuuuuuguauuuuuaguagagacggguuuuuaccauguuggccagacuggucucaaacuccugaccuugggcaaucugccugccuuggccucccaaagugcugggauuacaggccugagccaccacgccuggcuggccauuuguauaucuucuauggagaaauuugccuccuuucgaauuggguuguuuguuuugaguuuuagggucuuuucuauauuuuagacauuaaucccuuaucuggcaugugauuuguagauauuuucuguagguugcguuuuuacucuguugauaguguccucugaugcauaaaaguuuuucauuuugaugaaguccaauuuaucgauuuuuuccauuucuugccuguguuuuuggugucauauccauaguguuaucagucauuguuaucucgauaaagcugcacagcaaaacaccacagcagucauuuauucuuucuuaugugucaggggucagcuggagggaaggucagcaaaucuaggcuggacgugacugagcuugacucuaggcugugcauggguucugucugcucauucuucuggggccaggggucugcaugggguguguucuucucaaauugaauggcaggagcucaauagacaagucccucugcacaagguacaugcucaugcuacuguggagcuugggcaaagugagucucacagccaagcucagcauaagaggugggagaccccgcauggguguggacacaucauucuucugaagaggagugaagggcugggaucgagaaucugaucaagcccagugauggccaagaggugggaaugagcuggcagguuugaggcugagaggggcuaguguggcugaaauacagugaucggggacaggggggaaagucguauuuagcgggugcguggaagauguucguuaacugaauuaaucaaaagaagguaucgugacugacuggcuggauagagaugaaugugcugagaugggaaaggcaaggacuggaaacuauuuagggaagaaaucagcucacugccagaccuguuaaauuuuagagacacaugcuggugggcaaauggcuguaugagaugaaguagacucugcuugcaaggaucugugggucuucuggcagcaggaggacaagggcauggccagcugucccacgcagcugagauaggugccuccaacaauguaguaaggaugaggacaacucagcuuccuguuccagcagcguuccaagguggcuucguagaugaagggcauuugagcuguaaggugggaugugaaagguggagcuagggaugcuccagguggagggagccacagggucagggcacagggagaacacagggugggugacuggcagugaccccagugagggggugggugcagguuucagcaacaugccaggccugagcuggggucugugggcuguuccccugcuggugagccaggggauaggaggaagcugacuuugaucacuccauucuuguccaugugcccagcaggggcuggggauaugaggaucaggagccucugcugucuuuuuggaacucaaaaaaaaaaaagugagagcccagugauggcaaagauguggggaaaccgcuuuuuccucauuguuggugguggaggggguauaacuuggugcacccucuuuggagggcaguuugccaacagcuaugaaaauaugaaaauuuccugcuucuaaaugcaccacuacgcacagacagaggaacaaagauauuugucguggcuuucuucaucaaagcaaaagauuaagaacagccuaggccgggcacaguggcucacgccuguaaucccagcacuuugggaggccgaggugggcggaucauuugagguuaggaguucgagacaaccugaccaacaugaugaaaucccgucucuacuaaaaauacaaaaauguuagccuggccugguggugggagccuguacucccauguacucccagcuacucaggaggcugaggcaggagaaucacuugaaccugggaggcggagguugcagugagccgagaucgcgccacugcacuccagccugggugacagaaaaaaaacaaaaaagaacagccuaaauguccacuggcagaggacugguuaaaggauggucccccauauagaaggacacccugcagcugcuaaaaagaacaagcaacuccguauguacugaaauggaacaguccucaggauacauggucauguaaaaagcuaggagucggauagcaugaguaccacucacauuuucuuuaaagagagggaggggcccaugugcuaauaugaacauacagaacuucuggaaugagaccuugagcguugccucugggaaggaguugugggauggggagacaggagauucgcuuccugcuguacacccuuucuuuuuaguuauuuacuacguccguacacugcuccccaaaagaauaaaguaaaauaaaucuuuugcuguaugauauuuuuaagagucggugaggggaacucagagacaccaggcuucauaugggggaggcugaugucuguggcuccccacccugggggucucaggucgugcccugccuuccugccccaggcaccacuucauggaagcuucugggagggauccaggggagggugcaagaacagaauagccaugagguggucuugucuacucuuuccaucacagcagccuccccggcaguggccuggauagugugggcuuugaagcguggucaucggugaccuacaagggcuuggccauuagcagcccuaauggugucaucugcaggcgccuucuugcacgcacgaaccucucuguguguagcaguggugaauaaucaccaaauuguauuugauuucugcagcgcauuucuguauuucuauucaaaguugagugcaucugauuuuaugggaauucauaacaguucaaacuaaaucguggcaccaugcugugaaaaucucucacucccgagaaacugaaacgcugcccagauguccccuccugcccuuuuccuucccccugcucuauucucucaugucccccccugccugcuaggccaggaggcguugccuguuggcaggcagcagugugcccucugcccuuguaccuccugaccgggcugcagggagagaugggagauggucacggugggggcccugccccgggaguuaggcccagaacugccuauuucccaaaagaggggagugugccuugcuccagcagagacauggaaugugccuuuccagucuaggacaccaggcuucaacgggcuuccucuuagguuuuuuucugggauucagagguguuuggugaaaccccuacaggucauggggagcuuugcaaggaaccuggcuuccuccaaccugggcaaaggagugggaacaggaaggaggggcccuccaggguugugcaguggggugggggcauuuuguggaugcaucuccuggaggggguggcagaacgcaauugugugugugugagugugugcacaugaguguguuugagaaugugugugugugcauguguuugagagugugugugugcaugaguguguuugagagugugugugugagugugugaauguguggguguguguuugaaaaagugugugugcggugugugagugugagagucuggguguguguuugagagugugugaguugugugguguguguuugugugugugugagugugugggugaguguguguuugagagcgugugugugagagcaugugaguguguagguguguguuugagagugugugugugcagugugugggugagugugagugugugggugagugugugagagagugugugugugugcuuucaggcacaaguuuucuuucacacuguugguccucaccuggggaaaggagaacccucaguauggggccaagugccagccuugggccuugucuccgagccuggguuuuagcccauucugcugcucguggcugccugcaggcagagcaugagggagcccuccuggugaugggagcaauccgaccuccucgccuagcgaggaaagacccaguggggcuggacucgggauggagaggcagcgccucccgagcugggacccacggcccaggauaaaaggagcuccaugucccuagaaacgucugguagcagcccagggaggggugucagccagaggaccgccgaggacccucccagcucccagagucuccccugguguuugcaccugggacucuggccuucagggaggcucaggacagugcgggagagaacgucuaaucaggguuguccauguguucauaggcuguggcaagauuuugguaggguggccauaaaugaggccacugaugucaacacguugaaugcuuauugcagaagauaggcggaaugcagaaacuagcuagaagacaauaaaacuucccauaaccucaccacucacacaacacccuggcuucacuccacagugcuguaugcgcacacuccccugcauacauucacacacuaggaauccaaacaccauccccuguugcuuccuagggacaucccacaguugagccaguccccuuuuggguaucuaucauaaguuacgcagcagugggcaucccuguggcuugguguccacguacagcuauggcaauuuccucagcugagguucaggagguggaauugcugggccacaggguauaugcauuuucaggcucuuuggacaauuuucaaagacggacugauucucuguccaguugccucagcucagggguuugggagcccugcugaucuugccccucugguggcgguaagcaccaccucccugcugguggcucccacacuucugcuuccagcccauccuggaccuuggcugagcauguccagcugcugacccacuguugcuacuugguugucaacagccaugccagacucgccaugucucaaaugaacuuccgaucuugucccucagccagcuccaccugcagccucuccuguccuagcuaauggcaaugccauccucccaggugcuugggcucaauucauucuugcacagccagauccccaccagcaggaaacccucucagcucuacuuugaaacaugcccagaaucugccagaucccacaccgcuccccugccuggagcucaucaucccugccugcaucccugcaggagccuggacaccagucuagccacucccacccaugcccccuacaguguguccucaucacagcagccagggugcuucuugaaaacugguuauucauaucacguguuuccucacaaucaguggccuacaaaguguccaugauggacccugagaucucucugcccucaucuccugcaacucuucccgcugugcaccccuuccagccacgcuggccuccucaugcuccucaagcgcacuaggcaugcucuugccucagggccuuugcacaggccgcucccucugccuggaaggcauuccucccagauauccacauggcccacucuccugcgagugcaugcucauaugucaccuccccagugacccucagcugguuccugcacugcuccuucuuucccagggcaccucacucccaacacuggaugacucacucaccugcucuguugggguuggucucucccaggcagucucagcucccccagggugcgggcuuuaccuuguuccuuucuguguccuuaagcucuagcacagugccuagcacacaguagggcaugucagggcagaugugcgcaguguggccagacccagcuggaucccccacugccugaagccucaccuugcagcucacuggcucucugugguauaagacuuugauuugacuugguggggggcaggggugauuccuaugugggugacuccauggaugcugucacugaaccaccucucagagccuccccagccagcccucagcccagagcuggucugagcagcaggucuuccugggugaugacaggagaaggugguuaaugugggcggggcugcugcucuaaaucugagaaauuugcagucagcuucugccagggacaaaggugucaaccuugaggggaaggugguggagggaagcaguagcgggugaggaggggggagacuugcucaccccugauggagcaugcauucuccuauugcuacugguucuaggagcaaugcgugugagaugccaacagccugggagggcagaugaaacaaaagcccacccaccaccccagccaucugccuucuucuuggcaugugcagcuuaccuccugcuggcccagcauaccuuggcugugagcauguuggaauucucacugggcucgcugaguagaugccacagggucuugcccagagacuuccuaucaggcgccucugcaggacccuccccugggucacaugucugagcucagcaaggguuggggcugaggcugggagccuggccaugauggccaucagaauggaguucaaauccagacuugacacuuauuagcugugugaccuugagcaaguuguuuagccucucugagccccagcauguagaaugcauuguguaucacaaugacuggcauagaacauagacucaguaaauguuagaauuaugaaucugauguguggguagcuugaacccugaaaacugggagcccugggauuuucucucuccugauggcccugggcagugacagucuguuucacuuauuugacaccuagcacauguuuccagucacagccguauguucucauggcccuauguccucccacugugccuggcacaaaguuuggcaugaaggagaauguuggaaauuggagucugagggcuuuggggacuggcuaugugucuucuuaggaggagggcucuaagccagcacuugagagauuugggggcagcuggcuguggcccugcccuuaccucuggagcaggucucuggcaccuaucccagguccaagcaggaagcccagcacagaagggugugucuguguuuccugauccaguggggagacaggauuggugggagcucaggccgcauccugaaggugggccugaggaugguggaggaagccacuuggcugugcugaaugggaagugaggaggccaggaggcugggggaacagcuauugcacagagcagagugaggucaggcucucccuggggacccaugcugcucaccauggccuggguacugaggaaugccagcaggcaaagcagcaucccucaccacacugaggcuggaggucagggcuuaggagucugucucuucccucuggcaucagccucugcucucucugggccuugcuuuccucccguagacagaggagccagaggaagaucugggaccucagggaaaacccagcagcaggguggagcccuucaggcccagcugcuuugcuuuacccuuuggagccugugccaccuugaccuagugucggugccaccucacccuguggggaggauggaggcagagucagguuggagcugagauggucccugcuuccgaaugcuuuggaggcagucccugccaauccugcagaauuaggguugugugcaucuaccccugacugauggaucugggcacugaggcagucugaucgccuccgauggggaaaggagaacaggcacuugagagguugggggcccagugugccuggcaguguuggagccugagccugcacuguggaaagcgaaaggcauuaugcaugcauguguaugcaggcgcucacuuuuuggcagacauucacccuguguuuuuugugugaugcauauugugcuccgugagggaggggccaugucuuccccucuuacaaagucaggaaacgggaacagcagcauggugugauggaaacaucaggagacucugacucaggcagaccuggucaauccuagagugaccucucugagccucaauguccucgucuguaaaauggggacaagaagaccuacuucacagaaguguuuuggaagauugaauaaaaauaauacccgugaaaauccuuggccugugggauugccuaacaauuguucauuuccuucccuccuuccuuccuuccaccgcaaacuuccugcagcacccagcagaauggugugcucuccccagcuauuuguggaugauguucuuagcagauguuguuuaauucucauaacaucugguuuggaauggcagagggcuggaguuuuuucuguagaagauacucacucacugugagaugucagauugucacuuaauugcccaaugccucgguuucuccacuuguaaaucagggauaacgcuagugcugcuggcuagcuucuuugcaggauaugauaggguaaugcaagauaacagauggaaagugguuugaacauuuagagaaaggcaucuugcucaaccccgcuaguaguuagggaaaugcaaauuaaagcugcaaugcuauaccauuuuucauguguucgauuggcagccauuuaaaagagagaucacuuccaggugggcacauaggcccucucauauacugcuggugggacugagaauugccacagccuuuuccagaagauaauauggcagcgucuaguaaaaguucacauacacacucuggguuguauuuaauugacccagcacucccacuguuggagaaccacacugaagagccaaaucccaacacaauuauguacagagagauguucgcgguggcauugcuuuugggggcaggaaccuggaaacauccaaaugcccaucaguaagggaugaaaucuccauuaggaaacauccauaccaugagcuauuauuaucuccuaaaaagaaagagguaauucuaagcaauguuggccuggagugcugucugugggauuucuugaugugcgaaaagcaaguuucuuguauguagaggguaacuccauuauucucaaaguaaacaguagccucacggcucuguacauguguguaaugggaacauauuucuugggugcagagaaaggccugguaggaugcaugccagcccuugccugcccacucuggccauggucauguuugacucacaaaguauuccuuacaaauugaguuauuugccaacauuuaaaaauugaauucaugugaaaagccugauuucuaguuuuucauugagaaaaaucagaagcuccgccacacugggcccacauucccucuuggcugaaacacaucagcagcugccacuuuucaacagagagcauguggacuccaacuggccaucauccccacccacccagcaacacccucaucuaaauucccugcuggccuuguaagcauuucaguuugcaaccccugugauaggcuguuaauauucagaaacucaaggcaguggaaacacagggauaggauguguagggggaagaguugccucuuauuauucaaauacaucuuagaaucuuuuguguuucgucaugcaugguggcucacgccuguaaucccagcacuuugggaggcugagccggguggaucacuugaguucaggaguuugagaccagccugaccaacauggugaaaccccaucucuacucaaaauacaaaaaaaugagccaagcgugguggcacgcaccuguaaucccagcuacucgggggggcugaggcaggagaaucacuggaauccaggagguggagguugcagugagccgagaucaccccacugcacuccagccugggugacagagugagauucugucucaaacaaaaaaaaaaaaaaaaaagaaagaaagaaagaaaaaaaagaaaaaggaaaagaaucuuuuauucuucaaaugacugucucauacuuuguaauuaggauguuuuaaguauaauaucagaaggaaagcaaaaggggacuguuguaugucguguuggucaggaacaucugguagggucaccucauuguucacugaggacaugggcugagagggauugaggccucuccaaguccagaauuaagggguccacgcucucagcucuuucuuaaucccucaccccuauaucuuggcagagauguggaagucucuccaaaaauccuuuccuccagcucuauucacugcccugugucuuuccuggucacuuauugacaagagagauaggacaccagcuugggucuugaugcuggcucugcucucuaguuggaggucucugaacaaauugucugauggcucuaagccuacuuugugagccagggagaugaacacgccccaggccagaugcacaguagguaugcacugaaggguaaugugugugagucuggcccugcacuaccagggcagacaguucuguaggagguuaggauuccugguuggugaguguggucccccuggugucacugcugggcucuagggaggccugcuccugagccgcuggaggaccagggcccugauggaaugggaccagaguggggacuguugccauaugggagagagcugucuacccucccagccacccuuagaaauaggaucuggucuuucagaaccucugucaacugagcccccgaucucacuagagcuuagcucugagcccuucaaaauucagcuuuagccuccacagacuugcugugagguccugggcagguugccuccccucucugugccucuuuggacaccaugaccugcugcaucccuucauauacaagguuaugggauaauguggugaauauaaaaaauaaaaaaaaacaggaagagauaugcucauugggcacugguggugggauugggcuuguuggacuugccaagcccccuguuagaccgcugucuucccggucagugcccaucuccucaaugcuguccucaggauaaccaggcucugucacucuugggggaugugguccuggaggcugaaggcagcagccccugccuccaucuacugggccuagaauaugucacucuuugcccagaguccccucgcaggacagccagucccccaggagggcaaagaggacccaauaggccccagccucacccagugacucacaggccacugugcuauacccaggauaggacaauguuaaaaccaaaugauacagacccucuccuuucucccaugugcuccuaaacccuccaucuggguugauuccuucuccucccuucccagccccaguucucucuggagcugcagaggugggaggggcugaggagcagacccucugccacccaggaagcuucucacccucuucucuuucuuuguguccccaggagccauggggcgccauguugccaccagcugccacguggccuggcuuuuggugcugaucucuggaugcugggguaaguccaguccuccccgugucuaucccaugggcagccucugcacgggaggccaggcuggaggguguuggggcuggugguucaucuuugugcucugggacucuggagacacugucuuacugugugacugaggcacauacuucccucucugggccucaguugccuucugcagcucucacagggcugaaaauaccagcuguccccaaagccugggacacaagagggaaugggaggagccuugagaaauacuugagcucuaagggaaggaggcaccugugaccgugaaccguccuccuccuggggugcagggacuggccacagcucuauucaguuccacggcuguguucugagcaccuacuguuugcacugugugugaccuacugcacccagcucugagggaauggaggaaauaacucauucucaagaagcucagagccuggcaggggagaaagacacaugcaggauuuccuauacugcagggugaauagagugguaaugaaagaugggcgcggcuccagggauguccaucggaagaaaagaugaauugggccugaggggacaggagaaacccagccagaagggucagcauuugaucugggcugugaagaccaagaaguaguuuuaaacuaggugagcaggaagaaaggcguccugcuggagggcauagucugagcaaagcuauggcagccaggagccuuccccucugcccuccuuuccuggccuuccagcagccagcucagagugccagcuccagagcccacggaggaggguaggagaggccugggcauuugcuucucgcuuggccccuggacagcaggugguggggagcaaagcagcccugggcugcacugaaggcaggccaggagagcaggcaugccugauguggcaucccccagggccauagcauccccagagaagagccgugggcaugguguaccuggugacacacgcaaacacauuccuguggggggccagcuccuucuccccuccagggagccaggcggagucucuggaggcugcugcagccucgugcuuguuggaguguugcuagcguccugcagccugaguaucccucgaggauucccucuccuugccuccauguuugaagggaucccuacuggaauccccccugugaugggaagcucacucccauccaggcagcccaggaguacagcacagucucaaagacucucagagugcaagggagccucaggcgcuuuuuuaacucccagcucauuuuacagaggagacaccgaacccuggagaagcuacuggcccaaggcuguacaaagcaggggucuguuauccuccaugggggcuucugucaggauaucaccccccucaccccgcucccccccugccucaugugggaggcuucaaucggggcuccugagagcagccguggccuccauguucgcugcacggugggagucaggacacuuucuucagccuccccggggacucugccaccugggauccacccuccucccccauucuguuccacucacuuucuucauccguuaaaaagaaauacauuuggcccggcaugguggcucuugcuuauaaucccagcacuuugggaagcagaggugggaggaucacuuguggucaggaguucaagaccagccuggcaaacauggcacaaccccaacucuaauaaaaauacaaaaauuagcuggacauggugguggcgcacacuuguagucgcagcuacuugggaggcugaggcacaagaaucgcuggaacccaggaggcggagguugcagugagccgagauugugccauugaauuccagccugggugaaagagugagacucugucucaaaaaaagaaaaaagaaaaaaaaaaauacaucaguagaaauaaaggaggugcuaagcccuuggcugcuuuccucugugagacacggcagucuccccuugagcucuccagaugaaagaugcuucgugcauucagggugaggacaagaacagaguguauagccagagcugaccuccugucuuccacucccgcuccagcuaaggggucccuugggcgagugucuuaaccuugcugugcuuuaauuuccuugucuuuaaaaugggaacaauaauaggacuuuccuucucagguugucaaagugaucaaauggauuaaucuguacaucaagcacuuagaauagugccuggcacagaugaagugcuuauuaaguguuggcuccuuuauuaucagaaguuaucuuucucuaaggggagcaaaauggggcauagaaaacagagaagcuaagcaaauugcccaaggucacccagcaauucuaugccaaagcguguauggucggccugcauguggacuagccugcuuugccauacgcacaagggucccucacucucucauugcuuggcacagucaccucuuucuggucccugucugaagcagccagugcuguuccuuuggccuaguggggcaguggcugacuuuagagacuaggggagagugggugacugaaccaccuucccaggcccucuagacaccccugaccuagcccuucacuugugccccagaucagaccacacugcccucgccacuuuguuuccaccugaccccgucaccccagccgaucucuaccccccuaccugguagucagggauggguagggcucagggauuucaaaaccccuugccagccugccuucucucuuugaagccuccugcccuucuccccucuggccucaauguacucuagcaauucuccuucuucauccgugggcuuguuggggaggcaggaagcgaaggccugggcaggccugccccaccccauccuagacugacuagccagcaagcauucugcugggucacuccuucuguccccaguugcugggugggagaggccucugaccaugcggccaccuggcuuccccacccgacaacaugucaggcuucuguccccuggggcucaugugggccacgcugcagucaccucaauggugaccagggugcaugggacaccuguggccgggaggcaggacuggagggcagggcagggcuuuuuguccccauccugaggcuggaaaauggggcggagggcgaggcagagggagagggaucugccuaagcuccccagcagcaguggcagagcaugcaaagucccugacuccuugaauuuaucccugcacucccuguccagugcgccuuccuugucaaggggcgacuggcgggggcacucugaggaucucuccagcagggaucucagcagagccacugcaccuucagcccccaccaccgcccugaggccuggggaggcgaccggggcuuggacucagacuggccuggcuggaaucuggacccuccacuugccuggguucuucaugcccucagaggaacccccaccccgcaauucagggugaaguuuaugcuuccuggcuuggcccacccugauccgguggggaccuuccccauacaagcacaccgacgucccuucagucccagaucagguccccuggaugccaccuccaugccgccacccagccucuguuuaccccugugugugggaaaugcuugucauucagcaggcagcuggaaugcugugcccucucugugcccuucucuccccucucuccucaggccccuuagggugcuagaacuaaguaaagcaggcacaugcccucccggucugccuuugcaggcucuaguuggggaauggccauggggguggcagagagggcgggagagggcucagggcagugcucacaagccacagacccacaauggggugggccacguggggcuugggacagagagagggguccugcacuugggaagcugggauucuccuucccccgaagaaaucacccccugccccuccccuucuacauccacuuacauucccgcuucgcuggaggccccaaagcugcugagcacacagcugcugcgcuuuaacagcggcuuugagaauaagucaccugucugccccgccuguggugggccugcucugggaacacagguccuguuugguauguggcaggcgacccacgucccggagucugccuagcugucugugcagagcucccagugacugauuaguggcaggcccuguaaaguaaaauuuagaaaugaacgaugccacugcaggugauuuuuuuuccucacugguuuccuggccucaacagcccaaagcagcuauugaauucucugggcacucauuugccucggcugggcugcguccugcucuccuguauccugagcccaaggcccccagcagggaucaaaagccuucccgucggcugcaaaggcagcguauuuauuaauaccacuguuaauacuggcuaccauuuauggagugcuugcugugugccaguggcacagcgcuaagcgcuuuauguauguaaucucauuuaauccucagguuagccaugaaguccuauuauuauggcuauuuuacacauggguaaacugagacaugggaugaucauguggcuagaaagaggcacagggagguuucaaaaaaggugaggcccuugaccaccaccucugucugaggcuguugugcuccugacaggagacuggggagguguguacgugggugcaugugaguauuugggguggucagggagggcuuccuggaagaagggccaauggaaaugagauuuggaggaugaauaggaauuuggcaaaugaaggcagaagggccaucgguccuggccaguaagugagagagggcagaauaagggacuagaaauggcaucagcuuggcugccugagcacaucgagguggggaggaggaaaagaggccagucucccagcucugccuggucccaacuaggaggcaucuuggguuggaggaggaagugccauacccagaugccaaccuucucacccucugggagccuggcacaugcucugagggagccccgggucagcagaaaggaagggagagagagcugccccauacacccacacucagggccccuggagggcugagcaggugccccugauggcaggugcugcacaaugacagucccacuuccagcuagaccagcugccuccugguugggagggacugaggggaagugcccucacuugccuacugaaggccccuaagagaagcugggggacagguggggucagcucagggaaacuucaugugggggcuccucauaggugccaagcuccccagcccauguagguaucacccugacccccuccagacccagcccgcucugaagccaucacagagcagcacgugguuaacagcacgagcuuuggggucuggcuuccuggauggccaccgccacuugccagcugugaaagcaaggcauguuacuuaugcccuggaguucucauuuuccccaguaaaauagggaugugauagcaccugccuugccaucaggauugagugaggugguuuaaauagcugguauggagaagggguuccugagauggcagcuauuaucaucaucguuauuauucugugggaucagcuggccaucccuucacacaccaaaucgucuuguggguugucuaagugucaggcccuguucugggcaccaggguuccacccgucaaccaagcccuguccuugcagagcucauauucugcuagagccacacugcccaauagaaagacaaugcaagccacaugugauuuuaaauguucuaggagccgcacuagaaaaguaaaaagagacaacgugcgauggcucacgccuguaaucucagcacuuuaggaggccaaggcaggaggauugcuugagcccaggaguuggagaccagccugggcaacauaguaagacccuccccacugcaucuauacaaaaaaaauaaaguaaaauagccuggcauggggcaugccuguggucccagcuaauugggaggcugaggcaggaaaaucgcuuuagcuugggugguccggccugccgugagccaugaucacacugcuacucuucagccugggugacagagugagacucugucucaaaaaaaaaaaaaaaaaaaaaaucggcaaauuaaaaagaaacaggugacauucauuuuaaucauauauuuuacuugauccaauauauccaaaauagaaucauuucaauauauaaucaauguaaaagaucagugagcuauuuuacacuaauuuuuuucauacagaggcuucuaaauccugucuuuugccugaggagccccugucaugugcuugcuccaugugggccaugcucagcaggcacguguggccgguggccucacuugccacacaccagacagcugccugccgaccuacuggcauugucccccacuugccuugaggcaggauagugacuuccaggguccugggaaguugaccauggccauggacacaggcucagugcccacugcagcccucacccugugucaccuuauagaguguguaaagcugaugggggguacuuggcugacgcucuuguccucugacuuccaggccaggugaaccggcugcccuucuucaccaaccacuucuuugauacauaccugcugaucagcgaggacacgccugugggugagugggggcaugggcuggugggcgugcagauggccuggggugcaaucccuucccacaagugaaggggaucuuacagguugaggucaucuuccaccugauuuuggaaucuuuuccauuguguagaaaggccccugcuaggaugccuccagggacagggcacucagucccacagaggggagcucugaacgucaaaggguuuaucacauugagccucagaugcuccacucccacuucuggcacuaguuuggauuccucuugcacuugaaggccuugugaauauuugaagauggcagcuguuguagacuuuguuuuguggccuuuuguaauuuucugugauuacuaaguuuucugcauugaguuugccuggcuuuggcauuagaaaaaacaugaacuauuuagggggugauuauaaacaucuuggugcucagcccgucgccccaucacucaggucugucccagugucuggcccccuacugagggccugccuccuacaucuguggccccauuguccuagcucagcucuuaggacccagaagcuucucaggaaacugaggcugaauugcaggagcugucuuauagcugugcugauggggaggcaccugugcccgugugcaggcagccaaacagcagcaccugaaaagggccugcccaccuccaccgacagcccuccugugucaugucauucucgcuggugucacuuuagggaaagugccugucauccggggcuucuuacucucgggucugccaucucuacaugugcaaaggcaggccugugugccagaggccaagugcaucaggggucagcauggugcaucuuuagggagcaucacuugaacuuggaaaugaggcaggauggcucggaguggggcgggguaucaagaugcuuaccuaauaggucauguacacacucuuucauaugaaacccaguguaggugugcaguagaguggaugcauaauucuucaacgaucucugcuccaguggggugccuuacgcgggcccagacucuccccugcugucagugggggccugugagcagcgccuuucacucuuccugguggagguuuuuuuucagggggugcugggcccagcaggugugugucuggcuguuuguuguggggauuguccccacggcccaguagcacuuuguuccugggggcuguggggggcccucuguggaaaacggcuacuccuuuggugauagaucaguguuguaaggcuagauuuggggguaggguuuggggaucuggguguuugagggcuccccaggaagaagguuccugccuuuuuggaaugcccucucauaggcagagccccuuucuggggguagagagcauacccacgucccuuggggacccugcuaagcuguuugcuccccuuuggauuggguugagggauauuuguggacgacuggacuuguaacacaccuguauucuuuggguggaauucaccugugacuccucucuccacccagaccugggguggggcuggcauggagccaacauagcagcacacagugcaugugucuaggcagauggaugugcuguuagcagcauuuaucauuauucauguccauuuaaaucucauccucugggagaucccuuugugguggagggauauauuuggagcaggugggccacugaggcagugguguggccagucacuaacugacccugcugccggcuggggaaagugaaggccccucucaagugaguggucccugcucuguccccacaucugugaccugcaugccagguucugagcgugggguccucagaggccuauguauugggauggguuggggagggaugggcauugcauggccugugcugauggugacaagcccgggcuggaagcccauguggccagcccuucagcagguccuucuccugcugccuucagcucuggcucuugauugucuuuugcaaacgccagcaucgaucggccuccggaagcagcucccaggccucgagcccuguuaaggcugcacuuggcagucacagcaggguggcugucuagugccauggggauugaucccugacuccagggugccauaggauugagagggggcucagugagcuggaagauagcuaugcucuucucucuaggcagggggugggugcggagcugccucagcgcccucccagccucuucucuucuuuuugcaucaguaugggaacagcacagcuuucaccugaaagucaggagcccaacaucuguuucucgcuguguaaccuugggcacagcacugcaccucucugggccucuaucuccucauuucaacaaugagugggcauuggaaagaugagcccaguggacuuuggcuggggcagccuggcuggccccaguuguuucuagguucucagaggagaccagccuggagcccucugcugggugcuggcacccacuugucccugggccaagcagaugguggguauggacucacauggacgugugggcuccaugggugcaggccucccaccagcaggccagggagagggggagguugaaauggcuuguccaggggacuggccuuuuuccugccauggggagugggguggucuagagacuugacuuugagacuuggcucucaugaacuguucacucuuugacucaggguuccagucaccaaaaugggugacuggaucccucacuggauuguugggaaguuuacauacaauaccaccaccucuaaagcuuccaacccaggaauguuuuguuuuuacuaaagggagagcccauguguggcccagggauggcagauugggcuguccuacaagccaugggcuuucaggguggacaaacacacagauaagcuggguccaggguggugcucagugccaguggcaagaggcagagcccaagccaggcugaccgugucggcucaccagagguuggaguuguaagcagaucaaacuuccagcucgaggccucauuaccuggcuucuccuuagacacccagugauggucagcucgugggccuacaaggcagcucacucugugcugugggacgguuccaggaagaaaaaauucuuccuaagauuaacaggaaaccugccucccuggaacuacccauugggucuaauucugauugcuggagccucauagauuaaaaaugauaauauaacacauaugacauacuauauauauagauauauagauauaucauaaauuauuauaacaacagcauuuauugacuguucaaggcaguguccuaaguguuuuuaugcauuaauucauuuuaaaaauuccuuuuaagaaucagagguagaguugggcuacagggucuaucuauauguagcuucugugaaugugcuuuccuggguuagagacugagacuuuuauccacccccaaccuucugagccuucucguuuuguaugcucuugccugcguuccaacagggggccaguggccugggagcagaaugggagggcacagcauggccaucugaaaucccucacagagccuacguguucauuacuaucuccucaccuaucucaggcuccaguucccucuguguaauguucuuuuugaagaccgucuaccagccggagaagacagaagccaaaugaagucauuaacuagugcugccuucuccuggucuguucacaucgcccugcuuccccagacagggcccugaaucccugcaugucuugcuccagacguuaauaucaguuguuggcagcagagccuggaaugcguggaguggcgugagggcagaucagcagcucagucccuggucaggcugguuggccucacccacaccuuggcccugccuaucagcccugaauggucacaugaugccuuuagcaugagggacaggugcugcaggggugcugucucccacuuaaccuccugaaucuacuuuuuuuuuuuuuuuuuuuuugagacggagucucacucugucacccaggcuggagugcaguggcacaaucuuggcucacugcagccuccaccucccggguuccagugauucuccugccucagccuccuggguagcugggauuacaggcacacgccaccacucccagcuaauuuuuuuauguuuuuaguagagacgggguuucaccacguuguccaggcuggucucaaacucccgaccucaggugauccacccaccucagccucccaaagugcuaggauuacaggcgugagccaccgcgucuugcccugaaucuacuugaaaugccccaccagccuugcugaugucgagaucaccaaccaccucuguguugcuaaaucccaucauuucuucccagaccuuguggccuucaauugguugaucuuuuucuccuccaggacaccacccgccccuucccagccucucugcugguuccucccgcaccucuuagcaucagagggccccagggcucagcucuugucucuccucuccucauucucauucccgugguggucccaucuagccuccuggcuuggacacuaccuauaugcugacaacuccuagcuuuauauuuucugucugggcugcucucagggaagacuccagacuccuauagccaccucucuacucaacauuucugccugaugucuaaagggacauuuucauccucaguuuguccaaagcuggaauccugaccucccccagauuccugccucaccggcagccuuccccaucucagcuguggcuccauccugccaguugcccaggccaaaagcugggacucauuccugugccucuuuuucucccuccccuccccucccaucccuuagggcauccuguuggcucagucuccaaaaucaucccagaaucuucucaccucucggcccuuccacucccaucaccaagguccaagcccaguuaccccagcagcuuccucaggucucaguguucucccugacucggcccucacccacgcugcggccuuuuuuaucccagccauggauggcccugcccagccugaggcagagccugcuccaaggccugcucaagucucucccucccacacggaguaaaagcccguguuccucaauggcaaccaggcuguuugcagcccagcaccugccaccugucagaccucgcccccaccccgcuaucccccucgcuagcucuacuucaucugugcuggucucccucuaguucccuaagugugaaaggcaagcucccacuucacggucuuugcagcuguuguuccugcuaccuggaacauuaugaaccugcgcuuaccaggcucuuucagaugccaccgccucuggguggccuuccugggucuccuuguuggggguuaagugcugcucccuuugcuuuuuccggggccuggccauccucucuguuagccccauggagaugcugcuguuacucaguugcucuucuggcucccuucuuggccugugaaugccuccagguggccuggccaucacuguguccccagggccuagcccugcgccuggugugcgccuggaacuuagggaaggagugcaugucuggacuuggugagcauguaggggaaucuuccaaggcaggacccgggggcuggcuccaugcccuguucaacaucccuccuggagccucaggccaggcgcuccccuccccagggcaugucgggagcgagguguugguggcgauggggauggcugcccagggagugggcccaggagagcacuuucccgcagauggcacagaugcuguacgugccuaugcuugugaacggcaaggcccgcgcugugccagagguccuguuuuuaucaucccagcugcccgccugagcuguauguagaauauuugccggggaccuuggggcccugagccauggcuggcccugggggaagaacgcagagguagcagcaugaagccuggcuuggagacaccaaguugaccaagggggucuagaagggauccuggagggcauugaggcccugcaccuuggccaccaccuucauaccccaugcccuggaggggggcaggguuccugccacagugguaaccgcccgcagccagaagccucccgagugccugcaggaagaaguagagcucuguaucucagcgagucgcccccacucuccacagacaccuugccccccagcacugacaccucgcacacuguugcacugccgugcccucaaccaugcuguuuccuuggccaggggugcccuuucccuucccugccuggcaaaguccugcuccucuuucaagcugcagcucagaugucccuugugcuuagaggcuucugaagccuccccagccugcccuucugcuggcuuugucugcaucugugaaagcccucagcacacucuagcguggcuauuuguguggaacuccccauuggucuauuaauuuuuacuuauuaaucuuauuaauauugacauuauaauuaacagcgauuuuagugucucuauuauacaagacugaggagugcuaaugugagcuaugguuuguugacagccagccucuugcccgagccucuauuaggcacuucaagugcauggccuccugugagaccuugcagugauuguccuggagagauggcaugaucugcauuugacagaggaacaagcugggccuccaucucuguaccaagcauggugccuggcacaaaggcggccucagcaagugcuuggugggugaguggguagaugaguggaugggugaguggaugucagauguccugcuggguccccuccccuuggcucccuguccuuccuuuugucacugagguugguacacauggagcugacuuccccagccagaaccaccagcaccccaaaagcaucuuaagccacaauuaaggugaucaugccaugcuaaucaccuacacgaguaaauuagucuugucaagagccauuaaggugggaacccgggauucauuaggauggauuggucccaggcagcgccuggcacugcugccagucggugcugauuaauuucucuccaaacuccaucaaugcccagcuguuucuucuggacccagggagagcaguuuucaggugggcugaccccgcaucggcagucucugcagacggaggagcggugcgccugcaagcaggccggcaacuccccgcaggagcagccccuguagagcugaaugggaggccagggagggcagauggugggcuuugugggcagccaaggcucaggagugacgagcauagaugcuggcaggcacggaggcauaggugaaagaggagucugggaggcauuggggacuuuucugggacuaguuucagcccuggugcuccagaaggaacugucccuccucccugaaaccuccucccaaugucccuuuaaagaggagaagcaucucuugggagaggguggagaaccacagugggagaauuauuuuucucuuaaccagaagguugcuuaagauugacacaggugagaggggucaugguaccccagagcugucccacagcgagggcugguggcaaagccacaggaauuguggggcuaaagggacggggaugggaggaguccaguggcucccggacaucagcugggugugugcugucugcauaguuagggcuuuucugcccaccguguucacagaggugguauagccugauagauaucagcucuacgaaaaaaaauauaggggguguuagacaauaauaagugcccaggagaaauaaucaacuuugguuggaguuaagaugggagguagacaguggggguguaacagucuguauuguccaccuuugccuucacccuccccugaaguguucucagagggcccaggauggacuuguaguuugagagccacuguuuuuaucaaacauucccacuuugaagauggagaaagugaggcccagacugccuggaugugaaucccagcucugccucuuacuagcaguguaccucacuuuccucuucugcaaaaugggaauaacguucaguuuaccucuuuggguuuaugugaauauuaaacgagcaaauuguaaaacccuuagaacugugucuggcccauagaaauccaagcuguaauuuaaacucgcucgcuugcuuuuaagcuccuauaaacauauuuucgaaaggaaacuuuaaugugucagacaagcuuccugguugcccgcugaagaaacugccucuggcuguccuuucuauuggaaggcugcuggaggcucuuggaauugaccacaacaaaagaaccuagacuggaaauuggccaaucuguccagccggucacugcugucacucugaaugaauucuaccacucauggcacgggcagcaguguccagguggccaagccaacuuggguaugugucugugcucaggcugcaaaggggcaggggauagugacugucugccccucccagcuacacccaaugggacagucuccaaaaagaggagggguggaacuggacacagcaccuccauagaaagacagauguccauuuucuaccaucagagugaaaucccagggcugagaugcugacuggcuuuuccuaacacauauuaaaauaaauacauacuauauuuuuuuuacauuuuauuuuuuuuuuuuuuuagaaacaggaucccuauugcccaggcuggagugcaguggcgcaaucauggcucacugcagccucaaacuucuggacucaagugauccucccaccucagccucucaaguagcugauuacaggcuaaugaagcaacaccuggcuaauuuuuaauuuuugugugugugagauaggagucuugcuauguugcccagccuagucucgaacuccuggcuuuaagcaauccuccugccuuggccucccaaagcacugagauuacaggcaugagccacugcaccuggccccuuauuuuauuuuuaaacuuuuuacuuugaaauaauuuuagacuuacggaaaaguugaaaauuguacagaguucccauauacccuucacccagcuccccauaauguucacaucuugcauaaccaugauacaauuauggaaaccagaaaaaugacuuugauguaauacuauuaaugagaguuuaugcaaauuuuaucaacuuucccacuaauguuuuuuuuuucugcaauuaagaugauuuuuaaacuucuuuuuaagcuguggaacuguuugggcaaauguaaucuugcccagaagucuaggauagauagauuagauagauagauagguagacggacagaugcacauauauacuuauauucauucguucaacaaauguuuccuugagugucuucuaugcaucagacacuguuccagguauugugcaugcgaacagaagagacaaaaaucccuguccucauggaacugacauucuagagcggggagcaggcagaaagcagcauagaaaaaaauauauacaguauguucaauuguaacaggugcuaaggaagaagaaccaucuuugguagaaauuaaagucacggguagcagugaggggugaaagagccuguauuuuccaccugugcauucacuccuauauuaaaucagaggacccaugaaaaaccccuggggccuccugucggacaguuugugaccacuuuguuagacaaacaguugcacagauggagaaacugagguggagaauggggcgauugcccagggucccuagugaguuacugcugggguccggauugcagcugcccugacuucgcacaccagcugcagagggaauuccaggguuucuguccaggcagucacuggugccuccaggccugggcaagaaggggcguccuccuggguuggugggcugugagcucgggaauugaaguuuggagaagagucuccaggugccucgcagcugcugggaucuggagcuagagcgcuuaaggaggggaagggaggguagccuggaggcuuccuggggcuguuggcaagugggcugugguuuuggaggaaggaggugaucuaguauccauccaggugaucggugcuggaaccaagggacccagggcuuugggcucuuggugcccucacagaagggaggacuuuucucucccuucuaggaguugggggaugacugacagaacccccaggagggcuugggugcuucugcguccuugcuuccucucugccauuauccagggcagcauaggcccucuaaggugauagaacagacugugucuucuuggggguccuuugggcuguagccacucccaagcggucccugucugggcacaucuggagccuguggcagccccggcuauggacugccccucaacacacagguguggguauggggcggggcugguguuuuggaugcggccauaauaacacuaaugauaaugaugaugugccaccugucgugugagcaugccauuaaugccaggcacugaacaccugugccagccugugcuggggggugggguagggacaugcacauuagagauaacuggggaaauagugacuagcuuuuauuacauacuuaaucucucuagaucagccguucauacacauugcuucguugaauucuaacagcaaaaaagugagucuuauaacccucauuuugcaguugaggagcagaggcucagagagguuaaguaacucacacaggcucacacagcuuguguagagucaaaauugaaccugaaccuaucgcccucuggccccaaagccugugcacuuaaccacaagucugggauucuguauguaggucuuugcuuuuaaggagcuccagucuggaguggagaagagaaccaaugguaaaugaccaccucacaccaggcaagugggaggcaugaacuacagagccuugcuaaugccccgaggaggaagaaacucauccugggcacagggacagagaaaucuucauaguagagguggccuugauugguuggguuuugauaggcugaagcuggaggggaggcauuucacaagaaggcaauggaacaggcugaccagcugugaggcaagcaauuuguguugugucuugaaguuguugugguuaaaaaugaaaauaacaauaguaauuauuuagccccuguguuuuacuaguuagguuaccugcacaaucuuguuuaacccuuacagugaugacaggaaaucuguucuaguacgaucaccuuguuccaggcucagagagagauccagcaagcugcccaaggucccauagccaguaagcaguagagucaggauuugaauuccacguauucaaucuccaaugaccacacucuuaccgcccugcaaugcugccucccaggauuguguagggucuuuccucagucuguuaccuaggaaagagccucaguggccaaggguccacauggggcaggugcugggugaaggagcagcugcuccuaaggaggggagguuggccagcccagcucaaucugggagaccaggccccggacuggggccggugccugagucccaggccuggcauugccccuaugcaaccgugugagccugggcaagucaauuucccuguucagcccuugcuucccuguuucucagaagaugcauuccuugcuggauauacuaugcagaguuagcaagagugcugaaaaugacuuuggggaaaauagaugaaaguaugagauuagucagcuugcuugcuccuggguccacagccuuuuccagugaccaguggugauggcggugggggucucguccagcugugcaguggccaggaagcaggcacccccuuugcagggguggggggcugacacaugagccuggcacaggugugccauugggacgaggaugugcugagcuugcagccaaccgagaacacuuggacucccuaguaacuggcaaagguguaauuuacaagagcugaauacccuccagcuggcugaggagacgggcaggcagagccgacuuugaacuugucaucacuccccucaucaggacuguucuuuacaccccucaggggaccugugagccugacuguccaacaacagcuuugucuggaauaggagaucaaguuguucugucagcccuugaccaagaaagggcuuggauggccaggaaaguuguucuuuggugcaaggauuuccuugaagguccccucacccaugugccuucccuuccuccuuuccacaucugagcacagugcauggagugggaggcacaaggccuggguuucaaugccagcucugccacuuauuagcgugugaccacaggcaagucccuuaaccucucugaaccucguuucccucuucuggaaauugagaugaucauacuugccuggacaaccucauagggagcuaaugaaagagcuuuagaagugaaauagcuguacaaaugguggacauuguuuuuauugagcaauucaucuuuaaaugcuuccucuuccaagaagcccuccuuugcaucuuuagcaaguguggacuguaucaccagcuacuucaccucucucugucccaguuuacucaguucaaaauuguggauaaugaucacacuguauuuacuaauagagcugcagugagaauuaaguaaguuaauuaaaguaaaauuaaaguaagauuaaaguaaggguuuuuuguuuuguuuuguuuuuguuuuugagauggagucucgcucuguuuccugggcuggagugcaguggcgcgaucucggcucacugcaagcuccaccucccggguucacgcgauucuucugccucagccucccaaguagcugggacuacaggcaccugccaccaugcccagcuaauuuuuuguauuuuuaguagaggcgggguuucaccguguuagccaggauggucucgaucucgaccuugugauccagcccgcccuggccucccaaagugcugggauuacaggugugagccaccacaccuggccuuuuuuuuuuuuuuuuuugugagauagggucuugcucugucaccgaggcuggcacgcaguggcaagaucacagcucacugcaaccucgaccuccugggcucaagugauccucccaucucagccucccaaguagcugggaccacaggugugugccaccacaccuggcuaauuguuuuuuaaauuuuuuuuguagagaugggggucucccuguguugcugaggcuggucuugaauccugagcgcaagcaguccucccacuuuggccucccaaagugggggcaugagccacugugccugguuaagucagguauuuuaaaccgugcuuggcaaauaguaagcacuaggagaaguuaacuauuauuauuugcgguggugcuguugucggccagugcuuuucccaacuaggugagaagcagcucggggacaggaaugauauucuauguggccaaagcccacugugcugccacguaaauaugugaugugguuugaugcguuacucuuccaagggacauuuucacucuccaggaggaagaggccuagaggcuccugggcccaccuccuagccuaaccaggaauccccuuaaugcagcugccuaccaacagguggugcaagcgcuggugggcccuggcagcgggcaacucuaccucucagcaggcagugagcaccaccugcuacuagcaggcugacugccuccugcuguuacuaccccuggccagccccagagcucccuggaggcagccuguucuucuucauacgguggcucuccagggucugcagggcuuuccuaagucugcuguucuuuauucuagagguggccagcucuuguagcugguccuuauccacagacuuggcccaacuucucccuccuggucaccuuccuguguuccagaaauugugcuagggauguuuugugugccucacucauuuaauccucacaacgccccaugaaggagguaguuauggagcccauuuuacagacaaggaaacugaggcuuagagagguugcugcccacccaagggcucauaggcauuaagcugcugagcugaauucaagcccacaugucucucucucucuccauaaccaaugcuuuacucuucuuggcacagaacagaguggaugaagaggagaaacuuccagcccaggggcugguacaggguccccaccuaccaucuuccuuacuugccuucauaacacgguggacagggcacaagauccuccaaccuugguccccucuggccgugugcccuugggcaagggagaggaugugcccuggugucacagcaccgccugugggcccuccuuuccugggcucucuuggcagcaggacugugugcggcgggaacccgcacacuugcuaggauugauuuggccuuugaaaggauaauucaagaugaauaugcuggcguccgacuggagugagauggagagauuauugaguguugaaccugcuuugccgcaucggcugcuuuaugagcucucuggagaaacccuauguuguagauaacucaggccugacgggccaggagcggcguuugucucccacacucuggagugagcaguccgacagggcccagacacccugcucgccccauccaugagccaagaaucagcuuccagccucaucgcggugccaaccauugucccucccauccugcucaucccagccccgucucuugcccuguccugcuccugaauguggaguuggggcgguaguggccagcugguugguuccugcuguggucccuugcuccaggcugccuuggacaguccaggaagagcagaagugagugggcagagccuguggacacaucucuuugguuucuuacaccugucuccccgacgaguagcccagccuggucacuagggacaccaccucugcauauuccuugggauaucagaaaggaucuguagugcagggacuuagugcacuauugggaaacaguacacacagaggcaugaggccagggaagcaaagccccucguggggaccuggaaguucaguucagcucaacucuguccacccuggguguuuguccuaaucagccacugcucccuccaccccugcagccacacaguauucuaggggaccaucaggagacagggaagaguccaaaccacaaacucuuuggaggccgagcccaugucuuugagccuuguuaggugggauggccuguagugugcaccacacugacagugggcaugauggccuuucucccucggaguccccuggggacuuggcaugggguguggcacacagaaagggccaguucuaugggugaugccuuaaguaccugucagcccacaagacauccauccugggcugugacagccuuaggcuggggaagccuuuucuccggaagaggugucuggagagggaaugacgggagacacacagggacagcaggggccuccccacagcgggagucuggagaacagcgccagggugauccugaacagacauugcccugggaguggugcaccagccuucugucaucuuuugcacgauccaugucuccuccaugcuuguacaucuccaugcacgguccaucaccucacaggacagcgcggccaccgcgacuugggcugagaguggcuugcaagcccugugccguguucccacacauuagguccucaucgcaaccccgaaggccacccucacccccacuuuauaaugaggaaaagcuagugacuugugcaaagucagagcguucauuacacaucagcaccaagguuauaguccaaccccuggggugugggcucauguuggcagugcccggcuucuuggaaucugcauuuccaagaaauucuucaguaauguugcuguggcugggccacuuaggaccgcugcccuggccaugcagcuuccuagccuccugaauuggcuccaugagucuggggugaguccuccaucacccgccuggucagcuccuggcagcgccugcccuuugggcagcaugcugggcuuggggacccaccuggucguuucgagaguccccugccugagacaucgccugugucucugaagcucagcuggggcuuaucaucggauagcagaugugugaauuaagagggggcccaugggggaaggcaggcccgggaggcgaggugcugagaugcccagugcaguucgccccugcccggccccgccuuguguguuuacacagagugguggugcagcaguggacauaauuacuccugacggccuucauuaaagacucuggaacaauuuacagucaauuaaggagaaaggaacugucucccucuucaggcgccccaccgccaucugcuuuagagggagcccugcuggagcugugggucaguggaaguggggcuucagggaggaggagaaggaggaagaguggggcuucugaagccagugaacccgcuguccucaagagugaauggucaagccaccggucaccacacucacagugugacgugagaggccaugugccaaggagcaaagugcucugcacccuggcucugcccuaacgcaugcagagaccuggggugguucugucaccucucagagccucagcucucuuaucugucagauggagcuggucaagcauucucugcagaucuguuuugauuguuuagugaaauaauaaauguggccagcacagggccuggcccccaccaggugcucagugaucaggauggcaacuccuguuguaccugggaagccgcaccugccccugccugcacaggugcuuuucagaagcaaaggcucuucauaugucaacaguccuaggucggccucaguccccacucaaucuucagacacaggcaaccagaagauacacgugggagugcuucuuugggccaggccuccacccucagagagccuggguccaagagugaacaaccucuucauuggccuaaaggccaacucaggaaaauuuaaaugcuuaccggcugcauuucccccgucuaaaaugaaaaucgcuucauugaaugccauggggaggggggcguauauuuucacaaccuagauuaccuacuugauugacuagaaaugugucaaugagaaaacugguacugcuucuuagcucccaaaauauaaauaucugagucuauuugagaaauggcaguaaagaggccgcguucugaaauuagaucgggaccauauugagaaagaaggcaggcugcccgggagcccaagggugccugucccugcuccagccugguacccucauuuggugagauggcacaugacaugugacauaugcccaacacagagucuggcacaccaucaaggccaguaaaucccagccuguccgcacccggcugccaagaaguguuuuccuuuccugaaauccaauuauuuucugcccaguccucugcccauuaaaagaguaaugaacaauggguugagggccaccccgcauccccugccauucuuccugcuccagaaggcaccuuucucaggagccccucucuggguccccacagcgcugggagagggagugcucagcagggaucgcugaagggagggugggggaaguuaguauucccuuaccugccaucucuccugccaggguguucuugucuguaaauuaggacagugacucucuuguuaccaagcaucagugggugugaaguucccugggugucugagagccaggacccagagaucaaagacaucuucaugguagaacuucaccuguuuugccugaaauuugucggcugaguuucucauucugugucucuccaucugggcaguguccugccaucaacagaucaaaaccuaggccugcugggguucccuacacuggccacuucuuuguaaggaagguguagauguuuucuacccaauacccaaucccuggaguccccauuagaauauuuucacuaaaucaacaccuauaggacuugcucuccauccauaacuacuauaagcccuuuuaauccuuaugacaaccugugaggaaaguacaauuaucauucccauuuuauagauaggaaaauggaggcaaacagaguugaagugacuuacccaagaucaugcagcuagugaaugggagugggacugggauuugaacuuaggcugucuggcaccagcacccauccuccuaaccaagguguucugcuaccugcuaauaauaauaaugacagaguaauagcagcaccugguuauugagcaccuauaaggugccaggugcuuuauauacauuauugcaucagaucuuuaugauaacccaucauguagauauuuauguccgccucuguguggcagaugaggaaacugaggcucagaaagaacaaugaauuugcccaugaucauagaacuaguuaacaguggagccaagacugaaauccaaggcagccugucugugucucccuaccugcagggauggagaagaugguccagcagucauucccccacugguccugcugcacuuccuggaugcucuggcuccaaggaagaggggucuucugaggcccaccagguaucagugaugaggacuugucucaucuggaagcaauucugcucagccccacuaugcuggagccuggguggaugacuugcugucaguucccaaugaugccaaugucagggugguggggagggggcuggugggagugggagugaguggguagagcaggacagcaggccuccuguggaugacugauuguuggcccagcucauguguucccaugugccucuuacugguggaagcuagaucucuuuaucaguuaaaucaaauacuaaugacaggaaaguaaguucugugaagucuccuuauacucugacacuccuaaguucaaauccagucccccuuucuccuguccuucugacugugucccauagagcucaugagagcugucacuuauggagggccaauuaggugccaggacuauguaugcaugaucucauucaguccucacaacaaccuaggaugaagacacagugauucuaucuccacuuauuucagugugagauacuucaggcaugcagaaaagucuagagcuaauacaguagucauuagccacguguagcucuuuacaugcaaauuaauuacaauuaaauaacguagaguuaacuuucuuacucacacuggccacacugcagguguugggcagccacauguguugagugguuacuguauuaggcauugugauagaaaguguuuccauaauggcagugaagucuguugcacagcgcugguauagaguuguauuuuauaaaagagaaacagacucagcuaccugcccagagugacucagcugggggcaggcagccccugaaggagcuccuguggucuugaccaguguucucaaugccuagcuaucauccccuaucccuaagacaaaggacauucucuagccacgaggcauuugagguacaaagaggcagugugaccuccccagggucgagagacuccucgaguggccuggguaauagaaacggagggcccugagccaucgagugccaccgaguggucuggaucucuggcuaggccagcucagggcaggggggugcccccguggcugauaggcccaccccucaaccagagcagcccugcuggccgugaauuuuuaccgcuguuuaccugacgcuguucaguccaggaaugaaauaacucuccccacagcuacuaugaauucuuugcuucccugggaaaaaaacaacccugugauuggaacauugucugcaguccugucagguagccgcgcugagugacaggugagagaaagcaaacggccgaaagccauuacccucuuacuucaguggaguuggaaaaauagucauaaauuagugccggguacugaacaaggggagaggaagaaaacaccagagaggaaaaauauccucccuagaaagucauaauuuuucuccggagggugggaggaauaggguguuuggaaggugaugucucaaaagagccugugcgucaccccggccugugcugggcggcucuugcugcugcuccccagggacggcuucaacgcaggcaggacauuccggaaaagcaagagagacuuugcuuccucucacccacuccagggccaccccuugcaggggugugcccuguguguguauaggugugugucugagaaagggagagacuguggguguaugugcccgucugugugugugcaugugcacacguguguaugagcaugugaagugugucccuguuugcauguguauacacacauguuagugugccucugcccacauaugugaacguguauaccugcccaugugugugagucccuucccauguauaugagcaugcauguguguauguaccagcucaugugugugugcucaugugugucccugcccgugugugauaguaagaauguguaccugccugugugugugagccccugcccaugugugaguguacaugcaugugcaugugagagugugugagugugccccaccucacggauaugcgugugucccugcugaugugugagugaaagugugugugccuacccacguguguuugucccugcacaugugugcaugugugaguguguccaugcucauguguauaugagagugugugucccuucucacaguguaugugcgaguguaucuuugcuuguguguaugugcauaugugagugcguccuuguccacauuuguguguguguguagguacugauguguuugugggguggugucccgcuuacaaacacaccucugccuucuugcgugguauguguuuaagagugugugacuucaccuuuauuucauacuuugcuucuucuauauauuuguagcaacccacauggaaaaucuccgcccauugacaagacagcaugaggggugugugugugugugugugcacgugcauauaucugugggguugcagacugccuuggagacugcuguucauuauaaggcuggaaucuagggagagcaaaagacagcuugugagccccacagggaugggugugcucuacucaggguugucauuacuuaaaggacauugccucuauuuucuuuguggagccaaagguguuucuccgcagaggaugcuagcaagagcugcaaggaggggcugggcacaaggcagaauggcuccgcgagccccuucagagaccccagagggaagagggaaggaccacccaggaccugggcugcuggguccuaagaccugaaccucaguucaguguauuaacuguacagacauaaacgugugaacuugaacaagaacauuuuguaggugauaauguaugccagugguucucaggcuuccgugugcaugagaauccucuggaaggcuugcugaaacagauggcugggcccgauccucagaguuucugguugagcaggucugaggcgaggccugagaacugguauuucuaagaagcuuccaggcgauggugaugcugcuggucuggggaacccacuuugagaacuacugaugcacaccucugacaaauccuuuaacgcacccccagcaccaccagccugugagguugggugggaggcagugcgccauagugguuaggagcagagaugaagagcacaggagcugacugggggguucaaaucugacucugccgccaccaccugugugccuuuagacaagguucugaaccucucugugccaaggcuuccuuguccaugaaguguggaggaugaucauaucuacuauacagggcugaugugcagaaacuuagugcguguaaaaagcuuagacuagugccuggcaccuaaacagcauuauguguaucggcucauguuauuauccccacugcgcagaggagcaaacugaggucacacuucaaguuaaggcaaagcuagaaugagaacccaggucccaugacucccggccagugccucugcuccccacuucucccacccuggccuccucaauuuugcuuuaugggagcucuggccuacccuagcagaugcuuccugagccuuccuucauggggaaaagugggcagacacuuaauuucuucccucuuagagaggaauugcgggcgaaacaaacccugauggaagcucugagcucugccccagcccacacgcuccuugcuguccaccugugaccuggcccccuguccuccucuguccccaguuccucuagcucugccaguaaagcuccuggcucugccaagcccuggagcugccaaacuugagacuugauggcaggaaagaguaugaaaagacagggucccgcuguggggcccuuaagccaaauccuuaacacuuggacuugagccuggguaauggugagccauggcaggugcuuggacaugauaaaugcagggucuuugaagcauugcucucuuggugucacuccucagcucagaaaccuucaguagcuccuacugcccacacaucaaucccaggcuccuuggcuuaccaggccaggccaucuguacuagcauccaugaugcaugauccuuccagccuguguggaugcuugguccccuaaaaagauugcuaucaucucccacacuuucuaagggccauccuguuguacagcuccagacagcauggccaggcugcacuugcccugcccuguucagcucuggcuucugccaccuuuucccuccuaggugcccuuccacaaaguccucccugaucugucacuggaaauggugucuggcaccucagcuuuugggaacucacgauuccuauacccucccuuuguuuauggugauuuguggcccucuuaacucgaacacuuguuccuaguaaacacgcuccccugcauagucccuguaccccucugccggggcccggcaggagacagggcaggggugaggcaggugccuuacuccacgcacgccucuguuccucaccugcuccaggacacccuccuccucccucccagccuucagcaugugacugcccucaggcuggcucucaggagcugucuuucugccaggcuccuucucugugggccugagggaggcucaguagcucccuuucccuccaagagccccaaagcaggcucaugccucuugcguccuaacacacaacccuccuggacccuguaucucccucuaccacuuucguuccuuuuucagccaagcuccuuuaaagaaaagcaaucuuuauucuauaguguuauugaaguguaauugacauaugauagacugcaccacuuaaaguguauaauggauaaguuucaacauaggcacacgcccuugaaaccaucaccaccauuaagauagcgaacauauccaucacccccagguuuccucaugccccuucaugcccuuccuuuccacuccuccuccuuccccaggcaaccuuggagcugcucccugucacuauauguuaguuugcauucuccagaacuuuacguacauggaauaauacuguauguacucuuuuugucugucuucuuccacuuagcguaauuauuuuggaguccuuuuauauuguguauaaccacaguuuauuccuuuuuaucguugaguuauauuccauuguaaaagcuauaucacaauuucucuuuucacucauugauagacauuuggguuauuuccaguuuuuggcuauuccaaauaaagcuuucgugaacauuugugucccccccuuguuuuuuuugagacagggucuugcuguguugcccaggcuggagugcaguggcacaaucucagcucgcugcaaccuguaccuccuggguucaagagauucuccuaccucagccucccaaguaacuuggaguacaggcgugugcugcaugcccagcuaauuuuuguauuuuuaguagagaugggguuuccacauguuggcgaggcuggucucaaacucuugaccucagguggucugcccgccuuggccucacaaagugcagggauuacaggugugagccaccaugccuggcccauuuguguacuuuguguggacacauguuuuuauuucucuugggaaaauuuuuaggaaugagauugcugaaucauauguauagguuuaauguuuucauuuccuuuuuaaaaauaaaaaaaaauuugugcuauguugcccaggcuggucuccaauuccugggcucaugugauccucccaccucagccuccugaguagcaggaauuacaggcugacacagcugcacccagcauaaguuuaacuuuuuaaggaacugacacgcugguuuucaaagugguuguacccuuucaccuucccacuggcagugggcgggggucccagcugcuccucuugccagcauguggcaugagaggcuuuucuuuuuauugugguaaaauauacauaauguaaaauuuaccauuuuaaccauuucuauguguacaguucaguggcauuaauuacauucacaguguugugcaaccaucaccacugccuguuuccagaaccaacuuacuuguuccaaacagaaauucuguacccauuagauaauaacuucucauucucccuuccuccuacccccuagcaauguccacuaugggacguauuugauuuuuaauuuuacuuuuuuuuuuuugucuugcucuaucacccaggcuggagugcaguagcaccaucacggcccacuucagccucagcauccuaggcucuagcaguccuuccauaucagccuccugaguagcugggacuacaggcaugugccacuacacccagcuaauuuuuuauguuuuguagagauggguggggucuugcuguguugucugggcuggucuaacuccugggcugaagugauccucccgccuuggccucucaaagugcugggauuacaggcaugagccacugugccuggcccuuauuuuuuauuuuagccauucuaauacuuaugugauaguaucucauugucauuuuauuugcauuuuccuaaugauuaaugauguugagcaucuuuucauguacaaauuuauuugccauccauauaucuacuuuggugaaguggcuauucaaaucuuugaccauguuuagaaaaugaguuauucauguucugauaauugaguuuugaggguuccuuauauacagauaaaggacucauauaucugaguccuuuagcagauauaugauuugcaaauauuuucucccagucuguggcuugucuuuucauucucuuggcagugucuuuugaagagcagaaguuuaauuuugcgggucuuucagccaagcucaugcacucgcccacucuugaccgcagucccuggcuuacugcacugccaucugcgcgcagcccggcucuugcucccaccacaacacugacgugguacccacuaaggccagccaguggcucucacucugccgaguucagcaaauguguugcagaugguauaugccugggaccuuucccuggauuugacccugcaggucacucacgaccuggaacuguguuccucagggaccccugcuucucucccaccacugugauugugccuucucugucuccgucucccacucagcagugaugcuucccaggcacgcacccucugcccccuuuaugugcucucuguggugcgauuucccucauauuugcuuuaugaccacccccaagccagugauacccagucuccagcccagccaccuuccuggacuccaguugcguggacccagcugagcccuggaagcugcaccaggagggccagcgccacccccauugacguguccccgugagaacuuuuccccaaacccucccucucuaaccaucccacgccguguuguuucugaccccagggccuuguuccugccauuccugcggccugguacaccugcccuagguuuccuuuccuuuuucuuuuccuucaugcaucucaagccgucucucuucccggaagcuuugcugggauuccauccuugggaucuuuccucuguacucauggccuguaauacagcuuagcauguacacacauccuacguggaaaccaucuguuuauaugcuuauuucccccaauaggugguaauugcuuugagagucaaugugacuucuaauuuguauuuuugucccccacaucuacaggugugccuggaauggaucuggugcucgacagaugauaggugauucaguuucagggcuggaccugggccagucccgagcuuguuuguccucagcuccauucuuggccaccuccagcccugcuccgaguggcggggagcugaccccaugggcugccuuccucaggcucccagaucagcuggcuucugccuggguuuagccaacaggaggcccuggcaggagacuggauggugggaggaagggaggagccaggguguuucuuuccuucucuccucgggugguagcuccaaaguuugugucucuuggcuccuguuaacaccaccuccucccuugucccucccgcaaagggcuggcaguguggcuuucugcugggccucugucugggucaccacaccgcccuguuuggccucuuggcuccucuaucacccgugugaccgauuccccacguuaaauccccucucuucgcagcucuaacagugucuccuucuuucugguuggacccucacucagcccagcugccagggacuguccccucugcuuguacagugcuggcccagcauucacuuguccaggaaaugccugggugaauggcaggcacaugggccaggcuucaacuugcucugcccucgcccuuuggccuugaagguccugccagauacuccacagcgaagcgaggccugagcccuugugcugggguugccaagggaggggucuggagguggcagcaaguggugggagggcagguuggcagugccaaggacuccugugcucugugcauggcccuuuaucuauuaagccugcugagugguagacuccaguguggucccagguggugggaaaauagcaucuuuaauugugcucggaaugagauuaacuucuuaucugacaguuugacaucuuuauuguuauuaauacccgaauaaugcauuguuauuuuuauaaacuccaugguggcaaacauuuuuccuuuauuuggauuaaaaguagguguaucuguuacuuccccucauuacccugggcuggaacucagggucucuggcuggggagcagggacuggggugaagggaagcccaucugccgaguccucucccaaguggcagaggagccaggccccagagcuggucacuuggcaauagcacagucaaggucugggcaaagccuccuggccuccauucccgccugggaaggcaggaugcucccggagucuucccuacuggagaggcgguguucuggaauacagagccuggagacuuuguccuggacuuacucaggggcuguaaauggaaguacagguucuccacagcaucaaguggauggagaaggaagacauaaaaagucaauauaaaugccauggaggaauaccaagggcccucugugcaccuguguguucauucauaaguauuugcugaucaccuacugugugccggauaugauguuacgugcugguauacgauggggcuggcauccagagugccccuuuugggggugagguugaagggaagggcaggauaauaccaaagucaggaucauggcucuugagucaggcugccugggcccaaauccugguauccagaggucccagggcaaguuccucaaccucucugagccucaauuuuucucgucuguaaaauggagauaaaaaaguacuuacuuccaacauucuugggaucaucaaauacaugugaaaacauuugcuacacugccuggggcacagaagaacccaacaauauuauggaugaugauuguagcugcagcucuagacguggggccaggcccuugcaguauggcuacuagagggucaggugagcagugggcaggggugcccacagcuggccccugugagcaucaagcucccuccccagggaccuguugcccacucccaggcccccuggcuccuccacuuacccagucguuagcccagcugacaaggaugauaaugccucugccuuggagagcuggcgccgacgucuuuaucaaagccaauauuaauuuucacuaauuaggagcugccgcuaaugagcgucacagcuaauuuagcucaucuauaaccuaggaauggcacugcucucaugccaggcuccagaguccaggauguuggugcccgcucccucccccaccuccucuccacaaugccagaggcaccagcugccaguacagccuguucccacaugccaccagggccagcuuguucugcagaggguccaguggccuucaccuccagggagcccucaggguggggccaaagggaaaaucccuaaggaaggggucagaguaugugccaaucagcuccaggaguaaguuugaaacaggagguucagucugggaggcuuccuuuuuauuaggguaccaucccugcugaggcuuuggcucugucaguucuaaugccucugucgccuccuucaggaagccuucagagaccaccuuagcccacagagaccuuuccccacuuaguagagcucucacuggucaaacauuuggcagcaaacagcguuugccauguugccuucuccugggagacaguggaauacggugcucagaaggugggccuugcauucuggcaacuagcagcuguuagaccugugccucaguuuccucucugguaaaauggagaaaauaacauauugcucauuaggggcacggggugggugagaugagccagugcauugccacgaucguugcuuuuaacuuucccauuguguuucacagguccacaugcaucuucugguagucuuuccuucuuaagagaacuuacuuguccuugcgcuccucugugugcucagcacagacagggguugugcucagagcagacagcaggucaagagccccggcuagcaggccgagcccccagcgcaugccaaguaacuguugaaugaaugaauaaaccuggauucuuacuucuuucugagccuuaguuuccccaucuguaaaauggggccauuggcuuggucaaugucuaagacugcucucaucucuuucauucaagacccuugaugacuucaaguaagaauuuggugaguggauggaugcuggcuucugccucucacuaggaagacgggaauggugacuauuugccccuccaggcccugcagggugccuuccaguucucagauggggacugagaguagcugcuggucagagcuguguaaccuuagugcagggcugcuuuucugggccaguguggcucucuucucaccaccagcacagggaggcauucaccuggcuuagcccucagacacacgacauccgcaggagcugcccaggagcgucccugaccucuccagccugcugggaccucccaagugugagcaucacaguggggagggcgggguaggaagagagaaagcacuugggggauggucuuagacucucugguuuggaguuccuguuccugcuucccuuucuguuuccugugugcagccugagcucuuggcucccgagaggggagggucuaggagggcgguugaggacagcuuuuuugcacuuaucaccucugaaaagcgaccuucaggcugagccaacuuugggggaagagccuucaggcgugacagauuugacuauaaaucuucgguauuaaugcccgguucccaaggucugucauccuguaugcccgcgugacaauugaaaacagugugaggcccaucugucacccgagggguccccguccccugcuggcuuugccugagcagggauggcaggcugggaggcagggguaugaaggaaaagguagggaggaucuggccagugacaggguuggggauugcagccaauagcuggaaugcaggcccugaggggcggaggcuggaaggcagggagcaggccccaguuccaugccuggggucagaagccugcaggcaggugggaagaaugucacccugcaggagccggggccugggguuaucucuggcuccauuucccaucugccauguggccuaggcagguuggcugcccucccugggccucaguuuccacucuucaaagcaaggggguggcugagaugguuucugagguccuuuguccucuggucguucauguggagcccccaccucccuggcagcucccagacauuuggugauugguuugaugggagcugaggauaacuguacagagacacagagcacgcagguggggagggacuauuuaaauagggcaucaacaaugcaaggggaguuuuccuucccccucccaggaaaaguacaggaugcugcaguucauggcugcaucuuucaugcacaugcccccguccccaccccuucaugcagaggaggacugugucuuuguuaucuccucaucuugaaccugguaauagcaagucggcgauuugggagaaucugagacuugugucugaaaggaucuuccaguaucucuagcccaggcuucucacuguauugagaaggaacccagggcccggagaagggaagugacaugcucaaggucacauggcagauggcuggguaggaagccaagaaaggggcaagauguguccccagcuccaauuugcuccugaggauucucuggaaagauuuggggcuggaacagacacuucaaguacaaauggaaaaccacugacuuggccaagaggacagaggaugggagcaccagcagcuuaagagaggguuugucugccccuacuuucaacuuccuauuuguacuuuugauuucaagugugcaauauaucacauagacagaaggguguaucguagaaccuggauauacgaguuaaagaaaacacauguaugauaaaccaaacacauguaugaucucacccuggacauugccaggaacuucaaagcacccccuuuggcgugcuggcuugaccugcucccuccugcucccagccggacacgccuccucucauggcucuuccagagugagaacauuccugagagaaucugggaacagugccuuggcugagaggagcacuggaaauguuagggcuguucuacccuugaccuugaaugagaucccagagggagccacuccucaaucuuugcuucuugagaucugugcagcaucccacaugaccgaccccuaacucuucuccaucuuccuccuuggccuucauccaaggcucacuugggaggucccagcaggguagagaaaccagggacgcuccugggcaguuccugcagauguugugugucugagggcuaagccaggugaaugccucccuuuguuuuuguuuuuguuuuuuugaaauggagucuugcucuaucacccaggcuggagugcauuggcgcgaucucugcuuacugcaaccuccgccucccagguucaagcgauucuccugccucagcuucccgagcagaugggauuacaggcaccugccaccaugcccggcuaauuuuuguauuuuugguagagaugggauuucaccauguuggccaggcuggucucaaacuccugaccucaggugauccaccugccucggccucccaaaguguuaggauuauaggcgugagccaccgcgcccagccccaggcuccucuuugaaucuuccucaggccucugucuucagccccuucccugcucccucuacaauccuuucuucuggaccucaccacucucauggcuucggcugccaugugcaggguccagcuccaaaaaccuccuccagcccauccuguauccugagagcacugaacgagcaugcccugcaucuuacucgagacaucugcaagcaccucagacaccaagucuuucuucucccucucauccaacauucaguucguugccuaagccagagcuuuguaugccaacuuucuuguucuuaaaccaauucacuaagucacuagaucuugcuguuucuacuugugaaaugucgcucacacugccugucccuuucucucucugcugggcucuuauuaucccggcuuaggcaggacugguaaauccccagcacugaugccacauuucuccuaucacgugcccgggccagacaucacuacucuaucaugguacuuuuucucuucuccacacaguaccccaggcagccccuaccaaucuaugagaauuggcacauaagauaaaagugauuugcuauuuauggccuagguuucauaauaaccuuccaacuagucuccuugcuuucagugucuguccacacaaaucugucuucuacaugucugccaaaagaaucuucuaaaaguacaaaagaagccagguuauccuucuauuuuaaaguccuuucauagcucucuuuugccaacaggauagaauaaaagcuucuuagccuggcauacauacucugccgagugcucucagcuucucaccgucaucucuuaccacuguaugguugacccccucccuccugcugugccuggagauucacaguucuauugaugcaucaugcaaccuuacaccucagggccuuugcaccugcaguucccucugccuagugcccuccccuuccucagccuccugaugaugccuucucauccuucaagguccuaucuuccugcacugccauggccccuuccccugucacagggaguugucccccucgguucuccuggagcauccugagcagcccugcaugauagagcuugucacugagguucauuugcaauuucugcugcaucugguucauuuuacaucuccaggaucuggugcugguccaggcaaacauggccccagguaguucauuagaugcuguuggggcaggggucuggaucccaugccuccccugcccccucccaucuaucucuggucucuggugcugcucuccuuggcuaagggucaccccaaauucaaugguacauuaguaacuccaguggcuguggaggaaucuaagagcccgucuccaaagccugaaauauauaaaugaaaacauuuucauauuuucuuagagccccuccuuaacaaaugacuuggccaaaaacaaggucuuuucuucuucuuuuuuauaagaauggaaagccugagcaggcaugguuuauuuguccuguuauuuuuuaugucuguucaugggucacauggagacuuuaugcauuuggguugagagaggaagggaguggccauuuaccgaguguccacuucaaggaggggacuuccacguaugguucuucacugaguccucagaacagccuugagaaacuaaauaauuguccccauuauguaagaugaggcucagagagguuaagugcccugaccgggcucacacagcagguaauuaaaggaggcaggauucaaacccagguuuggcugucucccaaacucauauccagacugauuucuuccagacugaucucuaggcugcucaugugaagggggagcgaaggcagagcuaacauuuugggguuuccucaugcucauuucuuaccucuucucucuugucucaggguuccucagggaacccgcaguguggacaccuucaggagguuuuugucuaaggauuugggggcgggugaacugaaucccgcaggaaagcaggagugagaggggaagggacugcggccaaggugagccuguccaucugcaggagccuugcaaggggcagaguggauuuggagagacacaacaggcucucuugagccaggaaggcuuccugcuccugcuaaugccauaaagcccaccauuagggagccauuccuuuggguuuuuauacuuuugauucuucaaaagguaacgugcuccugggaagccucacaucuuacccagguuauugggucaugacuugggugagggucugccccugccaggaaguuagagagcaggggcccggugaggaucaggggcagggaaaccaagcuggggugaugcugggguggggaagggaaggggaggaugccagcagcauacacuccugugggagcagcggagaggcugggaugugugugugcauccauaaggggacuggauuuaggggcucggggagccauaggucagagacauggcugagaugauguuccuguuaguaucaucacaggggcuucacacagucaaggcucacacaaaaugcaaauugggugacucucuggauaccugccugccacgugguaauccagcgauccaccugcuucagucccaugacucugcugcugucucaacauguugccucuagaauccaccguggcacagggaggagggguggagagaagcaccucugcucccccacaccuuagcugggaggugacacaggucauuuccuccuguggcccauuggccagaccuagugcauggccccccugaagugccaggggacuggaaaaugagggguugcucgagauucucagggaguggguggccgggcaggaccugugguguucagucugcagcgcgucugcccacauucccguucuguccuuaccccagucuggcccuaucguuucugcagcaguuuauucaacaagcacuuaagccaggcuguacucugggaggacaguggugagcaggaugcagacacugcuguccgggucggacgggggcuagacuaacaucagccaacccaucucgaaagugaggcccagcacaggcugcucugaaggccugcuggagccugggcuguuggagaggcauugagguggcugcugcauuggagcugagacuugagggacaacuuggaugugaggauggaggaguguuuccagugaggagggcagaggaacaaagguaugaaggcaagauggagcaggaccugcugcacacaucagggauggcguccacgaccugugagccaggagccacugcuggggcuggugaggaaacagauggggucaggauacugagugcagagaaggcuggaggagccaggaugaguguagggagacuggaugggggcggcuguguggucucggcucacacaagaagaaggacaugauggagauggguuauauuuggggguggacucgauagcacuugccaaaggaaugauaugagggagauggaagaaucuaggauggcucccagugucugguuuuuggagcuggacagguagugaugucuuccacggaccccuucggaggaaaauggaaguuccauuuuagacuugcuggcuuuggguauccaaguggauguguugagauggcuuugugaaaaucugcagccugacagccugggaaacuuggggugggguugagguugggaaaggggacuuugagaucccuggggagccccauuucccguugcccagcuguggccuggguggcagccccauuuucauggcuggagggcuggaacuuugcucugcucaugggugcacuggcuuauccugggugucugcagggccccagcacagucaccggcacccugcuaaacagauucauuaaaagggagggaguucccugccuccagagggugcagagcagccaggaugagcgaaggggugaaggcauuaacugggccuucccuggaacaggcagucugcugccagcucacagccacccuugggagucaggaaauggggaaaggagaggugugugaugguggggggaaaggcaggagaccccacauggccccaccaaagagaacaggguuugaggcagugucuaaauggcgccucuucucagggugcacgugagauaagaguggcuggggcccugggugccuuaggcuaggcucaccuuccacaucccuccccuuuugggugucauucagcagauaguguggucaguaccagccucugucuaaaugguggacaaauagguccagguaggaaagcuuuuaagugcuggaagcugggaaauuacuggacguggcaaaugggagcaaaggacuucuuggaucaguuucuccuccacaauuccauccugagccaagcucccaacaucugggggcuuccucuccuucagcucgcagagcuaacccuugagacguggcugcgugugggguccuguggggcagcccugagucucgcacugugugggguccucuugccuacaugggugacugagccccugccagcccacagcagcgggcuuguguggcaucugcuuuaggucagcuuccugcugaguggccaggagagccugggcugcaaaggguggggggagucggggcuggcgugagugugaguccucuucccacccuccccguccagagcaucaggagccugacugaggcccuucgcaaugagggccuggccaagucccugguggcgguccccauucugugauucgccauccccaugaccauagcgggcuuccagguaugaggcccacugccaaagccuucccccaccuuccuuccuccuuucugccuucccucucuuucuuccuugcucccuucgucacuuucuuccucccuccuuuucucccucugucucuuucccuccccuucucuccuuucucccuuugcauuucuuuauucccucuaguauugaacuuccaaaguagaguucccugucauaaaggaccucaggucccagaaucccuugcaggucuaccccuccccaccuaccuggaccccugccccaacaaagauaccucucuaucuucuucuucuuagcauaggacugcuuuaaaguugaugccagaaguuucuugacccuugggaagccuccuguucucuaggccauaguggacaccugagguuggggggacaggccccauaggaaugggagaggcugccuccuccaccccauuggugggggugugccagugcucaggaccaccugugggggcacuggacugcugggcagguggagggguuagggguaucaucaaugcugcugggcugguuuguuucagaucucuugccuccaaaaagaccugggggcacuuagcaggaaaagccgagugcgaauggagacacaggaggauaaaauauuguggcucauccggaggaagcagagggauuagguggugucaggugcccgaguugagcggauuacaacauuuggggcauugcauuuggcccuaaguuuucugacaguuaaauccaagagggagccauccugaaguguuuccaggcaacagaaagcgugcccauuaaucuguagagcaguuuuucucuguggaaguaaaucuccagcaggaauugaucaugugggucuugguacaaaggacauugagaggugcagucaacagcaucuucagcugcaguuuugcagaagauacaaaaaugcuguucaguggcccguccuggcggauggaggcaggggucuaacauuaaaucacaacucagcuggggccugggugccaguaaggcuggggcugggggcuuugccuucugggaagcucccuggaugccaggcuguccuuaggacuuggugacccaccccagcauaacugugcauucacucucacccuuccaggggugacguucaacaugcucacuuaccuauccagcaugggacacccaagcccacaagaggcugguggggaggguugaacuuuuuggggagcaggcccaggcagcggggugggagugccuaggacagcagcucuuuaucaaucugcagaugguguuggacauuuuaacaaccaguguggcuauucuggugauucccagcugggucucaaccccgccccucaucuugcuccucacuuugccagucucucugcccuguucccagccucccucaagaacccaggcgagcaccaucucucuucuuccacucuggcacuuucccccacuagcucccacgugcaagugcgucuuaaucacugcagucaugggaugagggagaagcuccucacccuuuccugggccuucgccguccuaagggcuggucccugggcucagccuuuuaggugcaucagcugauuuaauccuccuaguggccugugugguggaugcaauccuacacccauuuuucagguggggaacugaggcauagagaguuuaagugccaguccugggacuagguaaugcaaaaaucacuguuuugguguacaugcucacacacauuuccuguguuucuguguucacucuccccccacacacauguucacucuccccccacacacaugugccugugcacacacacaugcccccucacaugcacauuuuuacauccuugcugcggagccuucaaaggaggugcugggucuuguccuccagcccgagcgcaccuguggaaaucaugguucugggauccucccaccauuccacaccucccacggccacagcgugcagcuguggucccagggccuguaucuggauguggggggugagggcuugaggcaugguggccccauuacucacaggugggaggacgcgagaacagucgagccgcucuuaaauaucucuccacgucguccucauuaauaacuguaaugccagcaucauuugcucuuaaauagcuucauuuaucaacaagcaauuugccguggcgaggugguagggacgcagauaagcagacagggccaaagugcuugcaagacaccugccaaguaccguccucucucuuccuccaucucccaggggagcaggagaaagaggaggcagcggcaggaaacuuaacaggagguguuccuccaacccagagaggggccgcaggaucaccuuuuuccagacucagaggagcugggcagcacaggacaggcuggcugcuggggaggcuggcacucccugggccccggcguuuguguggcacucagggaaugcucugacagcucuuucagccgcgugcaggacugagagucaggaggucagagcccggcccugcucugccaucuccugguggugaccuugggggugccuuuggaccacccacugugucauuuguaaacauuaucagcaaugcugggcauccucuaucuuguuucugaucucaaaaggacugugucuaaaguuuuuuucauuaagugcaaugccugcuguagguuuuugguauauacauucuguugaguuaaggauguucccuucuauuccuaguuugcugggguuuuauuacaaauagguguugacuuucuccuaugcauugaugucuguaaaauggggacuugaaugagcaacuuacauacaaguucauguacacacuaaagggcugugucauuuaggaguguauuggcugcaaguuacagaaaauuggcuggcagugguguccacaaauagggguguguguuuuucuuucuuuucguuucuuuuuucuuuuuuuuuuuuuuuuuuugugggacggagucuugcucugucacccaggcuggagggcaguggugcgaucucggcuuacggcaaccuccgccucccagguucaagugauucuccugccucagccuccugaguagcugggacuacagguaugugccaccaugcccggcuaauuuuuguauuuuuaguagagacgggguuucaccguguuagccagcauggucucaaucuccugaccucgugauccaccugccucggcuucccaaagugcugggaucacaggagugagccacugcgccuggcuggguguguguuuuucuuauaaaaaguggucugaaaguuggugguugcagaguugguuggcucagggaaugaaugacaccauuagagaccucagcuuuuucugucuuuggccauccguccugcauugaccuuuugugcucaggcugccaugucugcgacauuccaggcaggugcaagggaggaggagcugaaagcucuuuguuugagaggauauucccaccugcucccaagccaacuuccccuuccaucucauuggccagagucagccagggcaggugaggcuguuugacugccccagcccagcaaugauucaugccccgaggcaggagaugguccuaccuccacuggcugucugaacagauuggggcugugugggcagagaagcaguguggggugggaugggcgugguugccagguaggcacaucugccauuguggguggucaugcuggagucccuuacuccagaugggugucauccugcccucagggugcuccaauucuaugacaaagccacauuugaacaggagguuguccaggcgucucagucugagaugcucaugcccagcuggcacuugagaagccacagagaagucugacuuaucuuccugggggacuaauuuuauuugcaaauggauggagaaagaaaaauuuuauauuaaaagaagcaucaauauauuuggaguagaagacagaguuuauguagauuuucaggucagacccacuugacccuaagcuccuggagccacgccuguccugucauuauguagaugucagugacaacuuauugaauggauaaaugggagaauuaagcugcgaagacauuauuaaacacaagacucugaaucaauuucaucuuuggggucugccucuuugggguccuuauuuccagagguacuagucccugucuccucugcaucuagggauguuuugaugugaauuacugaaugaacagguuauuugguggagacucuaggcacucugggauuacagaggaaagggaggcagaagaaugaaugugugaccaucagggaaggcuuccuggagggggugggccuugaacugggaaagaugggaugagaggaggggagcagccuggugcuuuuguagcacaggccagccuagagugggggcaggaggcggggauuaugaggggacacaugacaggggcucgaggggacacaugacaggggcucagcugcaaguaauguggcauaaggugacaucacugucuaccaggguuuccccaaauaucaucuuacaccagaccuccagcagaguaggacagguaucauaguccucauuuucuagaugggaaacggaggcucaggccauagccacaguugcauggucaguagggggcgcagcuggaccugaccuggugugucaaacuccagcgcuguacucuugggcuacucuucauuguccuaggccagggucucuagagacagacugagcuggaaauugcugugcaggaggcuuacgggggugugcaggagugagggagcaggacugggcagagggagaaguggagcugcaaugcagcugcuggaaaggccucagccgacccucuggggagcccuggggaggggcugaucccugcugagcaagagagccaggccuugguaccuucccaccaaucacucauugggcacagacugcccacugggagggacacaacccugggccaggcauaugcucuguaccccuuccccuguuggccucccccaccuccccaaggugcaucuagaaccagcuguuuccccugccuggaauggccuucucugcucucucaccucucaccuccaacucauccuccagguccaaguucacacgucauuuccuuuaucucuaaaaucuacugucagagauauagcaaagugcaagacaguagacuacuacguguguaaaaaagagaaauaaaguguauauaaauauauaugaguguguauauguguauacagaugacccuugagcaauguggggguuaggggugcugaccaccacacagucagaaauccucauauaacuuuugacucccugagaacuuagcccaagccguucagacccguguuguucaagggucagcuguacaugcacauacauacuugcuuacauggacgugacauaagcgugucucuagaaagagacauaagaaacugcaaacagcgguucuugcaaagggcuggauggguaggaggcucuguguuccuuuugaauuuugaauuauguaaauuaauggcauaauaaaauuuaaaugaaucaaauaauuauuaaaaacacaaguuuaaaaagaaucguuaaaucauuuggugggguggggccuaacugcucacuuuucuccguauggcccuuaucaccaugguaaugaaauaauucauggugugguuauuuauuuagaguuuguuuccacccccugguuguaaguggucuugcccaccaugggaaccccaugccuagacacccuggugagccuuggaggauaaccagucaucauccucaggccagcuacuauucucaccucucuccuucucccaccccaugcauaaaaacagccuacuuccuucucauuuuuugcuuauuaaugcucuuuaugaccacuuaugcauccagccuagaggcccuugcauaauauauccacccugugcguacaccaucauugcauacauaauauggcaacaucugcacuccucaggccuuggccccugccccucucuguaccuuucugggaaccucagcuauuguccacuagguaccaacucugugcccuucaaggggccaggcccugggucauagucaggccugcaggagagugggagauggaccaucaacaguuguuuuguguggcugaaucugccagugagcacaggcagcauggagggaaagucaggaggugccuggguggaaguguggaggaaaggcauuuacuaagagaaaggagguaaaagguuuuccagacagaggaacuuuggccuggcaccuucuccugaguacaagaugccguaaauuuggguacagcuccuagagaaaaagaugggaaucuuucugcgcaggagugagggcuaccugccaaucuuggaccugagucacugagauuggcagcagaaccuuuucuagugcugcccuggccacuuuaacaccccuuuuccugguccaucugacuugucaaucauuucaucccuccaaaccgauaguauacccaugauccaucugcugcauucuguucccagccuugauuuguuugacccacucagaguuucuuuaaacaucugauuguuaagacuuaaacauugaaauguuucuugcaaacaugaauuuccaguuuuuguugauugcaccuggcaacaaucagugggaacugagaaagcucccugccuuaaacgggacauaugugcccugcaacucacuacauuguucaccugaacuucuuucuucaucuuuuuuuccuacuuaucccuaguggcauugacuaauuaaauagccugaacaugucuguaucauucuuguucuuaaaagauauuuuugcuuaauauggaauucuagguugccauuuacuuucaguacuuugaaguaccuuucaguacuuucagucuauugacuuugggauccacugugaucauugagaaaucaccuguaaguuuaaauguugguaccuugaagguagucuguuuuucuucuuugguugccuuuaaaauacucuguuuuucuuugguauucugaaguuuuacuaugaccuaucuggguuugaauuucuauuuauuuauccugcuggauuucauuugucuucuuuaaucuauggaguuuuugauuaauucuggaacguucucagccauuaucucuucaaauauugcaucugcuccauucuuugcuucuggaaucucaguuaaauguaaguuagaucauuuauuguauccuccauucuucuuagccuuucuguuguauuuuccaucucuaaccccucuguguggcguucuggguaauuucuucaauuuuaccuuucaauucacuaauucucuuuccagcuaugucuaauccucuacaaagcuaauguguuugaaauucaaaugaucauauuuugauuccuaagggcucuauuugacccuuuaaaaauuuuccuuggucuuuacugguauuugcaagccucucuuuccauuauugaaacacaguaaacauguuuuacauucuaugccugauaauuguaauaucugaacuauuugagggccugauuaugccaucuauuuuuuucuuuagguuuucauucacagugccucggggugugugugugugugugugugugugugugugugugugugugaauuuugacugugagcuacucauuugguugguugagagagugauucuuugagaccugagauaaaggucagaguuccuccagagggaauuuguauuuguuuuucuuaagcacuuaagcucacuacuugucugggacuacuuuaaauuaaauucuucacuuaaggauuuuagauacccaggccgugugaauuugggcugcaaaugcagaugugggccauuaggguuacaaauccuuaagagucacguuccccucucuauucagcaccacgauuucagagaguucauuuucuuuucuuucuuuuuuuuaaagacuggcuuguguggggguaugaauuuauuucuagucacucugacaauaagggggagguucuuuggggugccugcuugagggggguguuuccuauuagaccccuaugcuggguggggcaagauucugccuuaggccuuuucuccucuuuucugggccccggggacuguaauaaugaaaacuuggguuuaccugguucuguaaaugacccagccucucugaguuucuuccuucauuuaguauuugaccugaguauucuugauuuuuuuaucagcucauuuauucauuuaauacguuuaaacacauuuuaucugcuauuuucaguuguuugcaaauuucaaguugauccagguaccuacugcauguuauuagaaucagaaaucaugaccacuuaaacuauggccuauuugagagcaggauuuuuuucuauuuaucuuaugacuuuuguugauucucauuguccaggguugugucuggcacacauacugaagccacaugguagguccuccguaaacguuaauugaguaacaagugccugaguaggugagugaauaaugaguagauuaguugauaaaaugggagaucgucauauuacauaggaggaaauugaggcccaaagaggccaaguaacuuuccaaagcugaacaguaguugauagcugagccagggcuacacgaaugagggucauuagggacagccagggccuggcucagaacaggccacccugauaucuuaugaaugacuugggaaauaauaguaacgacugacacuuauugaacauggacuuauguguuuguuagacacuuuuuaaagcuuuacauguauuaauucucacaacaagcuuguguaguagauacuguuauuauucccauuuuacagaugaggaaacugaggcacagggaggcaaaguaacuuguccaaggucacucagcuuguaaaaguggcagauccaggauugaaacacaagcaaaucuagcugcagagcccacccucccaacugcuguauuaagaggggcugagaucacaccucugcacuccagccuggacaacagagcgagacuccaucgcaaaaaaaauaaaauaaaauaaaaagaggggcuguaaccagucuuggcucccccaccaaccugggugccauuccagguagccgugcaccaaaugcaucgauugggugcuuuaaagucaggcugggagcuccucgcgucaugugaucacagauugagauugauugguggaggucugcccugagacccuccuuccacacacuggcugguggcaugaugggguugggguacuuugauuacuuugcaguguggcugcaucuugcuugaacccccuuagacuucucccccagugcugcugucaguccaguguggcuaacucaucagcucccuccuccugcacaccccaggaaacaucagucaccuugagagacccugagacaugcaggcaagcaaacagacuugcacagccuugggcacacugucgaaauccaacaaaaugcccacagugaccuuagccccagaccuguuuacgagguaagagcuucuguugaaccaagguaguggguguugguuuggccaagguguuuuuggaggagugagcuauuucuucucuuuuugaccucagcagaggccauacucuacgcccuucauuuguaacacaacuaggaguaucacacuuuaauccucugagguuguugagauauucaguacaguuugucagaggaugaggguuucagcaaaguuggcagaugggggagacacacauuggaaaagaugagguaaagaggucuucauagcaacaaaggagagcaggaguuuagccccaaaucugcuccuguuugugggguguccagcagcccucgccugccucuuugagcaauuggagggcacuuggugggucuaaggcccuguucagcucugacguucugcgauucccacuggaaccagaggcgagccuuccccacucgagcacacgcagguccuggugccagcaacccagggaggucacguccagggcuuauugcccuacugcgcugcccagcacagcuucacaguggugccgcacccuggagagaggcaguuuaagagggaggccccagcuagagagagcacagagcccagaguccugccacagucuccaggagugaaauuacucgauguucaggaacagagggcauugaaagccaugggugacaggugucacagguggcacagagguguguaggggccaaucucugggcagccccuuggcuaaauggcaaagggagcucucugcagccuacccucaacuuacccauuccugccuccugcccacccacauuuaccaguuccaugauguggggccugagagcuucuagcucugucuauacuagacuggaaggguagauacuaauuccaauggaaagaggacaucugaggacucuaggaguuuucccucugccuaguuaaaaaccaaacacacccaacuaaagaacauccaucccaauuaggcagaccccagacaggucaggcauugggaaaacugacccuuacucucuucucucugccccucaaacaaagacagcaggacgcuccuugggaugugcuuugcagagauggaauggaguccuugguguggcuuuugacauuacaagaaccacacuccugcaaacacuagaaccaggucacucucauuuuuucauucauccauucauccaucauuuguuuaguagacauugaccacaggccugucugugccaggcacuccucaaggcucuggguauacagcagagaacacaggucagaguuccugccuucagggcgcucacagucacgugagagauguuguccagaggaucgaaggccaguaaggacacagggcggggugugcugcgcuuggagucugccguggggggcucguggccucuuccagauugugggauugauucagcgcuccucuuguguuucccggcuugccccugccacagcuucuuaggcagcaacaaggccaaagaaguggggcaacuugccuaggcuacacagaagggccgagaguggaaccucagcgccugacuccauguccagaagcccaugcuguacagcugugggcacacuacucagcagugcugagccauaguuuccucaucuguuaagagaguguguagcccccagacagcucauugcgugggggaguggugggguuguuggcaggggaaucccagaaucgguggccaggaaaguaugugcauuguguacauauuucaaguuauuaugauuaugaucccaggugcucaggauuuggccugagugaaagcagcucaaacugccccugaccugccacccuuagaagcagagaggcccagguuccccacccaugagguggugacuugcaagcuggcagggauccgggcagaaaucaucuaggcaguguucucagacuccacacucaugcaucccccuccacaacagagauucuguugagaacagcuuguuuuuccuuaacucauuugcucaucuguccgucuguccauccauccauccaucuacucaccccaagaagagacaugccugagguaagaacagccagaaaagccccuggcccagcauuuccccaguuauuauuucccauuccacuggcauccuuugagaggcucucggaauaaagggcuuccugaacaaauagauguggggaaggcuguauuuucuuuaccaccuuguggagcuucacagcacacguuacuguaauaaaggcucugagagauccugcaggaaagaaaccuguucagauuuuuuuucuaaugcaauguucccuagaucuuuuggaccaaggaacguuuuuucacagagcacccguuagccugccagggaauuaaugauucgcgaaauacacuuugggaagcauuccuuuacacacaaaauccuuuuuuuuaauuauaauagcgugcauagaauauucauaagaucucuuauauaccuaccugccuucuuauauagggaugacucaucauucagcacuuccuuggccugugguugaacauaucaccaugaauagcaaucuaugaugaugcuuugucauuuacaagagcuagugaagggacucaaauuauuuuaguuuucauuuuucggagaauuuuuugccuuucccuuuugugagcagcagaagcuguuguucauuugcuuccuauuauuguccaugcaccugcuugggauuaccauaaaucgcaagcagcaaagugccaagcucaucauaacuguguguaaaguacaagucaacaggcucugagugaggacuuggcccuaucucucauuucuguaaugagcuugaaauuuagugcauguauuuugugccauggcuuuuaccugcucaaaggccuuuggggcuaauuuccugcuuuuugucuaugucuuggauaacuggguguguaggaugugacuccagcagagggaaggccuucugugaaucaucuggggcugguacuggauaagaacauuguauauggggucaggcaguccugaaucuuaaauccuggcucuaccucuuccuagcugugugaucuucggcaaguugcuaaaccucucugugacucagucuccucauuggagugcgggaauaccuuccucacguguuugugguaaauauugaaugagguugugugugcaaagugcuuaacagagugucucccauacgguagaugcucaauaaauaguggcaaggccgggacugcggugaagcaagcuggcccccagggcacagaaauucaggagacauucucagacuugugcaaguacaggggcaggaccuaagcgugagugccuccugggugccugacuugccucaugcuaguuuccacccugucuagcuggguccugcuaccccggcacccauaacccccaguugaucucagagacugaguaccuggaaggccucugguaggaugagagagacccagcccugccccuguaacugccugcccaccugaaagcaggugagccccaugagaugaauaaaggguguguacccagggggagaggaauggagaaugagcccagugaaaagccugaaggcgcuugcucaccuggggccuucggagggugggaaccaccacggagccccagcccugccccugagugggggcagggccucugccaacugggcuggacccccacuucccugucaaaacuuuuaaaaacacaaacagaggcaagaacggcauuugcauaaaucucauuagaaaaagugcaaguuucauaaaucuugugauaaauuagugcgauaucauucucaacgugauguauuaauuuuagggcaaaaugaauggugcugugaucauuguggguaauuacgagucuccucaaagaggaagugauuucuggagggacuuuucugaccuccuucgcggcaggagggugggaggagggcagggcagaagggagguugucuugcucaccugcuuuuaugauugcgccuuucuucauuucuuuuccugcuauugaaaggugaagacaagcuggguugggucucuggcuaagggguggacagcagggguacaggaggugauggaauuuugaaaucaggccuugagucccaaauuccccagagccaaauuauuuuagaaaagaaucuuaagccgggcacgguggcucacgccuguaaucccagcacuuugggaggcuggggugggaggauugcuugagcccaggaguuugaacccagccugggcaacacaacaagaccucaucucuauuaaaaaaaaaaauuguaaaauuagccaggugcaguggcgcacuuguaguccuagcuacuugggaggcugagacaggaggaucacuugagcccaggaguuaugauugugccacugcaccagcccaggugacagagguuuuggaaaaaaaaaaaaagaaagaaagaaagaaagaaggaaagaaagaaaagaaaaaucuuaaauuucuaggaccuggacucauggaaacucuaacuuagggguucucaaaaauguggucucagacaggcagcauuaguggcaauugggagcuuguuagaaaugcauauucagaaccugaaagucugggaggggcccauaaaucuguuuuuaauagcucucuugguaguucugaugcacacucaaguuugagaaucacugcucuaaccgggugguucuuaacuuggcuguacgugggaaucauuugaggauuuauaucagaauacugcugucuggguccugcacuagaccaauuaauuaagacagaauccuuagugguuggggccugggcauccuuauuuuuagaagcucuccaggugaugcuaauaugaaaucagguugagaugcauggccucaaagccauuaauuaacaucuuuuuaauauugggauuggaaaauuuugaacaugggaaguggcaacaaagcaaaacauuuuuuuuuuuuuugcuccaccuguggauuggccuaagcugaaugugccuggggugcccccauuguagcuggguuccacauggguaagcacauggagaacuggaagaggcucagggaagcuggccucccuggaggagugauucccauucuugccugcccaguacaucaccuggcgauuuagaacuuuccaaagcccaagcuggccccuaggccagcuagucacaacguugggagugugggaugcagacaccaguauugcucgaaagcuccagcugauuccagugugcugacaagugugggaacugcugaccucuagguuuuccuccaucacaguuucucagauauguccugaagauugaaggaaccucagaaaucaucaagacccuggauaucaacuccacagcccauuggaaucacucgagugguucagcuuguucuuaaaucccgaugcuugagucccucccuggagauccugauguauguggucugguguacagauggacaguugggaugucaaaagggcuacaggugauucuaagcugcagccagggcugaaaugacccuuuguugcacugggacagaggcccaagacggaagggaugccccggagauggcagccucguaguggagagucauccuccagccaggccacugcuguucccccacggucacauucaggggacugugaggauggguucacgagugcagccucauucuugagcuauggggagggugacuggugacuucucccuguagcuuagggcagaaggggacaucaggaucacuucugagaaggaaggaaccagcaugugccugcaaguguuuggauaaucucuuugugagccuuuaauggccugcagugcucuguuuauuuuaaugauaaugucaaguucaauuugccgucauuuuucaacauuuccuuuuguaaaguuaauugaacaauucaaugaauugaaaaguuucaggagaggggaaaaaaaacacacccaccccacuguuaucacuguuauuaaaucugguaacuaccucuuggcucuccaagcccugagacaagacuucaacccucaugggccugggagcugccgcaaggauucaggaaggucaaacagaacauuccagggccccuuuauucauggcuguuucaugcucaggcugcuauuucagggcagaaaaaaaaaauauccagucugccauggacccuggcugcuggcucugcgguagcucauuccccaaguguccaaaccagauuguaaacccuugggagccggguugggucuucucugccugucuauccuccgcugcggagcgccuuccuuguacacaguauguggaaaacagagccuuaauaucguagauaucuaaacuggaagggaccuuaauguggugugguggaaagaacagcguauggggaguccagggaccaauuugagaggcagcuccuccaccugcuagcuguugagcugguugacuguggacuugucaccgggccacccagcccuguuuucuccuuuguaaaaugagcuuguuggccauaucaagaaugcaaauauucggccaaguagagcuacucccuccccugugugcaucgugugucacuggcagaucacacacuucuuccuacugaccucagaugcaaccucacacuccccagcacgacacccacaaaaccaugacccggagguuggagugggcacaugaaacuugacccauuugccaagauuguuuucaguucuccucguggaccucugcacuuuggccauugaugccagccccuucguagugucaguggggaaggagaagcucagagacagcagcgauuugcccauggucacacagcuaguccuggcugagugugaaccagggccagccacaucaguucuaggcccggcugauucucucagccuuaaaggcagggacuucucuaaggcugccuugcucccaaagcuucuccugugcccuuugagccuguguuccaaguccucaaccuccuguccuuggacucccuggaaugcucguccugagggucacauucgggccaggugaagggcagggaugcaguucuucaugccuacaguuugcaaacagcugccaguccauccugaacuuccccagggucccggggaaaggccaggagaagugugcagugugauagauauguaggucugcccgcuggacugucagcugcaggagggcagguucuucuggcugcaguguuuguuuuaucaucagugccuacagcaguaccagggacagcaggugcccaggcaguguuugcugagggaaucaguggaggaugucaacaggagggucacugagcaaucccagcucugccuugugcuagcugugugacuuuaggcaaguaacuugaccucucugugaugcauuggguuguaggggaauagagcacauaggugccuaugacugguccucgcagcccucagcaaaugaugguccuuauuugcuaugucagaggcagaggagcuccggguuucuaagagucagggccaggucccugaaguauugguauucaaugucugaucuuuccucuggggcauauuaauuuuuaaaaaaugugugugugaagggaaggaaaucaggauaucaaagggauagcugccucccaugcuuauugcggcacuauuugcaauagccaagauauggaaucaaccuaaguguccgucaaugauaaauggauaaagaaaugugguauauauacacaauggaauacuauucagcuauaaaaaggaaauccuaucauuugcagccacauagauggaauugaagaucaucauguuaagugaaauaagccaggcacagaaagacaaaugucgcauguucucagucacgugugggagcuuaaaaaguggaucucauggaaguagaguguggaaugaugguuaccaguggcuggggagagagugaaagaggggaugguugaugaguaaaaaaauauaguuagcucacaccuauaaucccagcacuuugggaggcugaggcaggcagaucaccugaggucaggaguucaagaucaaccugaccaacauggcaaaacccuaucucuacuaaaaauacaaaaauuagccacgcauaguggcacaugcuuguaauccgagcuacuugggaggcugaggcaagagaacugcuugaacccaugagguggagguugcagugagcugauaucaugccauugcacuccagccuaggcaacaagagugaaauuccagccaggugccguggcucacgccuguaaucccagcacuuugggaggcggaggcagguggaucacuugagguagggaguuugagaucagccugaccaacauggagaaaccucgucucuacuaaaaauacaaaaucagcugagcaugguggugcaugccuguaaucccagcuacuugggaggcugaggcaggagaaucgcuugaccccacgacgcagagguugcagugagcugagaucaugccauugcacuccagccugagcaacaagagugaaauucugucucaaaaacaaacaaaacaaauaaacaaaaacuagccaggugugguggcacccgcuuguaaucccagcuacucgggaggcugaggcaggagaaucgcuugagccugggagguagagguugcagugagcugaaagagagcaccacugcccuucagccugggugacagagcgagacuccaucucaaaaaaaaaaaaaaaaaaaaggauagugcuguguagcacaauaggguggcuauaguuagcaauaauuuauuguauauuuuaaaagagcuagaagagaagaucugaaguguucucaacacaaagaaaugauaaguguuugaggugauggauauccuaaauacugugauccgaucauuacacauuguguauguaucaaaauaucacagguaccccguaaauauguacaauuauuauguaucaauaaaauaaauacauuuuaaaaaauauaugugccuguguguacuucacuuauuccuccucuucccugcccccagagccucuggguuugugucguccggcucuguuuagugccuccuucuucccuggauuagccuguccccaucagugcagacaccuguguggccaggugagcccgcagccccuucucugacucucaggagggaauggccgucuugcugguagcaauaaguagacugaggaaagccagggugcuagaggggagcccauccccaccaagucucugccucagggcugcucaccuucagaccaggguccaccuggaggccgcccccaugggguuaguugcuuuggggugagaagaaggcuguauucaggagcugaguuuuggauuuggauaaaaggcuuugugauaaaaaccaugaggguuguggaaugagaaagacuuggguuggacuccuggcuugcugaccuuggguaggucacuuuaccccucugagccuguuuucuuuucuuuucuuuucuuuucuuuucuuuucuuuucuuuucuuuucuuuucuuuucucuuuccuuuccuuucuuuucuuuucuuccuuucuuucuuucuuuuuuuguuuuguuuguuuuguuuugagacagagucucgcucuguccuccaggcuggagugcaguggcaugaucuuggcucacugugaccucugccuccugggcucuagcaauucuccugccucagccucgaguagcugggauuacaggccugugacaccacccccagcuaacuuuuguauuuuuaguagagacgggguuuaaccauguuggccaggcuggucuugaacuccugaccugaagugauccacccaccuuggccucccaaagugcugggauuacaaggcgugaggcacugcaccuggccugagccucaguuuuccuaccuguauaacagggaugcuaaccccucuguguaaggccauuaggagaaauaagugacagaguaaaugaaugaaaaccauugagugugguaccuggcaaagagucaugcccaggaaacagaaugcugguuuccuuucccccugacaguucaugccguccccuccaaguggacggaguugcaggagagcacaggagugaagcuggccugugggcuuugaagguagagaugguuccuuugacccaggucaaggguuuucugaugacagugagggcgucgaucagugaagggugagccuagaggccgccugccucucaggagagaaccggccagugucagagcucacucuacucccucugacuucccccagguggagauauuggugaagccuaagaugaagaaaagagcuccccugaggucaaaccaaguucaggacccagggcauuugagagacugaaggcagaagggugggaggugggaccuaagacaaaugagauuauccccaggaaucaaggcacuuaacuggccugucugaucccagaggagagacaaaugagauggcaggcuccaaggccagcucaggcucuggggagcccaucccagggagagugggagggcaggagccccuggcccuggcagggacccggccagccaggaggaggaggguggguuucccuucuugcaggugggggugugcagcaggcuugauggccauggugggacaguuggagugaggaguaguuauucucagaaaacccuggccauacccguggccuuggaauuugaggcuggggcccugcuguuugcaacuccuuggcucagcuacucacacaugcauagcucuaucccaggcggcccucucccggccaggacccuugcuucccucucugcaaaaugagaagggggcuuugucuguuugguucucacuucagcgauaacuagucccugcuucugagcuagccugcagacaccaaggcugguucugucucucuaacagcccugagccuggcagaggcagaccacuagguucuuggccccuagauggggaaggacaguagaucacagcuggugugaaguccuuuuaggucacagguugcaaaagccuugcuuucuugugccuuuuaggauugauuaugguggcugcauggaacccuguauugugaaggauucugaaguugaaugcagauucacugggaaaaggugcugugauugauuaauaaggucugugugggcaagagcugggacuggcuagcucccuggcccuagaaaagcaguaguuaaucaugagggauggggaagaggagaaggaagauuugccaagcgugucccagaauaucaacuucuaccuucaaggggugauggccucuugccugcugugcagaggugcaaacaaugaauccaugcaggggccugguaugcuuucgggugacagcagucuggcaggccgggcccaggggugcagagggaaaugugcauggccagggagguugaggaugcauugggaagcacuagacaucaugguaaggaauucguuuucauucucugggaacuaagcaggcguuugagcagaguguggcacaauggaaggugugcuuuaaggagaugcugcugcaaggagggagcaggguauguucucacaccgcuuauucaccccuccguguuuugguaacaaauauugcuuucauccuucucucaucuagagaaaauaaaaagcccugcagccugugcugcccugccagaguuucuggcccgccccucaucuagcagguacugcucuccaggagccgcaugaccacaauccccaaucccagcccuugccccucagugcaaauaacaacaauaagaguaauaacagucaucucagcgaucagcaugggcccaguggggccucaggggaagcugugauuguccaccccuugccuggaaggcagauguggacugcugcugagggccgaggccacgguggaggaugugccaccagcuuugcaacucccaaggggccuuagcagucuggugggcagauuccuaccuccuaccuccaagaugggguacacagcccccaggaugggguacagggccgguuccucagagacuggacccccagucauugcacagcugugauuccugccugggcccaaagacaagugcuacugauuuggguguuauuagguuuugaucagcuauccuuuccccuguccauuugugcacacaguuaagaauuaacuugcuauacucucucuucccguuguggcucagagaccuucaugacuuuggggggcugucuuuuccuaacaccucugggcaguuguuagcaggauucauuuauuuacccaaugacuauuuauugagugccuccaggaugucaaucccuguguuaggcuuagggauaugacaaggaauaggcaggucaggcugaaugugcugcgugaugggcaggggguugggguagguggucagcaagucaagugaauaagcagauccuuucagagagagaggacugugaagacaauaacguggagucuuaggacacugaguaaccaggcgucucuuuagcuagacucugcugauugagaauuugaggaaggccuccccaacgugcuaacucgccacccgagaggugaauaaugaggaagcugccguagagguggagugaccuaggguaggaaccuucccagccaaaggcacaaucagggcgagggucccgaggcagccacaaacuuguccuguucgggaacagaaagaaggcauguggggccagauggggcucagcccagugagccugugagauucagugauggaugucaucuuggaccagaucacuagggccuuagaaauggucaauuuaagguuuuuuuuuuuuaauuuaauuaugguaaaauauacauaacaugaaauuugccaucuuagccauuuuuaaguguauaguuuaguaguguuaagcacauugacacuguugccuaaccgaccuccagaacucuuuuucuguugaaaacugaaacuguagccauugaauaauaguucuccauucugcccuucccgaccccuggcacucaccauucuacuuucugucucuaugaauuggauuacucuagguaccuuauaucagggagaucacauuguacuguauuugucuuucugggacuggcuuauuucacugagcauaauguccucaggguuuauccauauuguagcaugugucagaauuuccuuucuuuuuaaggcugaauaauauuccauuggcuguaucuaccacauuuugauuauccauucaucuguggacagauacuuggaucgcuucccccuucuuggcuauugcaaagaaugcuggcaugaacacagaugcacagugauuaaguucuugaauguucugcuuuccacccaugagguuagacugggcaugguuuggguggcacagaguggaggggcuggccuagcuggaugccccuuccccaugaggguaggagaggccaagugcacagaauccucugccgcacugauugagccaggaguccuaagacugggccuuucagucauccugggacggguggagcuuuucucugcaucuaaaaugggagccauaaaccaggcugacuuacaggcaguacuuacuggucugguuguuuacggccagcguuuuuucugauugguugaugccuguacugugccuguuguuaaauauuugaauaucauccugcuauaaaccagcuacaggacuucuaaccuggcugugugugagcgucuccugcagg[450 bp omitted]uuaggaggguucuaacaugaugaugauagcuaacauuuuuuagcucuaaccaugguagacaaggucauccuuaucuaucaucuuccacaguaacucggcgagcuccgcuuacuggggcauugguucccggcacuucccggcugugcuguguuuaggaggagcagucucugauggccggaaccccucgggagaacacucacaggcgcuggcaguuagaagucaggcugguguguguggaaaugugugugcugagggacagagggcaggguaccaauagcgucugcugcggagacccagccagcucccaucucucuaucauaagagggcauuccagccccugugaauagcaggguauccuccuuaccgcugaaaaaacaccaggccucauccauugcuggugagaauguaaaauaauacagccaccauggagaacacuuuggcaguuccucaauaauuuaaacauagaauuacuguauguuccagcaauugugcuccuaaguauacauccaaaauaauuaaaaacagauguucaaacaaaaacuuguacauaaauguucauagcggcauuauuuccaauagucaacagaugggaacaacauaaauagcugucaacugaucaaugaaugaacaaaauguguuacauucacacaagggaauauuauucagcuguuaaaaaggagugaaguacugauacaugcuacaacaugaaugaaccaugaaaacauuuggcuaagugaaagaggucaggcacaaaaggccacauacuguauuauuucauucauauaaaauaucuaggauaggcgaauccauagaaacagaaaauggauucgugguugccagggcuggggaagggauucauggggagugacugguucaugggcauggaguuuccuuuggaaaggaugaaaaucguguggaauuaguggugaugguugcacagcaucgugaauguacuaaaugccacugaauuguguacuuuaaaugguugaagagguaaauugcaugugauguguauuuuaccacaaauuuuuacaaaaggaacuccagauauccuucagcccugagaugcaagguauauuguuucucaggugggaagcaaaccuguguggcauguguaccccagggucccccagccagagaugguucuccugcauggcuguaacuaagaacacugggcuggagcugaaccccagagacuggccucacuccuguaggaauagcacaaccauagguugcuggaaaccuccccugguggagaaacaagccuugcuucccggagaagccagggcugggcccagcuucuguagagaggcagagcagcgcugggcggaggaguaugugcccagcuggaaaauugcagggcgucuugucuuaaauauaauauuaaaucggcaccuuuaauuaguacacuuagaaaaggucacuagcaauuaccugggacacaaagaaggcaugagcaggcaagagcccaugaagaagcugaaaaggaccauuuugagcagcacauaauugaggggaaaauggauaaaaguccgggaaauuacagggugggugacagcagcugauggccccaucccuguccugcccagcgccccccuucuugggaggaccugagcgucaagccugagagagccauuugggauauugggcccaguugugcaaccuuggcuggaaggccaggguggucuucccagaauccucuuggccagcugggagcuuggccccagauccuccaccugggcugggcccugagguacagcaggugaggauugcgguccagggggcugcaggcugccauggacucauuguugcaccuggacaagcaaggcgcuuaugggccucaguuuccccaucuggaaucugcccaaggcuuugggagguaacucaguguuucccaaacuuugccacuagagauuaccugagagcaauggaaaagaaauguauacuccuagaagucaggggaggcuagaaauucauuuauggcuuuagauuauaucuuuacaaauaaauuaaacauaaauaaauuaggccggacaugguggcucgcaccuguaaucccagcacuuugguaggccgaggugggcagaucacuuggggucaggaguucaauaucaggcuggccaacaugaugaaaccccaucucuacuaaaacuacgaaaaauuagcugggcaugguggcugaugccuguaaucccagcuacuggggaggcugaggcaggagaagcacuugaaccugcgagguggagguugcagugagcugagaucaugccacuugcacuccagccugggugacagagcgagacccugccacccaaaaaauaauuaauuaaucaaucaaaugcugcucccaaugucuuccuguucguuuuaguauaaaacauuuauuugucaccgggcaaugcaaacgcuuuggaaagaugugcuugguuuaucugugacuuucacauacuuccucuuacaccgucuagaaagagcaaugaacugggaaucugggagucuggaaacuuggguuugaacccugccuuuguggcucaccauugugcuuugggcaacuugccaaaugccuucagcuuuuccaacuccgaaaugggaggguugggcucugaagaugucccaggauuuuacuccuccuucucaccuucucccaucaccuuggaugcugccauuuccugcucugcuguucugcuguuugaccuuggagaagcugcuucaccucucugagacucagcuuccuaaucugcaaaauggauagaauaacaacuaccaaacagacuugcugggaggauuuaaugagagaauccacaugaauggaccuugugucuggcauaucauaagagcccagugaauguccaaugucuuccuuuuccagaucuugggcuucuuguuaggaucugauaggucauguccaugaaguccugaaucuugaguuuacauauugaguguugagauaucugugcuguggaaagaaauguaggcucugagccccaaaugccugggauguggauuccagcucugccauuugcugaccaugaggacaugguaaucaccucaucacucuuuguugccuuauccguuaaauggggggaauugcauuauggacugaauuagugcauggaaauagcucagcuuaugccuggcuuaugauuagggcucagaaauguuugcuagcaucaucauguuagaacuguccuaaaaguucuuuucuagauaaaauuccaagaauuuggaauccuuucuuucuaucuagcuugauuuucagagcuauuugguaaaugugagagucaguauuuggggcagguagugucugucucauuuuauaggggaaacugaaaccuggaaauaagugauuugccuuaggccauggcuccgaucuccucaccccuuugagaaucagaggaagacuauagacauugucuucggaaaaugacgcgcuguacacuuaucacauuuuguauacaguucuagugaguuuaaggaccuccugaagcuaaggagaccaaccaucccaguuugccuggggcuuccugguuuuagcacaugugcugggaaaugcuucaguccugggcaaagcagggcaguuagugacccuaccugaaagcuacacaggggagcugugagccccaggagaugaugcccugcacuucuuagggaggguauagaccaggcauccugaagccuaggugcccucaggccagggcuuugcuuccugguaagggaugacaccugccucucaauccccuucuugaggaugggaacuagaccuugucacccaguucuagacuggaguuccuugaggcucagcuacaucuucuuaaccucuguguacuccagugcucaucauaagggcagcaccuggucacucuugaaugaaugccaaaagauuuugcaaaguauucugaauuagagaaggugcuuccauuugcaaaagacagaaguccaacuaaacugacuuaggccaaagaaaagguugcaaggggaauuauuagcucauauagcugagaaguccagaggauggagcuaaugucagcagagcuggugacagacccucagaaagccaucaggaaucugucucuccauacaucauuugccucuguuuuccuuugugugcuucauucucagacaggcucuucuuguguggugccaaagauggcugcccgcagugccaaugagcaacucccaugaaagagagcuccucuuucccaguaguuccagcaaaagucccagggcuggcuuugauuggcuaguuugggucacaugcucaucccugaaccagucaucaugaccagggaaauggcacacucugauuggcuagcgcugacuuauaugcucaucuuggaacauaagacuugaaauauugggggccuguccucaucugagccacuuggagaaggaggucuucaaauuaaaaucagagaaaggggggcaggcagaagucauaagugucuuuuacacacucagaacauggugaguggugguucccugauaccaucaugacacacugugacaaguggaccaggguggaggugggguaccuggaucagagcucccagaugcgccagggccuugugaugaucuguggccugcuggaggauugcugaauggccacucccugcugagaguucagccaccugggcaagguaggaaggcauaaacgugaccucucuuauuuucccucugcucucucccuuggcuacuccagguucuucugugacccaguugcuggcccaagacauggacaaugacccccugguguuuggcgugucuggggaggaggccucucgcuucuuugcaguggagccugacacuggcgugguguggcuccggcagccacuggacagagagguaugacuugcccauaccccugccccaauucucuccuggggacaggaggagacacugggggaaggacggcccgccaucuuuuggcgucuuccucuaagaccccauucugacuccacaguggcaucuuccugccugaaugguauuccucuucaagggccaaugcuggugucuggacuuaggguuggaauggguggcuagaggugucuccaagcaagcagcuacauuggagaggcaagagggacagugacccuguguucaucccuuguagaauggcccuccauggaggguacaagucuaccccuacccccaguaaacauucccccaauauccagagaagcaggaauugacggcaugguagcccuuagcaaguuaagguaaagacgugaacacauccccaacccuuacccucuccuugaguuugaggaaggaaccauagagguguguagugacuugcucagugucacacagcaucuuagaggcagagccaagacuagcacccaagaugcucggcuucugucuuuuauugcucucuuaaagcaaggauccauauuccacaccugcuuccccaacccaaagggcaaugcugguauuuuagggaagccuuugggugccugguuccaggcaagcuccuagggcaauccuggagccccucccgccccauuuagggcccaggacccaggaccucagcaccgccuaacugccccccucccucucucacuuuucuuucagaccaagucagaguucaccguggaguucucugucagcgaccaccagggggugaguguucccuggggcccuggaggcauguuccuggggucacaggauuucuggaccccuaggguggaagaggccagagucagguggcggcgcuaauugcccgccuuucucuugccaggugaucacacggaaggugaacauccagguuggggaugugaaugacaacgcgcccacauuucacaaucagcccuacagcguccgcaucccugagguaggagccacugggguuacccuugaggguaucagagaccugcugcuccccagaccaccaugguguaggugaagagucagguggggagagcagcuguggcucuucugcccagaccucagcccaggugccaacucugagcagguuggcgaacaugcugguacccugggaaucggggcccagccugggguugggaagagcaguugggccgguagguugggagccuugugcuggaggcugagccccacaccuccagcuggagucaauggugggacaagaguugggagaagcagguguugcacccucuuuccuuccacucguauccaaaugugggccugggcagggugggugggcaggccuaaccccagaucuuccugcuuuggccagaaucaggucccuccaggacucagggagcaugcaguucuaggaaggggcuuucccuagccccgcgcucuccaccauggucucccaggccccuguacuguguacucugaguauguuugcaugagugcaugcguguaaaaucaagccauugcugguaauugagaaguacaaauuauugcauuacaaacgguucguuaauaagcuggcugccagcucccgauggcaccaggguucccacugcuugcggccccucuccuggguggcugauggcagucuuauggucuggcaguuagugauucaaagacucugaagugggaggguaaagggcuucucacugggugucccucgggccugcccucgggguuuugggcugggcgguggcagugaaggguugggaugggaacaguggaagguagaacccucuggaaaggcagguuggcaccaugucauuugaguucuaacuccuugauccaaugacugaucagggaguaaaaagcccugagagaauaucgcagucaguucauggaugaggcugggcaugggagagugacuugcccgaggucgcacagcuuuaacuucgagccaccuggcuucuagggcaggcucagccucccucgagggugacgagaucuugcucauacaccccacucccuggccucuguuacugagcugcgagccaacgguccuaugcuggcaccagauggaagagaggacagaugugcagguggggaugcagcggaggcaccaugcacuucgccugccuggggcgggagagaacuggggagcccgcaguccuaaacaugggggcauggugcucugagcuguggccggugugcccagggacugcagcuuggcuccugcucucucucauuuggaagucucccuaauuuaauuaagggucucuacgugccagccugcacuccgggccugggcucagaaaccaagggcacggcucagaguuaaugagccuuggacccauugcucagcugccauccuggcaggcauggcugcccucucuucccucucauggggcagcagggagccgcacuggcaaggagacgaggggucaugucccuccucuccugcccuugggcugggggccagccuuuuccucucuccugcuucaggagaugugacuuccaacacucggcccuguuggaauccccugggauucuccaaaggccugugccuccaaggagagagucucuucaagucauucauucauuuauuuaacaaauauuuauugaaugucugcugugggcuuggcucugagccaggcugucauugugcagagaccugggaggccacaggaauguggaaugacaggaguuagaacuagaggcaagagacccuggguccagccccugcucuguucccagcuugcugaauguguuugggcaugucacuucaccucucugugccauggcccuccuuaucuaauaaaaacaaagggcagguggauaaaguggccugcaugauacccaucugacaaggagaggguaggcugagaggagccagcugcaaaggacacaccguccuuggaggaaggcccacaugguuuaauugcucguguguaaacaucccugguugcuuuaguggccugauacucgaugcccugcuuggggcugcucaguguggccaguggggaugugguaucagcuggacggaggccuggcuacuccugaucugagguaccuugacauugaccagcccuugccugguguggucaccugagcuggaaacuagcugccuggcucugaccacagcugggguacuagcccagagucuacuggccccugccccggaaaugagcccaagcuuuccugcuugcauugaggucacccuggaaaccccaggccccugcccuuuagagugugauucagcagcaaagggcccugcaaaugugaacagggugaggaugcaagccagagaaauggggugagggagcacugcagacccuguuaggugugaaugccagggucugccagggugaucagagaaaucucagcaggcuuccuggaggagguggguuuccagcagagucuggcugagguaagcagugguugcucuugugcuguuucgugggaagagagaaacuggagucaggacaccuggguucuagucugcuggcuucaggcccuacagcuuucaaacuagggaguugaacccagccccuuccagggcugacaucccaugaucagaggaugaaacccagcaggagaagguccuucccauccuucagcaccuuaucguucuuugcaggauggcggagaagcucugguggcugcuuccauccauucaauuccucucuuggccaucucagccaucuagggcccuaauaaugauggagucuguugugugcagaacccaaggauuggcacagggaguaaguuacaggguggcaaauccaggucuaucuaaggaagagcuuccuaauaauaagacugcccacacacacccaugcacacacagucuaugccccugccuugcugagaaugugcugagcuccccaucccuggaguuaugcaagcagaaguaggaggaccacuucucuccagccaucuagcacugcguguuggggaagugaugaaucagagggucccaaacaugccccagcagaauuucccaggggacugguuagaaagcauauucccaaccucugcaauugugaaucaguaggcuggggagagccagcccaggaagcugcauuuuuuacaaacuccucugguaauggugagaacagccaggucuggggagccuuggaggaucccacuagagguuuucugagaggugcugagggguagccaaucuuggaugugaacuuucagccccuccauggcugccuggagacaugacccaccuggacccaaguccucaggccaggaacagcagggagugggaggcgguucaaggcuaggcauugccccgcugccugccucuccuuggcccccacucccucugaaagccucugccggguccagcccccagcucaggagaagcugggcagguguguguuugaguuuguuuguucucguuccccuccugcccaccccacuccccucacuaagcuguucuccauguaauuauccauuuuaucagggugaaaggcccugcaauucacuugucgaaguccuaacgaggcaguguagaugcuuucaaguccauaaagaaaagggaaauccugcuagaauuggcaacuuaauucaccaagccagccucgacagaccucauuaaguccccguguauucauuucaggcuaauggcugucaugcugacugcuguuugauuugcuguaauagacuuuuauggcguuccaauuugcucaaacguguuugccugugucugugcccagaggugcugcuccaguaccuccguuaggggcgcgugcccgccucgcugaccuucagcacugcccccucccugcuccucccagggccacccccucagcccuccagugugccccagggaggugacccuggugcugggguguuuaggcaggaggaugggugugagguuagaagucugguggugccagauggcucacugggucagggaaucuggaggaccugcuggagucucagagguggcuguccuugaaguucugacaaguucagccuccuuagcugggcagucuaggccuuuauccaucuagcaucaaccuaccuuucccaacuuauuuuucgguauucucuucugcuauuccuucauaugaacucuccuaucagccauagagccaauucaauggcaauggauaccugucuguuucucucucucucucucucucucucucucucucucucucacacacacacacacacacacacacgcacacauacacauuguacuuuucuaacuaguacuggaguucagccuaacucaacucugccugucguucaaagcccacaucucaccuaccauguucggaucugcccaauuuuuuuuuuuaaugaacacagcaaacauuuguugaacagcuacugagcaggguccagggauucugagcugacuugggcaugcaggauaggaaaaaaugcuaccauuucccaacugugugacuuuagacaagugacuuaaccucucuggauuucagcuuucuuaucuguaagaugagcaacaauaucugucuugcaggauugcuguagagaauguagcuaggaaaaguccuuagcacagccuguggcuuguaguguauucaguaaaaugcuggugauuaagaccaaggucuuuguccuuggugaaggcaauuuuacuaagagaaagucaaauaagugaaugucuaacuacaucuaaauguauuaaaugccaugguagcuuuguaugugcacaguguauuggaaacaguguggucuguacaugggggcuauuuguuuggggccuuagaggcugaguaggaguuuguuagagaaagagacuauggugucuaugaauaucacucacuuucagggauccuauagcuuauuuucauauauuggaauuucccagaggaaagucaacucugauuuaugauuagagacacugcugaggagggacaguggcuaaguggguguguguccuuugcagguccccacuguuaccucacagaaacaaagccaggcuggaagugagccucugugucccugcccaggucucugugacagguccuguacagauccuugucccauggccucaggugaccagcuugagguggggaugaggcuacuauggggaagggcuggagcuggggugagauccugggagccugagagguggaggguccuugccugagccucagugcuggcugcgaucagggucagagccgaagccacgccuccuggcccugggccccacuaaccugaaccaccucuccaugucccuuaacaaggaugaaagcugcucauucccuguaccuccuuacuagagaugggaaagcagagagaaggguaucccuggaugccauuugucaaugaaaucaaauacauaauuuauuucuauggugacaguaauaauaaaucgauuguuguuguugguuuccugugugcccaacacuguuuucugcaugggaucucagggagcccucaccaccaccuccugggguagccacucuugucauucccauccuacagagacagacacugaaguaggacaguuacauggcaugcccaaagcuagucaaagggauggagccaggauuaggaggcaggccugggguggcacgacuuuuugacauguagcuucacuucuaccugcaaaguagaaauaauuauaccugccuugcaaacaucguagugaggauuaaaguaaaugagaucacucacguagagugcucagcccgggucccaggauaagugcuugcucaggagauggcuguggcuguuguuuguguguucaucccucccgccagacuaagcaaggacugagcuuggucaucugugcauccucagcacccugccccaggccuggcguauggacugugcucagugucuuuugagugaauugggugaauggaauucacaaaugcagacagccaugcggcucccucugccucuugggcggugugaggacaaaaggaacauuuacacaaaguacuuugcucggccagcuggucuaccgaggugagggcuuccuuacugugcaugguccagggcugggugaggagcggugaggccuagcacugagcuggcaagggcacuuucacaugugccuugcacuccacuuuccucccagacacugaaagcaccuugcccucugcuggugcccacuaguuccuggaucucagcccugucauccugugugcuuuggcaugugaggagcccuggagugguggccagacaggguccagagcgugcagagguggauuugguccaagaggccaacuuauuagcacccaccgcagccagcagcagugccccagcuaccuucccacauggcgugccugucagaugcugaaugauuuauaaacugcauccucagguugcagcgagaagcugggggggagaugcgagggggcucccacuggcuugugccugccauggccccugaguugacagcuccacucaugagcgugucaucucccacgccaggagaggcagccccuugacaggccauauuaauuuauaccuuggggccacgggccuuggcggccccucugcaucuauaaccaugcaccuauugaucugggagagggagaccaauaaaucaucgcaggggcucuggacuccugcaggccacagccagaguggguuuuucuggcugagcggcagccccagacgaugucucuauggcccucggcgaccacccugaggugccugcccuuucccuggucuguccccucugucagcacagugacacaugccuggagcccugcucucuugcggcaggcagaugccaucgccugcggcagccaggacagcaagcucugggcugguaguggugaagcgacauaugcuugugggcagagcagcagggcuuucuacacaguccugaggguuguguguguguauguguguguguguguguguucuuauuuaaauaauaucuucuguaucuccuaguguuuucacugucuuucauuuguccucaugacaacucuguaaguuaggggggaauuauucuuuucauuuuauauauaagaaacugaggccaagacaaauucacugacuucuccaaguuccccagagucagauagaccugcagcauguuccauccuguguccugccucccagagggcccuaugaacucguucucaccugccagcaucuuugcauguauuguuuugcaauuugccauggccugcuuuugauuugcaauaaguugcagggcugaggcccugauccaucccuggcugggguaagcgacagggaacucugggccucaugcacaggcuuaggagguccaguggagaaacuguacucagagcucacugcuggcugucugcagugaggaccaccccugcugggcaucaccuuguagcucaggacccagccacggucauagugacaccccuuccuuguggccugcaguguuagugugcugcagaggcaccuccgugauuucggucaucagcugugcacacagcauuguuugugagaagcaggugaugacccccuuccccugcccacacacacacaggcuaaaugccagccugcuccccuugccugcagggaagauucaacauuuucugccaccucuuucugguucuuaggugccaaggagggagucaacagggucccacaaaaccagggcccugagcucagcccagccacacacucagaagcugcuugcuuccuccuccacccaguggggugaagccaaggaccccuggucccucauguccccuguaacaccaccucuuccaugcccauugggggcguggccaaggcugugggcguccuccaccacccacagcaccacgaaagaggacagcgugggagcaggagauggagggagccccccuguaauuauuauuuuguuuuaaugguaauaauguucuuaauuacaucaguuuccucgccgauucuagcugggagucuuugggggcccauauaauucuauugcaaugauugcgggacccucugccaugaauacgaagcagggggacugugcagagcccagcucucaagcauuagggauucuacggcacucaccggaacaccuuuuauugugcccccugcccuuuaaauaaagaaccucuaaauggaaggagaugauagcugccugcuaguucugcugcaguguugggcugucagccucgcacgcugaguccaucugccauuuuucagcuccuuucuuuuaaaugguuuccuugcccccaugguggggccugauggagggaggguacagggucuucugccuguaugccuuuuccuccaggcaguggggcaccccaagugggggcagacuuaggaaaccaagggucuagaaaggccccaccuacagccaagggcagcuuuguaucgugagaaccuguguccaucugugacauggggaccagacuucaacugcauugugauggggcugugcacaugugggcucuaacugcacacugggaggccauaaacaagguguuagccucucugagccucaguuuuuucaucuguaaaauagggauacacugaguugugaaaguuuaaugagagcacguguaugaagcaccacauacauagguuguacuugguaacugauggguauuaccuuuuuucuuuucuuuuucuuuuuucuuuuuuuuuuuuugagacagggucucacucugucacccaggcuggagugcaguggcauggugugaucacagcucacugcagccuuaaccuccuggguucaagugauccuccuacaucagccucccaaguagcugggacuacaggcacauaccaacaugccuagcuaauuuuuguauuuuuuguagggccaccagcauuuuguagagacagggucucaccacgcugcccaggcuggccucaaacuucuggguccaggcagccugccugcugcggcuuccuaaagugcugggaucacaggcaugagcccucucgccugaccugaagaguauuaccacuguuaugaaaagcuuugagaacuucaggaaaguugccuggaaguccgaggagcucgacagauggacucauccccguggacugauuggcugaagucagggcauugguggucaggaaacugacauuccaguggcagucaggaaaugugugggaaacauaaaacaaagacauggcaagggaaaaaaaugaaagagucaucaagaaacagcugguaauaggccuagacuuccacguagacucugugaaaccagcacagggugacccuggaggugacuuaauccagccgcacacucugugggcgagcaacacacugaguaagggucaaggaucugcccagggucaccccgcaauuaguggcaaagcaugggccaucaaagguggcuggggaagauucucaggaacuggcuuccagaaccuaugaaacggagcucagcccugggccagaggcacagcacugcuuucccagguaaggccugaguguccagaacagggcugggaugagggugcuccccucugggcagcuccccaaaccccaugagcaguaggcccggacugccuucuugaugcaggucacagguguccacaggugucugaucagccaccagcacacugcuauuguuuuccuguuucuggggucucuacaguuuuuaucuuggucccuucacuuauccuaacaaguucaaguauuauccaaacagccuggggacaggccuggcagccccugugacauggaggcccaccacacaauaggcuuguuuugaugugugcgcaggcugccugacccaccuuguuuucuaccaggagggggaaaacgagacagagcgagcuuuggguugauggaauuauuauaauuucucugauuccuuagcagccuuuaauuacuuagcaacuuugugguguuggcuggaagcugugagggcugggcucucccucuuuauaauaaccuuaaguggaagccaccuguccaucuauuaaaaagcccgcucuucucuccagaugagauaaugccaccgagagaugucacccggggcauaaucacuagauacaauguaaucguccccacucacugucuucaucauugaucagccagcccaccucccaggcauggggcacugccagccccagggagcccaaugcccacucacguccuugccccggagagucgugggcucaggcugguccccucucccaauccugcucccaagagagggaaauggugugggaggccuuuucccacugaccccuucccaucccugcaccucccagucugagcccacacuucccaccauugcugagacgaacccuccauuucagaaauccaucccauccgugugaggcuuugagccccugguguuccugucauuccuaucccaauaccaaguggucacuuuccugccacccagccuuuguuccugcggugcccuccccugagaugcugccauccaagcccacagcaccaucuuccuuccugccaggagccaaaccugacacuuccuuccucagaaccaucccgugggagaggguaggggagguugguccuuuauccccauucuacagauaagcaagccaagugcuagagaugucagagcacauauccccuucagaagcagcugcugagggccggccccggcucuucacuuaguccucucuccucuggauuuggaggcacaagucucugcuccuuauacccacccauccgagcuucuaaacccgccucccaggugggcccucugccucuugaccuuggcccagccuuuccuuccugggguggccccuggccccccaccugcagacaggggcggucgccugccugugcacaguaagacaagugcagcucaacccugagucuugggcgagucgucucacuuccagggcucagcugcuccucuguaaaugcuuguccugggccuguccacuccaugcugucuggagcuuaaagccucaugccaguggcaugaguuaauuccuagaguauuuuuucugguggcccccacaagcuuacacagguuuuuuuuuuugucuuauuuuuugaggaaacguauuacuuaagcuuacauauggagaagcaaacacucauaaauauucagcuuuaugagugauugcaaagugaaugcauuuguguaacugcacccggaucgagaagcagagccucaccagcaucuagagaucccacugugccccucccugucccucucccuucccuuaaagguagccacuguccuggcuucuaaccccguggcuugcuuuugcccauugucauuuuauuauauccauuccaguggguuucuguuaacauguaagccccugggagcaggcagccagcuuccucuugggggccacuccccacacugguuaggagcaugguauuaggaguaccacagaagaguuugaauccugcucuuaccacuuacaucugugugucacugggaagcuuacugucucugaucaaaugcauguggugcugacacaagguccccacugugcaggugauaugggacaguccgccuauacauugcacgcaccagggggagcuaaccccuguggucauuaccuugagacacucucucccuuguccagggucaucuuucagguggauauggagcugccuaggugcugggauaagaggcuggaugggugaagaggaaucauagggaggugaaugggauggggaaaaaaguuggauagagaggaaggagaagggaaaaaaggagaggggucuuuuccccucauacugucuccuuccauccucaguguaguccuuccaguugguaagaaaggugugauugucuucauguuagagcuggggaaaaaacacccagagagguucagugacuuguccaaggucacacagcuugucucacaucuuacggcucuugucugccccccaaagcaagcccaaaugcauuuaacccuuggaauagacacucaggguuugggguuuuacugcccggcugcugccuuuagaggagccggcccugagaugaaaagguggaagcagggaggguguuugguuaggggagggauucauccaagaugaccuuuauuguguucuagcaccuccagccucccacaaagcuucuguucacaucagcaacccaaucucaguccugcaugggaaaacacaaaaaucuuuaagggcuccuuagcggcuagaacugauuguuuuuuccuuuccuggucaaggcuggggcagggccagggcaaugggagaagaauaauaaauucuucuaaagcauugucuuucuccucaccucccccaaaccaccagaucccucaaacucggggacuaccaaaccuuagaaaaaaauauuccgcccaacacagcccaaaagauggagauggagggaaaugcaauagcagcuauuggggcggaaagcucuaaaugguguggaaguaaugccuaaagugugcuggcgauuacagacauuuccacggagccacacucgggaggcacgggucggagccagcagccggggggaaauaaauaaauaagugagcaagccuuagagaucccguuuaaccguugcugugcagaagggagggauggggcaggucacuggugaggggcaggaggaggguagagaggcucauucauguauucuccauccauccaucuauucauucaaauguauugagucccugggaugugccagggauguugcaaaaaccuuucuguagugcucugaagcugacgaccagaagcccggaaggcuggcggggucucaucccggcccccucuccagccuccccuuaaagauucuuuccccugcucuucuguauuccugcaccuccaccuucuuugugguccccaagggcacuaggccacagggccuuugcacggccuuucuacuucccuggaacacaucacccuccccguuuuucaugaacucccagcuuccccugggaucuuccauuccuaauucaucccuccucccaaugcagaaagauuuuucuguucuugggcuuucagagcagcagagcuucuauagcuuugaccuugagguguaauuacucacauauaugcaggacuauuugaucacuguuagcuucuuacgggugacugugagcucugugaaagcaggggcagggacauguggcuuuccaccguggacggacccucagggccuggcgcacgguggggacucagcggauuuguugcaggaugccgucccugcccucagggagcuuccucccgcuccucuguagcccauauccuuuaagagaggaauuccaugaaccagcccuuggugugcucucuuccaagacccgugcugaagguagcucagaagugcgguucgagcucccugccaggccgugggagaagggcugagucuggccucgucagucaaaggcagcuaggggcaaaaggaggaugccuugcucagggcuacuggaggaaaucgcgucaucuaauggggcuggagugugguaagcagaguaaugcccccuugcccaccaaagauggccacaucagaauuccuggaaccugugacugugugaccccacauggaaaaggggauuuugcgguuaaggaccucucugugaggccucuguaaucaccaggguccuuauaagaagcagguaggagggucagaggagaagacaugacaguggaugcagaggugaguguugggaucugagguuguuauguugcuggcuuugaggauggaggaagaggacaggagccaaagaauguggguguccucuagaaacugaaaaagggaaggaaacagauuucccuuggagccuccagaaggaacgcagcccugcgacaccuguauuuuauuucauuuuauuauuuacuuauuuucugagacagagucuuacucugucacccaggcucuaguauagucucagcucacugcaaccucugccucuuggguucaagugauucugcugccucagcuucccaaguagcugggauuacaggcgugcaccaccaugcccagcuaauuuuuguauuuuuaguagagacuggguuucaccauuuggccaggcuggccuugaacuacugacuucaagugaucugcccaccucggccccccaaagugcugggauuacaggcgugagccacugugcccggccgacaccuggauuuuagcccccugaggcccauguuggacuucugaccuuuagaaccacaaggugauaaaucuguguuguuuuaagccacuacguauguaguaacuuguuacagcagccauaggaaacugacucaaggugcuuuggaggcagagcagugggacauguguucuaaagugcaccccugaagcacccccaggcucuaccugccuugcuucucuguggccuucaggcaggaggauggaagcagguugucugcacaacagugggaagcuggugguuuuugggaacaauccacgagggccagccgugggcagagcauccaggacuagggaggguagcuggcugggaagaggccccauggaagccaguagggguggagugguagaguccaggaacccagagcugccagcugcaggcaggaacccauaccauagguggggagagagggagagauggcagguacggggugcugguggugcuacauccaacaaguggccaccacacugcugggacaccacagaggaggguucagcgggggccugagcauccgugacccuccugggaaaccuggcuucuuggcagcagcccagaaaccagagaaagaggcgucccugcuuggcuugcuacagcagaguggcagaggcaugcuagaguguugcuuccaugugccaaccccacccucauucauucauucaucuacucacucaccaaacauugccugagggccugcugggugccaagcccaugcuuggugcugggaacccaagaggaaugagucccuggccuccagcagauccuggcugaaagccuucacccacagcaacaggaugcaagacccagugcuugaggacccagauagccaccagcaaaagcucggcccucugcaucgcugaggggguggagcaggggguucacccaucccagcuuuggugcuacaagaaagccgggcccugccuugguucccaagucccugguccuccuguggcauguaucaagcacaucuuccucuaggcgguagaauugggucaaaugagcuucagaugagccuagcaaaguggcugucccuguccugucccaccccuacacuugcccccacugcagcauccagcgcucaccuguggcucuccacgugggcccaggaggcaggaagagggacugccuggguccaaggugagcagagggacuucccccguuucugaguuaucugucugcuucucuauuucugaggugggcggaggccccaaaagauggaaaagggcugccugaaguuaggggcaugaaggaggaaggggcagggcacaggccuggcaugggcucagauagaccguucccugcacugaccuccuucuccaguuucugcuuaugccacucguaugacaccugggaccucuuagucucaagcuccaggauucacaaaugauaaaaaauggggucuguaucuuaucauuuccuugaaccucuaaaccccagggguacuggauggaggggaaacgcugaacagcaauaauaauaacgaucauggagacugcaugcgucacucgggugcuuuuuauaaccaaucuauggccaaggcguugggauucucccucuuuuaaaaaugaggaagcuggggcucagagagguuaagucuugcccacgucacagagcagagaugggauguggacucugucagucacucccagcaccccuuaccaugcugcaccucuauugaccaagggcugggcugcagagguguuuaugucucgagugucgggcgcauguggccgggguucucagagaacccagcagaugacagaccauugugagaguggugcugggcucguagggcaggacaccuggacuguggcaccuugcagccuuccugaggucucccaccaccccucucuccagccccaccccagugcccuaggucagcguaggacagagugggguggggaugccagacaccucucucagucuuagagagccaggcugggcagcuuguuccuggagagacagccucccgccccugcacagggcacgcacgcgugcacacaccucaguugccacagccgcccugccuccuucugucccgggugucucccucacgggucagugcccccaagugcuaaaucaugagcaaaucagccacagccagcgggaggccagcaggacacagggagggaaugcugccaucaaggccauuagcacugagcuugccaggucgacgcagcacagcugauuggaagagagcagcccagccuccuccucugggcccuguguguagcccuucaaggugugacgugggacgggacagugugggaugugugugcugucugaucauucacugggcgugcacaguucauggccuggaugcuugguuuugucucccugugagaacaguguccacauggggacagcuucucccaugccuggggugguuuagagguguuccaucuugaauauagcagagaagcaagaccagggcaccaggaguuagccaggccuggguaugaauucugacccugugcaagugauuucgccucucugagccucaguuuuucucaugugaaauggggacgaucacaaacuuuauaaggcuucugcaaugcacaugaagcacuuaggaacaggacuugccugcugcaggggacccuugcaugucacuuccagcauagaagaggagagaucaguuugcguccaccuggacccuuuuggcuggagcagaccucaccucccugguccccauggcuggacugggauguuuccauaugcuugggggccucucaucucaucucucugggccucaguuuacccaucugugcagugggguuaguaacuuugacucuggcuagcuucccggcuggucaguguuauaagaaacacaugagccaaaggguguguaauggcauguaaaccaagagucuaucucuccaggccguggccuggcugaauaaugccaucaugccauggcacuaaaagggucucguagcauuccugugcccagaaagagaagacagggcuacugugacaagaaagaccauccugggguaggugggguaugucacuccaccgccaggccucuugggacuugggucucgguguucucucccuaaagaaggucaugggucaaucaaauucuaacaguuaauguagaggcagggcguauguugguaaacugagguccaggaccucagugcccccucggccuggccagugccuugggacgggucccuucccauaacucacccagagggcugagcagugacugucaggcaggcaggcccgucccuucugcacggcuggccuugcagccggccugcggcagacacagcuuuuuuguuuuugguuaaaaagccucaucggagcguuaugauauuggaaugugaaggguaauugagcugaaagcuauucucuuccugcgaccagcgcgauaggagugauugaggugcccgggccuccgcagcagccugggaauccugaugaaaggucuguggagagauaggggucuauuggcaaggaguagagccaggcccccagaacccuguuccccacccugggggcccaagccugcccugcaacaugcuccccugggacucugagcugccaggcugggccuccgcccaccuggggcagauagccaaagcccccacaugcuggggaugggggagggucucugaugauaggucuuugagcagggggauggggcacugcacuaaaaccagcagaacagguuguuuccuguguccccaagcccccugcucacugcuuugucuuugguuagcacacgucuguuuccccuguucuaugggagggucucucucucucuacuuugagucucucuucccccauguucuacuccaccucugccacuauuuggacaaccccaguguuuucucagccguauuuuaacacacaugugagucagcugagcauuuguuaaaauguggauccugauucaguagcucuggguggggccugagacucuguuuccacuaagcucccaggcgaugccagugcugcugguccuccgaccucacuuugaagacaaagguucuaggaagcagccagggccaugggccaagcaagagugacccagauguucaacacaggacucagcugggagggacccacccaggguggcaacagccaguucuggagcagggccgcccucuggggucaugcacguaguacccggugcagggaggagagcgcuggugagaugcagcccagcacugcucacugcucaggaagcugcguauccuggagcgggguggccuugucuggaggaaggagcaugcuuuucucggcacagaggggccauuuuuucauggagcuuugcacucauaggguaggguccacucugaaggguauguuuuucuaaguugucacaaaagcaccagauggcauguuucugcauaucccuauuccucccuccgucacacacccuuccaaucucagaacaucuagcagaacauggaaaucaaggagaagggaaacuagaguguaucacacucauacuuuaagacugucucucccuuacucgcccccagcuccaccuggcuggguggcucccggccaccugagcccuacaagcccaagaaacaggcccuuuccugccucccaccuccuccuuacccacggaacucagcuggaaggguuaagcuaggacaggccccucucacccagccuggggugggaacaggucugcugcaaggaggagguccuuaaggaaagagacucugacccacccaccccagccugcagcuuaccccucucugagguccacuuguaacucccucuggggcuggauggagacucaggcauuugcacacauacacacauacagacacacacacacacacacacacacacacacacacacucuccccagacucagucucugccuggccgguuauuaauugccaugcgggcugagcugaaugggucccauuaauauaugcuucagcagcuccuaggagcccgggcuggugcugggaugccacagcuuaucucugucagccaggcuuuccuuacacaggacuccacuggcauguaacaagcccuccuugggggcucuggacccgucggccaggcugggugaggagagagaggcccaccuuucccggcucugucuggccagcucaggccuuccucucacccugccggugcccacaguggggccucucagcagccggagucacagucccaggacaggugaauaggccucugcagacugccaagccguucuccacccgccgccuggccugaagcacccccuuuccacucuguguugcucugccaaggaccguggggauugugcugucauucuuguugccuggcuggcauggcaucggggggcaggugugugaggcuaggucucucgaggucuugcaggugagcagagcuaucacauauuucucccucuuucccaagcaccuacaauuccgacagccucucaucucacauguccccaaccaggguuggcauucacagccuucgugaccaucagaagagggaggagucagaacacucaucuccccaaccuucuguccgaccaaugcacagcaucaugugcaguuaauccuuaccgaacaugucccaugggccagaaacugugcucagcacuuucuaggcaucguuucauucuucgaccaccuuggaggaaggcucauucacucuucccaucauguagauaaaaaagcagagacccagaaugugacugcccuggguuacacagcuggccagcagaccucagaauaugcaugauacauagagagccugucugaacaccuugcuuuggcaugaggcucucggcucuguggcaaguucaggcaucucuacaucauaagaaaauuccuccuaugucaagcugguauaggcuucccugccauuugcaccacaugguuccagauuugcugguugggauagggucuaugacaguucaccccuaagaggcugccacgggguugaacccagcccuugggcccagcagcagcagcgugugaaccucugacuagcuuguaacuggcuuaccaggguuuauaaagagcaaagaggccucagagcuguccuucauuugccaagacucccccagcugcggacccuugggcugcauucuagcuuuuugccagugcaaacaaucgguguccccucauucccugcauaaggucauaagcccagcaucaccucuucaugauucugaaccuccauugacacccacaugucucuaaaaauauuguauuuuccaauucuaagaugcccauuugccccuuauuuuaaaauauaugcaguugaaaugugugugaguuagucgcccacagccuuugccugcacaaguaguagcugcacucaccccacuagagugacugcucugugcucauuagccuugggaaagugggcauggcuuacccuucccagcccuaggguagggauggggagccaggcuggguagggagggggagcugagguagcggcugaggaccagagagccuccauggcccaucacugcccuugucuuccuagccauagacaacacccauauuuggcacuuccugugcaggcaggaaguggugacauuuuugacuccuacacauagauugguucugugucacuguggugccucagggucagcuuugaaccaagaucuucuuuauaccuuuggucucugaaugugugauucagagccaaagaggggaacaacagugucagugauuccauucugcucacaaauuugauuuucuaaggaguugaagaguuuggggcuggacuaaacguuucucagucuuguucaaaagacccuuaguccccagggaaacuaccagccagcuccucccaaaaauggggagucccucagagagaccccagagcaaaagguaggaaaagcuguuugggagccaggaaggaggggcugagacuccuccaggggccuaagauggggaagugaguuagcuugaggcaucaggaccuuugcaggaagcccagucagccuucuccuuccccaacaacagccauucccagaagcccuugggcaaggagccucuaauugaugaacuuguuccucuguagcugucacacgucuucaguucauuacagccccaucugccucucacagagacugcucuccgccagccuccuggcugcgucuaagggagagagcgccugcaaccgagcagcugggcucugaggccccgauuaccuuggagaguccaaucaggguaauggcaggcccuucuuuaggagcacugagcgucagggguggaggggagcugguggaacuuggagaggugaguuaacccuuagccuuccagauccagaggcuggggaucugugccagccaggcacaccccacggcagaagcccucccagaggggcccucucugagguccacuuuuaacucccucuggggcuggauggagacucaggcaaccugaccuuuugaguccccagcccugagcuuuccuuauacuaaggccuucugaugaguaggauuaaguuugauguuggcaaguuuucuuuuguuuuuguuuuuuuuuuuuuuuguuuuuuuuuuuuuuuuuuuugagacggaguaucacucugucauccaggcuggagugcaguggcacacucucagcucacugcaaccucuaccuccuagguucaagcgauucuccugcaucagccucccaaguaagugggauuacaggcauccaccaccaugccuggcuaauuuuuuguauuuuuuaauagagacgggguuucaccaugugggccaggcuggucuggaacuccugaccucaagugauccacucgccuugcccucucaaagugcugggauuacaggcgugagccacugcgcccagccgaguauuuuuaauugucugugugugcccagcgcuguaucuggcacugugggugugacacucucccuguguucuggccucugcugggugggacuacgucuuuguagaccauggauugcuggcacugccugccccgaaggcggcuuggagaagcggcauggugagcuccggaaucacaagaccccuugauucucauccuguuucugccaucagucaguugacuuugagugucacuuauuaucuggaccuuggcuuccuugucugcauaaugaggacaggaauaccucccugccaccucacaggguuaggccaugccaugcuguauuuagccuuugauuuuauggguaacaaauucaacaaauacucaaauacucauuggcuucucggauauggaagacacacaaaugaaacaccgcccugccccgcagaagccuguggucuaaugagggagacaaguagaaacccacgcaauugugacccuaggcuggcuggacaccacacacacacacacacacacacacacacacacacacacacacacuggcuggggcugcagaggccagaaggcacuuaguuggggcagccuguuaaaagcguaggugauuagagcuaugugacacaggaugcagcacaucccagucagugguuuggauuuucuccucuuuggcacuggagagguuggagggcuuuggggucagggaaggaugcaguuguagcucugcuuuugggaggggucucugguggcugcagagacgguagaugggguggcagagcaagacgugcaaauaaauauucucucccccagcccgcucucauuaccagcugucuaaaucuauaacucuguucuaggaaagagaucucaucccacuuccuauuucccagcauuauuuuuuccugagguuucaaaaccagcaccuuugaagcucccacuguccccuccucauucccggccagggucugaauuuuaaccauccuauuuucuuuaccgauuuuaugauaaacagcccaguguuuucccacacauuuccuaagugugucaggcugucccucagggcacugcugcaucccuuugcgccgagaugcccaaucuuguccccacccuggauacaugauuguccccagaucccacugguuccuuccagguggccagcauauuuccagcccacccccgauccauaaacuuuggagccaaguguccaucaucucgggcugaaucugggucaggcuggcucauaaacuagcccacggaacaggccccucaacuccaccacagagcaccuguccugauuuuucacaguuuucuugccacucucaugucugggggucuuggcugccccuagcaaccaccacagcgcuaucacugcggagaaaaacuucccaucgcugcggaauccccacagccccauccuugcugcuccccuuacucaagucagucuuuugcuacugauacagaaaugaaauaauucuacuuaaaacucucugaccccuacacuuucuugaaauaccuuucauuccuaaaguucagaagaauccugccagcuugacaagcagacccaucugcauuuuccagcccaguucugccaccacccccuaugucagaaccaacaguuaaacucaugugauagucagagccacuucccugaaauguucgaccccgugacauuuuaagguucuuuccuuugcccugacuucugcuguccaguggcucuguucugagaauggcaguugcugccugugcuggaagauaugacagguuuggacauuggcacagccccaaaguauugcuccaaaccaagaagcaaggcuuguggggaucugugggauucauucuugcucuaaacuccaggcuccuggaggccccuccugguuuggacaggcugagggaagagguccuuccagcugaggaagccagucauuccuggccugaugccugaagagccccugucuuccccucccugugugggcugucaggagagggccccugggggcugggcucacuuugccugugcccuccgcggcucuucagggaagcauggcugacugccugcuccaugcccagucuuuuccauccagacugcucauugcacuuuuuauggcuuggagcuggugguuuauggagcaggagaaagacagcaguaggacugaaggaagggcagacugguugggagcggguggauggugcuuguaaccucuggguaagcccaaagacacuguguaaauuauagccugugucuugcuccgggcccacuuugcauuccugaucaggucuccauguucuaccgggaggagggugagcucugauucccucacacagggcguggccccuccugccuuucccagcccguuccgguggugaggagucuucggaaccaugagcaccacgagucagcaccuccugcaugagccugacuuccaggccuagugggcuuuguggcacuguagaagguuucgcuccacauccuggaaaacgccaaggaaaaugccucauggugaggccacucagggggucugaagaagugggaagaaagcuucauccauagacagacacccucgcaugggcuuucaccauguggagcucugugggauaggacuugaccuguguucugccugguagccaguucugaguguuccccaggccagcggcaacugucccuggcuggcuagcuggaggagauggacccugaugugagccccagggcagggacuugguuaucugccagggcacagcuggagcccacccugucccaugugcccugaggacaugaggguuugagccaggcaaguggcauuacauuuucacugugcuccggcccagaugugcugcauaggcagcucucuccacacgguguugaguugggacacagggaaagugcccauuaccaaaacagacaauaucaggccaagacagacagucagggaaauggccaaggaaaggacacacgcucucggcagaaguccucgaucuccaggccucggggcugguugcccgagaucugcaugggcugggggucagaaggcaagcagaaggugcacgcgccuugcuguggcauggccccugcccucaggaagccugcgcuugcaucgugggaaagggaaccaaacauagaagugagcauggugucauggggacaaggaggcacagggaggguuacuccauggagagcaggcuguaggugcugacaggccucuguggaaggagggcucgaggcacccugaacgguauggcuugauggaggccaaggcaaugaaggggacacauuuagggaguggacagaggagcagaaggaggaaugaguuuggucugacuggggcuagugaggaggaggcugguucaauggagccagagaaggcccugggcaagagggaggggugggcugcgaacaguggaaggaauagacugugagggcuuugaaaggcagguuugcuuuugauguaaugaaaauagugagucacugaagguuuuagagugacggcaugacacaaaugagaguaggcugggaggaggacgaucacgaaaacaggaaaugaguggacaaggcugcugggauuuggguuguagauugaauuuggaauggggcuggagacucacuuuuggguggggcaggguugaagacaguggacaauggaaauccauugcugauauucaacgcauaguccccugucccauccagacccaaacgggucaguaggguaagcuggauaugugaugugauggggaaaggucuucaggagaaggucacaaugaagagaaggggccaggaucccaaguggaggaggugguggaagggacccaucagggugcaguggggucucugggggccaggagaccauggaauacaaagaugcaaguaccugagcugugcuccucuugccaugggagaccucugcuguccugcgagccuugaggacagucuggccuauaaaacuggaaugagaggcagaaccauuuggauauuugauugcgaggcugcucugaaaggcuccauauugccuucgccaccgugcacuggacaggacugccacaggagcuggcgcugacccuccaacugcuccccccagcuccaucuccauuuucccaaccuucaugggcccauggcugagggccugggggugaaagcaagaggcaagugcccacccuuuggggcuggcaaccccuacuccccaagcagaagagcagcuugguucccuaauugaauaauauguggaaauaaugggauuucuccuagaaucaucgguuauguuucggagccaaaucauaacgagaaagucauuagugguaauaaacacagcggagagcccgggacaugauccgucagggaucugacacgguggggagggguagucaucccauuugcauuuucguuugcuagcagaaugucacuagcauuccugccccccucaaaaaagucaagacacuagaaaacacauucauauaagacauuuuucuugguaucacugaugcugaggacagugcagccaggaguagcuuggccucugccaaguggccuuaaaaacuggguguuuuuaagggaauauaaagagccuuucucauuuugauguccaaggagcccagugaugaaggaacaguguguggaccgcaggcuuuugguuucuccuccugccugucccaucaguccaucccaaaaaaaccccagcugaaggcaucucagccauuuaucuggcuuuauccuaggccccaaaucgacagugacaguggcccuugaaggagcccugaguuugggcccacgcuguguuaacugagucaaacaucacuucguuucccucuccugacuguuuuugcgaugaugguguuauuaucaucuuauuucacaaacaaagagacugaggccaagaacugaagccgacuccucccacucacucggcugguauagagcagagcugggauucaagccuaugguucucccacucccucaguagggagcccugcacagaguaaagcugucgguuucccucuaagccucagcagccagcacuguccacaucacugaguccauuuuacagaugggagucacugagauccaaagucaggccaauauguacagcaaggccaggaaaaagauacgcaggucugcauugcuccuggcccuacccgcccccaccaggucuccauggucacguugcucaggaagaacaacuacgaaagugaucaaugaguucauuuccgauacacuagggguugacgaaagcugagaacuucucacagucuccagcauguguuaauaacucgccaccaggucccccagugagggaaaauaugucagccuggugccuggcaguuucuuggcuuauugcauggccaccaucaaccucccagauuccagaggaucaacuaucagaauuggaagggaccuuccagccugucuggccucacucgacguuugggaaaacugaggcccagacgagugaaaugacuuguucuagggcccgugauugcuggagccauuggcccgccccagccaaaagccauuucucuuccugcuucccugucauguccaacauauuuuuuuuucuguuucuccgauuaaucugauuuuagcaaaacgguacaaggcaagugcaucaagacugucugaugcugaggcgaauauacuccagcaaaugacaggcagcuagaacaacugccuuguccauggauacagcgugcaacaaacucgcaggaguuugcaaucauucauaacuguauuuucuuuucugugaaugagugcaucuggguucugaaaguauaccaggugcuuuugccugcccuacucuacuaaauccucaccuguggccagugugggaguucuuaccgcucaguauagaugaggaaaccaaggcuggaggcaguguuuugccaaguucucaugguugguaaagggacagaauaagaaaucaggagacauguguagggacgagagaacaaaagccugaagcccugaaacugcucuccucacuugauuuugacccugggaacauggcucagccuguauccagggaaccuggggaguuuccggugccuugguccuuccaguccagacaugaauccuccucacgcuguggcucugccuagggaacuaccacucccuaguucucuccccacuggugggacaggugugugacaguguccuccagagggcagacaccuggacccauccacgccguagccccuuugcccuuccccugggaaccccagccaggaacccagagugagcacccuggcuuauggugcagccccagccuaggacccucaugccuguccagaccagucccagcccuccuggacccagcccaccuauagccuggcacuccagggcucccuccuggcuccuuccagcaggagaccaagucuuuggaauaaaaaucagaggugucagcuuagugugcagggccaggggaggaccacuugcuuuucucucucucuuucucucucucucuggucuuucuuucucugcuuguggcuuuguuuguuagacgcaugucaagccugaugaacuaaaugaugcaaaacuagagauauaacagcuccuuuuaucucccauuucaaaacccaauuuguuccugcugucuccugagggcugcauugcaaacccagccucucuccuccuuggagaacuaugcauauucaagcccucucccucuccugccuucccacuccacucuacuucuuugcucccuucucucucuuuccucucucccuucucuccauaccuguuucucuuagacucucuaccuucuuucuuucccaucuucucccauuuaccccuuucucugacucucuugaccucucucugucucccuguuucuucucuuucucccucuccugcuugcuccccacccaucuuccccuuucccucuccuugaagacaggcugcauguguuugccuuugucuuguuaaaugguggaagagcaaggaugcucacugguguagcgccuggcagggagcaaguuggcuucagaacacuuucuuugcugccuggacccugguggggagccagggaccucccuuuuaacaggaccccgcuagugugcuggugggggcaguccuggguggaccaugacuuucugcucacuaaggauguggggcauaggccaucucagauguuaagccgucaggcaguaugaucuuccuccgggguagggggauggagcuggagggggccgaggcucacgugcagaccagagugcacaauccuccugggucugcacuagggaacccacccucuuaucagcccagacccuggaccagaaagcagcucauucuccucugccuuucccccucucacuaggcaauuucagcuugacuggguuauucagugcauggugcuaaggcuccugcaggcaugccuguaugggccaguuacuagacuguggucaaggaaugucucacccgccccagccuucccagacucacaacuacuggcccuuggagauugauagaaucguggggucugugacguugcugccugcacaaaccacacgugcuguuggugaugacuuagcuggucucacuaccccaggaagacccccugcuuauuccccccauuucacuucuucccugcucuuuuggacagagaaaggaaaagaaggcucugagauggggcuagagaaggucagcucaggaaggagucuccaccuaccgucucucaguugugccgaccagggccccagcugagaaauuccccagcagcccagcucugugcaaaucccaagugcccaggugacuuccugucccuugggucuuguuggacuggagauggcaggcccugaugggagggcuuauccagcaugacauagccgaucaggcuggagcuaagaccaggacaaggucuucugcuugcugucccugggccagcugcacacuuugggugaaugggucucucucauguuccccaguuuccaccccaaagucugguucuuggaacccagguuccucccacgcaggcccuacccaacuccaucccucugguggucaggagguaaauaaggagagggccccagaucuccugcaagcccagcgucccuugcacaugcugccagagcccugcuccugagcacacaauucucaugcagcugauggccccccuggaaauagacagucaucaggcucuuauggaucuuucaaacccccuucucucccuaauaaucccuccucuggggcgguauugauucccagccgcuggccgccucuugguaugccaaggcccaguuugggguggauaaauagcugugcugucauuuucacgcagcaauuacccgcucugauuccucuccuccuggcccccgcaacagccacacggucaccugccuauugacaacacacucaagccucagccagccgggcagggaaccuauggaccugugagccacagcaaaguuaguaggaacagagacuuuggaaaggcaagucuggggcccuggcccugggcuagagggcaggucccagagcugcaggcugcuaggaggaaacuucuucacucuggacauugaggagcacuguggagagugugcgugcuaucauuugaugggauucaccugugcauguguggcuagagaacuuccggcaggaguuucugcacccagcucccuccuuggguuuucccacuccuggcugcucuggggguuuggaggccaggcuuaguucagucuuacaucagaggucagcaaagauuuucuauaaagggccagagaguaaauguucaaggcuuugcaggccauauggacucuguugcaaccacucaccuuucuugugauacaaaagcagccacagauagcauauaaaagacugaggacaacguguuccaauacaaguuuauagaugcugagauuugaauuuuauauaacuuuuacacaucacaaaauauuauucuucuuuugauuuuuugcuaagcacuuaaaaauguaaaaaucauucuuugcuggugguuucaacaaagacaggcagugggccagauuuggcccacagaccauaguuugcugaccccugauuuauaucuacaaaagacgguaaggacuuuuuuccucuccucauuuuccagauaaggaaacugaggcugugagaggcaguggcuuggucccaugcaggaggaaggcgccuucuaucuagggaucgcucagugugugaagacccucucaggaucuucgauguaguugacuuggagauagaaagguggcguagcuuaguaauuaacagccagguaucugggcaucacagccugggguuggaucccagcucugcucgcuccaugugaccuugggcaaguuacuucuuuucuccagaaccuccuuuuccucauauggagaaugagggagagugggauagaggacaaaagaaucccuaggaucguccagcugggagaauauugauuaaucugugacucugugauuugcagcccucaauccucugucuuuagggucuugcugugcuuaaggauucuuggucacaaggcugccaccuccgauggcaggacucagggccuggccucccugccugcccaacagaugucaguucuccagggcccccucugcccacaagucuuugcccuguacagccucucucugggcuuugcagggaggcugagcucagcaggcgcccaccuaggcaggaggccgagaagauaaggccagccaagaccuggcugcugauaccuggcgugaaauugaaaagcaccagacuccugccuccacagccuggugcccugagggagagaaggcugggaauggugaaugaaacugacccgcccagccagcagggccaggcuccaggcugccacacuucagcucuccccaccccuuccccugggggaggcacaggcugagcggguucuucgaggcucugaacagcaagccccuuuccaggguggcagcgugcagggggcuucugugagccuaggggcuuuagugggccccugguuuugaagugggggacaaccaccaaaaaggggaauuggaugggagugcccuugccuuguggaauuaggccuguccagaggccagcguugcagugcucuaaggucauuguaaugcaaggcuagcaaguccagaacuucucagaacagcccgaaugcacagacuuaugagacgcuguuccuccagggccccauucagcagguguggacaccaaggcccggagagcugagcacccggccccacccaggaguacagggaguuggguggggacccaagugucugauuucuggagcagggcuuucacuucugcagcccaguaugguccagaacuugucacccucauccucaggccuguuguccccgaggaccuccauuauccagagagcacuggaagaaaccuugcuguaguagaccugaggauggggacagcuccccucucuccuuacccucacugucaaagcacccacagaucagaugucugaugguaaugaccucuccagggucuggcccacagcauguuuauuaggguccauaugcagccgaugcuguccaugccgggugaauacaugccaagugauuuccuguucacccaguuccgcauagaugauucugguuauaacagugcaagcuaagagggaggaagucaaccauuuuuuuuccaucagcaaucugaauuuuacaaguccucaugcuucuccuagccacucuagcaagggaaaagguucuuuccauuugacagaugggaaacugaggcccagaugggcacugugauuaccuucaggcucuauagaguucaggggccaggguggagcugaaccucccagcacccucuuaccagccaccccaccccauguggggauguggaggaucccagggcugcugggaccuguugcuucacagugacuugguucucccaaagcugcuaaguacuguagagcagaaugaagugcagcagacggauccuugggccucuuagagagugccccaauuuguaaaacaaagcuugagaaggagaaaaaaaaaagauggaaaaaagcaaauuggaagcaagagcaggcuguauuuuccaucccuucaaccaucagcugcuuuaaagggccagccucguccucguggggcaggauaggauaaggaggcaggccugagcuuuuaaucagaguuauguuagauaaagcuuuuauuauucaccuggcuuuauuauagcucuuuccugagguuagaagcuaauuuuccugguuuuuaccgaacucuggucugcuuggcugccacagaugcaggagagguggacgggaguagcggaaaaaagggagauggggguagaaaucaaaucaaauaaacucuccucauccaguggaccgagagagugggcggaaaacaacucuaauaacaggggaaguuuccagagguggaagcaggcuggugaaaucaggccuaaucagcucuagcagaagggguuccaaucacccccagccucaccagggggagggcagaguggacgaagcuggcgaugggaguaggcugggggcuggacaguggcaggcaaggcaaucagagcccugccagcagagccugccccacgcccgcucccacccucugccuuguguuccagccacaggagugggaaugcuggcagaggguuaaccgguuagugaccgggauggaaaagaggaggagcauaccuacaccaggcccggggccacaggcacguugcccugggacacgcugcacaccccaaauaccccucccacaaucaggcaugaaguagaagccaccaaugccacagacaagacccacgaggcaaagaacuuuggccacagcuaucugggggaagaagauagugcuccguuuucuaacucuccccaccuucaaagggagucggaucauuuucaguugacuucuccgccagucaggagcccaucgaaugauguuccaauuucuugacaguuagagagucauuuuauggcuagauuuagagguuggagguggucuguggcuggggucuggugucugugacuggugcagugugugcccugggguaacccuggggacagagucaguccccgaccccaaccccuggugacaguagcaggaggggaaagccacguccacccuguaaguuacugucgaaggagggauucgcauccacuaaacagccauuaggccagaagcaccagaugcaauagcuugaaagagacagcagugcucaccccagccuuuccuggggguugaucauuuaaucucuuuagcuccugcuacaagagggaaagaagacugcagagaggagaggugauauugagacaggcaccgugcucccaggccacggcaggggagggggaggacagagcagcugucccugccagagaggucaguggccuucggagaaacccauuagaccguucucauccaccgugcguuucauuaaaagugagacaguuugcaccuuccacuuucucgggcugucuucagguugucgucaucaaugagccugcccuguguccccugcaggggcugauuucuguuugcuccauaaggagacccgaugcuuacccccaaagagucuuuugcacuuucaguuagucugauaagcuuuagaugccacauaccaucuuccuauuugcuaucauucauuuauucauucaagaaacaguucuucagggccuacugugugcuaagcacuguucccagagcuggggacgcagccaaacaaaacugauggagucccugcuguuggcaccuuucaucuagugggggagacaagacaaccaacgcauacaucuaugucugcuggugagaagggccacaaagaaaaauaaagcaggcaaguggcuagcgcaggcuuuguggccagggagggccucucugaggacaugugagcagagaccuugagggagugaagcacgcauuaucuuaggggaggugacucuccagguagaggacagagugauugcagaggccacccccaccccccagggagugacgggcaaugccaggaggacaucuggggugguauagacacccgagggaaguaccagggccaaacagaaguaagacugaaagcagaggguuuuggagucuuguguaacccggcuguccaaguuugcccauccaaggauuucuggucuugcagccucauuuccccucugaucugauggccacagcauucucacacccaggacagggaaaucacuguuuuccagcucauauccccucucggugucuugucucaaagccccuccgccucuccagugcuggucauggucuccuuaccaaugccccuucuccauguuuauuucagcaacuguaacucaguccaaagcaucuuccucucuaccuuuagagcuuguggagacauucguaaaagaaacagaggcauuugcucgugcggaaaaauggauuuugaguggcuccucuauaccaggcagagcgauaugaugguaccggagcuacuguggugagcaaggcaguuguggaguuuuaaugcaacgcaagcaauuuuaaggugguguaauaaaugcugugauggaggcagugcagaaugugggcucugggagcccacagaaggggcacccaacccagguucagggaauuagggagggcuuuccagaggaggugauaaacaaguugggacugaaacaugcauaggaguuggccugcguguccacugcaccuagaacacagaacaugccugauauauaguaggugcacggucauuauuaguggaaugaaugaauggggaagaauguuccagacagacagaacagcaugagcaaagauccacagguaccagauucaggcaguggaggagcugggaacuaggacacaggugcaucgcccuuccugucacaccuccugacaugaagaugggcacucugccuucacagaugccuucagacucucuaggugccugucagugugccuccacuucccagcaggggcuaggacacagugcucggugaauauuuguugaaugaaugagagggagagacuucagagcugguauuucccagccaucucauuaaauaggcagaugaggggcaggucaagagacggguggccagggugucauucauucaacagugauguuuuucaguaccuguuuaauacagggcacugggccgggcccuggggacacaguggagagcagacuugggcauggacccaccccaaggagcuuacagucuaguggggagucagauggugaccagagagucaccuaaugucagugggauuggagacccagagaauagccagguaacucugagcaaauacagccaaggacccgauccagacugggggucagagaagccucuggaggaaacaggccugggugagaugugaaggcugaauaggcaagaguugggggugaagaugaggaaaggauucuagcagacggauggcacaggcagcggcuggaggcagcgcaacacccaguucaucugaggaagugcaaggccagagggcuggagggaggcgaggagucagugaagccgagaagggcaaccaggcaggccaggcagcgcagguguggaagggcuucugugguguuuaucuggaggucaacaggaagccacuguggaguuacuggaggacuggaauaggguuguggcgacacgcccagauauguauuucagggcauucauagcgccacgggggaguccacauugcagggccagagaggcuguggagcccagugagccgguccccgcaggggugguggugggugggagggacaggagcaaacugcuccuggaggcagaauugcaaggaagagucugguuucuggcucaguggugggugcagagggaauguauugacauucauggagccggggacacaguuuccagaguuuguucuuaggcgugcugaaucuaugccgucuuugagacuccugcagaggcaucaaguggacgguggcuuguuugggacccagagaggccuccauggagaugggagugucucaacugcuguggccagggcuaagcagccacuuggcgugcuugacuccagccgggaacaggagccggaagagaggccccgugggguagggucagucggaggcuggccgcugcuccuccagccugccuggagccugucagcugcguggugacggaaugcauuucucugcaccggaauagauuugggcucagcaguuggcucuaagugcuuuuugcccugacguucagaaaugagcacuggggcagcgggagggcugggauuggggagggagcccaggggacagggccacagccugcgggggccugcugcacgccugaguaaauacguguuugccacaucacacgcagucaugcgggguggagacagagaggggagagugucuuuguguaugugugugcgugguggaggggggugauggcauauggacuugagcuccuaauccaguggccucagaguacaggaauaucucgagguccaggaggggugcacagagccugacagcugccuccaccgaauacgucuucuuuaucuucauguagaucuuggucagaggcaccagcucuccuccaaguggaagggauuaggggacaggagaagcaacaucagaggugggcugggaagagguaauguagagccccaacuuggggaaccaggaggaaaacacagucccaugugcaugugcagccucccugcaggucucugggugugugaugccaaaccuugccaaggggggcacuguguacacacagagacagagggaaaaaggaaguaguacaguccucaggguaguacuuagugguugucauuuuaucuuuuaggggaacaacuuugguauaauaaagacuucauuuaagaucaguguugagcugccuccuuuauuagacugcaaagccuguccccaugaagaagccacuggcuuugccauacuuaggcaaagccuuccagagaguucuugaaaaaccagcucugagccugacuaggccucuaucuugguucaagagaaaugacuuccugccugcaaucaccauaaccgauagcucaugagacagagacaguaaauaauuguuccacaaguuucaagagcaagcguaauuaguacaguuaacaguguuaggugauuaauugguucauucagcaccauugugaaugaggcagagcguaagcaggggaggggccagagcccccagacacccaaauguggauauggcccacuacugaucagccaggaucugaccccugaaacagcagccaacagcuaaaaggcauucaccuccaagagcuggggcuccuugggccagagcagagggcaggucacugggcagggcccacagaguuugucccauuaguggacauucagggcuggaaagaacuggauuuggcuuccauauuguuucaccuguuugccaaaggucagaaagcuguuguaagugaaugauaagacugaccgauuagcccauauaggaggggagggggcacggaugcauagagucccagccugugggguuggagggacuccagagaggggucaucuacuggaucucuugaccacugagcugaacugcucuggggcaucccugucagaggagacugggcucuauuuuaaaguccuccagggaaagaugcucuaaacagggguaacaagcagcaauucaaaucaugugccaacuccaggccuucgauggaagcugcuuaucagcauguuggguagagaaucccgaggcucagucugggaagagcacugugcuugacuggcacugccugcccugagugcagaacagaggagaggcagccugcgggccauuuucagaucaaaauccaccugggucacucaggcggguuuuacacuuuucuccaagguaguuucuuggggccucacuuacugccccagagaagcgaaaacggucuugacugcaacuucaaggcacuagagggugugagagaugaucaggaaggcagcugcagacccagcuuguggggcggggucggggagguuccuuucuugaccuugugggacuacaaggucccacagaccuugaagcacagagcaggguggagaguugggaccagccugcuggguuuaucuagcuaucccugccuccgccaggauauuaacgggcuucccgcagauggaaacuucucuuuggaaacaggguauugggagcuuuagauuaaggcagagcugagucccaagacuggcccuccucucaggagcuaggaauaaggccuugagcucucuacacuuguuucuccuccuuuacaauggggauaaagccucagggacuguugugagggcugaagaggagaaaguacguaaaacuucuaguacagccuuggucaugggacauaugaauucucccacagauguucugagguuuggggugacacauuaagaccagacugacuauuccagugacuuggcaggcugaggagucggggaucgcuugaggccaagaguuugagaccagccugggcaacauaucaagagcccaucucuguaaaauuaaaauaaacauaagugagcuagauguaguagugugcaccugcagucccagcuacuugggagacugacacaugggaggauuacuuaagcccaggaauuucaggcugcaguaagcugugaucgugccacugcacuuuacccugggcaacagagugagacccugucucaaaaaaaaaaaaaaaaaagaaaaaagaaaaagaaagaaagaaagaaaaggaaaagagaaagaaaaaagacaaggcugccugugggaaacguguugagaaugaacagcugcuucaggcccaaguccaccccagggccccagugcuguuacucuuucccccaccgucccauccucaaggccacugaguguacaccaggcaugcuggauuugcaggugugggggcagcaucaauuaugcugcugacacggggcuugcuaagccugggggaagcucugggaagagaaagaggaguguccugggguggguggaggagggaaggaaaagcagauguagaaaagucuggaagaugcuuccccuccaccaccagagccagcccccaccggcugccuccccuagccaaaaggcaaggcuuccucgcagcagaaaacauauacacauauuugcaagcuacaguacaaacgagcggcaaaccuaaugauucgugauuauuauuugaagggucccacuguuacagauuuauuugucauuucuuguaauaacaccgacaguaaugaauucguuuguauuaaugugagugucacgaggacuuccgucgaaauuccgcauuaauuaacguaccauuaaaacaaagugucgcccaauuaauaucuaacagagguaaggcugccaggguccucuucaucuggguuucauuuguaauucaugguauuagcauccugcuuaaugaacgucauuugcaauuccuaccgcuggucucucccacuuccugggggaaggucagggugcccuaggagcuguugggcccuucacugggcacccccggggccaggaggagaaggagggaggggugggacucuguuucuagguggaaaucgagucuccgcauucuucauuccagaaggggcuuggaaggcccuuggaacuuccugaucgguugguuauccacuucaguuacccagaagauaccuucuugagguucugguagggaagagaaggcuaguuuguuucuuggucaagccugaucuuaacagaugagaccauggccauccuaggaaagccuuccagcagggagcacccaggauucugguuucccucuuuucuuagugucagccugguggucuucucauggucuuugugugacaugagaagacuaucagacugaccccaaggacccucaggaccucuagcugucccugaagccagcaguggagcccagugggccuuggucuccgagacacaauagaccaaggaauuggacccucugcccuguuccucccacaaccccugcggcagggcccaccucccccagcagggacagaggcaccaucauccagccuuuagagcucucaggaccccauccugggacagcuccugaagacaacauagccgggcacccuccccucucagggaaugcuccucaggugaguggaccuccuugggcuguccccgcccaaguauaagaaccugaggcugccacuggcaauaaugaaguuuccugcagugauggcuacuaccgcuaugacugugggccaggccucaggcugugugucucagaaucauuacugcuaggcccacagaugcaggaggaagguguuauugcccccauuuuacagaugagaaaacugaggcucagagagcuucaguacuuuucacacagagguggaagaggggaacaagacaggugucuggguugucacauugaugucucuguguccucccauccuuuccagcuagugauccacaugagagcuggagggacagggcaacagggggccaggccucuggcguccuggcuuauagugcccuugacucucagaaaguccuuccuucacuggucgcccacaugcagggacugugcccugcaguccuggcacauggcaggugcccauagccagccguggggcguuuuaaccugugcuucaucugcaugagagugucauauaucucacuggagagugaggcucagaaaaaaaacaggaaagggagggagaaaugcuuucauugauuuuugcuucagaacgugcugccuuucuauauuccaaggauggucccagagcaaagaggcuggcuuggaacuagagugccuuggauuugaggaaggacucacaacugagcaggaagggagugcggagugaugugguucugcccccucauuggauggacaaggaccggaaagccaaaaagcuuugauucuuguccagaaucacacaggggacccugguccagggucuucugucccccauccagggcucuuucuuccaccccaugcugcuucccucgagguuaagaaugcuguguguuugggaagccaccuugcauccauguuuggacaagguaggggacgucagggagucagcacuaacaugggcaccugcaggcagaacucacugcagaaaccgucugugugaccaccauccaguccccccacucccagcuucagcuuuuucaucuguaagacaggguuccugggcuagggcagugcuuccccaccuuggcuguacaugagaacuugaugggaauuuaaagauacagagucagggacugggcgccagccugcuauuuuuuaaaagcuccccaggugauucuaauaugcagccaggggugugaaccauuggaauagacauuggaauaggaucauucgguccuucuucacugauugaagcuuaagccauuccuccaagguccccagagcccagugacucugcaacugcccucucccugccuggguccagcuccccgcaaucuccucaaaccccccggcccucaccaccccucagcuccucugcagccccguucgaaccuuccccagcucugucugccccuaagccccagggcaccaagugacagguuccacuuaucacaucacaccgccugaagggccggcagcaguagccucaggauuggagaggcagaaaccacaccaggccuaccccaccacacucauaccugcccaggccucugcugcccccuucacccacuccuucagaauguacacucacccaggcuugggacagagggacaggggugggaggaguccgaggggcaggggaggagagacagcaggagagcugcguugcuggagcugucuucuuauucagaauccauuuguuaggcaccgcuucccauagauguaaggcccgcccugaggagauuugcauauucauuuuguuuaacaugauucaucaucaugcaaaggaaugaauuugggggcugggagauggagccccauuugugagcaauagaucuggguacaaagagcucagggcaguguuagaggcuuuugcacacccagagugguccccuuugggauggaggugggagacauaugauccccagaggguucccugggaguuuuaucucugcuaagggcaaagcagggaccucagccuuuagaaccuuccccuccccuuccagaccuucccaccauaaguaacaucugcaaagcacuuugcaguuuacugacccuugucuauacacauuuccaccuuaacccuuacacagccccgugagguaauagcauuaugacagagccaaagauuuacugagcaccuauuaugcacuaaacacuuuacacgcuuugucucccauaagccucacuguaucuccaugaggcagguuuucuuuuuuguuuugucggauuuuuguuuuucauuuuuugagacagggucucacucuguggccccagcuggagugcagcagugcagucacagcucacugcagccucaauguccugggcucaagcauucuucccaucuuagagucccaaguagcuggaaccacaggugcacaccaccacacuggacuaauuuuuuuuuuuuuuugguagagauggucucacuauguugcccaggcuggucuccaacuccugggcucuagcaauccucccaccucagccucccaaagugcuagucuuuuucuuauuuaaaaaaaauuccaggagacuccuugcgucucucagucaccacuuuucagaaucuaccaagucucaagguuacuguaugccuccagccccugcagcccuggguucagagacagugcccuggaaccgugauggcccagcuucuggacuacaggcuagcuuuuuagacaggacucuucuuauagaucacaucguaucauucccuggauuuuucucuuggaguuuucugccucugcagaaaguugugagaauuuuuuuuuuuuuggccuuugauuuuucaaaauauguuuccauaguuaacucauuuuaucuccaccccagcucucuauagaagauaguauagggauuacuauacccauuuccuggauggaaacacugaggcaucagauguuuauguugacauugcauagcaacagagaaggaagugggaaguuauuggagagcagcuggacugugacccagagucugggacaguuguuucugggacuuuccuaaucaggccagugugcauggagaggaauacaggcaccacacggauccuuccuggucuccagaagcuuguuuccaagucccuacuugagggcacggggguaugaggcuuccagcagccaaucagaccaaucacucuggcuagggagggguaugagauuaugacucuaaauagcuaagaacuggauuucccaacucauaccuuuauucuugguuuccucccauuucauggagaggaaaacagaagcccagcccacgagggagggggugguaccugguacaugcugccugguguugaaagcagauguccugggcgcuggggccaggguggguaucagggcugcaccgucaccacggcccucccuguucccuuuuucuuugcgcacagcccuuagcccacugcugggaauggaaauagcauucuuuauaacgugaaauuauuucuuccuuaguguuucagccuauagugucacuguuaugaacuuuggugccacuuugacucuugauccuuuguaugugggccagccguccgucccugaugcaugauacccucugcugccacgugcucucucccucugcuccugcuggucugcaagugagaagaugcagggggagccuggaggaggcaggugcagggacggcccuggaauauugucagugauggcagguggcacugggggaucuccaaauucuacugucauucauucuacaggaaggucacucaguuggagucaaggguaaggaaacuugccuuggagcuccuuagucucugaauaggaaggagcuggggcuguuucaugcuuggguaucacacuuggccuugaaagucaagcuccugagaagaagggagggaggccccagaugucccucugaugagacuccaccuagcucugcauguccagcaugugugcauggggugagggagagggugucuugccccagacccaggcaugugugcuagaaaccuggguggagccaacagccucuucuaagaagggagggagugucagucauuggguggugaugucugacgucugcucucuaggggaaauauccaaaggaaggcaggucaaaaagacagaggcaccaugagcacaggccuggaaggggaccacacuuuggggcuggcacauagaauagcugaacugaaaucgaggaccucaguggagcaguagugaaagaagaguuuaaagagagaaaguuuguugagacuaucaugauggucaaggcuugggagacuuugccuuggagcagaugauggugauuuggggggaaaugagaugcuggaugagugcuuuaaggcagggacuuucaggauccauugcagggggcagaguugaaagggaggaggcagcugggcaccauggcucaugccuguaaucccagcacuuugggaggcugaggcaggcagaucacuugaggucaggaguucaagaccagccuggccaacaugguaaaacccugucucuacuaaaaauacaaaaauuaucugaucauggugacacaagccuguaaucccagcuacuggggaggcugaggcaggagaauugcuugaaccugggaggcggagguucaugccauugcaguccagucugggugacagagcgagacucggucucaaaaaaaaaaaagaaaagaaaagaaagggaggaggccacucaguggugcagccauagggaaaaacuguuuuuaauuuugauauuaaccuuuaucaaaguaauauauguaugaauuuaaaagucaaauaguacagcucagcuuauaauaaaagcagcagacccugauucauucuuuaccacuccugcuucccacccauagagaaccucauucaauuucugauauuuacuuccuuauuucuaaaucacaugccuauacauuguuuuaguuuugaauauuaucuauugauuuuucaccuaugaaggaugagaauuucacuuuuacaccauccucuaccuuaucuuugcuauacacacacacuggagcaugcacccuacucuuaacauucacugaacccuacucuuaacauauauacacccuacacaaacauccuacucauaacuuucacuauguccuacucuuaacauacauacacccuacauaaacacccuucucuuaacauucacuauccauccuccaaacuuaauuauauuucucuuuuuagcuaaaacagcauuuaguguacacaguauuaugauuauguaaauguuauucacagcugagccacauaauauacuguaauuauauuuccucuuuuauuuucucuagaauuaguaaucacuucuuuuuuuguuuguuucuuaguguuccuuaaugcuugauguagggagccucucagcauauucaaaguauauugaguuuuuaaaauuugauuuucauuuuucuuaacaacauucucccuggaguguccacccuccugucucaacaugggccagcugugcucugacuugugugguguucuggaggcuugauguggggugggcauuggagaggaaaagagggucacucugaggaaucuguuaucucucuucucuauuggaucccuuuucaugaaugucauauuuuccuguuucuugguuuacaguuucuugaaguacacucuucaguaauuuucagaaaaaaguguucaugggaauuuuuuucacuucaucugaacaaugcguucaugcuaugcuuuuguuuguugauaguuuggcuguguauagaauucuggaauggaaauaguguucuuuauaaugugagcuuauuucuuccuuaguguuucagccuauagugucacuguuaugaaauuuggugccacuuugacucuugauccuuuguauaugaccuuuuguuuucucucugaaagucucaggauuuuuuaaaaauaaucaacguuuuugaaacuucaugguuuuaugccucaguaugagucuuucuucugaacacauacuggucucuuucaaucuggaaacagguccuucagaucugggagauuuucuuauguuacuuuuuggaugauuucuuccucuucauuuacucuuuuuuuuaacuuauuuauuuauuuauuuuugagacagagucucacucugucacccaggcugguguguaauggcauggucuuggcucacugcaacaucucccuccuggguucaagcguuucuccugccucagccuccugaguagcugggauuaugggcacccacuaccaugcccaacuaauuuuuuguauuuuuaguagagacagggguuucaccauguugaccaggcuggucucgaacuccugaccucaggugauucaccugccucggccucccaaagugcugggauuacaggcaugagccaccaugccuggccuguauuuuuuuuccucuggaauuccuauuaguuggaauguuggauauucugaacugcuccucuaauuuucuuacuuuucucucccauuucaucccuuugaauuuguuucuacuuuuggggaaauuucuuuaucuuccaacucuucucuuaaguuuuuaaauuucuacugggccuuuuuuccucuuggaauauucuuuuuccaaagauguugugucuugucuuucugagcauauuaaagaugcuuauuguuguuauuccuuuuuacuguuuuuucccacucugucuuucauguuagaggcucuucucaaauguuuagugauccuuaguugucucuucauauauaccagugaguucacguguagcugccuggaagcuugcuguguauguguggagcagggcaugguugggacugcuuguuagccagugggcuccauuaugggaugauuggaggaggaccuggcuguucuuucgagggaucugcaacaugucaauguuuguguuuucucuugcaccaguuuuccuuuuuacugccuggagccuucaggaggcugaauggcuaaagagaacugaagagggaugggauugguggggaggguacagauuuccuccuaaccucccuguuuucagugccugguucagcuuccauccaugaguccagaacccaacuaacucagacccucuagaaaguaaaucucacauuuucugcaagaguuggggaagggaucugggagucuaaccacucuuuuuaaagcuguuuggccccaccccauucccucccacucagcaucaccuggugucuccggguccugagcuuuuccaguguucugagaugccggccugagcuucagcucacccgucuccuaaggcaguuauaacuggcccaucuguuuccaguuuccagaauuuuguugacaucucucaucugcuguugucuccucuccuguucuuuuugcccuuguggauuugugcauuuuuaauuccuuuauugucauuuuggugaggggcugggacaaaaacagaauuaaauggauguguucaaucugccauguuuaccacaaaauccugauucuuuuaaaacauuuauugaaugccuucuaugcacaagugacagugccaggacuaaagagguauccaagguaaauagcaaaaaggaagaggagggugaagagugggagcugggaaagagggggaggucucguauggcugcagcaggucaggagggccauucgauaagcacuuugaugagugucuuucagggauuccaaaaagccaguacacagcuggaagcugugaaggagggacucugaggagggacuuggagaugggagggugcugaguuggcucuggaggagaccagaacagcuggggagaccagcuuaggcccagagagauguccucgagccaugucagggugugagugacuuagggcccaggccacagagcuggcagcccaccccggcucucagagcauaccuggcacauuuuagauccaguacauuucacccaagagagcaaauacugguagaaagaagagaugucgucaaauuaucgcuccccgauuccuccaggcagagaugccggaguauggguacacauggguuuaugcacacaugugccccucccugaccagaauggggcucccugagauauguguuggugccccaugggcauucgccccuccugcuucucuccccuauacuguccucuguguggaccucguccuccugcgcucaagugccuuccugccuauuugagaaagaaacauagcccaccucucccauagaccccauuucuccuccaucacugcucccccauaagcuggaaugccacaaacccccauauuuggaagugacauccucccaaagcaucccaguaggagaggcgccugcuuuagcauccaacagaaaccgaagugcagauguuucuccucugccccaggagcccauguucagaaaguuccuugccucugacuugaauucuucuuguuccaaugggagcccauuuucuuauucucagugaaagugugcaauuuugaaguacccuccuuccuuccuaagcucuuuuuuggcuacagcuccccaccaaaccucuguucucuuaccuagaggcgucuucagcugccacccucauccccagcccuuccagaccaggaagucccacuugaggaggggcccugagcccacucuccacccuuuucucuggaauccugaggucugggcacagaaaggugacccgacuuugaauccugauuccaccacuuacaaucugugcgaccuuggacaaguggcuucauuucucugaccuuccauuuuccccaucugggaaaaggaagcagggagcggagguguauaaaaaugcaacugagggcagaggaugggagggcagaaucccacuagccccucuccucuccccaccccagccccagcagacagcugcccagccucugaguagcacaggaggcuguuaccagcucugauccaccgagaagccugcaccuugucaggacuccaucugucaggaauuuauuacuaaugcauuuuauaacaggcucuguaauaagauauuaaagacuguagcagcaucuagcaagcauuccauaaauauuaauaacaccuuuagagauggcaccuaugguggaaaugguagggcuuuuugccaaaguuuggucaaggguacagcauaaaucuugaagggggugaagggagcaggugcacccuaaaggugagaggguguggcguccuucuuuucucucucucuccuaucuuccuuucucuugcugcuuaauuuuuguaugucuuuuccucuguucauaaguuuuccucuagaaugucucuuuuuuuuccuguuucaguuaguuccuuucuccccaaguuuccuuuccucccuuuucucucgcaaauuaucuuuccacuuuaucccguuuucacucuggcccucaguccugccccucucacuguucucaccgcauuuuccucuguguuccugugcucuuccuucuccuugccccuccucccugccccccuuucuuuacugcucucucugucugguuccuccuuccugccucucugccccacucccucuggccuuuucucccuugcugcacacccucccucacccuguuccagugagcaaccuagccaccucuggagaggccuggaguguaauguaacucacacugcaugugagaagugagcuauuuaucauuauuauuaacaaacaagauccuuugcacggcagaacuuucccagagucuauucccuugucaccccaggaguagcaaaaagauuuauuugucucugaauugcacaggguggcccauuuacagcagguccaucagaagugauauggagcuuaaaugggaacuggaagaggcaagaccugccguggguuacuuggcgagagagacaaccuggcaggugcaagaauuuugaaggggauaaugccuagacaugcucccugguccccugaaggcauggguguacauuuggggagacuuccuuugaaauggcccagaagccauaagggaguaggugggacugggcagggggguaccaugaaggaggggaggagggaagcagggguggggcagagaagugggucaagaggccucccucagaagcagaagugaucaugccccauggggucuuucuuccaaagaccacggcugcuccuuuccagcaagaagcuggacccagggcgaguguccacaauggagguguuggaagaagcuacccuggaaaggaggagcccaacccccagcugcaacaggccucuuggugcugcuucuacaacuccaacccgugcagccccaaccccagacacuccaagccccaccccagacgccccgaaccccaccccagacaccagagcgacaucuuccacucauucuccuuguccucagauggcaaagucuggcccugccgagcaucucucuucaaggccuguccuggcugacugugugaaguccaugaucaagccaucccuugcccguccggccaccuccccaugcgcaugcugauaauugccugcaaccuggauuugcacguuaauaggagugucuggagacgguuaaaaagaagagggagcuggcauuuacccaggcuccuugauucuucuccccauuguaacuuccagccucggguggcgggcacugugcccucauuagcaguccaggagugguggccuggcacuuugcuugcugugggcgcuaaagagguagagucccaucagcagagggucugggugagccuggggcagagccauggaaaugaggaggcccugcccauggcugggcauguucuggggggcaggagcaaggagcugagacccaugcaggccagcgugagcaaguggggugcccauagaaaggacggcacaggcaggucccagcaccgcagccaugggcaggagacaaagucagcggggccugggacagccagggugggaggcucuuggaggcccucaucuccauuuuuucuccugcacugugcucugcuccgcucacugcaggugggcuuccucugacugccuguggcaucucugccacccuguaacuguggcuuuuguguggcucucggccugucauggugcccacuccagccagauaacaagaucuuucuuucagauucucagagaaaauugauuuaauuucucaggccccaccugauuggcauggccugggucugaagucacuuggaacaaacaugagugccuagacccaucaccuagagcagagcuguggucaugaggagcagcuguucuuggaaggaggguggguggggaggcagcuguugguaucucuuugggugggguggaaagagcacuccguaugagucaaggcacccgauuuccacucuucgacucugucaugauccacuugugaggccuggagcaaggcacauccccucucugggcucauuuucacaucuguaguccacccuaggaaauggggaggcuggacuagaugaccccaagguuccuuccagcuccugcauuccagccauccagggugguguauggucaggacuggcuuccucguuuaggagccucccaggcccccaggugccccccucaccccugccucagaucccaccccuccccucacaggcucucaagcccauuguggaaggucuucuggggcucuuccauccucaucuugucuucagcagccaggauccaaucagcagagauguucucuuucugaauuuuaaggugcccauuugucccaaguucauggugaagagauucauuaacuguuuacacuauuucuaauacuucccccuuuauguggggcucaucucacccugccuguaaugauauuuuauuacuauaguaauaagugcaauaaccauuuaucgaguguugcucaguguugcugugugucuggcccaaggagacucucuuuuuuucacaccuuaucucuuauaauacuuuuuuuuucuuuuuucuuuuuuuuuuuuucuuuuuugagacggagucuugcucugucacccaggcuggagugcaguggcaugaucuuggcucacugcuaccuccgccuccuggguucaagccguucuccugccucagccuccccaguagcugggauuacaggcacgcaccaccacgcccagcuaauuuuuguauuuuuaguagagacgggguuucaccauguuggccagccuagucuugaacuccuggguaggagcugcuaacagcuccauuuuacagaugaggaaacugaggccaaaaagagguuuaacagcauaugucugcaaucucccaggggaaaguuccagacucaaaguuagggagucuaacucagaauucaugcucugagccaccaaguguuacucccuguagccuaccuggaaacccagaugcaccuggccccauaaagcaaaucugcuugcauugagucugcagaucugugugcaugucugugcauuuccauggaacagcagcuggguguucagacaagcccccaguguaugugcugaugagcgccccuccuuccccgcaucuacuucccugauagagcauggugcccaggaccugaaaugcaggaagucagcauucuuuucucuccaauaguuugucccuucuaaguauaugaauggcuccuugccaggcccauuuaaaaccuucucuaaguuaugcagaaauuaaauggguuuucaccgcagggcaugaaacauaauccaagaaggucagacguggagaccaucacuucuuuuuccccuuuuccaccauuuccugaaucuugcucuuaaauccucugaucagaugcagaaggaucagagaggcuuccccucaggaccaugcgguauggacagucaaauguccucgccuccccgaggcagggagcuggagagcugacaucucacgggagccgucccucuccucugggcgccagcuucauacagagugguuuaaguagacuggccgagugcucugaagugagggccggcuacccuguuuccuguuguuguuguuguuguuaaauauuugguagaauucaccagugaagcuguugaguccugugcuuuucuuuguuggaagauuuuugauuaccgaaucaaauaaacauaaaagcauaauguugaauuaaaaagcaagcuucagagugaucuauuguauaugaaaaccaucuauuuacaaauacccacaaaacaguaucuuauauuauucauggcuagauauagauacauaugaaguacaaaagcagacuuucacacagggggcuggcagcucugaaaucagaauguggcccuccuuucuuguggcaggagccgugggcccccaugaaguguuucguucuggauucaugggacuggcucuggcacuucugugugaucuagaaagagagagggcaggacagagaacuguggguuagcugagaaccucagaaagaucuccuuaaggugggggaggggugguggaaauaagggaugcuaagguacccagggcuuagcaacaggggaaaguucuaccccuagggcugaagggaaaggagacgaaaauuguauuaucagagcccacugagaguuggggccauggaagagagccugcugggguagagcuggaggggguagaggaaguaagaccccaaacucuuucucuuccugcucugggagcuccuaccagaacuucccauuggcagaauccagcuggaagccagccagcaagagagccuggagaugcaauccauugagagcccggggauuggggaaaggcagaacuggguggaucauggugccaggggaguggguagacagggaaugcccuggaugguacuguuaauaucagugcuucuugacaccucccugccccacccuugaaggugcccuugucugugccccucuagguuuccagaaauuaaaauugcaacuacugucuucucagcacuuaugugcuagaauguuuacacucaugaucuuauguauucuucacacuaacccugugagauaugauuagcuucaguguacagugaagggauuaaggaucagagagauuauguaauuaacccaaagacacacaacaaggcugggauuccaacaaauggucuguccaucccugaaacucuagcacuugucugcuuugcccccuugcagacuugauucuguuuuggagggaaugagcaucuuccaagcagcugaauuaggauaggcaaaccuagcaaaggaaaagcacauucagacagccagaggugugagggagccugcuggguucaagaaguauaaauagcuccaugccuccaggaaauaaaaugugaagggggagacgggaauggaccacaagggccuguguucuaugcaaagggcacuggggagucacggauggugaggaggagaggggcgcccugcaucugccuccuguccccaguggacagagugguuggaacaggcaggacgugagccugcccauucagguugacacuugucugcugaugggggcaaauccacaaacccaggaagaacccucagcagccccauccauuguucuccggaggcccuuuccagccugaccaggggccccguaaagagcaccccuguguuaagugcauggucugucugugaagggcugccaggagggaggcuugaggcugguccccaaaaaggaagccugcagcuugggcagccaaggagcauuugacagaggaagcgaaaccaccaagaaacagguuuggggaccguaagaccccucauccagaacucuagguuaagcaaaucaucuuuggaacuggugcucuuuacagccaccaggaggccaucaaaaaaugaagaagaggaaaagaaaagauaccgcauuuuaaauuuuggggccccuccuagaaugaaaaugacaaggccucgggucugguuggcugaaggauguagagaaugggcuuugagggacucagcccugauggcgcagcugcuccgcacuggcucacccuuguacuugcuuugcucucauccccagaauacaccaguggggacgcccaucuucaucgugaaugccacagaccccgacuugggggcagggggcagcguccucuacuccuuccagccccccucccaauucuucgccauugacagcgcccgcgguaucgucacagugauccgggagcuggacuacgagaccacacaggccuaccagcucacggucaacgccacagugagucuccaugcuggggccccggccgucccagcugccucuucccacccuggaagagagugacggggcauuccaaugggacauugacccaguggcacacacucgaugaucuauaauaauuauaguggugacagucaugauagaaaugaggcuggcauuacugaggcuuugugcugugucccuggcaccgugcugagcacucaaagggacuuuaaaccucaagcagccccgugucauaaguauuguuaagaugcccacuuugcagaugagaaaacugaggcacaggagcaauucagugacuuuccauggucacccaggagcccgacuccauagccugcucggguaacuuccuugagacauucuuagugcagagugccucuugcucucugggacacaggacagagguguucacccagcuguguccugacaccauccaaccugcagggcccaaaggaguucaggcauccugccucuacuccacagaguggugacauuccacaucaucccucugugccaagcacauugcuggccccugggaauuccaggaugagugagucaagggcagaaggcaggagaggguaauuaucccaucugauggcugacucuguugagggucacacagcccaugaguaguggcggagcaagaacccaaaccagguuguccaccucucaguccagugcccugaccaccaugccccauggcuagacaucuccaggucucaagaacaucgcagcaugcccuuugugccagcuguuugggagauccuggggaacaggcaagccacacucuaaauaggguccucccccuacccgcccccucuccuugcucccagcugcugccucagggcauagcuggagccaucagcuggcagcagggccguaagcuggccuguugucccuuagauucuguugacaaagcuuacgccaagagcaaaaaaacaugggagucccucucaacccuccagguccuaucugccugacacucagcauccacuccugacccacauagcugucaaggggccugccggcagcgcuggggggcucuccuugguaggucacaggcucuagauccaaggcucuggaucuggacuggguccagaauccaguuuugaaagauggggugcccccagacuuggccaagaugcagagagaggccucaagacccaggaaaugcgaacuucuuguuuggcccuggcccaguggcuguggggaggucacugcaggugacacucacguucuuuccuucuccccuguuuaaguguuaguugccugggaggagcugugugcugcuguuuguaaaacugaccucagaggucaaggggacaugcaagcccaggauuugcuuuuugugcacauuugccugcaccuuccaugcagccuggcacccacacaugcgcugccccuccaccgcacuguuugcacacaccagggcccagaaacacgcagaugcuugcccgcugugggauaauuuccacccaccauaaaaauggcuuuggaccguggggaauagaccagagcugggcacaggcaagaaucuggguggcggggccuaucaagaggacugggcucaagcugggaugaugaauacaguuaaauugcuguuacucucccaguaaucaggcuuggaagcagcagaacaggaggggcccuagaagucccucucuagauggcuucucccuugcuucuggaggagcugacaccgaguccuucucggggcuggugcugugcccuuggcugcugagcacuuccccaaggaaggagauucucggccuggcauugcgggcaacagugucaguucccagccaccacugagcugguaccaggauggggaaauugaggcauccucugggaacaagcugcugagagccaugggccccagaguuacagcugggagccugacaggaucacuccccuuuccccaccacagaguccagagugggcugggcaggggcauuuguggcaugaacaggacugcagucacagguaugggacagagagggccugugccaggcuagacaaaagccagcugccugcaaaagccugguuauggcaaaucagagccacuggcauccccuguccaagaggucaggggacuuguuuugagcuuccccgcuccagcccugggugccugguggucauucaggucccuagcugggagcucuccccaugggcagugcccaagccugccgugugggccccaguccuggagccugggaggcugccugccgagaaccucucugcucaccuccugcuuccagaccuuccucucccuugcagcacccacucccaucccuaaaggcccucccacccucucauuggcugucccugaggauuccuaaagacaaccagcccucccuucuccuaggcacagcagcuccaucucugcaggccaggaggaggcaccaggcuucuuggaacuccaggaaugccuugcuucauucaagucaccccagacaaacuaagggagagcuaaccuggggacagucgcuccucaaaucuuagcucagagaauguucgagccugaggggccuuagaagucauucacuugagccccuucaucucacagaaaaggacaucagauucccagggggaaaaagaacucauuugagguuacucagcaaauuaagagaccgaacugauguuagagccccaagucaaaacuguuaguggcaaauuuuuaugugaaaggaucugaguuugaguucuggcuacacacuuagaaguuguaugacuguggacaaguuacucagccucucugagucucuguuaacucaucugaauaaugggcucaucauaacuacagaugcgagugaagugcccgguagaguggcugccacgucaucuguacaaagcacugcaguuacuauuauugcuggcuauuguuauucaguugcagcaggcuacuuaaacaguagaagauagauuuggaguuuucuuucuugccaagcauuaaaaaaaaauuuuuuuuuugagaugggggucucgcuauguuguccaggcuggagugcaguggcuauucacaggugcaaucuuggugcacaacagccucgaacuccugggcucaagugauugccccaccucagccuccugagcagcugggacuacagaugcaucguugagguuuuauacaaugaaauucccaacugacgguuuaaauauugcuugccuggcugcagggggauggccugugugaccucucaggagucuuucucggagucccccagaugucacagacccuggagcucccccugcugguuggauugggaaaagucacugaaccaguaaauccccagcccaaagcaagggacucaugaaugcagggacacaggugccagauuaauccccucuguggccuuucuucugaggaguccccaucuuugucaauccucugcugcccugggaugagugggggcaggaagugggcacagagagggguggugaccuccagcugaacucagcaaaggagcugagggcagcaccauaucuacuccaagcuggucaucccaccaccggauguccaaggaagucaggccugggcuacuaggggcuggaggucuagcuguaccccagcccugcuuuguaacacuggauaagcugccuuccucuggaccuuggggaugcuguuuguguuuuccuguacagcucagaaaucaccauggcuucuuagaauucuuaagcuuccuuuuacuaagcccuucccugcuggagugcaagagcaugggugugugugugcgugugcauguguuugcacuuaugugcugcacggugcaggucuguguguguguguacauaugugugugaguguccccaccaucacucaaccuaaggcuguguguucucuccgcucucuaaggaucaagacaagaccaggccucuguccacccuggccaacuuggccaucaucaucacagauguccaggacauggaccccaucuucaucaaccugccuuacagcaccaacaucuacgagcauucuccuccgguaagacuccuggcccuuccuucucagaagucccuucucagagggacuuccuucugagcuccuguuagggaugggcccuguuagugggcugggcuccuccuuggcuccuccgcagucccugugcguggcagugaugaguguucuggcacagcgaaaccccagccacucuucacaccacgcccaucuccucacccucucacucuacccaaggggcucuguguggcaaagaacaaaggcuuccagggcaaguaacggggagccauucagacagacuuauguggagggauggggaucccauggaaaauucagccugugcugaagaauggacucagucuggcuccacagaacaucaguguggcucagccgugucucugccgugucagucugucccucucugcugaugagcacugccagagaggguggcagcugcccuucuucaaggguccucuuggccccggcucuucccugcgagcuugcagcuccuucugcccucccuaaugcccagucuuuggauuucuuaaguccagguuuccaagaaaggcuccugauuuuucugguguguugcaaggucauaggucaccagccuguagaucggcuacccaugggugucuuagaggacaaaacaugccucggcccacucugcaaggcuguggauggagcagcuuugcucagcugugggccagacgggcaacggcagccaucucuagucucauaaccauucgugcgucugugcaaacuugaaugcaacaccggcuguggguggaaaaauuagaaaaaugcgccuccccuaggcagucacaaucccuggucauuagcuuagggaacagcguuuggggaaagaaaaaugagccccuucuuuugagagaacucagugugcuuaaaggaaggacucagcuuugggagcaaaguggggcacccgccuaaggcucgugagcguucagggccccacccgcaccccugcacaggcucacagaauugagugugacaggugagcuucccuugacuggggugcaggcugugcuccugggccugaccccucauuuggagaccauggcugcccuggccacuggccucccuucacagcaugaggccgcagucuccugguguauggggcuggcauuuggccacuuccuucuugggacagguguggagggaggcucuaagaagcaggauccuuuccggccugcuacuguugaguguuugaagcugcuuugagaguagagggggacagaucaaugcccccaauuccccagccuucucuuucuuagcauuccgugggcagugggagccccugcuuuugagacugaaggcugucucuucucagcacagcccagcccauuucccaugacuuuccuagccccuuuucucucugccccuagcccaacuuugccaggccgauaccuucucagcaucaggucagcugugacgugcuguuuucagaugaggcagggcccacaaucugcccauggccccuggacaucuccugaguggucagcacucuugaacaacuugccccaccucugcuccccugaaggacuggaagcgugcaguucagcagggacagggucugcugugggcauaacauacagugugugcucaggagaugguaauggaauggauaaaugaacaagcacccucacccugggcagaccagcauacucaccauccugcacccucuccgccccugugccugcucuugucgccagcccaaaguccacccacccauuuguucccaguucacucucuaccuuucuuauaauuuuuucccuggcuucuucccuauccgucccagagauagcaacuccucucccucaacccugguagaauuaacucucucuaugcuguguaauuuuccacuuaauuauagucucgccuguaauguuaccuauauauguggguuacuucugagcccccaguaaucaagguaccugagucucugggacaugaucucauccuuccuuugggucuccagggcaucaugcccagagcuaagugcagggaagaugcccaaggccaacuagauugaaguauagaacauggcaguggcugggcagccagaggagcucagaggagucccgcacugccguacucacuuuggcugaaucaaacggccuccugaccagguccucacugggaaagggggauaauugugccugcaguggugccucccucuccuuaggguuuuaacgguuggagauaaugcacauaaaacacacagcaagugcugccaauuagcggacauuaaaccacgcugggcagugaccuggucagucaauuacaguagcuagguuggguuggggcucccagcuucagcuuccuuucagagucguuguaguuggcaagagguguguucuuggugugaguguccccugagaccccuagguugucuuuuucuaguaucuuuuuaguauaucgugcaaugcuaaguuugcaugcuuuuauuucagaccugcagauuucugagcuguccauccauugggucugcacuucauccuuuuaugcacccaucagacauugaugcggcuggucccaugugcaggccccaugcuaagccaugcccucugcucuacaggugaucccacaggccccugcuaggacaacuccucagucucagcaaaccagagccuugcccuccuuagcuuccggucuccugaugcuccauuucuuggcauaugcugugauucuccucucucagacgcaaggaucuugaugucucuuugccucaccaguauuguuccuuugucuccacaagggcacuaaggcccaugcccagggagcugcuagacccccgaucuggguggugcagguuucagccccacagcuuggcuuauggcugggcugggggagccagaaaaggcagugcauugaggguuucagacccuccagccuggcccggcuccccuggggcccacagaaucugccuccguguccacacaucucugcccuuccuccagucuccacacuugaggaguucucagguucccucgccucuugcagagccucucuccugcaggccgauucccuugcacugccagccugauccuucccggcugcuaauugguuucugugccuugaucugggcccuccaugucccuuuacaguguagaacccugauuuaacgcagcauucccaggccgggcccaggcugagaugcacccuggccuguucugccucccaggccagaggaccccagcacccccauucccagccuugccucugcugccccggggcccccaccggaccuuuccccacucuccccaacucccccucuuuaucugcggcucacagcauguaugccucccccuaucagcguaucagguuagcaugccucaucuaaaguguauauauuaccuaauaaaauccuucuuauuugggauuauugcaucagauuuuaauuuccucacucgagcagcagcaugucggccugcccgucagugaagggccgauagaaggugaaaagagcggauaaacugcacaaauuacugccagccgaugccuaucagccuuucgacuggaauugacuggaauuaaggacugagaaauaggauuugcuaccucagaaucugcuguggcagcucucaucggaaguccccuucagcccccaccagccugcuccccccaaggacgccuccuacuccugaagcaagcugcacguucaccuuucaaguccuuaaucccgucauggaaaugggguagggggugucccggcugagcuugcugagcaggaggaggacgugggucccugaggccaggaacagcccagcugggcuccuguguccacggcuuuccugacaagggcaucuuuggaaggggacaagccacagagggaagagaaguccagcuucucucaacuguguccccacugcccgggccucagaggcuggggcugugucucacaccucacccccuccucaucuuggcacacgcacugggugcagagcccugagcccuugccuccuccagagagcaaaggggucccccaggcacaccccacacugcccuccauuccccagucaccuccgccucccuccaccccaccccccacugcaccaugugacucucagcaaaucccugagcacucugagccucgguuugcucacacauacccccaugugaggaaagagagagagggggaaccuugcugggggccccacacaguggaacaucguagacacuccacuagugccaguucugcccuggaggcugcuagcuguccucacaaugcacagaaagccacuugccucuagguagagaugauuaauaugggguguuggggagucugaauuugcugaaauucuuuggaaaaauccacguggaugugcauuuucuggaaagaggccccugaguugucaucagaugcacacagugauuccaggcccaaauaaaguaacaaucacguuuauagcauucaccaugugccaggugcucuucugagugcuucacguuuaucggcugcugagggguggggauugugauuuuuacccauuuuauagauggggaaaacaaggcagaaagagguuauaaguaacuuacucaaaggauucgagcgcacgcagucuggcagcagagucaaacccuuaaccaccuuguggugcuuuucugcuccucccauuacaaacagcggggccccugcaggccugcacacuguagccucucucucggaggcguccuacucccugaaauguggauuccugugcagggcagaagcccuuggcaggucgcacccuggcgcacaccccagcuggacuggcucccuggagaagcacagcaggcagcgugcccuugggagcagggucggcuccgggccgagcacagccgcacuucuccaucccccgucuuuggaaauaaguuucaguauauugaaaauauaaucacugagccucugaaacaagagcugugggcucccaggagcccccauuccucccuguuaauuccuucucauaauguuuccagucuuucuggcugcacuuguauuaaaagcucaggguuuuauuaaaaguggauuuauuuacccaaaaaaagaugaaaccccaaacuuugccaggagccugucagagcuugcuucguagaagcucggguaugacucuuuuaggaagaguccccauuguccuccuguccuggagaaccgacuggccuccacagagcccugcccgcccagggggccucugggcagccccaugcaggagcccagcacgggcucugaggacugagggcacuuuugucgccaggucuccucugcacaagccugcaccagcccccucgugucucccccugaggaucacugucccaggccuggccuagcccugcucugcaugugugucugggacaugcaauugccccugaguacugcuuagugacucucugggguggugauccagugggccucaggcccaguuauccuagcaagccaggagagcacggagcaacugcugugaagggauacaagugcuuggggagggugagguggggggugccccugcugugucauggcagcgagacuggguggaguuagaggagggguagcuugccccacaagagcgcagggcaugcgugucagggaacaagccucugcacaggugaagggggugggggugcagcucgggcuucagccuccugcugauaaacagugaguggagggaaguggccgaggacacaagagcccuucauuagccaugcagaugccaggguugacauuucccuaggggguggggacaggcuuaucuugcucuccaucacccaggggaacacuguggccuggagccagagccucaggcaggcauggugggcaggcauggcuggcacuggccauggugugauaggaccuggggaaccaaguaaaggcugccccaggcaaggggcgacucagcgagugguggcggugaccuuccacccuaagguuuaagggcucugugaagguuuaaacaaacucuuguuuguucguuuguuuauucagucaaucaaucaacccaucaauugauauucgaaugugccaguuguaugccaggaucucuuccuaggacagucuuaugccuccaggcacuugccugagcucugccuucugcccagagcaccuuccucuucauguucucucccuggcaaacuccuacucaugcuucaugacccaugcugaauguugccaucuguacgaccauucgccaauuccuccagguggacuucuccccuuuuuuguacguuucuccaugugagccauauguguauucgcacuccuaauaugcguauagcagcugucugcucagauguucuugacuucaugccauaggcugugcuccccaagaacgcguuccccuggcuuccuauacuguuaguuccagcuccugccccuucuccaucagugcugcagagagaaugaguaggggugugggcagagccauuccaagcaggaauugccaggcacagugcugugugggccaugguuccuagggccauggcggccuccugaguugccaccgucaucccccgagauaccugcuuucaugauuuaugcuuucaucccuaaaguaguugagccaccauguucuccuuuauucagaccccagugaaaacaaggucccaggcuuuuugcuguuauucuuauuaagguggagggaaagugaggccagagaggugcagcaaccuuccuaaggucacacagcaacgugaugggugguugagcuugagaccagaucucuugucucuucgcuggaugccccucaucuguucuuccguggugguccauuugaauaagggauaugggaaggggaaaggggaaugauaacaucgguaagguuuggccuccccguggacccuaggguguuugccugggaacugcagugugugcccagggcagcugaugccugagcccuuggcaucuacuuccuggguugcccuugcagccaggaucagccuggggagggaagcugugggugccaugauagcuacaaagaaagacagcagccaggggacccaaacucaagucccuccucucuucugcccagggcacgacggugcgcaucaucaccgccauagaccaggauaaaggacguccccggggcauuggcuacaccaucguuucagguaagacagaaggcugccccucucuccucucaccccucuguccuccacccaaggagagccaguaggcaucucaggcucugagggcuaaggagaggucugcgggcaugugggacaggguaggagaccugacuacagggacaguccucgccaaagggccaggaaggugacugagugaaggcaggaggaacagggagaagaggugcugggaagccgacagaggcuaagcugucugggggcugcuuggugggcacuggggggugggcgcgugugccgcuguccaaggucugagacgguugggcacuuuggggcucugggccugggacuuuggugacuccuaucuaaccuccugcagcgcucuggguuugucuuuuucuucucguauuugaugaaaagguggcaguucuagcaucauuuuagaacaaacggagcugcaacuacagcugauuucauguucuuuucacauuuccaacccuuaagaauucaugucgcaucuggaauguugcgggggggaacaucagcccccuugccgcccagcugccuugguugagcagaauagugacugacggcagagaugguuccgggugaugggaucccugacccacgccccacccaaagacugacaaauggcagcucuguucggcugucccagggcugggugguuuuagagcaagguugccuugaggauguggugacaggcugcucgcccacagacucuggcucugcccacccccccauacaugccauacacagccucccugcccaacccacgagucagugaagggucagccugguguaucugggcaggccagguugauggccgaaaggacaucuggccaccaggccagauucuacccacugccucucccuaccauacccccacauccccagaacugggaguggcauuguuggaguagcauccugccccuaaagcucagaggacagcaaagcauagugaucaagaacauggaggaggauggagucuacugugccaugucauuuucacugggucccugucccucaauuugccuguaccuccauaaaauuggagcaacaagaguaccuacuucaaggugauguaagggucagaugauuuaacauauaaagggcuuaguuaacguauguaaaguaccacguaaguguuagcugugguuauuacuacagcuagcagcuaaugcuaccuugggaagcuagggguuagcuaguaggagggagacaccucauguccuuggcaaugcaggaaaccaggggugucaugggcucccugggacccgcagcugcugacaugacuauuguugcaccucuaagcccagggaaccccaggacccagagcaacucccagcccagcacagguggugacuggcagcaggaacauggguuugggccucugcaccacccccucccccauuucauuauucugguguccagcacaggaccugguguagcguaaaccccgauauguacuugcaaaaugaaugaaugucacucuaggggagugaguuuucaaacuccagcaugcccaagaaucucccggggcuccuaccaaaacuacgaaguccuugggccccauggagauucuccuucuggaggucugggaugggcccaagaaugguccuuucucacagcaccccaggcagcucaggugcaggcagucuucagacggggaugugaggaagccaggcccaggaaggaaacuguucugcaggaaggcaggaccugccugggaaucgaggcccuuucuaggugggcagagcagaaggggaggccugucuuggugcugaucuucuucaugaauuuugcaaauugagacacagagcaggagccucccagugaccaggggcuugugcuggagaacugagggaacaccggugagcccugggugauggagcuggggagccaggacagagcggcagcaggaagggggugcugggcugggcaggggcgugucucuuaugugcucacagccuccgggcugguuccagauauaccccagccuggauggagguggggagcagagagccaggacuugguucaaggucaugcuuagaaugggaacuccugcagagacccugugagcccauccuccagggcgcuggcccauuccagguucaugcugggugccaggcugccaguccagacccuuagguccucuccagucuucaaagauggcuccagccagacccaccucucuacucuauccuucuggggaaggaggcuggagauccaagcugcuaagccuuuggugucugggcuggacucuggagcuuggaguccgggcacaacugccugcagcaucuccaguggcaaaaucuccugggacaggcucccaaguacaaacaacagggugagaagggagacccaggauuugaaaccacagggaagggauguguguggaggcgagggcaggagacagaaacuucuggaaggccugaggcauucagcauagcuuuauaggauucccacugccagcacagaugugucuuaagggcuuuuagaaaggaugacaaauggguuaccucucacaugccagcuuugauugauugguaauggcugccugcagaggaucauggaaccaaauaggcucaugagugcaguauucaauuggcagagucugcuauggauguggcaagggauagggccacuguuugacaaauauuugccauccuugcuauguuaccacuugaacaacacgugcaggguggccuuagaacuuccuuuaccuauuucguggguguuugucagcaccucacuucacccaaaccccuguuggguaaugagccccuugagcaaaugacagcccugcucuuucuuaccuagguaagaaagguagguaaggguggcucaacagggcugcccccaccccccauuccuaccccuuucucuguggcccugggcuggcacagucucccugagagccauccucagcaugagccuaaagcaggcuaaugggcaggagggcacuguccccaggggagcagguggacagcaggcuaggauuuggccucaucucuacuuccuuccaccaguguagacguggcugaaaagaacauugucugccaagggucugucucacacaccugccucucuggugacauuuggucacagcccucuccuggguggccuggccagugccuguuuauuggaaagcaggcagaagggaugguucaugucacccugagggcaucuucacagcugauugccccaagcuugcccugagugcccgguaggggccugccccagcccuagcugcucaggaaccauuuuccuuugaaagaaagaauuaagggcuuuguagggggugggcagagccaaauggagaguccugagugucacugacaugggugacuugagucucuggggcacccccagaagccugggcuggugguggcucugucugcagugggugaggucugucugccccacguggcuggagacaggccugagcccacaauggauccguggcccacaguuaacuugcccaguccccugaggcccuguccccuccaggcuguuuaucagccccgcagcuguggggauuuaugucugcacaccagugcuuuccccauuacuaaugaccccucuguuuugccaagaacaaagaggccuucagcacuaaguuauggcuccauugccaucaauuuguucucagcccuuuguggccaaacugagacugaggaaugacaaguucccacagaggaccuggcaugggccccaucugcucccucagccugugccugcccugccacccacaaguggcaucauuuucuugggggccugaccaaaacagaguucugcaggcucccauccccaaaggacugcccagccuguggucucaacagacacccccucuggccucauccuuccucugccagacagccacaguccuccuucaaggggcagcugcacucacccccccaacagagcacugaacuuggagucagaaauuguggguucgaggcccagcugugccaccugccagcaauguaucugagcaagauguucgaccucucaauccugugguccucgcccguggaaccagguuaauaauccacacauggaugagagggugcuggagagacucuaaagggccauaaaauauuaaggauuaugcauugucaaguaacaagcaggacccagggguccuugggacucauucauucauuuccuccuuuauuuguuugagcacagggcagugguugagaguacaggcucuggagccgcuguccaugguagugaccucuagcugugccggccagugcauuugcccacaagcccauguagcuacugggcacuugaagugcggcuagucugaauugagaugugcugucaauaaaacacauaggauuuugaagaccuagugugcaaaaaaaggugauaaaauaucucacugguaguguuuuauauugaugacauguugaaaugauaauauuuuggauauacugggugaaauacaacauauuauuaaaauuaauguuaucuauuucuuuuuuguggcuacuagagaauuuaaaaucccccaugugcccauauucuauuucuguugguggcuguguucuagaguuagguggccucggcuuagcuucugccacugaccagcugcauaaccuucuaagcauccguuuuccaaucuguaaaauggagauaacagccucugccucacaggccuguggggguuuagugagcugagccgagucagcacucagaagagcaccugaucucguagcuaaggcacugagcagcguggacucuucauucccacccacaguugaccgagggccuucccugggccaggagcugugcuaauguccugagaagugguggagaccagggcaccaucuucgcccugggaaccugcaguuuggucaggagacagaccuaugcagcggcagcuuuaauaccucgguggaacucugugaagaggaggcacaagauaugcugauguugacaugcagugauggcucccugggggccuguuagacuguuuuaucuacuucuguguguguucaaaaauauccaugauaagaagggagaaaagauccuugggagggggugccucauccacucaacgcaggguggggagacuccaugaggagagaucacaaaagccaggcauugcaggaggaguaggaauuugccggaaagaggggcggacaggcagaaagaacaguguguacagagacucugcaguaggagaggagccacauucaugcaucugcaguagcucagcguggccgggcagagugcacaggggaggcggggugggggcggggguccggugcugaggccgcagagggaggcagggcgggccaugcagcauguggagugcccggcucaggagaaugccagcccugguccugggagcagcagggggccaccuggggggucuugggaguggggugcauagucaggauugcguuugggaagcccacuguggucaagguggagcagacagguugggggacagcagguaggagcagguagggaagagguugggguguccagcugagagacagucacagccccgacugcccagccacaggccacauuaggagacagaggccaagggggcauggaggccuuagaggaggugcugauaggacaagugcugugggugagggcagagcucuguccucuuuucaugcugaaaaggcuuaaucucuucuugccgcccacauccguuuccccaucugcugucguccgcagcucaggaccauccccgagugacgggaggagaacccuguuuauugggugccugccgugcaccaggcacugccuggacacaaguuaucccucaaaacagucuaugagagagacauagacaaggaaagcaaggcucagagaguuuacauagauuggccaauagucacagcuacuaagaggcagagcagagauuugaacccaagucccucggguuccagaaccucccaguuuccaugacaacccacuaguucucaaagugugcuccccagagcagcagcaucagcaucaucugggaauuauuagaaaugcaagguuuugcauccccacuaaaccuaaagaaucagaaacucugugggugcgcccgggcaacacugaugcugcuggucuggggaccacacuuugagaagcucuggucuaaaggagcguguguucucaauggcggcaaaauuuuguacuggggaagaucuuacucuuuuaauguuuaaagcagauuuacauuauauccaugguguugacauuucaugucgggggaggaaagcaauuacguaaaaaugucuaaaguggcuccuggggcaagggguugaguggggugggugaugaugaagagaagguugagaaacccucuagaaucaaggguaggugagaaauaucaggccgaaaccccucacuuucaacuuucaaggcaguggccucacuuccaggucacacuggggcacuaugguagugaaggacagagccuucccuugcuugucucugaauuuuauuuuaaugcuacccaagugaggagguacauugagugcuuuaaaauauacugaaauacaugaaaauacacugauugcuuugaagggaagucuguguguguguguguguguguguguguguguguacgcagggagaauaaucagauacagucagacuugcacaaccucacaccccccacauaugccaauaacugaaucgggccucuggccauggccuagugggggacagcuaucauaggagaccaucgugcgaaacacuucaaagcccuugugauuaagcugcuuggcauuuucuuccccugagaaguaaaaacucaggaaaagcagaauugcuuuggaacucugaaucgcacaccacagcuccuggcuuaggguagcacaauggcugccuggaagccccaaacaucucagggcaucuuggggaauggcucaccuggcuggagccagaggucaccaggaaggaguccagggcagaucagagagggguggcaggacauuugcuagaagacagagaaagcaaaagaaguagguuauugagugcagcuggggucggggaagugaacgcggggucaccaggagauucaucaguucuggguggauuggagcaggaagcacuggaaugagggcgaucugcuaacaggcuguggcucuaaucuguccuugccgcggggaggucugggggucauuguggugacguacaggaaccgagucagcaggcucuggugauguacugaaaauagaugaugugggaaaaggaggagacaaagaaacuacuaacgucugagucuagguuucucggaucauggugguggccuaggcagaaaggggcauauucauaggaaaagccuguuaauaucugugaaugccacccuagacccacauguaccaaaacaccccauucuucauccauggcagacaucacuaauugaucccagcacaaggaugggccuccaagccuuucuuaccugcccucuggcagccacuagcaguugagaagcauucucucucaagcuggaacaaaccugcuguccaaagugcagguuuagcccauuuguauccuguagcucucuucuuucaagaguaucuagggacagagccucuagaggguuuuuaauuuaauuauacaaacacgcuggccuguuauuugcaguucucucccaccaucaugccgagacagcaauaaugcaucacaccaacacucacuuucuccugaugagccacagaaaagucugcacuucuuccuucccccugaucuuucgcccucuucucugcagggugugcuuccugccagccggccucuccugaugcucucaugagcucgccuuugugauaaaccagucuuuauagccaugcucaugauucccuguucuuccucucuccuuuaaugagguccuguaugcucuuugucagcaacaguggcuugccccuugcuuccuucccauaaauaacacugguggguggacuuuuaagagguuucacugaagcacagucuaggacucucccuuucugcgucucgucuuccccauacccuccccaugggcaggagucugucucugucccuugcucgggacauagagugcuguggaaacacccucaaggccucucccuucugcuagaccugaguccacuuccccagcugggcaaagcauggacugcacgggcucuuuuuauugguccacucagcucagggaaccacaucucugagccagagccauggcugaggcagcucugugggguugggggguuucuagcucauggcuggagguuguuuuggugggcgauucugguuaccacaugucaacaggaacuugucuuuuuuucuuuuuuguuucuuuucugcuuuuuccucaaucuguaagauaacugcuuuuuauugacuuucaagagcuuugagaucuuuggaggaauaagaaauuagccaccauucaguuugcauucucuuucuauuuuaacuugguccaccucugguacacagaauugauuuaaacguaauucucggcucacgauuaacauugguccauguguagcucucuuuuguuucauucuuagccuuaauaauauuguggaugccugugaaacucaccagcucaccuagagcaagaccaucacccaugccuuaccucgccuuacccacaccuuauucauaccuuacccacaccuuacccucaccuuacccacaccuuaccaccuguguguuccuccucuaccccauucccugccucccauccuccagaaccacauauuugaauccugcauucucuuauucucuuccuuuuggcaaauaucuuaucgcauauauguggaugacauauugcuugaauuuaguugucuuugaacuuuauuuuacaaauaucauguuauacauaggcuccugggacuccuauuuuauccucgauaguauauauccaagacucauccaugcugucagguggguauuguuuuucauguuugcuaugcauauuacuccaucaugggagaauacuguaguuuauucauccauuucccuguugauggguugauuuuugcuauuacaaacugugcugcuaugaacaucuguguaucucucucuggaugugugcaagaguuugccuucagcuacauacgucaucucucacccccaucauaacccccaaauguggcuggcuagagccauuuaacagaugaggaagcuaagacgcaaagagcucaugaaacaugcuuagggccgcauggcaaaugagcggcagauccaggauucaaaccuagaccuuccugcuucuaaaacucacauuuuuuuuccugcuauuguuugcuauucugccugagaagccaagggauucaugucagccugguggucuguguguaggaguggaauauuaagauucauucaaucauuccuuuauucauucauucauuuguucauucauucauucagcuagccagugaguacuuauugaguggcuacugugugccaagcuccaugcuagacccuggggaccaacugugaacugaaagccaccaucaccacccucguagaguucacauguuaguggagaaaagggaucauaaauaaaucagcaaagagaguguuuccccgcuguguuaaacaucaggaagaaaauaccagggugaggagaggguaccuaggaaggcaucuaggaaggggauuuaggaaggcuggaccagggaaauuucagcugccugcauccaccuuuccagguuaugggcaugggaggagauccucguagcucccaccucagaaaaggucuccaauaucuucugggggcuuugaaccugagacgagccccucuaagcagcucagauucccagcucccuuuuucaucugacucccuggaugacugcuuagcuuucaaggcagcccccagccggggcuaaucugaaauaaaaguuuuuauuuaucuagcuugauaccuggugcaagguuaaaucauacaaaagaaaaagcaauaagagagaaagauuaagcauaaggcgcugucuuaggcaugcccuuuugcaauaugguuacaaagauauuaagccugaagacacccacaaguccacauugcuauuuccuugucucucugggcucagcuuagcugcugcuggagcaggaaggaugacagaacuuggugggggccguaggagggagacccccugggguacccugcggagagggugagcagccagauggaguucuaguuacucagcccaucagccaccucccaccccacacagcucugauucauggcuucccuggggaacaaaaacauugacaucugcaccuacguuucuaucagcguguccgugucaucaguauuuauuaugugccugccacgggcaaggcacccuggggagagagagcaggcaagaaaccuucaucacaaucccuucccacagucagucugggcucaaaucucaggugaccuugagccgguuacauccaccugugccucaguuucuucaucugugaaaugggaauauucauaggguuauuuuaagcgucagaugaguuaauacaaguaaagcucucaaaacagugccuaacacauaguaggcacacuuuauuauuauuauuuauuauuauuauuagcauuaaaaaaauuauagucuaguugaugacaaacacaaacaagaaaaacaaugccuggauuccucagccuguagguauuaauggggucucuaaaaauccagauuucacugacucguggccuuccuccaugucuguauaacccuaagacuucaguucucuauaaaauccccacaaaauauugcagaggcaccuacaggauggggaggaggcaguuccccugcacuuucuaacugcccugccagcucuccugcccucaucccucuggguguucccugcacaaagccgcugcagguggguaacucaccaggccucugcuguaggcacccucucuagccccugaaauggcccagcaucuccugggcgcccaugacccuggagccagauggauugucugcucaucccccugcugcaggcugcacuugggaucugggucccauagcuccacugccugagcccugugcacugcgugccccuccccacucacacgcaaacagcucccccagcuccagucugcagcccuucccucuacagggccaggaaaggccaugaggacaccaugccacccuccucacccaucuuucuuacagagcccauuguuuaaaguaauuuuuuuuuuugagacagucucacucugucacucaggcuggagugcaguggagcgaucuuggcucacugcaaccucugccuccaggguucaagcaauucuccugccuuagccucccaaguaguugggacuacaggcacccgccaccacacccagcuaauuuuuguauuuuuaguagagacaggguuucaccauauuggccaggcugguuuugaauuccugaccuugugauccacccaccuuggccuccgaaagugcugggauuacaggcgugagccaccgugcccagccuaaagcaauuuuuuuaaaagaaggaaggaaaggaggaggagaaaagaaagcuuucuuuuagccaaaauaucagcuuacuuaaagcccaccccacccauuccccagacauguccaguacagacccuagggagaaccaacuacacaaauaauucaucaugggugccugaagcauggcauauguaauacacacuuucggagguuaggaaaggguuuguucuccccaggaaaggcagcccuugaaggagaguuuggggagauggugaggaagaaggguugccacccgcaggguagggugugagcacacgcucccaggaccuucccccaaccccugcccuaacauucuccugcacguuggaacccacauugggaaagguuugaaugccaaacuagggaguaauaaugacaucauauuaauagcuaccacuucuuggaugugugggaacggaccuaaaugcuuuaccuacaucaacucuuuuaauccucucaauaaacccaugagacuguccuauuacuguuauccccauuuuacagaggaggaaacugaggcccaguugccuaagauuucauggcugguaggugauagaacuggauacugaacccagcaggcuggcuguaagcccauuuuucuccaccgcucccugcccugagcacuugagcgggcugccacaggcugagaaucacugggucuaccucuggacuuggcuaaacuuccugugcuccucugccaccucucucucugccucuccgucaaaugcucugagucaauuaacuggcugcccccauucaaauauuugaccaauauccuggaaacagagauuucagagcagauauuuucagacauucauugaagugaacaaacauucuggcacagaacgaaauuauugcucaacaucugauucuguugggcugugcccccaucccagccuuaccccuccccaccacuugaaggcauuucuuuuugggugcaagguggguggaaucaggcugcuucugcuuucuaucucacugccccuccuacccccuuugacugccaguucgugaggaucuccccgcccucacuuguaggaucacgucauugaagcacuuuugaauccauaaaggcagaugcugaagggcacuucacaacgacguccggcagaccaaggauuauuuuaaaggggcuugugacuaguuuuucuuuauaaugacagugguaguaccaaaugucagcaaaagcaauuuaguugagauugaaaggagcacuuugcaaaugaggauuugagucccugggaugcuuucaguccucuuuagaagucuguaggagcugggccugguggcgagugccuguaguccuagcuacuccagaggcugagaugggagaaucacuugagcccagggguucgaagcugcagugaacuaagauggccccacugcacuccagacuccagcccgggcaacagagugagacccugucucuaaaaaaaaaaaaacaaaaaaaaacaaaaaaaaacaccagucucuucucuagggacuggggaauuggccauucaugacucagcaugugguuggcaaggucuuaaugugccagcuuccacauggguggucuugaggagacagacaagacuauauaaauggaaacugaaaauguaaaaccaagccaccaagaagcuugaggauuugcuacagagguaaacguaugagaaaucgcuccuccaucacagcauuugcugagcggcuggugcugucaguaaguuccugggggagaucagaggaggccgagagggcugagggcuggggcagaggcgaggauaacagcuucacccgaaugcugguuccccaacuguaagaugauacucccaagggaugauuuuaaguggugcauggauggggcgugaaauaacauugaaucacacaaagagacgguuauuccauucuugauucucuuacagaauuuccauuucugucaguucuacccaggaaaggguucaguugggugcucaugucuuuagcaccucuucaacugggcucguguccccacuggacacaaggagagcugcuggagccuucagaggccaagcugaugcagcuaaccauggaggcaaacgacacaggcucaucuccccauguuacagccacccucuacacauggcugaugaacugguucuccaugugugauacccuuaaagaguuuuuuuaagaugauguuuaaaaaaauuaaagaaaacuacuaaacaaauaauaauagaaguuucauacauauauagcagaaauugggaggcuggcauccacaugacugaagaucaggcaaugcugauguaggagucacuugacuugggccuuuccuugacugacuuuccuucugagagucaccucaaugcaugugaagggcucagaacagcuccuggcccagggcaggugcucaggaaaugccagcucucuguuggauggaauggcccuuggaaauggggugcacuagcacccacacggcaauguuuuuggcgcugcugcugggacugagguguggguugguuagguggcaaggaaagcaucccaagcaggagaggcugugaugagcaaaggcuuagagggaggaccaagaaacauuuaaaggacaguggacagacggaucagacugcagaaagggaaagaugaagaugaacagacugaccagacugcagaaagggaaagaugcaagaugauuugaagggucuugggccaagcuaaggaguguggauuguuccuuucagggcaucuguguuuacaagaacccaagaucucucaggagcucaggaaaaggggcuugcugugaggcucaggguucccauggacauucugagcugacccuccucagcauuggaucuccuggcucaggaacuaggaacgaagcuuggauguuuucuccuuuccuacagcaucuguauucauuuccuauaguugccauaauaaaaugccacuaacuuaguggcuuaaaaaccacagaaguuuauucucuuacaguucuagaggucagaagucugaagugaggcuuaugggguuaaaaucaaggugucagcagggcugguuccuucuagaaacuccaggagauaaucccauccuugccucuuccaccucuucugguggcugccagcaucacuuggcuugugacuguguuguuccgauccccucuucccuggucccauugccuuguccucuccuguagucaaauuucccccugccucccucuaaugaggacccuugugauuacauuuagggcccacccagacaauccaugcuaaucucccauugcaagaucuuuaaccaaacuacaucugcaaaguccccuuugccauguaaguagcaugcagagcuugcagcguuucggaccugggugcauuugauggccauucuucagcccaccauagcauccgugcccucucugagcaucugccucucucuacuggcucccuuacagucucaccugggccaugaugucuacacugccucuucuucgcgccgcucuugaaaugcccuuucagcugcugucccagcugccaagcaccucuacacucuaguuaucccauucugaguuuccuagaggggucagauuggccagcuuaccacuacagcaguguccaccacaagccgugggagcuggcagccugagaugcuguccccuaggcagccgguacaggagagggugguggggccaugcguggggcaggccccaaauacaucuaguacacuuucaaagauagacagacugaugggacagaauagagcucuuagaaccagacccagauauaaauaugggaacuuguuauaugauaaagguggcaccgcaaaucaccgaggaaaggaugacuuguuuaguagcugguguugggaaaacuagcucaccacguugaaaaaaaauaaagcaagaucccuaccauacaccauauaccaagguagacuccagauggauucaagaccuaaaugugaaacguaaaauauaaagcucauaaaaggaaauguggggguauaucuucgugaccuuguaguaggaaaggacuucucggcacccccggagcacaugccauagaagaaaaauuguucuacgucaaaggaguuccaauucaaucagaauauauagacaaaguuaacagcaaaugauauauggggaaauuuuugcaacaauuaaaaccaaggaacuaauagcuagcauauauaaggaauuccugcagaucgagaggaaaaaguuggaaaauccaauacgaaaauaagcacaggauauucauagagugggaaaccccagugacugguggacacauguaaagaugcugaaaccgacuaaaaaucaggggaacgcaaaugguaacugcagugacuaaccucuucacaccccacauugacacaggagccaaauccucccuguuuuugugcagccugcaagcugagaauggguuuuaaauauaacuauuuuuaggccuggugcaguggcucacaccuguaaucccaaagcucuguaaggccaaagagguggaucacugaggccaggaguuuagaccagccugggcaacggaguaaggccucaucuccaugggugugguaacccaugccugcaguccuagcuacuuggaagguugggaggauugcuugaccccaggaguuugagguuacagugagcuaugaucaugccauugcacuacagccugggcgauagagugaaaccuuuucucuaaaaaggauaaaagaaagaaagauaaguauuuuugccauugaucugaggguaguaaacaugaucugugaacuccaguuaagcaaaauguuaucccccaccacaaaaauuccauucuucucauuagcaggacuguaguauaaaaaauugugcucaauuauuauuauauuuugaauuccucaaaaauguuuguggaaauuuguuuucuuucuuccuuucuuucuuccuuccuuccuguuucuuucuuucucucucucucucucccucccucucucucucucucugucucucuuucuuuuugacagaguuucccucuuauugcccaggcuggagugcaauggcacaaucuuggcucaccacaaacuccgccuccugaguucaagcaauucuccugccucagccucccgaguagcugggauuaugggcaugcaccaccacaccuggcuaauuuuuguauuuuuuuaguagagaugggguuucuccauguuggucaggcuggucuugaacucccgaccucaggucucugcccgccuuggccucccaaagugcugggauuacaggcaugagccaccgcacccagccugcuuucuuucuaguaucaacauaauguccuugauuuggccucuugaccugcaaaguuugaaauauucacuauagcccuuugaaagaaaguuugcugacccccacacacucugcaucaguuagaagccacaugcuaucagguugaaccauauaaaauccccauuuucguagugacaaaaugauuuaaugucagcaauuuguuaugguucaaauucauagacauauauauacagcaaaauagauuaauauuuaauuuacccacagggcaaaauuacugacaggaugugccaugagaaagggcucuggcauuaauauacugagauaucagccaagggcuugggaucacauagguccaaguuuaaauccuggcucugaguucagcuuccuguggggccuugacaaaucaguucuguaaauagaguucaaaauaccuacuucgaugaggcauugcacagcagugccuggcauauaguaagugcaggguaaauuacuaucgaucacgaguucauugacaucaccuagagaaaauggcugccuuucauuguaccaucuugaaagaaggcugcuagggaaaagcagggaggagccucugccauccuauuucucuaauuagucugcccguuccccucuuuuccaucuuagcgaucuuucuguaucccuccccuccuuaaaaacuuaucuucacacucaccucccccaggaagccuucccugaccacccgcuugcaucaucuacuuaacugacaguagcagguuugucgcccccauucuauuuccaaugcggagguucaugcuuacuccaccauccuuggacccugugcccaggacagugucaccucuggcauggccaccugguuggccugggguucacaaguauuugucucuuugacauucuuuccuuccccccaugguaaccacugaaucccugggaaucugcaggucccaaacacacggcccucacaacccagaaaggagccauccuuucccaaggggcaucccaagcaccugcaggggccuuccccugucauccgccgagacaacgcucugcgggagucauugccucccacuguacccugagaaccagaggcccagccuugauguggccugccugggacugcccagguuaugcguggcacugccagcaauuggcaccaaaccacccacacccauauccaaggccuuucugucacaccccagccacuuucaagcccagaggugaccacgugacuccaaugucccuccugugaaauccuucucuuucucuuaccucuccagggaaacugaagcccacaccaacugacuuuccuccaugguccgugugacucagaacugcuaauuggggcuuggcucugggcagcccccucugugauuagcacugguuuucccuggcaccaaggguggcgccuucugccuggcccugcucagggguggugggaggcacacaccucagcaguggggagagacuggccuacagugagagaggaaacaagccccuugaaccccacuuuuuugcagccauaauuaggaugucggugggaucccacacaaggaugucaugcaaggcccucucucgagguugcaucuuacacuuacaacaagcacuaucaauauccccauuucacagauaaggaaauugaggcucagaaagguaacauaacauguagggucaugcuaggccaagaaguggcagagccaggauucgaacccaggucugcaugagucugaaguccucagggaccacccuccucauuggauggucaugacaacccugucaugugcagacccugccucuacuauuuccaucacacagauggguaaacugaggcucagggagcucaggaaacucaaggccauaugguugguaaagugauagauacuggcuggccccugauccagccuuuauucgguccacuguacacagacccuucccuuccacgccaggaccccucucccuccaguguggcagcaugagggguaaccaggagaggagcugaggguaggguugcucuggacagacaugagaagcagaugggaaugggucacaaaguuguuggauaggucacaaagggccaaguugcagaaagugcuggaagccagguggacuugccguguugggcaggggggagcacguaggaucuuacaggaggagugaagugcugaacuggcacuccacaaugccccuugcccagcccgccccagggccugccucccagccccgguccccaccuccccgcugcccggcacucccuuccucccucccagguuggggacauugggccacugaggucaggucuuuguuugaaggacagauaauuaaucccacaaaguaauccccagcacacucuggcagauuuauggaggucgccucuguccugggaacucugccucaucaucuuucauuucccaggcaaagugacugacuuguuauaucauaggccccacgccaacaggaauuucauuuaggggaguucuccagguggaaggagauugauaacccaggccugggcaggaaccgauggcaguccuggggccgggaggguggggagcagagcaggcaucgccaccuccucuguccccuagcuggucuccgucuuucucccaacauggggcugguuucauggaccucaccugucacaggccacagggacccggauaucauccaguugagccuuuccaagccccaagaugagaaagcagaggcccagagcuugagaaagggacuguuucccaccuggcucuuggggcuacucugccccagcuguccucaccauuacuucucccuccccacuccccaccucauccgcccugaagcugccacagguacagggcugucaaggacaggggcaggggcuccucagagccugcuguggugguccuuggaaccuaccucccaaggaggcuccuuucagugcaggagggcaguagggauuggcaggaccuggcagcucauccaccaagcagugaggaaggagagguguggcccugggggucaggguaguugcuucuggucuauuggcucugccuuuagcuugcuagacaguuuaauggcuaccauuguccaccuuugcaauacaggacuuuggacuuauuugauaauucauaaauauuuaucaggcaccucucguacucacugcuggggauauggccaugaacaggacagacaaaacugucgcccucagagccucucuucuaacagaguguguacucuguuguauccaugaucccgccccacccccacccucaaaggcgggguaggcccaggcugugggcaacugggaagggaggggagggccuggccauagcacagagaguagggguugguguggcaauguguaggcaggcaccaguaccagccuugccaacuuggcagcuccacgucgacagggaccaagcaugguggggcuggcuccuuccugaggcuccacccggccuuucguaauuaaagccguaagucaucuuccgacgggagccuguaggcuggggaggccacagcugaccuugcuugggguuuagugcugggagggagagugaguacaucugggcagagguuuguagagggagcugaagaucaaaggcugcccucuguucuggccuaggcuggggacaguguuugggcucugaggcucugcuuggugccaggagcagugccaagagcuuccuccacaagcaaagagguuacuuccucuuuucuaugagugcugagucucaagcuugcaaacaccccaagugacgccaucugucuguagcaggacccuuugcuccgggcccucuccaggagggccuaugcccagaguuuggagugggagugcuauaggguauccacugcuuuggagcacuucccagagagccugccuucccuccugccgacagacuaggggucuguaacccagaacagcugauggggaaggaggcagggccaggaacccauguaauugagaaggacaccaggccacgcaucuguaggguggcccagugggaaagacccaaaagucgcuccugugacuucucuuuuucaaaaaagcggccagaggcuuuggaaagauuuggguuguggagccuccucccuggucgaaaaggcaaggacgucucucuuuuuccuguuucucgcuugcucagcagaaguuucugccugugugagccaagggaugggagcgucuugggacaucccucccuaucuggcugggcucauucaucaagcauucucugaacgccuacuugguguggggcacugggccaagggcuugggacauaauaugacaucuggggcugagccuccagcugggaggaugagggcauucuggaggcaggcugccgggaugaaauggccaaccacccaccccaccccacacuccaccccacaucccagcccgggaccccuggccuuugucagagaagcagggccaaguucacuggcaaaugugaaauauuaaauauuuagaaaaguacagaaaccaacacagcacacccccauguauucaccacccugauaacauuuguugacauuuugccauauuugcuuuggaucuuuuuugcucuucuuuuuguucuuguuuaagaaagggaacauugcagcuauuguugaaggcaccuuuucuuugauuucaaucaucucagaggccuguucugugagcgcugagcagaaaagguaaaaaccucugauccugacguuggcuucaaaaauggcaucccugacuugaauguggacugugucuuaggugacauugaggaaucauuuauuuuauuuagggugaaaauggcauguuuuguugcauuuuugaaaguccuuaugagagaugcauacaguauguaaagaugaacugggauuuccucuguuaacaccgugaaaaauugguaguguuguggggggugauuuuaagauaagauuggcaaaauuuugaugauuguugcaucugggugaugguaccgagagcuucauugugcucuugucucuacauuuguguuucuuugaaauuuuccauaguaaaacuuuuaugugugguccccaaagcuucucaaagcagaccagagagccacaucugaccuguggccuggacaggaguccagacuugagccagacuucugguccacccaucuggugccaguucugcuucuaacgugcuguguguuguugaccaaguuacuucucaucucugauucucacuucuccaggggaugaaggaaaaguuggaaccugcuaggcuuuaagcaucuuuccauuuuccaccucugacacuugacacaucuaacuuguaugcucagagacuccacuggagggaaacugugggaauagucccauuuacaccuucaaugucuuuccuuuuuuuuuuuuuuuuuuuuuuuuuuggugagacagaguuucacucuuguugcccaggcuggagugcaaugaugcgaucucggcuuacugcaaccuccgccucccagguucaagcaaaucuccugccucagccucccgagcagcuaaaauuacagaugugugcuacuacacccggcuaauuuuguacuuuuaguagagacaggguuuuaccauguuggccaggcuggucucaaacuccugaccucaguugauccaccugccuuggccucccaaagugcugggauuacaggcgugagcgaccguacccggccacaccuucaauuucuucaguggguuggcccacugaugcuuuaggagauaagcuuugcaaaaagggcucuguggucaaauaaguuagagagacacugcaucacaauuuccuugugcuggcaaaucacaaugcccaugagcacauuaaaggcucugacaaguccagcagugaagaugucuguugagcauuucccagauuuguuugaccgcagaacuuuuuuuuuuuuuuuuuuuuugagacggagugucacucugucaccaggcuggagugcaguggcacuaucucagcucacugcaaccucugccucccggguucaagcgauucuccugccucagccuccugaguagcugggacuacggacacgcaccaccacgcccagcuaauuuuuuguauuuucagucgagacaagauuucaccguguuagccgcaauggucucgaucuccugaccuugugauccacacgccucggccucccaaagugcugggauuacaggcuugagccaccaugcccggcagaccacagagcuuuuaaaaguugaccuuuccuauaccccaugguaucagaguuccuggggaaacccuggccuuucuguuuucagacugggggcucugacucuguaggacaaauuugccaucuuuucucauaaauaugaugacucugacucauacucacucgaacccaagauguuugauguuuuccacauugcugaguggguuugugcuuaaccaaaucuguaguuuuuuuccuucagucaugcccugaccagaaucaucugcuuugauguuauacucugagucacugaccaaaugccggaaaacccuccaacauuaggaaacugggccuggcacaaucugcauccuuucugguggagccuucuagaagcauuguuucuagggaggaguaggagaaggaauauaggcauuggcauuaaaggccauggcuucaaaucucagugcgaccacuuacaagccuuaugacuuuuucaccucuauccucaguuuacuaaucaaugaggucuaacauuuguugagcaucugugaugugcuggacacugugcugaacuaaguaggauuauuaccugcuuuuauccucacaucagcccuauaagauaagaauuacuccuccccuuuuuaugguuaaagaaacgcaagcccagagaggguagauaacuugcccacggucacacagcuagugagaaguaaugcugagguucgaacccugguccuagccacugcaauaucugcccuuucaaaaagaucagaucucccauggcaucuuaaaacugaaaacguccugggaaucuccagauucccugaaccccaucccucagggcccccuuggaggguaacggggugcugggugugcuggacuccacaccccgucaucugcuucagccagggcaacuagcucugauuuuggcuguuuucuauacuggagcucugugugaaauuuugucugauacaagaaucugcuacugaaacaaagacauuugaaaaaccacugccauggaaaagcccccucuuuuuuaaacaggagaaaacccugaggcccagagaagugaagugacuggcccagggucacagcugucuucugagccccaggcagaucucuguucucccuucaggcauuggagcagggccugggcugggugggcggcggaggggggggggcucugcagcccccaggggaccccucaaggucggucauucgggcugguucagccagcugguggccaguuucuaugaagauaacugugucugaggcuggcucccugaaccucguccgaccacaucuauuucugggcugcagaguccugacggagcacaauuugauucauaaauuacccggcucaaggugugugugauggguucuccuuccacagauuugaaagucauucacucuggaacuugcagcacuuggggcgggagggcaggggcagccguggcacugucaggauuaguguucauggaggaaagauggcagggaagauggagagggcucggacaaucagugagagccgcucuguaccagcucuguucucccagcagccccaggaggcagagucugucagugucccucuuuggcaagugaggaaacugaggcucaaaggcaaagucacuugcccaaagccacauagcuagaaguaguggagcuaggauuugaacucaguacccucugaggcccacacugcuuccacaugaucucagugaugcaagacaaaggacugaacagauggcaguuggagggggaggcuggacccugggcaguaggauuuggagggaaguuucaggggcaccaacccucuuugucccacaaacuucagggugcaccugucacugccauugcaccccacccugccccgcucugcccaucuuuccugcuuaacgucauccagucuguggcacugcacagcuccaccugccccaggcacccaguucaccaucuuugacgcauccugacauggguucagcacuuuacaguuuguaaagcaucuucagauuccuuaucucacugaaccucuaaacagcccugugagaggggaagguauucucaccuccaaagaggaaacugaaucucagaauguccacaagccccaaaugaugaaaccagucucuuaaauucacauccacuccuuuaugaguucuccagucggcuuccucauacaugugccuuguccuuccccgaagaugaccaaucuuccccauuagacggugggcucccuggggguaugacccaccccauaccugguacggacaggcccagugguagauagguggucucugguguccccacuucccgagaagcuucaucccugggcccaucuuucccaugucccauugcuggauuggagccagaggagggggugacaacacguccaggaugacagacagcgcgugcccccuccuccugccaugggcuuucuucuccuugggcgucugaucaccguccucuuuguuuucuuaagugucucucccacuccuuccucccucccccuccuucccugggacaaggccuuucagaucaucaaauaucaaacacugcuuaugcacagacugagauggcuuuaucggggcuguaaaucucccugugcccugaccucucuugagugccaagccucgggugaguuaugugggcccugcccagugacaggcagaacagacagccagcccucugggaggcacaggcugggggaccuggggcaccuuggcucccacucuuagcccaaggagagaccccaguugaagggaagcauggguguuugggccuaccugccccaggccccggagguaaccgggugccaagcaggcagcagggggggccuccuuuuccugcucuccuuuuccucaccuugcucaccuccuggccagacuccgggccccagggcugagggagcaccagucccacacaggagaggcaaggcccauggcagccaugagggcuaugugagacccaaaagacccagguucuaaucccagcauggucacuuaguaaccauguauccuuggacaugucacuucaccugacagugccucaguuuccucaucugauaaauggguagcagugcuggcuucacacgguauuuuguggauccagugaggucgugcaugugaacaaacaugugaagcgcuuggucaacaggcagaagcacgcaucuuccccaucucucaggggcaagcagcauguggacuaagccuguagucucuagaggcagacaggcuggccuggaauccuggcucugugacuggccaguggugugacuucaggcaaaucauuuaaucucucugugccucuguuuucucaccuguaaaaugggaauaacaauaauaauggaaggccaggcaugguggcucaugccuguaaucuaagcaacaugggaggcugaggcaggaggaucccuugagcccaggaguuugaggcugcaaugagcugauugugccacugcacuccaggcugggugacagggugagauccugucucuaaaaauaaaaaauaaauaaaaagaauuuuaaaagcuaagaguggaauaaugacgaugcccucacaggaggaggccuugaggaguagcugaccaacucacaugaagugcugagcaccucgucugccacgcagcgggcccacaagaaacgucagcccuuguuauugccccuuuucucucugccaucacccaguccaugcccucgucaccagcaggcuuuccugccuccagcccaaccccugcaggagcuccucagagccagacaaaaauccaaacugcuuccuccucugggcaucagccucuccugacagcuuccugugaacucucugcuucuccugcuggcuccccaccugggaagccauggucccaccuccacccuuuugcucaggccagucuccccagcaggagugcccucuuccuccauacuuaccccagcccugcccuccuccuccagccuccugcagaaucuuccagggccuggcaagcugcccucagcaggacugggccccuuuuggcacagguccuauuuccucaucuagacuagaugccacuuggaagcagagaccucaccuuuccagugccucgcagcuccucugugagcaaauuccuuccuucauccuagcugauguagcaagaccagggcgggaaaggccccugcccucagggagauuaaaucuggugaauuguuguuaguaauugugguaacccagggagaggaagaauuacacauuaaaaugaaucaguuugcaaagcagccugcaucuagcaccaacuuggaacacaaagacacacaccaucaaacacugggggguauuuuggugcaguaaaauaugaauaacguaaaauuuaccauuuuaaagugugcaauuccgcggcauuaauuacauucacaguguuguacaacugucaccacuaggaaguuguagaacuuuggggauuauuuuuuaaaggaacuuguauugaccuuuuuuuuuuaaaaaaaaaaagaaagacaacaaauguaauucagaucaaucaaaagagaaaguugaaauggcuggagcaaugguucuucauuggggcgauugugccucucaggagacauuuggcaaugucuggagauuauuuugauugucauaucugggggaaagugcuaccagcaucuaguggguagaggccaggggugcugcugaacaacucacaaugcacaggacugccucccacaacaaagaauuauccagccccaaaugccacagugcugagucugaaaaccucuguccuagcacuaucacucagauaaucuguguucacauuuugcuaacauuucauuccuuuuuucuaugugcacauuuuuuaagccaaaaaaaguaucuuauggaacugugcugaucauuguccuuuuuuaaaacacaucauaaacacaucuguuuuuucaaguuacaagcaucucuucugcaacguuuuaguggcuugcugcauuucauaucauaacuuauuuaaugaauccccuauuguuggacaucuagguuaccuccaguuuuucuuacuaaacagcacuauggugaacauccuggugacugcauuuaugggcacauucaugauuauucccuuugaagaaauucucuccauggcaguguaaagguuuuucaggaaauagguucuuauuucagccauagucccuggugaugucuuucugguccccaucaaaacauccucagaggaccaggggccgccucucugaggcuuuccauuuuacagggagccaugcacagugcauugcuguggguggaagaguguggcuugacccuuagcaaacuggcaugauagauuucacuaucuuuggcuacucaaguuaaugcuucauaaacuggagccaguuauuagcaaauuaaucaggguccaguuuguagccuuauuaggagagguuauaauuuguugguuuaagugagcuugauaaaaacuguugugguguaaaaugccuguaagacaagcggacugccguucacaccuacuugagggacuggaaguuugucuuacccugacuggacaguaauaacuaauuaacugagauggcucagcucaaacaaacauagcacuguggcugcaucaggaggguauuacagccccaacuggaauuacuaauuggcugaucccuccucgugggcccuagugcagcuguggugucuuuaugaugugugacaucaggagucaccccaguaucacucugcuccucagccuuuuggaccagucucagaguggcccucagacauuccugcuguggcccauucauccauucagaaaacauugauugaucaccugcuaggcaucugcugggcacuuggggaaaccaguccugcccuccuggggcuuacauuccaguagggagaaacagacaauaagaaacacauaaacagauggaagagagguucagaaaguagaagugcuuugaaagaaauaaaagaggauaauggagagagagugacaggggugagggugggaagguggggguaacuggggaggaaucugaggagugacauuugaauggaggccugaaugcacacagaagagaccugcaggaagaggcuccaggcagcuugggaagcuuuggggaggggcggucuucccccaccccgacugacccaggauccuuaugcggcagcagacucucggcaggcugguccccucuccugguugaaagccgagguaacccacaccgcuggcugccauauguugaucguggggcuguugaauguagcccagcccagaugccauccaggaugcaggccccuuuugucaucaggcagcuaaguaacgauuuuuaauucauaagaugucuugcucaaggcccauaucucauacugacucccaauuuucauuauacagugauacaacucuauaccagucagaaugauauggcuccgcuggacagcgaugggccugcaagccagccugccccaggggcgggggcuuaggcugcccacacacagcugcuuaaugggcuacaccuggcagggaagacaggaagggccaggggccucugaaugggacaugaacucuuuagcuuccuggaagcugaguuuaauuccuugcucuaccucucacugccuggaugaucgagugcagguuauuuuuaaccucgcugugccucaguuucuuccucuguaaaaugaggauagugugucugucucagggguuuugugagacugaauaagacaugcauacaagacacuuugcgcagugcccagcacaaggucagaacucaaucuauguuggccauuguggggcaugccccucacaacucugggugagaggggccacagcugggacuagcuugcucugagucuacuauuccgaaaacagguauggccaggugugguggcucacgccuguaaucccagcacuuuuggaggccgaggccagaggauugcuugggcccaggaguugaagaccagccugggcaacauggugaaacccugucucuacaaaacauacaaaaauuagcugagcgcaguggugugcaccugcagucccagcuacuagggaggcugaggugggaggaucacuugagcugaagagguuaagucugcagugagcugugaucaagccaccacacuccagccugggugauagaacaaaacucugucucaaaacaaaaggaaagaaaauaaaagaaaacaggcauggcaggaaagaagaaaccaaaguguccaccugcuacaugucaggcaccacaauaagugccuuacguacaugaucacuccugaugcucacacagccuggugagguaggaguuguuauccacacuuuacagaugggaaauuuggcccaaaggaaugagugguuugcaggaggucucacaacugguaagugauggagcuguuguuggaaccuaggucuuuuucacauccugcgaguucaugcucaguaugcggucuucaccaggguguugacguaauagacuccaggcacagaccaugacuagaagagagaccauuggaaggaauggaagcagaucccaguucugcucccuucccuggguaaggucccugacgcuggaccugggcagggccaggugaccaagucagaggccacaguggagaucaggaucgcacaggucaaucucauccagccuccugccuccauucagacacugccauuuaaagagauggcugcuuaggcccagcuccuaagaucccgagcuccucauaagccauggcuuuuuucuucucuucucuccccugcggccccaacacaggacuaggccccaaguaugccgcugccucuuacauacugguugacccuuuggaauugcugcagagggaggaagagaaacuucaggccauccaacaaauauauaaugagcgcuguucuggggacugccagagauugcagcaugagaccccagcccuuauccucaaggccacgcugggucuccaggcaugagaauuaaagaagcgcacugcacagggcagcugccucgugaguucugagcccagcacucaagggcucagaggagccagagguggcagagccuccaggcgagagaugcgggugggcuuccuauagcaggugauacuggaccuucagaaagggcaguucccaggccgaguggggagccuuaggcuuuccuuuaacucugagugcagaagagcagaggcaggacucaggggcuguuagcccagcggagcagacaaagcaauugaaagucaucagccuguguucccgcacgcaccaucggccacucacuaaacugcuuuucgcccagacccagcucugcugugguucaagaugcugccagugagauaacaaggggacaagaugugggaaugaugagauuuggcagcaggcaggaggggcgaugcugcagguggggcagggggcgugaagggggguagccuuccagccuggaggaagaaagagguagggggauaagccuaagcucccccugccccacauggcucgaagagagagaacugccccgccccaacaucagaccuucuacccccugcugcagccccucccaguccacuucucucucccucucccucucccucucccuccgaccaccuagaaaacagcagaaguccuuugcuugacucugcggcgcccucuagcugccacucagccucuugccuuguuuuuuacaccaaacucugggcagcagcaccucaggaccugugcucacuguccccacaucccugccccaccgucccucaguaucuuaaagucugacucuggggacaucugaagacccagucaguggccuuugccagaccuuccucuuccugagcucucugcucuaucugacccugcagaccgucucuuucucaagacugccuccuucccugacucugggcacccggcacuaggcugguuucccaucuaccucucuggccauugcuucucugucuccuucacuaccuucuaaauauuccugguuauacucguccaauuauacaugugccauaaacagcagccucgccuggugcgcuuuuucccagugucugacgaacgucaccagccccauugugcugacagcucuugucucuugccuuaccuucccccaccaguccccaugguaggccaccuccccagcuaccuggaagacaucgcaacauggacauucugcugcuauguaaaacucuaccauggaggaauuuaucuagaacuuuccagaauguguaaggacucccccgugugugugugugugugugugugugugugugugugugugugugugagagagacagagagacgagagagagagagacggagucucacucuaucacccaggcuggaguucaguggcaugaucuuggcucacugcaaccuccgucucccagguucaaacaauucuccugcucagccucccgaguagcuggaauuauaggcaccugccagcaugcccggcuaauuuuuauauuuuuaauagagauaagguucacuguguuggccaugcuggucuugaaaugcugaccucaaguaaucuguccaccucggccucccaaugugcugggauuacaggcaugagccacugugcccagcccuaggacucccucuugaggaagaagccacuuuguugacacuccacucuaugaaggaugaugaucucuuauuugccucauccuauuuccuugccccauagcacagggccaggugcagaaugugcacaaauguguggaaggcgaaugcuugcagggagagaaaaagaaauguaaaucuaaguccaagcuggccacuugcuagccaugugaccuuaggcaaguuauugagcaucucugagccugcuuucucacacagaagaugggauaucuucuuauaaggugguugcaacgaauaggugaugugauugugcaaacagcuuagcucagugccugguacaugguaaguguuugauaaguaguggcugcuacuuuuuaauaaauaggagaaugaaggcugcaauccccaccccccgaccccugcccagcagccuuucacacaugauucauuccucccagccucucucuugcaaaucugaaaaggucuugauuccuggagcuccuagaggagguggcugcccccaggaaaaccagcagggccaguaaugaccugcuuuuuucuuuugugaucaauuugaaucaccaguucccagaauccuuacggugguaaaagugcagccaccaccccaccccaaaaccccuccccuaccagauacuccccgacccuggaacucaggacagcaccuguccacccaggggaagcagcugcccuucugcucagcagaaguggggcugaacagaugaaaggcuucccuggugagcgcccccagccccccagccccccaugggaauuggaugaagaaugucugggagaccagaaggccgacacggagguaucaguuuccaggagagcagagaaacuugcauguguggcugccaagcccacagcgccuguggaggggaggacguggaagugagggaagaagugaagggagcgaggcagggauguggaguuccccuccgcacccaccauccugaaugaggggggagcagaggucagagcucuggguucagggcccugugugugggccugaggguuuuguucucagccucaguucagggcagccuguaaacacuagcucucuguggcgaggcucuccuggcaaaagugugggguuggcucagugucacugcugggaaaacagcuguaggcacaggcugcuggggugguggggagagaccauggugguaccaucuugguaaagcacaggcagccaacauuuguugggaguuuccuguguccccagcacuauauuaacuuauuuaauccuuaaagugacagccugggguggguucuauuauugccccccuuuuacagaccaagcaacugaggcccacauauaagucacuugaucaaguucacacagccaguaaguagcagacccaugauuugaacccgugcugucugccuccagaggguguaaucuuaaccauuucuuuuccgaauugcuuuucuucaggggccuuagcucagcgaguacuuacacuuucaauugugugguuuuaucaugaaugucugucuucacagacaauucauaugagacugaaggcaucaaccuugccugcuuuucuuuaccgauucuccaacaccuugcgcauaguaggugcucaauaugaacuugaaggaaugagugaauuaaaaaaaccaaugaaucuuugaaugagacgugcccuuggccuuuccagcuuuggaggcagggcucaucuccugccccuacccaagccuagcagcaucccagagaguaccaguguugcuauggugacaguaagaacaucuuaccgagcaucucacugagucaguccucucucagguggccuugucggcucccuagguauagcucuuucuggcuguuggucuggggaguuaaucacucgugcuuggcaggaggugggaagguguacuccaugcaaacagaugugugaaaaagaaguguguguguguguguguguguguauguaugugugucuugaguuugguugaauguggacugugugggggguacuugccugcagguuuguuggagaagguugccuaggucggggcauggggugucuuaugugcuggggacagaugccggguuuggagugggcaguguguacgugaacggggcauaggagcugagugaagaaauacaagugaguguuccaggguugaaaacccuguuuuucaaaccaaaaaugaaagcacgucauucaacaaggggcuucagguuugugaaugauuuauaagaaaaaucucacaaagauaaaaauugaaucacauuuagcuaaacauuugauaggcuccuuuauuuaaaaaaguaaauuuauaugaaaaucuggaaugcugggaugcugucugugggggggcuggggaggggaccccugccugugaguguguuggggcaggagugggaggccggaggcucugaggucuugccucagggcagcccuucagcugagccuuaggggcucagaggaccucagccccuacagggcccugcacugccucugcuucacccagccucagcacugaucacccuguacguugagugcuguggcccccauuaaaauguaucgccauuuguuuuugagacagucuugcucugucgcccaggcuggagugcaguggugugaucucggcucacugcaaccuccgccucccagcuucaagcgauucucaugccucagccuccugaguagcuggaauuacaggcaugcgccaccacacccagcuguuuuuuguauuuuuaguagagaugggguuuugccauguuggccaggcuggucuugaacuccugacuucaagugaucugcccaucuccgccucccaaagugcugggauuacaggcaugagccaccgcgcccagccuguaugcucauuagagaagcacaauaacuguuuguugaaugaaugaacagaugaaaacacacaucucguuucucuagcagcaaaauucccagcuaaagaaacucccuucuaucauacauuuauaugccuccuugcaauccuguccccccaacuccccacuaugcaaacgcagccauacaaaacccagcaggaagugaccuaggagucuccauggcugggaaaggaagccuuaggcaaggggauagcuacagugacacccccuccugggcuggccccauguuagagauuccgaaggcauagacugauagacugaguucuaaacaggccccacugucugcagcuucugccuggccuugcccagcccauacaguggacugggaggacaggugagaguggccacuagccacuaacuuggguagaaguaagcugccuugcugaccagcacaggcaggugacucagcauggguuggcugagaauagcuucugucccaaagucuaaaguuagaagaggaaauugccccacccuugacuuuuucccuaguuaauccaagagaggcuaugagccucugcuacaugcagaucccuuuagaguuggggaaggggaagaccugggagcuacagccacuuccacggugauucugguguucaccugcguguguugaaggcuuggguauuaauucucuaacguggaaucgguguccauccauccucuuccucaguccugcccauucuccaggaaccaccucaaacaauaacgacaacacuacugaguccuuauuuugugccggggauggucccaaaguaauauaucuauacuuucacacuuauuuaauucucauaacccuguggggcagaugccauuauuaucuguauuuuacaagugaggaaccagagcacagaggguuuagguaaguugcccaaggucacacagccagucagugguccagggaauuaaugaccccuccucuauggagcuuuccuucuuugagcuuucccaucuguaaacagccccucccugcugugaacucagagaugccgauucugguggguaccagagaucacuuaccaggcugcaaagugcuuuggugucagaauuccuggcacgcugacaucugcaugcccaacaaugcccagcucagggccugcuauaggaaagccuaccccagagauugcugggugggugaaugaaugggagugagugaguaugugaaugaaccaacaaacugguuugugaagaagacagcagaguggaauugggauuuucccaggugaauucacaugugggaagggcauauaggcaaggugggggcccaugcaggacuggcccaggugaggaacaugccugccacugugugcccagcguuggccagguaccuuaagggacagucaugaaaggucuccaucuucagagggccgggaagggagauccaaugaacacccaauaaucaacuggggaacaguuaguuacaaaacaguggcuacugccuguggggaccagaaagggccagcuagagaagucaggacugccuuucuggaggaggagaagaggcuggcacugagcugggcagaggaugaggacaagagagaaugacagacacuaaaagaugaggaggcaggaaagagcauagugaucuggagaaacccaaggacgccagugugaguuucuguggagagaaagcagaaauugaagguggcagagggagagggguggguuuacagagacaucgguuugaggcaaguguggcucauagauaauuuuugccaguacuuuaauacauaucuuaaauuuuaauaaguacuuaacauaguacuuuuuuaaaauuaugucuuuaauuuacauuuuuuguaaaaggaaacuuuacaucacggucauaaauaaaaaauuagaauagaauauacuagacuagacuagacuagaauagaaugucaccauaaaaauaagcacaagagaaacaaaaccagguuauugcauccuggcuggcguccacucccuuuggaaggcucugagccugaagccugcucucucuuuguuaaaaaagaaaucaagcgagucuagagaaguguuaaagcauaguagcaccaaaccaagacuuucucccuggcugggucacagagaccagaaggagauuggaaaggccaugcuguucuccuucugggacccguugcugucugccggcugcuccauggacuccagggcucuuucuauuacucuugaaccagcauucauuucaaguaacugaugagucuuuaaugcccagagaggagcccuggccccagcuccaugccccccugcccccagcuccaugccccccugcccugugccuggucacaccugaaugcuucucucucuugcagggaauaccaacagcaucuuugcccuggacuacaucagcggagugcugaccuugaauggccugcuggaccgggagaacccccuguacagccauggcuucauccugacugugaaggugagaccugggugggcaccuucaccccagguagaggagaugccccuacucggaugccaaccuccagcaguguccgagggcuccugcccccggugguggcgccggaagcacuucgcuuccgugcucucacccugcacugccucccggggcugugcccagggccccaucaggaaggcacccacguuaugaaguuguaggugugcugggccugccgcauccaucaucaacaaccacacggguuggaacuuuuauccccucucagcgggaggcacacaguaggugcucauccugugguccuuccuuacuguugucccaggauuccaaguucucuguugcagccaccuggaauucuggaauuugccccauuucugggguucugucccacuuccaagugccaugacuuccuguuaagaaacagcaaugcagcagggagcaaugcaacagcaaugugcuggggucuccaccccaggaugugaggcagagcuacagucccgcacccgcugcagccgccugccacucacggucgguuucaauucaaaucagugacuugcagagccauucccugagaaacccguuuagggguauggauccugucugagccacggggggucuucccagcccaggccaucagccguugauugagagaaacggguggcccaaagacugaggccaggggcucugggaaggaggcccuuccagcgccauggggaggauggugcagcccagccuggcccuuaauugcuguccuugaccuugggaggcccugcuguucagguguggguuagccaugggagggcgugcucccaccaccauccuucccuccugucugcucuccugccauggaagugagguggucagcucuaccagagagagcugcccccuggucccagcaccccacugcgggacuugaacucaguuuuucugucuuuauauaaaaugugaggguguguucucacacuuggcugugaacccgaauccccuggaaagcuauugaaagguaucuguuccugugucucucacccagagagauucagauucagaaggcugacucagaacugggaaugggcacuuuugggcccauggcucuggcccagagacuggacacccagguaucugaaucaguccaucugugcugacccucagagucgagcacaggguucagcccauagcagaugcucaguuaagucuugauuaaccaccagcacaaacauucuuggccucaguuucacaaucugccaaagagaaugaagacuucccucuugucccucgaugaacccccagaucugucuuguccucccuaccccaucucauccaucugcugucaguccuaggauccuacuaccugagcuuaaaaucuacccuggcugugaauccuuauacaaguuacuuagucucucugaaccucaguuuccuuaucacuaaaauggggauacuaaugauaaaauccuccuccuggaguuguggugaggauuagaugggaucauucacauugaggcacaguggcuggugcugagaaagucuuugguaagcaagagcuguugcugugauuagcugccuucacuccggggugacugaucucuguccauagggcacggagcugaacgaugaccgcaccccaucugacgcuacagucaccacgaccuucaauauccugguuauugacaucaaugacaaugccccggaguucaacagcuccgaguacagcguggccaucacugagcuggcacaggucggcuuugcccuuccacucuucauccaggugguggacaaggaugaggugagucccuggacacauggcccaugcagacccaccacccauccagacccaccacccugccugggcuguucagguccucagcuauaaaauagaaacaaacauugcggcaccccacuccugguagguucugaggauaaauaaggcugaaaaaaaaaucacuagucucuacuuuuggauuauccccuacacccugcaaaaaacauguaagcacauguuuccauaugugugguuauuauuuagaaguuacauacaugaucaucauacuaaucuaguagggauauuguaaagcauguacaaaaauagcaauuuuaaaagguagaaauaaggccaggugcaguggcucacaucuguaaucccagcccuuugggaggccggcagaucaagagguuagaaguuugagaccagccuguccaacacuggaaaccccgucucuacuaaaaauacaaaaauuagccgggcgugguggcgggcaccuguaaucccagcuacgugagaggcugaggcaggagaauugcuugaagcugggagguggagguugcagugagcugaaauagcaccauugcacuccagccugggcaacaagaguaagacuccaucucaaaaaaaaaaaaaguagaaauaaaccauauguguauuuucacacacccugauggaucaucugcugcccucuuugggaugccuguacccguuuuugcuccuguucaaauaaugaccuuagcagaaagucuaauuccuguuuuugguguaauaaugaccccagcuuuuccacgugaagagugaaaggaccuaagugcuuuggaggggaucccgggccauaagaagaccccugcaucaccagggggucuacccuggcugggcccagccuuaaaaggaaguaagggagagcugcagaggaggaggcaggaggcucagggugggggcagcccccugcacugguccugacacacccugcaucacaggggcgggcguaggggggcagggcggcgaggccucuauucgguggggccaggucuccaucccuucaggacccucucagccugccuccuccccugcccucaccccuccuugcaccccaucucccugccugucagcagcugccaugcuaauaggacuucuauuuauugcugcugcuccuccuggcccacucugcucuggaauuccauuagguuuuccagccugaggugcuucucuucgauuacuccuugcguggggcugccgcgguggccuugcuccaggcugggcuuccuccaccguccucgggagagcccucucuacucuggcugcuuagccagugacccacccuguugacccaggagccccucugcccacgucucuugccccccucuggcagcuccucucaaccagacaugguccccccaaggacucagggcacgugggcaagucagucccaccaugugccugugugugugcucaagugugugugcacacguguguguguguguacaugugugucuccaucuccugcuaaguaaggcauuccauaccuaucugucugagauaacuaaaguaaguauugaucaccugcuguuuacaaggagcuauauuuagccucuuggggagccaaguauaacccaugguccuaggagucaacaguguguugauacaaauacaguacguacauuuuaaaacauauuuuuaagccgggcacaguggcucacaccuguagucccaacacuuugggaggccgaggcagguggaucacuugaagccaggaguucgagaccagccugggcaacacggugaaaccccaucucuacuaaaaauacaaaaauuagccaggcaugauggugugcaccuguaaucccagcuacucaggaaggugaggcauaagaauugcuugaaccugggaggcggagggugcagugagcagagauugcaccacugcacuccacccuaggugacccugucucaaaaaaaaaaaaaccccaaaaaacaaauuuuuuaauguaguaguuuuaaaagguggaaaaaacagguauaaaaacaaguucuaauauguucucacacccuaauggaucaccuuguaucccccuuuagggcaggcaccuccuuuuggagaugacuguaugaaugagaugcucagaagaaagucccaucugugguuucaggagaaccauaaugcccaagagaagagaaauguggauaccagcgugggguccagguccagugaccacaggcagugaggggucagcuguggggcugagaggaucaggagagguucuauggugagaggggccuagggcugcacccagaggcacacaggaagauuggcuggccacagcaggccauaauccaggcaagcaaggaugugugcaguggggagguaggccgggacccaggucucagagggccucaaaugccaagccaaggaauugaggcuugaucuuggaggcaacccagaaggaagacagcuugugugggggcagcacaagcucuggagucagacagggccuguguuucagccuggccuugccauguacuagcugugugaccucagguaaaguaaugagccucacuuuguucauuuguuuaaaaaaacaaauagaaaagaaagagaaugcauccaucagcuuauauugcaguaacaaguuaggccccacauaaaaguugauuucucacguggacgacuaggcuagcacagguggacagggaaacccuaccccguguaguggcugaggagcaugaucugcaggucccucggucccugcagcagggaagaggcagcuggaaggcuaaguaccagcucuucugugcuucaucccagaaguggcuccgugacuucuacccaaugacuauuggccagaacuaguuaugugcccccaccucaccaccagcaggccaggaagcguggggaaggugccgaguaguugucucugccacagagaaggaggcauguacagggcguggcacagcgcccaguacguuagccguugucaucauucaggagccgcagcuccugaccaggccugaguccagcgagugccaccagauguaaggccggaaccccccaggacugcucaccccaacugguugggggcaauguaacccugacaccuccgauuuuaucucaggcugccuuugcuagaagcacuuucugaaaugucugcaggaaugcccaggaguaucuggguccaacccgccucuagugaccgccccccacccaggcucagccauuggcacacccgcugcagucagggcacccaaccccaccagggaccauucccugcucuccauggcuguuuucccaagggagcuggucagugucucugacagugcaggccuggccuccucuucuccagggcacaauaacuugcagagacagagccaaugaggagaggcagcccaggagcccaggccacccaacccugaggucaccuuggccauuuuccagccuccagauggggcggcccccaaaccaucccucauguggcaccgggcucauuccucaauaagagggagggaugaguugcuuucggcccagcccugcucucguguaucucauguucuucucuggaggaauccggagcuggccgggugaaugcaucagaggaccagucuuggauauaggggaggccccaucaugauggaggaucaggcccagggacccccguguagcauuuagccacauugucaacaggagcaaaagaaggacugcaaaagcaguuaaacauugccugaguguccagagccagaaaaaucagggaaccacaaagagaaaucaggcaacuguuagagaaaagauuuuuagaaaaguguuguuucuugccaguccauuucugaggaaaaaauacaucuguugggauuugugucuggguugaaggugacucuggauuugcuugguguggcaggaaaauguguucguugaguaaauucucugaagggaagggagccagcagagcagucagaacccucugucccaggcucuguggagccacgugacucucacaugcccacgauuagugugaggaucccacuaaaucuaacuccugauugcacugaauggugcacggggguggggcaugcuuaguuuggcucaccaguguaauccaggcccucaugcucugccuggaacguugauggcacucuggaaaugagcauugguugaguuaaugcaugguuaaaugcccaaguaucagcgagauggcccagggcuuuuuccaaaccaggucuggcugaguuuguguagcaaggaugaccucagaaauccucugcggggcagucgagggagcugaugcaaaacagaaagggaaggaagaagcaguguaaccucuccauaggaacucuguggcagucucuccuaaugaggaugcuaaucgaauucacugccgccaccagaucgaagauucugcucagucucucacugagucucagacucugcuagaccauucacaacaacaaaggugcuugaaagcaguccuuucugucucccaaggacuccauucacauugucaagucucacugaguaauuucuuuuccuuugccuggcuauagaaaacccacagacaccagggaaggaaaggacagggugggcugaaaccagcaacaacccauuuguaccuugugacaguugagaugcaaauagcugguugugaugcaaaucagaaaaaaaaaaauccaaaaggcagaagccccagaagucagccuugguguugggagcucaucucugaguuucaaauuaaagguuguggcagccucauuccccugcaccugguggcugggcguuuucuugugucuuccuugguguucuggggagccacggugaaucggcaacucacucacccaccuggaguccuauaauguauauauccuuaaacccccugugccgcccuugcccccaacauauucuuuguauuuucuccacuugggucaacuuuuccucuccuggccuugccugcagcccuccccugccucaccucauuaacaugccuggaagcugagucagccacuggcaguccuguuuucccuucugcauggggacaguuuguugcgcggguuggaauuuucuguucaguuguccuagaaaacguuccuccacuuaggcgccaguggauuaccucuguguggcaucccccuccgaagagucagacuagcagaagggggcgggggacggaggcaggguggcucggagaccauccacaccucugggugccuuacaaaucccagcaagggguauuguucuuaaauaguuguuucauuaugcacgaccccuccccgcugacccagauagcugaaaacugacaguuccucucauccgcugucaggagaaauaccauuugcggauguccugccuuccuucuccagagcugggagcauuugauccacuuuccucugccucacuccugacccccagcuucucagaacacacuugcugcuguccuugagaauauuuugugcagaggagagggaucgggguagggauugggacaccacucucuuccccaccccagagaggccucagcugccagauucuggcugcuucugggaauuggaauauuucagaaaggccuucgggccucauuaauuugccgaaccccuggccuuccugagggacuaugcugaaacuuacgcagguuggggguuaguuauuaauucaagcaacaaguguuaugugcaccaacuaugugccugccacugugcuagguccuggggggacugagcugaagauguagccucugcccucccagagcuuauauuuccuuccaguggggagacagaauugcaguagaaauggauguucagaacucuauaaacagggugagugagugacagggugggauagggugauuccugacuguggucccagaaagccuucagaaaggugcuguuggagcugagguuaaguggcauggaaggugcagccaugcagagcuguggaggcaaaacauuucuggcagcagacgcuccccuacaagggcagagauccccaaaagggaaauggccuggcauuuucaaggagcagaaaagaggcucuuguggauguccaggacagagcucaagaggauggaggugucaggaggccaggcugcagccucaucgggggcaggcagggcuuugucaggcacaggaaggcguuuuucuguuacugggagccccaggaagccagggagcugauguggucugagucgccuuucucaaggagcccucugauggcuguguugaaaugugcaggguggaagcagugaaaaggagugaagucucccacacgggagacacuccccacucccgugaccaugcauuccagugucugacgguuuagcaguuuagccauuuuccucuuaagguguuuucagaaagcuggagaacccccaguuccaugaucauagaacccuaaaaguccaauagaaacugcucuuaggaacucuucccaggacacugaguuggccccuucagccuuuaugacagaggcucugugauuucaaaucagcccaggauuuugaacucugaccucagccuuccacuaccacaccuaccccaacugcccugagaagguggcagagagagcgcccaagccagguucucagcccaguucuucuuccgcauucaggugcgauuccaggcaagacucguccucccgcugugccucagugucugccucuggaaaacaaugaguugggccagucagucuuuaagacucuacaaauccuaauguucucuucauccaagaggacacggguaggaaggggaaggugccgcccgggccuucccccugcccacugacccugcagccagcucauccuccuuucccugagccggcuccacggacucgguuccggcaaacccagcucccacuucaagcagagggacuugggcgccucucugggccucaucucuguccccaaccccagccugccuuguauuuguguauucaaaacccccugcagcaucccuuuucagggaaggacgagagaggcagcuggaguuguuagaaauaaaauuaaccagccagacagccugggucugccacuugguuuucguacuuuugaucugugugaccuuggggacuuauuuauccucugaugccauuuucucaucugcaaaguagagacaauagccacuguaccucacagagcgucuaucaggauuaaauggguucguaucuguauuuagaacagugccaacccauaaaaagcacucuugaaguggggcaugguggcacacaccuguagucccagcuacuugggaggcugaggcaggaggauugcuucagcccaggagguugaggcugcaaugggcuaugauugcacggcugcacuccagccugggugacagagagagaaccugucucuaaaagaaaagaaaaagcauacuuuagacauuagcuauuauuauuauuauuauuauuauuauuauuauuauccccuguccuuucuauagaggaagaagucaaggcucagaggaguuaagcggcuugccuaaggucacacagcuaguuggucucagaacuuggucuugaacucucaaccuugcacuucuugcauguguugcagggcuccccauuugcaaacauggcuuccuguucucucucaucucaguuuuccaaacucugauaauuuuuacuucccagugucugcugagaagaugagcuugagugacagcauuagacaagagugggcacauccgacuacagcuguccaauauggggaaaacggcucugaauagggccuuaaagaagugagagccccccgugaauggggauagaaagucagccucugcuggcaugagacgcacccccacugggggccgcuugggacccgaggguugagaauucagucacagggcucaaauccacugggcgaccucccaaagguuuggucccaccgagcggaggggccugcacugcagagugaacggggacacaucuggcaggaacugauucccguuucaggcaggagaugacaugguucauuuauuugaggggcauagaaaaaaaaaacggaaagaauuacccaccuccccauggagaaaacaucaccaaauaaauuaaaaaaaaaaaaaaaaaaaaaaaaaaaaugacaaggagaaaaggccauauuccugaaugcuggggggcggguggggguaggcagugaugggguggaggugagaaggggagacuguucuuguucuccugcucaucucagucuuuauuuuuauccgucacccucauuuuccauuccacauguguuccaggccugucaggcagcaucagcccacaaccuuguauuuauuuaaauuuauuuucacauuugguccuguuaggcaguuugucugggcugcagugccuccaggcccuccccacgcagcucugcaaagguugcguuccuggcugcaggcuucuccugcgggccucuucggcuuccuuucagucuuccuuucaguccaggaguucucagcccaucuggggaaggggggccacggaccacccaaggcauccauggcccuggguggagaaaaaucugcaucuuucuuuucaccagcuucuaagugagccgcagcauucuuuuaauuacaaauacagaaaaaaccacagugguauuagcauuaccuguggcuuugaccccaagagacaucucagauauuuucauaucacguuacaggugucacagaaaucucaaaauaccauuuacgcucaucacugcucugaaauuacagcauguaugagacugacugcuaagucuccuuguuuaaugcauccugaagcgcauacaggauuauaacaaccuuuuagaauacuuugguaacuguauuucaaaauaauuaguuggcucugugguuccuuguauuuuaguguguggaaaauaaaaauucuucugagaagggggugccugggcuucaccagacucucagaagggucguggcacaaaaagaugaacaccccacccuuagucccuguacugcgcuaacccuagcuccccacucgggccuuuacugcaaggcugacgucugcugguucuuagagcuggcauccuuagccuuagccguacaccguguggggauggacagggugggagcagggaggagacaagacccguggcuccaugucacguguucagcugagggucccuuuuccagcucuggaccacacuguucaacugagccccagaaauguacaccccagcaucugcucagugggagagacccagucaaugcacauucuugccaccccagagagugggugcagcugcccucaacucuccccaccugcuggugugaccuagggcauggaccucuguuuuucugucuccuaagcaacuugaauuaagaaccaaacucuagaagcagugaagagaggugagggaaagaagggggcaggcugccagcaucccguggggcagauguaggguucguacucucggauguacaauuguccuauuuuccagacccuucuuucuccuccaugaaggugguaacugggaucuggcuagaaaaaggaaauggauggauugccuccaacauucuguaccucucaccagcuugugauuucaucaaugaaguaaagcagagagggguuagagggcccuuguccagggagcaaucaaggcaaggcaugcagagaagugggggucuucauugccucgccccaugccggaagccagggagcccauccuggauguucuuauuuugaaaagguucucuggugacucugaccucgcagcaaggguugagcauccacacaaaacaguguccacacagcugguaccugggauuccuggggccccggugagcaccucuccgcaucucuguuuccccauccucugcccuggcuguaggcaggggucuguuugcaaggccucgguugucucacagcuucagcucacauuucuaggguuccucccccaagauuuagucucuccaggaaaauauuuguugacuucaaagcaaagccacucuggaagagaagcuagagggagcggacagcccagacugugcguuuucccauuaauuucuccccaguugccuucagugaggcccuuauugugaugaugaugaugaugaugaugaugaagauuuuucuguccauggccgcauccuauggcgugcuuccucccagcgugcuaagcuccagccucccuggggaccagaggguggccucugccaugagucagacaccuccuaauuuagucucuuuguaaaucuaauuagcaugcuauuuacgccaagcccuguaccccuggcagggggugugaggcagggccuguguggcagccgcgguaccagugcccaccccucaccuccuccacacgccgguucccgcagcucccagccuggagucccgucuaacagcuggaguucaucuuucauguuggauuugggaaauuguuccccucucaccugccucccuggcaggcuccuuccccacacccacggccacccacacuccugagcagggcuggcaccaugggaaguagugagaaucauuuuacccauggagucaugcucccucaaagcaguggcggggcuuccugaagaccccaaugggaaucagaagcagagcuggcaaacuuucuucuccaugccucuuccucuccccagcaccucuuggcuggcuuguacccucccuggugccccuucguugugggugccagugaacccaguucacccuggaaccucccauacucccccugccugccccauuggccaccccaccucauaccccuaacagugacaggugugucuuguuuucccccugucuugaacaaggcugcaguaagcacagcucggcugggaguugugccugugugucucaccccaucgccaucaugggccgugaaauguccuaaucaacaaguaagaggaacugcagaguccugcugggcagcuguggcaacagugggccaccaggaacgcagaagccuccuucccagcccaugcugggcucugcuugcccaggcgccuacuaacucugucccccgaaaggggagaauagugcagggauggggcugggcacagggcagagggagaggcaaggcauuucauggcaaagcaaagugucacaguugugcucucacucuguccaugcaggcuuagggcagacccucccuuccucuccaggccucaguuucuccaucuguuaaaaaggaauucauaucaaaguaauugagagugagauaauuuuuguuuuugagacagagucuugcucugucgcccaugcuggagugcaguggcgcaaucuuggcucacugcaaccuccaccucccaguucaagugauucuccugccucagccuccugaguaguugggauuacaggcaccuauuaccacacccagcuaauuuuuguauguuuaguagcgaugagguuucaccaugucuaccaggcuggucuugaacuccugaccucaagugauccuccugccucauccucccaaagugcugagauuacaggugugaaccaccacauccggccugagauaaaauuuucagcaucgaaguugucacagguuuacaucccagguugcaaggugcagagcacguuuuccccucccugguucugacuagugcuagcaucaacacacggaugauaucuuugcucuuuucacaugggcaaaacgaggcucagagaggaaauguuuuagggaaggucacagagcgugggaagagaggccugguggcuagcgaagcacacagguagcaggcgcccacgggccucuggcaggaacaaggaagagaugcccugagggaugugcacguugagugggaggcgggauuggcuuauuccuucauucauucaacaaauauuuguugaacaccuacugagugucagaugugauucuagcaucgauucacaaaguucagcccuugggcagcuaagguuccaaggauggaagaccaaagaaacaaacagaugcaaaugaugucagguggugagaagagccacggagaaaaagaaagccagggaaggggauuaagggaauccugggaggggcagaaccaucagaggaggccuugacaggccugggugaagugagagggcccaggcucuguggauaucuggcagaagaacguucaggcagagggaagggcaggugcaguggcucugcagaaggaggcucaggggcugggaggggaggucagagaggcccagggcuguggucaggacuuggcucucacaggaaugagauggcaagccgccuaagggaagcaggcaggcagugaugugacaggagugaaguuucgggaggaggugcaguggaagacacccaacuucuguacauccgcugccgaauggagaaacugaaugugaugccuucaugcggugggccauuauucagccauugcaggagugaaugaagcacugagcugcuacagcaggcauagcccugggaaacacaaaaggccacuugguggaugauuucacgugugggaaacauccagaagaggcaaauccacagacacgggaagcagauuagugguugccaaggguugggggagagaaauggggagugaugcuuaaugggcacaaagcuucauuugugggggacacaaaaauguuuuggagcuagauagagggaguagugguuguacaacccagugaauguaggaaaaaugcugaauuguucgcucucaaaugguuaaaaugaugaccuuuauguuauaugaauuguaucuccauuuuuuaaacauuuauuuuauuauuauuuuuuauuuugagacaacguaucacucugucacucaggcuggagugcagugguguaauuauaacucacugcagccucgaacuccugggcucaagugauccucccaccccagccuccccaguagcugggacuacaggcacaugccacugugccuagcuaauuuuuaaacuuuuuguagagauggggccucacuacauugccuaagcuggucucaaaccccuggccucauaagaucauccugccuuggccucccaaagugcugggauuacuggcgugagucaucgcacucaaccuaaaaauuuuuuuaaaggaugcugugucugccaggggugggggugggugaauugacccugaggggcaggggccuuuccuaggagugacugccgucauucagauggggccuguggagggugaggagcggucagccgcuggaucuguuuugaagggagagucaaugggauuugccaauauggggaggggaggaagggaguuaagagugacugcacaagguuuuuggccugagcaguuagaaaaauggaguucuuacuuccugauacgguaaagcagucgauucagugagggcaugauggaauccguagguuagcuuccagcguguuacguuugacaugcuuguuagacacccagauggagacgccaagaaggcacaugggcugugcugguagauaccuagcgagcagcuccagggccucggugaggggcugccucauagcauuuaguaaucucuguggugucaaugcuccucgauggccgaucucaagcuacuggcguggccucagcuggcucucccagauucuagaaauccaaccauuggcucucaggagccucuagaaccccaucuaccaccauguggauccaggcuggaggcgggaaugaaaguguugccaacacccagauuguauuuaaagccaccgguggccggcauggcggcccacaccuguaaucccagcacuuugggaggccaaggcaggaggauuaugugagcccaggaguuugagaccagccugggcaacauacugagacccccaucucuacaaaaaaauucaaaauuagcuaggcaugguggcgcacacuuguaguccuagcugcuggggagcugaggcagcaggaucgcuucagcccggagauuuaggcugcagugaacugugaucacaccacugcacuccagccugggcaacagagcaagaccccaacucuaccuaaaacaaaugaauaaauaaagccaccgcucuagcuggguucacuugggaaagggauguggauagagcagaaaggagacuggggacugggcagccccaggacacccugaugcuucacuuuaggggagaugaggaugacugaggagccacccccaagggaaggggaagaggagcaagagggagcacugaugacaggaggaagauugaggcgaaggagggaguggagugugcaggaacagaggcaggacucagaagacuuggaggcagcccuaaugucuuucaguaguggcaaauuaacacgcauaucuuaguccauuucuguuuuuggcaugaugccuuguugugauagcccucauuagggaauguccaaaccugcuaacauuuacagagcaggucuaccaggauuuguuuuucuuuucuuaauccucuuggcccuuuucucucuccugccuccagagcccuccucuugcacaccagggggccacccuucuaagagggaugccagagguccccucccuagcucugcagaucacucagauaugcuaaauaguccuacagggacagacugugcuuaaauaaauagaucaccaaagggaauugagaaucagaggaaucucaaaggcauugugcugaaagaagccacucgcuauugcccugugcugcauaauuccaugacauucucaaaaaagacaaacuuauaggaacagagaacaggucagagguggcugggggugggagaggagucccuguaaagagacgggacaaagaagugcugggggcagugggacuguucuguauccugguuggaggggauagguaacaagaaucuuugcauguguuaaaauucauagaacuauauaccaaaaaaagucaacuuuacaacauguuaauuaagaaaauaaacuauaaauuauggaauacccccacacccaucccccaaaaaggaugaagugagaggcaccagcaugagcagcagcacuggugggcuucuagacuaagauagccccauccuucucuccaccgucauuaaaucagcaagugcguaauuugcacccuccuauacagcuagaaaggccaguuagagggccuugaacaccgcugugagauucaaucuaauucagcaggcaauugggagccauagaugguccuugagcauaagugauguacucagagcuaugcuuuagguugauuaaucuagacacauggagaaugggggugguaccagugggcaaugacagagagcaccgguggguggggacuggacgaggggucaggacugcuuagauguggggucuauaggaaaggcagagguugagaugaggcugcaguuuagaguuccagcaaugggagugacagaagcucaaaagggcaggcugggggaggggcuagauggagaaaaagaugggagcugccaccaucugccaccacccugcugugcagcggccagguuccaucuuuaccucaguauagcuccucaccugaacacccuccaccaccuuugcaugcccucucuuucccucuguuaaucugucuuugaaucugauccucucucccugucucucugucucucaccugccuucccacgugucuuaguccauuuuguguugcuuauaacagaauaacugaaacugaguaacuuaagaaacaaaauuuauuucuuacagcuauggaggcugagaaguccaaggucagggggcugcaucuggugagggcccucuugcuggugggggcucucugcagagucacgggguggugcagggcaucucgcaugaugagauuacuacgugugcucaugcaguagcucaggucucucuuccucuuauaaagccucuagucccccucccaggauaacccauuaauccauuaacccauuaauccacuaauccaugaauggauuaguccauucaugggugcagagcccucacgauccaaucaccucuuaaaggccccaccucucaauacugccacugaggauuaaauuucaacgugaauuuuggagggggacauucaaacccuagcaccauccuuccuucucugugucugucucuaucuucugauuuuuuuucucacacucacacaugcacagcagauaaacacaugcaacucauucauucaugccuuuaucccuucguccauucacccauagcaacuaugcggccaauacacauacacgccccacgccccaaagauagggaauaugucaaguaggaggagcccuuugcaugccugagcagcccugccugggggcagcugagugacacacaggacugucaccagggauggucaccccucuacccggagcccagcacccugucccagcccaggaccuauuccuuaagacauuugugaugucuuuguucacugggaagaggacccaagaccgggcagcucccuuggaagaggacuagaaaggagagggagaugaaauuaccugcuccuucuuggcucccaggguuccaggacaccaaguuuauggccuccuaugacggugggaucccugauguagaaaggcaacccagagagggcagacaguuugcacgaggucacaaagcaggccagcgccaguccucgcuccccaucuccuguccccuccacucuucucagcucccucucugccacccaaccaugcaggaaagguggaaucacucuuggaggagaggcagacucacucuuggaggagaggcaguggaauacaaagcggugugauuagcagcuguagcgguguccccuccugauuuccauaaggcauuuagauuucuuugccuggccacacauuucucugugggaagagggaaaucauuuuagcauaggaaauagccagagccaggcagcugcagauugggagagccagcucccagcucugcacccuggcccucccugcucccugccuggaggccucuagagggccuggccagaaagcagagggcuggagacccaggaggcuggugaggccagcgaguacucccucucugcggugcugccccucaggcccugugauucuccccagaaggggccccagaaggaggggcaggacaguccugggcuugggacaggccugggugcacacauccuuuugcccugcauuuuggacucuucuccgugcaucucugaaaacacuuacaccccacuuuagcccccugccccaaccccagccaaaaguugggugcagaguuugccauuggagugaggaaagggauugaggccagguagagugaugagguucaaauuagcagauucugaugagaauggcagaccuugaaguuggaaauauggccacuggggcugggaggcuugccugggguugcaagacagggccacaaggaagggauugcugaguuuuccacgugggccaggugccuuccaaacagagcccaugcuggaggaagggagaagaggacauggccuggcuucccugggaucgugggaggcuggaggguagagcaugguguccuugaguuaagaacucaggccacauaaauccucugugguucccucuguccuuugcacaugaauuaccaguccagguggcuguagcagcagcagcugcuccaucuacagaacuggaaaggaccgugugucccccgaucuccacauaaagcuugcccuuuggccauacccaugggcgugauugaggggagccucacccuccuggcuagccccucuaagcccacuuuguuucaggaaguacccucugggcugacugcucuagucccuagagguccagggucuggaaugcagaagagaaagacacagcaaggcugagcuaugaaccaugugacaugggcuuggcugggucccaggaguuggaagucugugcccaggaacaggaguggguacagacaggugguaaaguauaacugggcuuuggaaguauaagauucccauagugcacugggucagugggcugcagauuaggaaaauagaauucaaaagcaccugccccucauuugccuuaaugcaaguaccaacgcacauuauaauucuuuucucaggagaacggaggcuggcuucagggccgaccggagggagugggggaaggucugcacgugcaggugaggaggaccugcccaccucgugccuucaucuguagacagauaauacacacauccgcggugaaaaugauggugcucugguauucuucccccaaagugccagcugccaaucggauugaauuagauuucacaaggguuuuugaaauacauggaauucaccagcaaauuacccuuaaagagggaaaaucaaucauuuggagcagagauaagcugaaggcgaggcagccucggauugaucccgucugugcaggcguguguggaauucagcagauaaccugcggagaggagggaggggaggcuggcugagagguacaggaagggcagagaggcagggcaagagggggaaggagggaguuggagagggagagauuggaaagaggaaggugagagggcaagaaggggggaggaaagagaaaggagaagagggacagaagaaggaaaggaagaggagagagagaagagaggcuuagucugcacaggcugcuguaacaaacuaccauugacgguuggcuuguaaacauagaaacuuauuucucucaguucuggaggcugggaagugcaagaucaagggcccaguagauguggugucuggugagggccugcuucccacuguguccccacauggcuggaggggcaaggauuguucuggggucccuuuuauaagggcacuaaucccuuucaugaggacucugcacucaugaccuaaucaccucccaaaggcccugcccuccuugcggguuaguauuucaacaugaauuuuggggaaggggacaccagcauucugucuccagcagaugagaagaaaugagggcgagauaaagagagaaacaagcaaaggagucacaagaggaggcgaggagagaggggaggagagagaaucaggagaaugggagagagaguuugggcuggagucauggaaagcaguuggaagagcacagugggccgggugcgguagcucacaccuguaaucccagcacuuugggaagccgaggcgggaggauggcuugagcccaggaguucaagaccauccugggcaacuuagggagaccccaucucugcaaaaaauaaaaagcauucgcugggcauaguggugcacacauguggucccagcuacuugagaggauugcuugagcccaggagguugaggcugcagugagcaguguuugcaucaacugcacuccagccugggugacagagugagacucugucucagagaaaagaaagagcaccacauuaaugggcauuacgggccuuagagaaucaccccauccaagcuucccaugugguagaucagaagcccagaaggaaaacagggccuuccccaguugcguaguaauacagggcagcuccagagaaaacagacuccugaccucaggcccaugguacucaagggccaagccacagaggagcuuggggaggggacauagguaggaggaugaaagccugaaaugagggugacguccuucaccuugaugcaggcccaagaggugcuccacucccacaguggagaaacggaggccuggagccaugaguggcggggcaggccugaagggcagaggaaaaagaggcagcagggcagagccacccaccaugugacaugggcuugcuggguaccagggguugagguggagucagaaacggaagcaguguccucugccaggcuccuuccacugccuucuguauccuggcaucucagugggcagagagacuuagcaccccccuuaauguagggguuggagggagaagcagcuggcuuugaguugaagguggaaggagaggccuaccuccugccgagguccccuuugccaugucugauuggggugaauuaagugaaaggauggacaaagaaggauaaagaauauguauucgaugggcuuuuauuuucuacugcucaauguuauggaugagaccaacagaaaguacagccgaggaaggagggaaaccugcgccccacgcccagggugggacuggugggucccgucacccaagccuuugcccuucucugccugcuccuuucauuucuggccauggucuagaaaucagcuccuucccagggaugccuccucuccuacccccacuacuccuagaacaauaauaauagcucuccucuauugaacacuuauuccgucccagaugcuugaccaagauuuggcagcucacccacaguagcccuaucaaauaggcugcauucuucccauuuuacagaugaggaaauugaggcucaaggauauaaaauuguguaugcaaaaaucacacagcuguaaaaggcagugccugagccuaggcucaacuccagagguuguggcuuccaagguucuauacccuggaagcucaggucauggggcucuucccuggcagacccgaguuggggacaggguugguuuuggugagggcagcacugacucugggggccccacuccgcacuccagauucccagccccgauccagcuugggcugagggugucacaccagcccaccaaccagaacucccugggugccucacaagagcccuggcccuuuaucuugccccagcaucccccuaccccccgaccccaaacauaaagguggccuugguccuugcuguggcuccugaggccacccugccuucacaugacccugguccuuccucuuccaugaaaaggaauuaagaccuccuccaagggcacauuguaguuuacaggguugguugacgguccccuagcauuugagguacaaagaaaagaacacacaaggucccugccauagggaauuuccuggcuuaggcaagaaaacacaauucacaugcuuacaaaacacgggggagcagagaaaugauacuguuuucauuuaauucugugagaugugcuuacccuccccacuucacagaugaggaaauugaggcuucaggagaggaagugaguugucuaaagucacacagcuaggaagugacccagccuguuccucaacguugaacugugcucucuuaacauugcgucacgccccugggucacuaacccaggggccacccugacugauggcagagagagacaaacaucccggagaggcaagcuggugucaccaauagcagggcagugccucaggauggggagggccaaagagccagagagacaaaggaggcaucugcaggccucguugugcuggagggagccuggaggcuggcucaggccucccucccuuugggggcccaggccaccugcagcggaaugcgccagugcugagagcccucagguaaugaaugaccaagggaagccaugcuuagaagucaggccacccaacccaaaggcaggaccuagacugaaauccaccccucugaggcagggaaaggucugcaugcaggugguuaaguagcggaaauaucacccuugacccucccucccaagggaguauuuaacgagcugaugucuguugagggcccaacauguaagcucaacaaacagcuggacaaccacgcugggucagcacacggagccgggucugcugggacagacucaggucggcuggcucugggagccuuagagagacuaggagggagcaguggcucaucugacccuucucaaagcuaccccccacuuccaggaaugggaggcagggagggggcaaggucuagggaaguugcggggcagcccuccuggcagccggcugauaaggcgcugcccucgugggggugggaaagcugcagcccuaggagcaaagugcaggagcuacacggggagggaccggcagggagccaggagggauuucauguguccuuccccucccaagaaauaaauaaagcuaagcugucaccucggccuccccgcgggcagcugccagcuccgcagccuguaguggcugggcucuggcuccgggacccgcggugggcgcuaucagccuucucaucgccucucucagcuggaggagaauuuaauccacaggcuccucuccacacacacuagggcuccuuuugauguuucuguuuaucucccuuccaacaaaaucgccccucugcagcuccaagagccccuccagccuccuccgcaucuccaccccaugaaggcagucccccagcccccugugggacaagggcagggaggaggccuagcaggagcagggaggugggugugcccuccaccaguccaggcuuugugcccugaccugagcugaggugcuugugggccuccuucugccacguguggcacagggagggguucacuaugccagcuccuggcaucgcacuuggagcagcguucuguagugggaaggccaggagagcugcaugguuaagagcucugacuccgaggcggggugggggcaaacuugaguuccaagccuuccuuggcugcuguguggcuugaacacuuacccccucuggccccaguuucuuucuccaagaaaaggaguggacugacgcugucuuugggccaucguguggauucugguuaaggugugugacgccugugucauagccgggcuucacaaauggaagcuguugucauaaaaggcucagcagcacaggacugcgaucaguagggguuuugcaccaacuuagcaaacuggaauaucucucucucacacacaccccuauccugagggcugacagucacaaauccagaccaagcaggaauuggccagcugguaaaguccuggaaggaacaggcugagcauuuuagaggacuuggucaguaggugauccugagggucuuaggacauguguccugaccacugcagcgucuggccugcgugagcuuuuccagccccuggcagcaaaucaaggagaagggagcaagucucauucauuugaaaccccaagaauucuccuaaaggggucaggaagcugucccgaaggcuugucccucugggugcuccugccucaccagguaguuaaccagaagcuacacugagcucacaccaucuuccaggcaucuuugagcucaaaaucacugagcucacaccaucuuuucagucccucacuguugaccucagccugcacacgauuggugccgccccagccgacacaugguucuuccuaagccuucucugcucauccaccauaccuuacugcuuauaccuuacaggccaaugcucuucaguucugucuugcuucuucccagcaucacucuauccugaugguucucagacauuagugagcaucagaaugccugaagggcuuguuaaaacaguacugggcccaguccgggagcgguggcucacgccuguaaucccagcacuuugggaggccgaggcaggcggaucaugaggucaggaaaucgagaccagccugaccaccauggugaaaccccgucucuacuaaaaauacaaaaauuccccgggcgugguggcgcaugccuguaaucccagcuacucgggagacugaggcaggagaauugcuuggacugggacucgggaggcagagguugcagugagcugagaucacgccacugcacuccagccugggcgaccaagcaagacucugucugaaaaaaaaagaaaaagaaaaagaaaggaaacggugcugggcccaauccccagaguuucugacucagaagaucugggcguggcccccaauuuugcauuucuaacaagcuccaggugaugcugaugcuguggucccaggaccacacuuggagaaccacuguuuuacccuuguaguucucauccuuggauacacuuuggaaugaauaacuggagagcuuuauagaaugcggaugccuaugcuuccacccccucccucagucuggucuccauggucuagggugcagcauaggcagcacccuauguaaagcuccccagguaauuuugauauguggccaguggagaacuaccccucuuugccucuccaacugcucaccuuuuucucgacuccuauaggugccuccaagcuacucucccugccgcagugaugucuucccaacccuggcuaugcagugugguucccuggggagcacgagagaaauguagcuuuucccagcccccagagaugaugacacacuggcucugggcaucugcauuucuuuuuagaacgccacuggugauucuguuguguaucuagggagaggagggcagcaccggugugauucgcacguggcugcaaggccaccucccucuccccugcugcagagcucagaguggcuccgucucgcucauggaaauaaugccauccucaggauggcaucugccugggacuccaagcuucucgacauggacccuuugcaaauaauaagucauugaugauucuucuccacacuccgugccuuugcuuaggacagugcuccucaaaagguggcuucagaucaggaucagcgucgccuggaacuugguuagaaaugcaaaguuacaggccucaacccaggccuacagaaucaggaauuccugggggagggagaagaaucggggagcaaucugcaggugauucugagacacgcuaaggaucuaaggaucaagaacucuguguuuaaagcuacuuccuccacccgaaaucccuuuucugccaguccaaaagaguccaaaaauaauaccuucugaccagacacaguggcucaugccuguaaucccagcauuuugggaggcuaaggaggguggaucauuugaggucaggaguuugagaccagccuggccaacaggcgaaaacccgucucuaccaaaaacaaaaaacaaaaacaaaauacaaaaauuagccgggcaugguggugugcaccuguagucccaacuacucgggagccugaggugugagaaucgcuugaaccugggaaguagagguugcagugagccaagauuguaccacugcacucuggccugggcaacagagcaagcuuccaucuaaauaauaauaauaauaauaauaccuuccuucauuccuaacaccagcucagaacuccccuucuuggggcaaccuccucugcuuguccuccccuuagacugggcccuggagcgcucagaugguacaucucaguuuguucugguaacuaacauugcugacugcaaggccaaugcauuucacacuguggacucgugcugccaauggggaaugcccgcaucagacaugagcuccacuuccuuggcuggggcagcagcacaggguugugggaaggugcauuggcccagaagcuggcccggccucuuuuuuuuuuuuuuuuuuuuuuugagaugaugucucacucugucgcccagacuggagugcaauggcaugaucucgucucacuccaaccuccgccucccggcuucaagcaauucuccugucucagccucccgaguagcugggauuacaggcgugcaucaacaugcccagcuaauuuuuuuguauuuuuguaaagacgggguuucaccauguuggccaggcuggucucgaacuccugaccucaagugauccacccaccuccgcuucccgacgugcugggauuacaggcaugagccaccgcacccggccugggcccggccucuuaucccccacucugccaccagcucccuaugcaaccaugggcugcucagucaaccucucugaacucaauuccacuggaggggcuggaggggcccgugggaggaguagcaguaacacacaaggaagagcugcugaagcccaggcacucccugagcacccacugugugucauggucugcuggggaaucuucaccaccugaggcauggucuacagccucaaggggcugcugacauuccagaauaaucacagagggaacuguaacccagugaugcaagugcucugcagccauuaaggaaaacaaagcaaauacuugguacuuacaaaguguuuagaauagugccugaccaagaguaggugcuagguuguuaguguccucguucgcaucaucaucuauaugcacaguuauggaccaaucaccaagauguaguucuaagugaaaagacuggacacagagcaaugugcauagcaugcuguuagugucacagcaggguggcauguacccauaauggucauauaggcauggauuuccuggggaaagagacccaggaauggggugugguggcugcccugggagguuugucaguaccugggcucagggggagagggagaggcguguguuccccuuacacuuuuuaacuucuggaaaauuugccaugucucugcucaucaugucucugacauuuuuuauguuaggaaaauaaaaacauggggguguuugggguuguuuccugcagggauuuuauccaggcuccagggauguaggauguagggauggccccucccaucccagccuacacugaggccuucugggugagaguggacagagaucagggagacaggagcccuugccccccccucaccuccucacccuucaugccguugagccucuucugggucccaugcuugucccucuucuucacuguccagcacacaugugugcacacucacacaauacgccuccuccagaccccagaagcuauggcccaucagaggcuggggacagcugcuccucuagggugugauccuggggucccucccaugacccagggucucacugucuuuucucucugguuccuuccuccucuccauaccucuccggcuccuucugucugucuccauauccuuugacugaccgacucccauugacagaauuugguaagugagccucugaagggcagggguugggcuuggggagggcuuguggugggcacaguggggaggggcuuugaaaagggcacagcucagcccucccccacccucucaggcccccagcuccugugguugagggaccaaagguucaggggaaggagaggaguuggugucaccuguucaaacugucacaccccacuggcuucagcuauuagugccccuucgggcauuuaauuggucccuuccaugugacgggacgcauuccacaccagggagcgcugcaaccuccacagccugacaggcccagaggagccuugcccccacauccccuggggagccacuuugggcuggggcucuggagccccgcggcuugccuggaccccagaauuggcaagagagggcuuagggagcucagcuuccaccucuccauccaaaccucugugccaguaacagggcacaggccugucuccaggcuuuaagaaaagucuaaaugcagcaaguguauuugccaguuugcuaaaaugggaaaaacccaagagacugauggguaaacguuagcaugcauucauuccacaagugccuuugagcauuuagggggcagccccaggggcccaugaaucuugugaacucucaggcuucacuggggguaucacuuccugaucauucccccucugcccugagcgggaugggaaccagccuugcagggacuauccccuuagaccacggagagucuuuggggccagggugaccucgcagccacccucucaccaggaacagguuucuaagaggagucccacaacauacccuaagcaaccaagaugugagggugggcuucccuugccagccacugguucaagagaaaagggcccaugugccaagcuggccacugggcuaggggugggcucugcaccauaagccagagccucugccucuggacugaaagccaaggucagugaccuacugggcaccugcaagagaggucagaaggaggcucuuacacaucacaggccgccugcccaguuggaggggagucugggggcgcaggugauccccuugccccaagugcaggcaggaagaggaaguagaaucacuuucugagcaggccagaccucagggagucaguaagcugaaucucccaccuucagccaugucuccuccccaugaucuggagacuucagucacaucacaugcuuucugugaggagagucagguagcaucugaggggcucugugagccacagcccugguuagaauaaucagaaaugccugaacuugagugaggcacccaccucccugaaaugaugggcuugggccucugggacacagcagaaccugugaugggguggccacccugugcucagucugggauccugggccccccgggacuggcaacagugugggaucccuggccauucacauugccacucagucucuggguuauucccauuucacaugucagcaaaccaguguucucccugcuggacacguuccagaggaggaggggaagaacagcaucugcaucccuuguguccucuccuggccaagccugucauggccgcuuaacugcuucucuucucuccacuccccucacauccucucuccuccuccuuccucugucuccccgcugggucuugcagcuggccggucccuccgcagcuggggucacugggacagagaaagggagcaggaaauggagagugaaccaaaccaccugaaggggacacugugggcauccgacagcacaaggaaggaaaagagagccagaggagguuuccagagggccuagacaugggugggucauggagucuuggagcugcucugggaaagcccugcucugucccagcgccucauccauugccccaaccaaagcagcucugggcucacucuccaggagccucugcuccuccauuugggucuaggcuuuggccacugugcccuuccugacuggcuucuucugcacucuugacccagggccugaacagcauguuugagguguacuugguggggaacaacucccaccacuucaucaucuccccgaccuccguccaggggaaggcggacauucguauucggguggccaucccacuggacuacgagaccguggaccgcuacgacuuugauguaaggccccacucacuggcauuuuggaguggggugggggguggauuucaggggaggcgaggguaggguagaagauucccuuagaucccaccuuccacugcugcccaucuucccuuguggaucugacucagauaagcccuccaagagacggcaggggccgggcugagucucccuuuuccaaggaggaaaaggauauguccaguaauugaguggaauuuuaccagacucccaucaggagccucugcaacccaucuccugccagaucagccccugcuagcuccuccugcccuagcagaaucagcagccaucccuagagcaauaacagacgggcucgcaguagcacagagcugggaugggcagagacucuaacaggugcucugggcuggggccggcaaaggcauggagaggacuuacagggacaaggacucugggaggggacaugugggagcuuaccugggccccuguucugcacccccagcucuuugccaaugagagugugccugaccaugugggcuaugccaaggugaagaucacucucaucaaugaaaaugacaaccggcccaucuucagccagccacuguacaacaucagccuguacgagaacgucaccguggggaccucugugcugacaguccuggugaguccccgcuucacugcagggccacugagcucuccagggccgacuguggugaggcacccagagggauuuuguccaagggaccucagcaaucagggaaggaggcacccccaaaucccugagcuguguuuguugguguauuaaauaaaguuuuuggacucuucaggaaggggcucccuugaccuagguugcaauauggaaaaggagccaaccugaggggugacgagacugagcugaggacacugguuuucugccuuuccccgagagagacucagugagggugggcugggagcccuggaagcccccucaaaugggugggaaggugccagccauccuugagaagggcaacccucuccaugugagcacaggcaccagagaggggcaggcgccuggaggguaccggggcacccccagcugcccauggcuggacuugcccuuugacaaggggcccucccagugucauuuguaucugucaguacucuugguugcaagggacagaaacccuuaaguaguucaagcaaaaaaggauuggcucauguaacucaaaaguauaagugauuucaggccgggcucgguggcucacgccugucauccaacaccuugagaaagccgaggugggcggaucacuugaggucgggaguuugagaccagccuggccaacauggcaaaaccccgucucuacuaaaaauacaaaaauuagccgggugugguggcacacgccuguagucccagcuacuagggaggcugaggcaggagaaucgcuugaacccaggaggcggagguugcagugagccgagauugugucacugcccuccagccugggcgacagagccagauucugucucaaaaaaaaaaaaagugcaagugauuucaggcacggcugcauccaagcacucaguugagcagggaucugucuucaacacugggcucugcuuuuuuguauuggcaaagaggggcaccagcaccucuaggcugacuucuuaccaauuuaucaccccuagugggaaaaguucuuuugcaguaauuccagcagauucucaucggcccaguugguugugucauccuggaaccaauugugauucugguaugccggggagggaucacacucccccuaguggacccagggguuggggucagccccgccugaauuacaccgucugagaauggggaaggggcuucuauucuaagacaagggauugaaugcuaagcagauccaagugguagaugugugcuacacaagcucagagucuugcccagucggugcucaauaaaugucacggaguuuaacucauugcuuucuccuccuugcacaccuggggcucccagaguccuugcuuccauuucuugcuccgucccaacuccaagcagagugauaccaagaccccgcuccgaaguguguuuacucuacagacagaugguaugaaacugcacugagcccccaggcccuuccccucugacaguuauuaauauuucaaacagauguuuagccagucaggcugucagacguaaacaauaauucugcggcagcuguuuucuucaccucccgcgucucuagcccaugacuccuccagcuuucaccaaggugcucccugcaauaaaucaccaggcgcuugaggcccccuggaccuuccuucagccucucagugcccagccagagagcaagugccagaggcucuggccuucuggacccaaagugugugucuuuacccaccaucccccuucgaaggacuggguaaaaggcagccaacagccuaugcuuuagaggccucagaguggaggggaggcucuguccccugugggucugggaccacguggcaaagaauucuagugucagauccaggcuuagugggugucaggggauuccuuccagguguucuugcuugggacagaguuuccucacuucguagucccaaguucccaugguccuuggaaagggauggggaaaaccuauagagccgggaggagaugugaaauaugagaaggggcaucccuuggucgguggugccaaggacagcugugucaggcccaguccaguuuggggcuggcgcuggggagcaggcuuuggugaaugugagccgagccccucaggcuagguuuuuauccagaacuggggcagcugcugggccugagcucagccuccucugugagucgcuaggaaccagcagauccggccagccucccuggguuccuggcuuccuucauccaagccucacccacccccuucucaagcucccagccccaggguuuaugaagccaugaaaggugagggcccauuucaucagguaacagcucucacagcaggaccgugugccuaaaggaguucaggcccugcagggagaugguggggaccccgcgugcuggccuauccaugccacucuuagcgccuucauuuucucaucugcaaaaugggccccagagcuaguaagugacuaaacuggaauucuguuccuguaaaggagauauaaaaacauccugggugacccacccuccccccuuccucucccagucuccccaggguguuuccuggccacacccuccacaccgcccugcccugcucuuggccuccuucacccggcagcucucugcucagacccggggucagcccaaucucuccaccuccucugccacaaaaggggcugaaauuauggcugccugcucagggacuguaaaauuccuucuccgugaccuuuucugggauguuauuaaaauguuucauggggaguugugucaggaaaaaaauuaugaagaaaaggaaauguuuuaauaugcaaugaaggcaggagccgagcguccccagcucucauccuggcguggcccugcuucaguggcuggucaccuguccugggggaagguggucauuuaacauggcuuggggaagcuggaauaggaagggcugucaccaccaguccagguguccuagcagggguggaagggccagacuuucucaccucccaggucccuggaccuuauggcccccaguuacagcaaaaugaguuuccacugguggcaggaaaagaguggggacacccucaugcacacagucagcgcuggcagaacccacacauacaaaaaguccaccuucuguauguauacagggguuuugcauauauggaguacuguauuuuccauccaaauuugguugaaaaaaauguuguaugcaaaugaacccacacaguucaaacaggugcuguucaagggccaacuguaucucuaaccuguuaaguaggcgcuguuauucucacuuuacagaugaggaaacagaugaggcucagggaguuaaguaacuugcucagggccccagggcuaguaagugacuaaacuggauucacacagcgacuccauaucccaagccacaggcucuuaaccacgaggccacccauccagaagguucuaugugggaccacugagccuaguccuuucagcaaccuucagagcugaggguaaagagaggagccggaaagugcucucugcgguauccacagggacaggucccagggucgcuccaggugguguguucuuagguggcgcucaagacuuuuagggccuguggcaccaccaggugaauuuucacaucucugagcccuaagcugcuccagggacagagcugugugaguguuuucacugauggagaaaccauuucagagauauucgagcacuuugcucagggaagcaggaauaccaaggcagcccagagcugucucugugaggaaagguccccuggaaggagggaggguucaggaugaaugugcucugaagggugaucacacagaggaaggaugugcgggggugcauauguguauaugugcgcaggcaugugagguaugcuugugggauguguauggggguguguguaggcaggcauguuuuuuugugccugugcauguacauguguuugcagcuauguauacucagagguauguguauguaauauacaugugugugugcaugugugccugugcacguacauguuacgacuacaugcauuuggggaugugcguacacuauaugcacaagucucaugugcacacguguguguacauguaugugccuguaccgaugcauggaugaugcugguggcuccccauccucuaggcugugugguuuauucccucucauaucccaggcugcucugugauucacaccuuccaguccugccuccugaccuggcaauugaaaucagaugagaaggccagggagugucuuauccugggacccugcuaggcuuggggcagcccugcagccuggccagugucuggggccuggcaggguuugugggcaccacuggacaguacaagaaguacaagaguaaccuaaucauuuauucauucauucauugauucaacaaacguuuggugaauaccugcugugugcuaggcacauggcccugaggacacauggugaugugagucuuguacuuauaaaguuuauagucuuccaggaaaacuggacuaacuacgaaaugaaucuucacacugaguauuacuugcugugauggagagaucagggaguacgcgaaccucuaauaggguaccugaccuugccugggguccaggaaagcuucccugaggaaguggcauuugaguaagcauuaacuggugaaggcagacagggaauaacauuggagaaaagaggcugggagcaguggcucaugccuggaaucccaacacuuugggaggccaaggcaacuggaucacuugcgccuaggaguucaagaucagccugggcaacauggcaaaacccugucucugcaaaaaaaaaaaaaaaaaaaugccagcugugguggcauacaccuuuaguuccagcuacuguagaggcugaggugagaaugucacuugagcccaggaaguugagacuucagugagccgugauccacugcacuccagugagccgugagccacugcacuccagccugugcaacagagugagacccuaucucaaaaaaaaaaaaaaccacuggaggagagaacagcaugugcaaaggccccguggcuggaguacagugaggacgugugugauguguggggaagugggguccugcuccuuugaagcacaagaggcuuggcuguuucucuucuucccaaauugauacuccccacaauaugcccuuugggaugcuguucugauaguggggaaggccuauaucaaaccauccauacccccuugccuguuccauccuugugacgguggcaggcguuugggaaacaguuggcagaggugguaccuaggaugugugaggagccagcuuggccucuugcagcauggggcacgugucccucuauuuauuagcuccauguccucugggcagugggagaggcgaagugcugaggaaggguggcagccccccuggcgcagggcuuacugagcuccaaggccuucuaucccugcugcaggggguggggcauggcagaaaugggcagaagauggacuucagacaagacaggcuucuuccccagucggaggaagccaagaaaggagaggcccugaaaaguccugacugggcagguguggggccccaggaccagcuugugguuugcugagccguggguagagcuccaccucucagcuccagacagacagggcuggcuggagguggccuaaaagccugcuccucucucaucucccugcccccucuucccagccuguccuugggaggcuggcagcaucuugggcagggccacaagacauccagggagucccugcaauccugucuuacuaugagcuggucacuccuucucugggacuuggcuuuuuuccuaugaaaugggaaaguagugccugcgcagccugcagugcuggguuguugggagacccauugcagugaugugguguaaacagguaagauuuacagauggcaggaguggguauuuucaucacuggccuucagggucucaccuggcugcccaccagcccuucggccuguggacaagcccagcucugccgcaguggacccuggacaagacaccgggccucaguuuccucuucugugagcugggggagauaaccugcuaggagccuaccuuggaggauuguugugagaaucaaaugaaaugauucaugaagacacagcacagaggcuggcuaggaacacacgcuggaaaugucagcaagucaugccuggccuccuggcugagccuccagggagcacgggcccugggcaaggacaccacccucagagcuguggcccugccucaggcagccaugugaccuuggccagucacugaaccucugggucccagugagaugacugggccaggggcugguucagggccuucuggguuggugaggcuuuaauuccaauuugcacuguccaaggagaaaggggagccauucuugcuguuuaguuucaugcccagcaacaugaacgugccacccacccugcaaggguccccacccacccacuggccucuagagcccgucuccugcccuaccccuccucucucagcucccaucuggaagucucaggaagauuccccaggacuucacuucccccuccuagagcuaacuggcuuuuccuccugguccagcccagccucccucuccugccacaucagcagacagcccugcugcaucaaugucagccccauugcuguuuguccccaucucuccuuccccucccacccacagcauugaccccacaaggaaaagguggguaugaugucauugcccugggcuggccguguugaaggcaagcuucaauccuggaggacuucaaaugcagcaggccuguuccaccagcuguaaggccacagggccucucccucugcucuguaacugucaggacacccccagccuucaggcucagagaucaccccugucccuccaugcugcugaauccaagaacucuaacauggguucuacucaaggugcuggaaaccuaauagcccagccagaugauccaggaaagccaguucacugccugucuuagucuuggugcucccuggggcaaaccccaguuccucccuggucccucugcccccagcagaaggacauguugcucugcaacaucuguggaagccucucagcuguaucuaucuacuacugcaggagggaaccuugcuauaggagcaaggcuuuggaaccagaaacccagcuucaaauucuggcucugcugccugcugucucuauggcccugggcaggugcuuagcuguguccugacccucagucuccagagugugcuguagagagaauaauaauaauacuuaucccacaaugaagagagacggggcauuuaaagcacuuuguguauuagaaggcacuggguaaauggcaggugucuuaucugggagucgguggaacuucagagagcauugguauuuaagcuugggucucuugguuccuagauuuucugccuuuggcugugacuucccuagacucuggguccucucaguuggugcguugguugaguuuuugucugugcucaaccccgggaagccaacacacugagucuagccucaaggaacagaacacagagaaagguuaaacaagcuugcaggugagaaccaagccucuucggagggacgcagacgauaguugcugccaggugugcgaccugugcgguggucuggggacauggacucggaagggccccaaacuugguggaaugcucugcugucaccaucuugaaauucugauaauuucugaacagaggcccugcgugcucauguuacucugggcccugcagcuuacguggcuugcccuggcacaggaguuuaucauucucugcccaaauaaacucaguggcucuccacgguuuucaucgaucccuacauucagucaacagucagcaaaggcugaagugcuggggccuucuguucccacagagcuugcuucaguucuuauugccgcauaagaaaccacccaaacuuaguggcauaaagcaauagcuguuuuuaauacaaauggcucauggauuuggugggucaggaauacagaaagggugcgguagggaggccuucucuuuccuugggaucugaggugacucgaccagcuggagucuggaaacagagggcccggaggauccauucugaugguguucucacccugccacgacugugcccuuggcucauuuggcugaagggugagugcagccggacuguggcccaagcacccacauguagccuccccacguguccggacaucucccagcaugggaguucugagcaggcgcacccccagggaggccucugggggaggagugucccaagagauccagacagaagcugcguggcguuuuucaacccagccuccaagucacacugcaucauuucugcugaauucuguugguuuuaagucaccagggcaaguccagauucaaggagagaggacguagaucuccccagcugucaauggagagaacguccaagaauuuacacacacguaaaugucauagaaacacucagaggucacuuuuccauaccacuucugagcagucaugcaugagcacagugccaugaugccacaauuucccucaccuccuccuggagggcacaaaaggaagcaggagagcagaagggaaaccugcaaauccccuuuccagccugggacgagcucuccgugacugggaagugaaaagacagugaucccugcugucccaggcacucccuggccaguggaauucaagccuucuagaccuggguuggccucugcagccuggccuugagcugcuauuccagcccuugcccccauaccccucacacccuucucuccugcccacucagauccucaacaccccucaacccucagcauuuucuugccacggcgucuuuacuugcuacucaccugccucucccuccuuccuauuggagaccaucaaaaucugcugaaccucagggccagccuccuuggcagcaccgccuuaaaaagcccacuuuuccugguaacuggcaugugucaccucucgaguuccucugccucuucucuggggccccagcaugcugugugccuugcugucuguggcuguucccaccccuguaugagggcucgcuggcaaguguuccuuccccacgccacugaaaaccuuccccaagcagguucucucugucucaggggccccacccaugguguaugcaacacaaaguaggcuggacuccuacuuuggugucugggguggucugggguaucuaggacaguugcuggaggaaggaaugugggcaggagaagguuagcagaggccucauggggacacaugaggcacagagaugguaaauuacauacacaaggccacccagcccaucggcaacggagauguuuguccaagccugaagccucauaaccccacauuucacucucugugccaggcucccccaacauccccucgggugacaagcauaugcagaagacugcuggccagagaaccccaaggccuggcuuccaggccacugaguugcugugugacccugucccauucucauacucucuccagaccuuaguuuccugcucaguccaaggagaagaugggcuggaggccuucugaaugcccuucauagaucaggcaucccuggggaugcagaccgcagccccaggaccaaggccaaggguagggagguguaauggccaccagcuuccaggaucgccugggccuccuaguccuaaucagggcauacgaguccaaggucaacgcugaaaucugcccugccucucagucuggcccuguagacaggugggcgggagcugacccugcuucccuggcuacuucugggcagggccaggugcccugggccuuccuggcccucugggagccccugugucucccuggaucgucugcucuccuccuuccccucccagagcagaacucugcacucucuggcacaaagggugcccuccagaugcaaauccagcgacuauuuaaggccuggaaugacaguggugagccagacaacuucccugucuguuccaggggcaggaggcagaugaugaacaaggaauuucagagcccaugggauggggaugagugauguggggaaauacgacugggcaggggcggggagugccagggcugggguugcuacugcaucguuauaucaaguggugcaggaggacaggccucuccuggaaagugacaugaaacaaccuggaaggaagccagcugggauccagguugaaaaugcaggaaagaguagcccaggugagggaugcaggugaaagacccugagcaacagccuggcugugguggaugcacagagagcaggaggggcauggaggccgggaggugaugaggccugggagcccaucguggguagcaagucuaggagagcccugaggauggaucuccucgaugcuccucaguggagaauaggcgggggguaggggauggaggggaccaggguggaagcuggagaccugcccugaggcuacugcaagaagcagggaaggaugaguauccaaccacgcagguggggacaguggaaguccagaucccuccugcugcuucacccuccucuccccacccuugcuggaguugcuucacucuucuccuucccaggccagcaaggugcaugcgucuccaucuccgccugacugaccaggugggcccugcaccaucccgaaugucaaguggaaagggcugcaaguaggcccuaggcgggguugggguccugccucggcuuccugccugcagguuggccuugagccggugacugaagggcucuggguuuccauuuucucaacuauaaaaugggaagaguaauuccuaucucagcaaugcuaugaaauaauguauggccaggucauaggccagggccugccuacagcaagugcuccaaaagcguaccaaugccugcugugucagaccuccaggguucuccaugguuuucuagaauagucgucucucccugcuucugauagcauccauucgacuugauucuaccauuguauaaagcugaugacaaaacuugccaacgugaauuauuaguaagccugggagaugauaacagggcccaagagguaggcccgguccacaggcuuuagcaaaaccaagaggacaagccggucagagcaggguagacagcccuugcgccucugcccaagaaucaucagaagcuggacuuccagagccugcucagcucuuccagcgcauuccccagcaccccccugccagguauccucccuccccacccccuccugacacccccaccauuggcaucuuaauugaucucauuguucucaaacccuugagaccugagacuccagcugugcuuaaacagaacaaaaucucuuccaauuuccccaccguuuaaaagaaaauugaauucuuuaucugcagccuggggaggggaagagggaggcuaaauagagagggacacauacacacacacacacagacacacagaaaauaguaggucauuccagcccugcccccaggcuggccuggaaggccucuguggacacacucgcucccauuugggggugucuacggauguacuucugggccccuuuaaugggcucuucuguucaucucccucagaggggcuggggugggagcuggaggaggcugagcuggcugucagugauugacggguccggaguuccucugucaggccucagcgccccucgccuguguuuaucucuuuaaucuaaauaucugucuuugaaaccuaaauggcguggagugagagguaggaccgggguagagagagagaaagaggaagagagagggagggaggagagagcgagagauggagagagagagagagagagaacauagcaggcugucgccuuucuuccacugcggcuggggugcccccgccucugccucggaagugaauuguccuggaccuugugugaggucugaugguuuucagcugauuggucauucaacaaauugauuuuuggcaaauugauuuaaggccucacugccugucccgccuuugaagcacuccacagccucugucaccagcacuuccagaaucuaccauccuugaccgagcagcucugucugcggcuaaucuuugccccuuugccaaaacaagaggauacugcguucaucccaggccuggugaagcaguggugugagcuuagugaaugccaggcauuuuacagggcguucccugucucuucuguacccauuguguagaagaagcuggggcccggagaggugagcggcgugucccaggccagccaguuagugaccagccaugccgggauucagaccccagacggucugaccccaaagccccuggcuuccccuccauucugccagucacccucagggcucaccucccaagcugggcuccagccuuuuggagucagcugucuccaaaguccagggaaagugggcuugcaagguggaagcagcucacucccugggugaccuugagcagguccauggcugaaggggccucagcguccucaucuggaaaaugaaaggguucugcuggacacucucuaaggcccccugugccaacaacaccugaguguuccuguagacagucaccuccagcacagagagcccgugacacccugugcucugcuccugucagaagucacccuucaguagguucgcugcugauuguuccugcucagacaaucacucagagaacaccagagcgaagacaauggacccccugggccaggggacaaugggcagcuguacaaguggccagcgccagaaugaguuuguaaaugcugcagaccaaaugccuguucagaguccaccagugccaugagcuaggaagguuaugagcccuggaacucaggugacaggggagagaggggagagagugacagaagcagccacugggaacuaggccugagaguuuguccagggaacauuugggagaaagccuagagcagcagguggguaggggacccacagagguuuagggagagguugagcuggcucuguggguuugggguggcuuaaucucacucuguaaucucuguacaggggauaguagcugugguuccuaccagcuuguuucuggaguggcucaaaguuccauaugccugucauaaaaacgacauuuaacuucaugacccaggacacauacucacacggacacuuaucuccagcaaagcaguacuuccugaacacauguaauaauacacucuaguguuuucugauuuaauucugcuagauuucauuuucuaagugcuaaccaugaacgacuagauugauuucaugaccaacuaauggauagauguucaaccaaacuaaguuugaaccucucuagaaggagccuucucugcuucaccaucugaugaggaggaggaagguaguaucaacuuguauuucucuaguguucacuacagggagcaaagggauaaagaccgcguccuccagacuuagaucacccagguuuacccugacucagcuguuucuuuucuuuucuuuucuuucuuuccguuuuuuuuuuuuuuuuuuuuagacggagccucgcucccuugccaggcuggaguaccauagugcgaucuuggcucacugcaacuuuugacucccugguucaaacgauucuccugccucaaccuccugaguagccgggauuacaggcgcgugccaccacacccagcuaauuuuuguauuuuuaguagagaugggguuucaccauguuggccaggauggucucgaucuccugaccucgugauccaccccgcucggccucccaaagugagugagccaccgcgcccggccugacucagccauuucugagcuaugauuuugaauagguuacuuguaucaacaaugagccaguacagccaccagcaacagagaccccaaaaacaguuguuuaaauacgaucaagguguauuuuucucccauguaaaagcaguauacagaugaccagccuugggcggcuccuuccagcucucuucuccaccaccccuagggugugucccucaucuucauggucccaggugguugccagaacuccagccaucacauccgucucucaagcuacaggauggaggaaaugaaaaagggaaccuccccucccuuuuaaggauaccuccuggaagugcuuugcaaacuucugcuuucaucucacuucacuggucaaaauuucgucucacauggcugugcuuagcugcaaaggaggcugggaaauuuagcauuuuuagccagguagcauuguguccaccuuaaaaaaaaaaaaucaguuucuguuaauuugugaaaguuagggaaggcauggcuguuuagucucugccagaucaccucugugugccuccauuuccucuuuuggaaguguggguggugauaguucauuguagaauuaugugggcuucagugaaaucauacauguaaagugcuuagcccaaugccugacacagaccaggugcuaaucaaaugauagguacuaauauugaggaccuggugccaagcugcgcuccugucacguguguuaucgaagccucaugacaaccuggugaggcugaaauuauccuccccauuuuguagaugagagcacugaguuucagagaagguagcucugugucagaccacacucccaugaaaggggcauaacggaggcacgaaccuccuugucugcaagaugccaaaauucuuucccuuaaccauggggcagugcagcccccucauggagacugaacugcuccccgagagccuggcgaaucuguagggcugagaugugacgagacagaaacugaacuugauuagccaacauacaagcugacccaggcccagcgcucccucugccggcccagccuccugcaggagaaacccacccacccaccuaaaaagggaacaaagccaggacaaaagagcccuuuaggcuuccacuguaucgccaccuacaaacugguagucagaagauucagguguuugacucacugaaugacccuggaccagccccuuuucucugaacaccuccguuucuccaucugcaaaauggggaggauguuacugugcccucucuaccuucuggggacguuuuuaaaacagugaggccagaguguuuuggauuccuugggaagcaaauaaaugagauaggcggcucuucucucaguggguuucuccagccugccuuaggacauucugauaacugggguggggugggcagaggagucaggaaaccuaaaugucaggggacugggagugagggcugcuucuuggcaugggugcuccuagcguaccccucccacccugcgcgcccucccacccugcgcgcccucccacccugcgcgcccccucccacccugcgcccccucccacccugcgcgcccccucccacccugcacgcccccucccacccugcgcccccucccacccugcacguccccucccacccugcacguccccucccacccagcgcgcccccucccacccagcgcgcccccuuccacccugcgcgccuccucacacccugcgcgcacacacacagaacccagcugcaccaucccugcaccaucacggugcagcccugggcugcgugggcccaggugagugaggggcugggcccgcagccucugcuggucucacagaucaugggugauuuauauuucccgcgugggacuuugaccuuaauuucuuccggcagccuggggcuguaaaauucaucagggaccugcgggcggagugacggagaugucaggcgagcaaucguguggguauuuaaucuaucagauguguggcuugccauuuagggagacaacaugagaauguggaaucaauaugguucauuagugagccgcaugugccaacccaaucagcacccgccagugacaggcgugggggguguccugccaggcaccaagucaccuuggagugaggacaugucccuggagcauaggcagugaccagccuccacccagguaccucucuccaccuucccacuagacugggggcugccugacaccugcguaucccacagggcaagggagaggagggagggugucagacuuaugacuugugguggggacacugggaagaugcugucaugguaggaggcgucauuaccagcccagguuucgcugcacccccaggggguugacuggacugucuuugcccccuucucucaucuccuuggcucauaaugucccacuuaacugagccucagacacggugucuguccccacaucucucaggcccuuccccuuuuccuuuucuaccacaucaucccaacucgauaacuggccccagagagggcccaaguccuuucugacugugagcuucuugcucccuugccccuucccuggguaucgccuguauccguuuccuagggugccaccagcugggcggcuuaaaacuacagaaauguauucuccugcagcucuggagucagaaaucugaaauggaggggcuggcagggcuguccuuccuccucaggcugagcggagaauccugccuggccuuucccagcuucuggaggcuccaggcguucagggccuguggcugcagaacuccagucucugcaugcgucuucucugugccuuuccucuggaugucuuuaugaggacacuugucauuggauuuauggccugcccagauaacccaggauggucuccucaaaaucuuccacauaauuauuuucucaaaguccccuuuuccaaauaaggucacauuugugggucccagagguugggacauggaucuauauuuugggaggucaccauucaacccauuacacacccuugaaggugucuuaaguagugacagggacauguugauaaggacgugaagggcuagccauggggaccugacagcucuuccaaugccggcuuucguauuuucucuccgugccccgacccgucucugaaccacccaccccagacugcagccuccuugggcuucucccucaguugccugccgggaaugccgucuccccugcaucucaaggccccaccucuucuuccagcugcagcucugcucugccuccuccaggaagcccugacugacucauggucccuggacuccucucggcccuugccucccuugccacucccugucuacaccauccuuggacuuuuaaccucuggccuugcugggucuuuuuucuugccccgugugggaacugugacuucaggcauguugcuuaaccucucugagccucgcuuuccuuguccauaaaaugaaaguaguauuaguaccugucucauagagugggagugaagauuaaaugugucaauacaugugcauuucuuagaauaaugccuggaacccaguaaggauuaaaucagugagcauuacuacuauuuuugcaguuaucgucagccagucucuuugccuguaaaauggaaugugaccccugugucucugguuauuuuaaagauuaggaaauuagccaagcaugguggugggcaccuguaaucccagcuacucuggaggcuaaggcaugagaguugcuugaacccaggaggcggagguugcagugaaccaagaucgugccacugcacaccagccucggcgacagagugagacucugucucaaaaaaaaaaaaaaaggauuacggacugguugcaugaagugccuugcacagugccagguccacagauggcacucagcaagggaaugaccugugccucugaggggagcccaacaccccuccuccaggcaucuccccagcaagaggccccagagaccaccagguggugccaggcacuuggcacaggcagacaccggccacccugacagccuuugacauaccguaauugcuucccccacuacgacuucuuuaagcccagagcugcuggccagagcaauuugcuccccaucaauuuuuauuuccagguuuuaaaauaaaauaaagggaaauaaggaagaagguuucggagcccaagaacaccaccaugucugugauaacaaacaagccgagggccucacaccucgagagcacccaucagccuccacccagggcugggccuggcuucccuagagcaucccuccugcagggcuuagcaccacuuccgcuccaccuccacggacccgcugcuggcacaggacaggcaggugggagggcuggccugggaggaggcucagcagcagcauguuugcagagggcuggacaaagagagcuuguagaacuggaaguggaaauaauaauacuagcuccacuuagaaagcggcgccugugugcugggcacagagcuaaagcaccugugugcauuaccuuccuuaauccucacaauaauucccugaggugggugcucucauuaccuccauuuuacagauaggaaaacugaggcucagagcagauauuacugugauuacuccuucuguucuuccuuugaucuccucccccuucccccuccucccuucucuccccucuuccuucuccuccucccuugaucacuuccuuucucuccuucucccucuccccuccccaucuuccuuuaucucucccccagcccccaucaucaucuuucugauguccuuuccucccuagaaguccaucuacucaggauuaagauccuuagcuugucugcuaaaaaaagauccucauaagucaucagauaucucauuuauucuuucaucuauuuagcugauauuuguuaagggcuuccugugugucaggcacuggaugggugcuggggaucccugggaaacaagacagacucaguuccugcccucauaaagcuuauauucuagugguggggggaagcccagucaacauucacccaggugcucuuaccaaaaccaugacuuucucccaccacaccuauccgcuggcaagaaccgucagcuccagauuccaaacauaccuggaguccagccacauccagcuggacuucccugaccacccugguccaagcccccacugccucccacuaccccugugugacugccuuaacugccucaucucggagccucuguuccugcccuggaguuguagucagaguuugcuuuuacaaaugcaagugcuuugcaaauguagaucagagugugcccacugaggucgcagggaagagaaggagcagcaacccagagaucuggggaagagugacuuagcagagggaccugugggugcaaagggugugaggcugcagccgcuuggccuguuaggagccuagugacugucugagaggcaggagcagagggcagugugugggcgaggugaggaggcugcuugaggauggacgcuggcacaaggacagccaggagcaggcacugcggagaaggcauaugcagcaugcuggccaaccccagugucuuacccaacgucccacgugcacguagggcagaacccaggucccacccccgagcucagugggauuuccaugacuuugcaccuggccacaaaucccuuuggaggcuuuuugugccuggucuugcacugcaccccccagggagaagcacauuucucacucucaaggagcagagaguccaacaggauagcaaagaugcguuaacacaaguuccaccugcaacugguuguuggaaagacugauugagagauauucugaggcuuccucugcagucaaugccgugauccauuaggaaugucuaccauuggcacuggugauggagugcuggcuguccagcccaaguccacaauggaacaaaagggagggaagguccccuucccuuucucugcaggccucaccacuagucagguccccauccuguccucacugcucuccugcuuggucccuccacccaaccagugcuuugagccuccagcccagccccccuucccaguagcacccucuuguucuacggccucccacaugcucagaaggcccagagcaggcacgagagccuuuuccugugaucacagccccccaauaucuccccuccaccccaccgcucacucccugguaccauugccaacccaggacguguacucucuuauccgucacacaaaaugcaaugggagccauuuuccuucaagcacccaucauuuccuuuucucccaggugcauggccacccccaggaaugcccauaaaggcacucagagagcagcuucccaccacacuuccccuuugcccaucuaacacccaccaugcucccauccauccagcccuggcuuccuucucagauuaaaucacuuccuucugagaugagaggggaaaaucaaggcuccaagcauuuuccuagaaguguggggcagacuggaugguauuugcuggccauuggcuucuaccucacacgccagagagaagcuggaacccuuguccacagcacuaugggagggaaggaaaaagggccucgggggccccagcaggcauguggaggucacccuggccucugggcuaccggguuccugcagcagaguccuccuaccuccugccagccacuccaaccccccagagcuuacaagagugcaguuaaucucacacaguuuaaggacuuauacagaggggcucagugaaugaugaaugaggaaagcauuaccagcgaagcaccggggcuccacagagcuguuuaaaaaugcauucucccauguaaauuucugcuccaucaauccuuaugacaugucaaacauugcuauuguuuccugaacaaauuguaccgcgugcccuucucugcagauuugugcaugagagcagaacuccucaccggcaccggccgccugccucuguugcugggacccagggcugcugcggaggcagcugggccugccuugcuucagagcagaagccccgugcggggcauuccugugagugugcgugcgugacgggagugugggcgcuggugaggagugauugagugcgugccugccagccuguggucugcagggacagacacccaggugucuagggaggggguguggaggagaccacaggggcugagacugggcuggagacaaguaggggugcugcuugaggcagagaaagagagagagagugugugugugugugugugugugugugugugugugugcgcgugugugugugagggguggaggugugggagaccucugaguagagucuaccugagccagacagggagagaaaaggaaaguuucuaggagagugugcaggggguacaggaugcagaaaguuguucgcagcugccugagaugcagagagaggaagagaaagggguuguguguggugcgugcauguguuuaaagaaguaggaaguauggagacacaggaagagagaugacacgaagacacacaaggcaggcaaccuguaaggugggggacccuguuccagggcaaaucaauggaaaagggugagagaugaugacuguuaauugcaaagaaagccuggguaagaagggguucucaggaaggggacaaagagacaggagggccugaacacuguuggaauagcggguccccagagagugggcauaagauguugcgcugagcaccagagggccgggagcugggcuggacauagaguuuugaaugcacaagaugaagggggacuacaugagagggugccaugggaaaagccccaggugggucaggaagggcaccugcagccagccagacugccccauccuuccaagguggccucagguugggccacacagcucccuccaauccaggcccuaagccaccugcacagaccaagaccaagccugggaugggguggaguccuucuuuaagggucugugggaagcaccugcuuggguaucugagggucuaggcucaggggcugcauccugggaaaccacagccagagaccccugccaccacagccagagaccccugccaccacagccagagaccccugccaccuuugcuggcaggcauagcuagaguugcugggagcccgcucuuuccaagcagaacguagggagcagaagccaccauggcaagaagggcaaacugccugugggggcccaucggucuucaacagggcgaggaggaugacccuaguaggagcacccuggaucccauggccgagcucucaagcucagacucagacuucucaggcucagacuucacucccccagccccaccaaagggaggagcaagggaggggaggucuuaagagcacacgccuuggaguuaaccauguugauucauguucuagcgcugugacuguuucacccuggccaagucgauugaucucucuugagucucuguccccuccuucaucuauaaaguggggauacuauggugcugguccuauagggcuguugggaagacugaaugaaauaaagugcaggaaaugcuugguaaauuugguggcacauaguuaagugcucaaaacgaaaugucagaggggcacccucuugccccuuccccucgcuacagccaggagaaagacuggcauugcugacucaggccucaccaguccaagcauguagcaauucccccaccacaggcuccuccaaucaccuuguauuaaccuuggaauuuuucacccccguauguauuuauuuuuuuccuuuuugucagcagaagaaaauuacacuucugccggcauuguccaucacagaaauaagcacuugcagaugcgauuauaaaggcccaaaugacagaauuaguuuugcugguaaugccagcauuggggagaaucagaaggaacgccuuauaaaucaggcacuagggagcagccagucucggcugcacccucucccccacaugcugacuguagggcagaggcugacugcaaggacagugcugagcgcugagcggccauugaucuucacagaucuuccccugaugguucugcugagggaggcugauggggaggcagaggcuuccugaggccuucuccaggccuuggugccagcaagugcccaccucucuccaggagcuaccuggacuucuaggugcgcagccgaugacugucccauagacuggcauacaccugcccaaagacagcuucuccaggaugaaucuuucuaagccagcagccucagugaccuucaagcccacuuucagccuuguuuuccucguaguucuuaccauugccuggaauuacauuacuuaguuauuucuccccuuggugaucugucuccccauucugacuuuuuuuuuuuuuuguaagauggagucgcauucugucacuaggcugaagugcaguggcgccaucucugcucacugcaaccuccaccucccggguucaagcgauucuccagccucagccuccugaguagcuuggauuacaggcaugugccacuauguccggcuaauuuuuguauuuuuaauagagacuggguuucaccguguuggccagaauggccuugaucucuugaucucaggugaucugccugccuuggccucccaaagugcugggauuacaagcgugagccaccgugccuggccuccccauucugauuuuaaguggcaguccagguuguccugcuuaggaugugacuucacuguugggcacagcagccagcacauuggaaaagcucaaaaaauauuacuaggccgggcaagguggcucacgccuguaaucccagcuacucgggaggcugagacaggagaauugcuugaacccgggaggcggagguugcagugagccaagaucgcgccauugcacuccagccugggugacagagcgagacuccgucucaaaaaaaaaauuuacuaaauaugugacugaacaagugucuggucacuguuuucaugaagguggcuucagaggugugccgggcaucuucagcugcuccugcacauccucugugccugucuccuucugggcagggcaggggcaauagggagccucggcaggggccaggguguuggaggugcucuauaaaccccgccucgccccaugcaauccagcaaccccucugucgcugcuugcugcccaccauggugucugauggugggguaucagccccacagaaggaagguuaugcuggcccuccguggcuggcaguggaaaucacacauucuacuaaauugggcagagauguugagcccuguauggggguacuacauacgaugcaaaaaugaguuagacaaacuucucuccuucacagggaggaaaguggggcacacacagacaguuuucaggaauggcagauucugccacauguuccaagagagggaugacgaggggcucccgggucaagaccagugaaugguuagggacucuaggagaggggcauuugggaugggccugggggguggaucagaguuuggaaggcaguuacagaaggaaaggauagaggaaccagcaaugagagaacagucugggguguaccagggaagagguagauacgagaacacuaagcccaaccagacuguggacacuaggguauggaucugaaauuaauucagcagaucauagggagccauugaaggauuuugggcagagaaggacaauaauuuuagcuaccggcuuugacuuuuugccccugggccucuuaugagagccuucacaaguaguaaaaugcacuaguguguaccucugagugccagccuagagccaguggggagccauuagauggcaacagagacacagaaacaccagagggaggagccuggagcacaguugaggugcucaccuggagcccugauuuggcaucuuuuuuuuuuuuuuuuuuuugacagggucucacugucacacaggcuggagugcaguggugcaaucucgguucacugcaaccuccgcuucccagguucaagcaauucuccugccucagccuccugaguagcugggacuacaggcaauugccaccaugccuggcuaauuuuucuauuuuuaauagagaugggguuucaccauguugaccagacuggucuugaacuccugaccucaagugacccauccgccucggccucccaaaccaaagugcugggauuacaggugugagccaccaugccuggccuuugguuuggcauuuuuuagguacaauaugaaaauggccagcugggccauccccuuccccaaucccugucaccaucuggcuggccugugagacccuggaaguuacccugcagggagacagagaugcucauuccuagaacauugcagggaaggggguguuugcagcaggaagaggaaauuuuguucucuauacauaggcccuuggcacuccucgaacccuccuuccuaaaaugggccccaagggucacugucugucugccacuuuauuugucuguuggacuuucaguuggucaaccacaaacaagucuugcuugggaggagguuguuuaaacggugccaugacaagcagauuggggcugggauagacucagucgcugccccugcugccuggauagggcaggauggcaggugggcgguggagcagccacaguggguccucucuggagucgggucagccagcaucuggggggcugcucugggaauacgaagaccagcuccacucaccagcugugagaucuugagcaagucacuuaacaccacugcgccucuguuuccucacuugcaaaagugggugggagguaaugacaguacuuaccuguggaguucuggucaaaauuaaauucauacauuaauaugugucaugagaacgugggugcaguuguaguuauaggugacagagauagacguaccuuucuugagcugccuuuauguccaggcccuauacuaggcccugggcacauguggaccccaugaccccacgcugcccucugggagccacauccugguugggggagacgcacguuaaccuuagcuucagugccucagugugaucagggcugggaauacugagugugcgcagggaggagcccuaacuuugccuugggggucagggagggcagaagggugugagcuaggcaggagagggaggggcgcuguucaagcggagggggcagagccagguccugggagcuacacgugguccagucugggucagagaugaggcuagacauucagggccgacaauguguguaggaggggagggguuuuccuucaagcacagaucuaccgccuccucccaggcccagggccccugacaggcccugcugcagcccggcacuggccccgcacccaucaaggcccaaggucagugcugcugcccucacccuggcagaggcaaggagcagcuuuucaucuaguucggcuuccuacacuugaaaaaugaagcucucccucuccuccucacccaggcauacauauuucacauggucauuaggcgguggcacugaaggacucacaaaucuucccugaucagcauccgcagccugggcaggcagugagaggcccuggggacaagggucacugugggaaccauggcugugcccaguccaacgugggcaggggaggccaagccuugcagggguugggggugugaagccagcuucugcucuaagacaguccaguccugucuccuggcacucaucaccuaauuucccugggccucagcugcuccaggccccagggugaaggggaugggaugcaggcaccucacauauccuucccguccugacaguccagagcaauuuuguggggcacccagaucugaagggcucauccccagggcucagaugugaccuucuccaggggcagcacaccccccaugacccaggccccucccuuccugcacaccccacuuucugcuucucagcugcucuccuccaccuccuagccugcugucucuccucuacuucccuuuuccuuuucuuucugucauuugcuucacuucuguccucuuucuucugaguccugccuucuuugucuucaccgcugucucucugccccuucccuauuuucucugcaccacccccuucuuauucauuuuucaggcauuuaugaagcaucuacugcaugccaggcaccgucugugcugugcagugagccccacaggugccugcccugcccucguccuuccccaaacccuuuuccuuugacaaaggcaaaugaugggggccaaggagguaugguuuggucacacagugaccuggaacugaggccuccacaccacagugaccccucgccaagggguucaaugacauggcagucagaucuucccaagaccaagcugcaguuguaacaguccaacaagaccaugcauugaugaccaugauugucaguggaaccugggggugggaaggacucugggauuccuccugcuccccuucuccuccgucccuguaaaaugaggaugaaucugggguuacuuugggcaguguggucuccucucgccuggaauaaccaggcucccuuccuucugagaacaagcgccccucuuggcucagaggcaaucacugauggagggcaagggcauggcuagguggcacaggauucaaacccagcacaguucuuucucuagcugugaagccuugagugaacgauguacugucucgaugccucaguuuccccaucuguaaauuggagguggugcuaauaauaguaccuaccucacagggcuguugugagggugaagggguuguagguagaaggcgugcaggagccagcagucgcugcugccguugugaggaauggcacaggcagugggagaggccccguccaggagccaguccuggguuggaggguggugacauggcucagugccuuccuuucacuuguucagcaugcacccccugagaaccugggaugagcucugagccuggcuggggugguggcggggacagaggucugcaccgucuauaggagcauaagcuguggggauauugaaaggaaauccaacacaagaggcagcccuauacaagcuggcagcccagagcccccagaaauggcaucuuucuguauagccaaguuuucuggauaacuaagaucuuaauccuuuggguauaaacuuuuuuucauuucauucauuugggauagaaauauauuuuucacuuaucugccuuccugaacugaauguacuaaacacaaauuagcuuuuccuugaaaauucaggcuuaucauaaagaacauagaauuuacuagauuuaauagacuccaggaacuuuaaaaggaaccucaaaaauauugagcgcaaagggaucaaaauacauuuuuagccaugagggcuuuauccacuuacaaucuuauagagauaccuuaaauauaaaacagaugcaaguggaccccaaagucagucugaggccuuucccuacgggcaucugguggcaggcagcaguuugcccagcucuggggcaguggucugggaagagagcagaggucacaucuagaccucugcauggauuauuuacugucucgaaguacugcauggauuauguacaaccucuucacccucacaacagcccugugagguagguacuauuauuagcaccaccuccaauuuacagauggggaaacugaggcaucaagacaguacauaauccuugcauggauuauguguuucauaaguaacuguugagugaaugaacgaugucauuuagccugcacuguggauuagaaccaugccagggacaauauggaagccaauauuccaagccacaaaagccaaacccccauuaaaacuuuaggucaggggagauggaggagggccucccugggauggccacaccugguguguggaggaacaccugguggcgguggagaggccaguuucugucccacucugcuucugacccgcuccuaacccagacuggcagcaggcuuucaccaggccucacuggggucugggccucagaaaauucacccugggccaaaggagacgugcgagaggaacauggguuuccuguggaccugaagccucagcugggccuggcaguaaugacuucuuguucucgcuguugcaggcaacugacaaugaugcaggcaccuuuggggaagucagcuacuucuucagugaugacccugacaggugagacucugcccacagccccucaggccccuccgcagugguccuuggcccuccccagacucaugagaucugggaacuuuucagugcccagggagggaggugcuggguccuguggcuagagcacuggacuggaaguuggaacccaugggcacuguggcugguuugacucugauuguggcacagccuuggucaagucuccucaacucucuggggcacagcuuaucugacccucaaaagauagccuuuagcuuugggaauggauccauugugucucugagaggcuuugaaguacuagcgacagcacaccgccaccaccgccagccgcaguuacuacaugucaggcucaugauggccaagggcuucacaggcauugucuugugucauccucucagugaaaugacagaagaacucagugcuaggcacuuuuaucauccccacuuuacagaugaggaaagugcaacucugagaggcuaagucacuuguccaaagucagacagcuauaagugccguggucaggcuucugcaugugaccuucaccacuaggcuacacagccugccccaagagggcucucaacaugcagcaacuuguagguggguuacucaccucccugccuaacacaugccagccuugccccaucacccuucaugguaaauugguccgggcuugauuuugggccaucucuuucccuugucuucaguuaauccaagccaaaggcagcccucuaacuuuuuuuuuuuuuuuuuuuugaaacagagucucacucuguugcccaggcuguagugcaauggugcaaucucagcucaaacugcaaccuccaccuccuagguucaagcaauuuuccugccucagccuccugaguagcugggauuacaggcacccaccagcacaccuggcuaauuuuuguauuuuuaguagagaugggguuucaccauguuggccaggcuggucucaaacuccugaccucaggugauccacccaccucagccucccaagugcugggauuacaggcaugagccacugcacccggcccccucucacuuuuaacaugcucgaaggccacgugucugaugcacugggaagcccgguggagugagugaggcggugggugucagcuugaaugacuggccccagcuauccgugggaaggaucaagaaaagauggggaaggagcuggaugccauggcucaugccuguaaucucagcacuuugggaggcugaggaggguggaucaccugaggucaggaguucaagaccagccuggccaacauggugaaaccccaucucuacuaaaaauacaaaaauuagccgggcgugguggcaggcgccuguagucccagcuacuugggaggcugaggcaggagacugguaugaaccugggaggcagagguugcaaugagcugagauugugccacugcacuccagccugggugacacagugaaacccuaucucaaaaaagaagagacagggagauuguuaggggcaucuguccauucucugucacucagugaugggggucugaaaugggaggaagucaccagcauggcugaaugcacagggagcccuuuccccagggaacccguguucacguggccuuauccuggucaucuuggauggucucaccucuucccaucuucugggccugagacuuuccucacuccaagccagaaccuuccaggcuugguggcuggcagcuguggucagagcacacagaugucaacugacagcucagaugaggcuccugaggggacauuuagaugagguaguuggaggcauugucuugccggaccuuucugcuaccugggagaugucuaccagccucccacucaaggcucauuuccucaaagucaaggggcagcucccaaaagcggaccaaccacccugcccuucaccagcugcuuucugcccauuccuagcauucuggugcaaaacgaucuggguuggcacacguuuuuacccucacaguucuccagcaucuaaauaucugcaguagguaggaacuccuguucauagcaggaggguuguucugccuggguuuccuccuugcuuaaaucaggcaacuccuccugcccaccucgugugauccugauccccgccacccacccacccccuuuagaaauagcagcucuucucagggcaagugaaagggaaggcagauuucagacuucauuuguuucuguuugucacucugggcaaggacaggcugggaaaugccggccccaucaacaagccuguuuuaaaccacgguguuccuucucuccauccucucggccuggcacagguucucgcuggacaaggacacgggacucaucaugcugauugccaggcuggacuaugagcucauccagcgcuucacccugacgaucauugcccgggacgggggcggcgaggagaccacaggccgggucaggaucaauguguuggaugucaacgacaacgugcccaccuuccagaaggaugccuacgugggugcucugcgggagaacgagccuucugucacacagcuggugcggcuccggguaaggugccagggagcccugcacuccugccauuuaucuuagccuucucccuguacuugcuugcuugcuucuuuuuuguuuuuguuuuuaugagacaggucucacucuuucacccaggcuggagugcagugguacaaucagaguucauugcggccccaaacuccugggcucaagcaauccuccugucucugccuccuuagcagcugggacuacaggcuugagccaccgugccuagccugugcuuucuucuugaccaacccccuagggaacccacugcaagaggggcugaccuucuauccgcaaagaauacugcacagauuucagagucaaauucuuggucuguguugggccuucucugagcaacgccucauauccuugguaccaaguggggcuuuauacacagugucugucucagcuuaaauauuaggucagaauuuagcaaaagaucccaccccccgacccauccacugccaucucccuuagcaagggcauugaguggggagcaguucccugugucaggaccuccuccaagcccuuuaacgacugacuagaaucaggaagugcugcagcuggaaggagccacagagaccauggagugcaaccccauuuuacagaaggggaacccagaggggaggaggcuugcccacgaagacauagucggguagcagagccaggucuagucccggaaugcuauucuccaagugcuuccugcagcaagucccccacuaggcuucagugaccuuuaaccagagacuuuuaaauguccccccuuccccaugcugccuaccccaagggaugggacccagagccuccauuuggaacuuguuucugaagcagguagggaugaaggcaaggcuggaagggugagcacaggggauaccaagaagaacagaacaugugcccgcccagccuggccacggccccccguacaacccuguccugcccugcccucccugcucagcuccagguguacccggagugguggggaccacuggaggcucuagagugagggacaaccuggaaagaagcuuauuaauucagcucccagagaagacagucaagggguagagggaucccuggccccacuccaggugccuucuuuccuccuugcuuucaugcaacaugcauggauuagacacccacuguggccaaauacuguguuggccuguagguaugcagcagcaaucaagaaacaagguuccugcucacaugaagcugacggucuaagugagggaggcagaaauuagauaagaaauuaccacuggguguaaggggaccaaugggguaugcaacccuagggcccuaaccggcuccgggagucagggagggcaucugcagguggggguguuccagcugggguugggggugggagguaauugugucucagccucugggaaggcccggccucugcauuauuccugcgccucccaccugcccucuagauuccccaggcugccuccacacccagcacauggaggggagcagggcgucugcugggagccagagugcggccuccaguugaagcacaaggggugccuccuggcguccugggccaggacaagacccagggcuggaucacccaaaaaaggagcugugaacagggccagucuuccccacccucccagcugcccacccucuucuggcccccagucuccugcaggcucacggcccuugucugcccucuuccuuucaggcaacagaugaagacuccccucccaacaaccagaucaccuacagcauugucagugcaucugccuuuggcagcuacuucgacaucagccuguacgagggcuauggagguagguguggggcagaacucggggcccagccaggaggagggcuggggggcucucugcacucacaccucccuuguggggaugaggcgggcacuccuugucucccugacacucugggcuacucaggaagcugcccggagcaccugggguggagcaggauguggccugagucgcccuuccguagggucaacaucugugucccucaucagcaggaucucucucugguucuuaggccauggccagcccugcaaucgagccagaagugugauguuaacagaaucucugggguucucuguuucuuaccaaggcugcaggcagguccgugggauggaagcucuuuagccaagacucccuacuuuuugggcggccgugugggaccaggcacucugcaccaugcccugcugccugcuguggguccccaucccuagagcccugguaggaaauagcagcaaccucaagcuccaagaucccaagagagacuauuuuguuuuucagauaaagcagcuaaggcccagagacagggagcaacuugccugagcucacccugcaaagcugcugagcuuggcaccaaguccccguguggucuggcccuugguugccuugcgagccucagcucucagcagcccuugccccaccagaguccagccucuuugaacacuuugacacugucuccccuuacugguguucacccccaugucuuugcagaguuuguuccuucugccaggaaagcccuuccuccuugccccuugguccugccucccuuuggcuguccaguguguagccccuggcuagcuuuaagggcucauuuaacaccuccuccuuugggaagcuucucugauuccuggagccuggguuaggugcccccagggcagaaggaaucgaugugcguugagugacucuggguccaguggucauuccucccacuaccccacaguuaguucaguucagagaaaugccacuguagaaauugcaguucugaccagcgcgguggcucacgucuguaaucccagcacuuugggaggccgagaccggcggaucaauugaggucaggaguuugagaccagccuggccaacauggugaaacccugucucuacuaaaaauacaaaaauuggccaggcgugguggugugcaccuguaaucccagauacucggaaggcugaggcaggagaaucacuugaaccugggaggcggagguugcagggagcccagguugcaccacugcacuccagccuggugacagagugacacuccgucucaaaaaaaaaaaaaaaaagaaaaagaaauugcauucucuaugaaaucuacaucccucugucuuucuuuuuuuuuuuucuuuuucuuuuuuuuuuuuuuuuugagacagaguuuuacucugucacccaggcuggagugcaguggcucgaucucggcucauugcaaccuccgccuuguggguucauacaauucuccagccucagccucccgaguagcugggauuacagucgugccaccacgcccagcuaauuuuuguauuucuaguagagaugggguuuugcuaauguuggccaggcuggucuugaacuccugaccucaagccauccuccugccucagccucccaaagugcugggauuacaggugugagccacugugccuggcccaucccucuuucaaaaacuuaaaaguuccaugcuucugccugccccauaccucacccuccucucaacuagaagaaucccccuuagauuuuauauuacuaaagcaauaaucuuguuucccuuuuccaaauagaaaguuguaauuuaauauuguuguaaugccuucuaagaccucccaugccccccacucccaagccaauauaccuucccuccccaguugagaaucaauggcuuagcacaaacaaguacuaauggagagauuucagucgugugcagugguagggauauuucagggcacaggcaucuaucuuagcucccugcaaauccugccucucagccugggucugccuuuggccuuaggguucuucgcccaccucuaaacagaguucuguugaagguaaggucugcagcaccuaaccccgaguaccuccccauggggucuaaacagugcccagaguaggugacuggauggguaugaagagcccauagcauaaaguggggaggaaauggagggaagagaagagagagacgccaggggcaguggcucacgccuguaauccuagcacuuggggaggccgaggcgggaggauugcuugaagcagaaguucgagaccagccuaggcaacacagccaggcucugcuucuacaaagaaauuuuuuuaaaugaaaauaaauaaaggagaagggagggaagaagauuagagaaauagggcuagagaccgaggaggguccugccuucugcaccccacugccugguccucccuggcauccccagugcugggcaacuucuggggaacucugugcuuaccuggagagaggaguagugacagggaggccuggagggcccaaggcaugacccuguccuucgagcagcuuccagacugacggggaaaauccauaaagugccagaugagugagugagacagacagacagacagacagacaagcagacaggagcaccuacuaagaaagagccuggguucuggauucagccaaaccuaggcucaucuccccacucuguugagagcugugugaccuugggcaaguuacugaacaucucugagcuugguuucuucaucuguaaaaguggggcuuacauuaccaccagcuaucaccuggugggcgcagcacagggucuggcacauuucaggcagucaggaaaccucagucgagauguugaggcuccagguguucagaaaacaagccagagcuggcccgggccaugccagccauaacuucucugcccaaaggggaccccugucuggacgggcaucucaagucugcuuacagagggaucuggccuguuccugucauugcagugaucagcgucagucgcccccuggauuaugaacagauauccaaugggcugauuuaucugacggucauggccauggaugcuggcaaccccccucucaacagcaccgucccugucaccaucgagguguuuguaaguacccagggccacuggccuugcccugcuaguguaagggauggugagugcuuccugugaacccaguacuguaggacuguggcccccaccuccuuggcugucccugcaccuuggggaguuuacccagccaucugucccaaagccugcccuuagcaagucucuccacugcugcaacaacuucacugccuccccgcuuggccagggaaggcccagggcccugguacucaggaagagacacauugucugcucugacuucacugggggccccaggacacccucgguggggaacaggagcugggagucaagugaggaggaaaugucgugggcuuccuucauuuauggcugcauucugugaagaacagaagaaugaccagaaggucaucuucucccuucucucucucucucucucuauccugcucuuccuuuuuuucuucccuuuuccacuccucugaagaucuaaagcggucugaaaccaagccacaguuucucugacaugaauaucaagcacaccuuaguauuuucugugucugaaauuaucaguugcugaauccaucuccacgcugguucauuugcccaaugccacacggggaugcagagagugguaugacagcgggaccaaugggccccuccgcauggagaccuccccacacacaccugugcaugcaccgccugcccccuccccaucugugggagacagcgaacgcguguugaucgaagaguuagugcauuaucggcuccgggaggauuagaucagguugucagguucagagaugcgcugugauuucacauaagcucaggaaaaucucacccuggagcagacaugcuggagagccuuccugucacagccagcuucaccagcagccucugccacugcccacgcccggccuuaacaagcucugucuucucaacccgaggcugaagcuccagggccagcuuccaagcggaaaggccauugucugggccagggacccaauuugcuugcugaauaggaugcagcuggaagugaugggaaagucaaagugaugccugaugggagagccuuccaguugggcaugugggagcagaauuuagggggggccaggaggaugaggcuauacagaaccaggauagcaaagggaagggcagagaguuggggccuggcuucuggaguccuugugccuggcaccucagacuucagggaguguugggggaaggaggacagggaccaggagaucuucagaaaccuuaaaacugaccugggcugggcgcgguaaucccagcacccugggaggcugaggcagguggaucacgaggucaggagcuugagacuagccugaccaacguggugaaacuccaucgcuacuaaaaauacaaaaauuagccaggcaucguggcaggugccuguaaucccagcuacuugggaggcugaggcaggagaaucguuugaacucaggagguggagguugcagugagccgagaucgcaccauugcacuucagccugggcaacaaaagcaaaacuccaucucaaaaaacaaacaaacaaacaaacaacaacaaaaaaaaacggccugacucgaaccuguaaccucccaccuagaaacaccgaggguagggaacgauaaugcauucccuggcagucaugaccauggacuggcacuuuaccccauggcccgacccugaccacaucaccuaaaccuggccuuaguuucccagacuugaccacagcccccaagccuccucuaaucguagcugcacucacaacccugaccaacccacccaucgcuuucaaccagccaggaugcugcucugcacaaggaggcagugaauucugugcugggcccccaguaggacaggaaggugaaugugcagccugcuccacccccccuggagacaccaaguggaaagagggguguggcuguggaaagagggguguggcuguggaggcacauggguuugaaaccuggcucugcugcccucuugcugugugaccugggucucugaaacaacuuccucaucugcaaaauggugguaaucgugauaccugccucaugauauuuuugugaggcugaaaugggauugugcagguggcaccuggcaccuggaaugucuuaucgcuguaaugacagccaugcauagcagcagccgcacccaugccccagccugucgcuagugcaaaugggaguucccaugagugggcugaggcagagagggagccauucaggcuuuggggaguggaugcuggagaggguaagaguaagggaggucuagggaaauaaguuaaguguucuggcuagcccggggcuagacaggccuaaguagcgaaauggaaacuaaaaugugcugagcuccaggaacgugccaaguccuuucacaugacccagccccuuucagucccacuuuacagauggggaggcugaggcucagggaggacccaggcucaccagugccuuucuuccuuacuggcagagcugggacuugaacccugaccugaaugacucccauguugacaugcuuuccaccacagccacaggccuggaaccuuggucaucccuauccacauaugacugagaccagugcuucucaaacuucccugggcccuggaauucucuggggauuucauuaaaaggcagauucguauuuagugggucugaggcagggcugggauucuguguguccucccacacagcuugcaggugauguggaugcuucuggucaggggacaacacuuugaggagcaaggccuucagagacccacccucaugagauuuugaaaccugagcucugcuccaaaccccagaccugucccaaccuguagcucagcuaaggcagggacuggagcaucucguugugccucagccccccuaaaaggggccggagcaugcagagagaugaaggugaagggacugaacucacuuuuugucccugcaaauaaaagugugaccagcagccucccucccugggaccacagaggagguggguggggguaagaacccaccucacuuugcacuugggaagccagggugugcccuggcaugaaaccacaguggccuaguagaagaggccccauuuucaaauucccucaaagccaucccagggacaagcaggggcccugcacuucccuuccgaguacacccuggcccuggggcagccggagagucuggcaacaaagacaggugccaccuuggcuaugagugaacauugucucucaagcagggccucuggauggcacagucacuugugucugaggaccacacuugaaaaggucaccaccuucagggugauuuugcacguggcugguuuuuaaguagcugucacucggcuaagcggccuccucccuccaccaaaaggauuuucucccaauuggaauuuaaaaacccagcagcaaugaaguuguugauggcagcauuuccugcacagguuggggguggggagaggcagauggaaaccacagggcuccaggaggaggaggggccggaggggccaggugauucuuuuucauccacugcuuguugguuuuuaauaaagaagucaaacucgguuuguagauuucccauuaggggacaauaagcuuuuguagagcgagccgcugauuuagaacuaauagcgaaugcagcgccaagauccggggaaauaucaccgcuaauaaguuucugccucaugcucugucacugacauucuccacaccguuucgugcagccaagcagaagcuuaaauguauaaguauauggggcgcucgcacccgcaccagggacaggggagaugcccaggcacgcagcuggggcauuggacaucaggggaauccugagacugcuggguaucuggggagaggggcaggucagcgugacccagggugccauccagagccaaggggcagauuggagaaagagaggaucacuccugucugggcacccacaaucuuagcaggcugagauucucugaugucccaaggggggugcagccagagagcaugcccccaucuuucauggcugcucugucagcagcgacuccagcaaagggggcuucauacaggauccuuucccccuaagagcucucaguuccaugagaagccaggccuucucauggaacuccuauuugcacuagcaaacgaacaggaacugccaaagacuguaacauaaagacugcccaacggugccgggacucagccugacuccugagcucugcacuggacucuugggaaaggggagaaggucaugagccaagugggcuggggaggcuuccuccaagagggaagcagggaggaauucuuguugggagauugcaagagugguuggugaggauaagaguauuaaagggcaggaaagucucuucuaauugaagaggaagggccgcggugugaaggaguuggggggugcguagcaggaggcagaaguugcccacccuacccugccaggcucagccccucagccaagcaccgugcucuggcuauuggcaaaggcugggcuggaagagauauugcuuuagaacugacagggguggggcucuaggccagggguggcccaggggcuggaagagccguuguucucaugugcaaggaggaaucuagcuguaccugccagcagccagcccagggccagaguuugggcucugggaaccaccugacccugagcugccauagcauacuucaguaucuuugaggagaguccuagaagcuuuugucaucauccugguggaccuacgcagggguccaagugggcauccccagcaugggagcugggggugugagugcuggagugagccuggggcucagcuggaggaccagcggggagccuggggagcuggcagcugucggcagucccagcugcugccggcacacucccucuuccugggccuccccaucccuuccugaggccugcauguuuccccaaggcugguccuaccuccuagagcuguagccugccagaggguuaccugacucccugcugacaccucaccuggcucugguuauacggagaggccaaagcucuuuagggccagccagaccuagccugacuccuuggugcccaccuuagacaucuggccagcccaccugccucccugcagccuccugcaaccugucuguguuccuuccaggaugagaaugacaacccucccaccuucagcaagcccgccuacuucgucuccgugguggagaacaucauggcagguacaggcucaggucgggggguggggggcacauggagguaggcagccagcagucacggcacccaggaugugcagaccccggcucugcacacaaauugugggagguccauggccuucucuuuccccggccaagcuccuugacaaaucggggagccuuuggaaacaucuaguuaccugccagcuaacagcuaguuccagagcaccugcuaugugcaggugcugugcugggcacuugguuccugcucuccucuaacuauagucuaguggggaaagaauaaugauccaugauuaauuaagcaaucuugauuaaacagucucaaguauacagagggcucugagacuauagcacugugaggcaggucccaggggccaugauuucagagggguggccuuacagcggggcauguguuccuaugugaggaugcgauugagaggcuaaucucugggccaggcucagguugcagggcucaguuugcagacccagcaccaccagcuccacacucagguuccaggggaucuguucugcccuugaggcaggcuggcagcuucgcccuuacccucagagcaaaugauccuagcaaagaaaacgcccauaucaggaacugcugcaguggcugaaggagacaggaaggcuggaaucagggacaguagagucauggaugguggagucauggauaguggagucagggacauuggaguuagagaugcuggagccagggaugguagagccagggaugguggaauaaggaugguggagccaggggucguggagccagggaugguggagccaggggugguggagucaggggugguggaaccagggaugguggagucagggaugguggagccagggguuguggagucaggggugguggagucaggggugguggagccaggggugguggagccaggggugguggagucagggaugauggagccaggggugguggagucaggggugguggagccaacggugguggagccaggggugguggagucaggggugguggagucaagggugguggagccaggggugguggagccagggaugguggagccaggggugguggagucaggggugguggagccaacggugguggagccaggggugguggagucaggggugguggagucaggggugguggagucagggaugauggagccaggggugguggagccagggaugguggagccaggggugguggagccaggggugguggagccaacggugguggagucaggggugguggaguccaggggugguggagucagggaugguggagccaggggugguggagucaggggugguggagucaggggugguggagccagggaugguggagccaggggugguggagccaggggugguggagccaggggugguggagucaggggugguggagccaggggugguggagccaggggugguggagucagggaugguggagucaggggugguagagucaggggugguggagccaggguugguggagucagggaugguggagucaguaugguggagucagaacuggucuuuccuggcaccacgaggccuucuaaagagaaccucuggguaccacucuggcaccugacaaugagcugggugggugcugggcugcacccagccuacccugccuguccuagucaggcauccccuggagaaugucacugcuaaagagcugccuccagcacuacacccccaucccuggggacugugucaaggagaagccuucacuauggcacuuaauucucuucagggguauguuauggcucaugugccuguccuccugcucaaggcaggccugagggucauauuugaggccccagggccacagggccacuauggccugccuggccccuugccccucgggacugcugauucauccgcuggauggucaccaccagcccugcagcccaguggagcucccuguggggcucagccuguggccucaaugcuuuaucccucaggaucccagcagcaaacucacaaguuagaggguaucuuuagacccggucccaggggaagaagugaugcucaggcaggugaaggcgccugccgaggcccugagggguccagucugggugugaagauuccaggaaccugugcaccggaccuccucaccacugggccagagcuggcaguuggguggcaggaggggcuggagccagaagccuuggugggcacagcuucaggacaagcuguucucagggucuggacaggguggcuggaaaagcugauaccuugagucaggauuucacggaacuggaaauaaaagugaaggccuuaacugaacauuaaagagaaaauaaaaacccuuauaaauuccccugaacgagauaaaacuagacugaaauugaauacaguaaauguagaauaauuuaauauggaauuucaugucuuuugacuccaagugacaguuggccaaucugaguguauuuaauauaguggccagccaagcaggggccagggagacaggaagacaucagagggcccaguccaucccuaagccucucaugagccuuguccccacccagcccagcgaucucagcuccaagagcaacgauugagccgcccuugucccagggaugucgcaacaggcaggccucccaccucccugagagcuggucacugggagggucccacguccuccucuugggccagcgcaaaugcugcucccagggcuggggccuugaagccaggggcccagggugagcagcacccccugcccccaccuuuuucccccugaaggagccacggugcuguuccugaaugccacagaccuggaccgcucccgggaguacggccaggaguccaucaucuacuccuuggaaggcuccacccaguuucggaucaaugcccgcucaggugagcccccccaccccaaguacccugguccuccacacccugaggcugacuguccauacccggccccaggaccagccucugggcccagguccccuuccuuucaguuuugagcagaccagcuuugagcaccaguguaauccaugaaauauuaauuugagugugauuacugaucuuacccaaaaaaucacaacgugaauugacccagugaaggacgucuuucaagggugaagaguuguauuauguuuuaaaugugcuccaucuuacaaagagcugguuaacacaccccucuucaggaacaccuuuauuaaagccucagggucccccucccucagcugcugaccucauucuuaaagccuggcuccucuucuuacacggaugugugccucaguuuccccaccuguaaaaugaggaagaucauauuagggcuguuguguggauuaaaugauacauaauagggagcaacuuugauuagucccuggcacacgaaaagugcuaaaaaaaauuaccaucauuauucucuuuuguuuauucaccugugagcccccugcccccagcucccagcucagcccauguaacucucuucuuucuucuucgucucuccauguacauuccucaguuuucucucuuccuugaagcugggagaaaaagugggcagaaagaagcagcaagagauccaggcuuucagccagaccuggggaagaauugggacuucuguacauucauucauauguucauuuauucauauguucauucagaaauuggggugggggcugcucugagccaggugcugggguacaggaaggaauaagacauggcucugaccucaugagguugcuagucagcucagugggcaugcaaggcaccccacuuccaauacgcauuucuguaugaguuaaaggaacugucgaugcuaaacagcuacacccuaucucaguggcuugagacaauacaaauucaaauucauauagucaacccauguagauguugagugacagccuuccacaugaugauucugggacccaggccccuuccauguuguggcuccaaggucacugcagaagggaaaagagagcauggguugucagagcacuaggaggagguuaugggccaggcccugccuggcagucacauccaaguaauaauucuccccugggaagggagcaggaaucuuugguggacacuggccaucccugcugcagguggucaguggccagcagggcaucagcucuuccugcuauccaucccuccacguuggaagucagccuucaaucccuuuuccuggaggcuuggggagcagauggccggugcugauggguacgaagacugaggaaggggacccagggccacugugagccuccuuuucuaucucugagaaagugagggcccuccucccagcucucaggagcuucccccacagugagcccucauucccaggggucucagagucaugucaugaauggauaugaaccacaugcccagcacuguucccagggcucugagcagcagcagcaucucauucugcccuccucaccugugaggcagguacuagccuuauccccauuuuccagaugaggaagcugagccacuggggagguuaaguaaccugacugaggacucgcagagcacgaacuucugacuccagaauccaaacauuaaaggcgccauuauaugaguagcucccuggccuuuuagccacccccgcccuugccuccccagucggggcuccagcuccaccuggggccuuuaaugacacagacauuuucuugcugccuuaacacgacuuugucuccaaagguguaaguguuuuccucugaguuccucggucaaauuagccagggcugcuccacagagguggccuuaauuggaucuaauuuccuagacaggagaggccaucuaucaugccgacaaguucacguuuaaaacuuuuuagagauuaauuucuuccucgcccugccaauuacuugacaccacccuggcagggaguguggcucguugggcagaccuuugugagucuuccauuccuggccucagcaccuaagcugcccugucacccacccccagcucccugcucagccccugcacagaccagagggcaagccagugugccacagagggaacugucaggguagaagcaguccuaaaagcaaucugguccagcugccuuguuuuaugguggaaagaaccaagcacagagaaguuaagcgacuuggcccaggucacacagcucaggcaauggggauaaaaagauggauagcacacaggcccugcccguggagaaugcucacgguccauuggaagaaaacagucauuuucugaguguugggagccucaccuagaauuacuguagccucacaacggcucugcauggaagucacacuaaucuccauuuuauagaugagaaaacugaagcuucaaagaauuaaaauucuccaaggccaagcgucugggaagggccauaaucagaauucaaauccacaucucacaucuucaccacgugggugcucucccauggcugaugcaagauaguaaauggccuggcugcugugauugcugaagucugcugggacuggcucacccugcucccaagagcuagcgaggcacucaauugugaacuccauauucaauaccaccaaguugguagcuuaaaaugggcccugguggggcuauuuacaccaaggaaauuggcaaaugccuuuuuuuuuuuuuauuuuggggagccaguugucaaacauuuaccagcacgccacuaucagggugauguuugcauuucaguuacaccaaaauacaaagaaagaccaaauacaggcgaacaagaaauguuguuuaauuguucagauuuagcacacuaaaacaacucgaggcaauguaauuaugcucuucacaauguaauuaggaaauuauuuuauaacuauuaauuaucaaugcacgauaagguuggauagguugaacuguccaguaaugagucacaaguuagacgcaugugaacacccgguguuuuuauuuccugucauuguauuucugugacuguauaaauaaacagugccuggcacuguucuaagauuuccaugaucuuaauuaaauuaaccccacaauagcccuaugagguaguuccuauuaugguucccuuuggacccuaugaggaaacugaggcacagaggauugaaguaacuagcuccaggugagaaagccaguaagauaaugucaaaagucuaaacaagaggugaucugugacugagcuuaaggccuaauggcccuccugcccuguucuccagccccuaaccccgagaaucagccuagauuuucccacaucugcaaauauuuccuccucaugggguuauguugcccagcccuggggaaccagcucccaaggcacaggagcucucccgucucccacugugagcaccagcucaggaacacauccaggccgccagaucaugguagcuugcuaacauuucucgugcaaguucucacccucucuccuucccucgcucucucucuucuucccucccucucucccuggcccacccaaacccucucacgcacccacuucucucucuggcaggggaaaucaccaccacgucucugcuugaccgagagaccaagucugaauacauccucaucguucgcgcaguggacgggggugugggccacaaccagaaaacuggcaucgccaccgugagugcgcuccccucccgugccccagcucccccucgccggccaggcugcugcucccugcuuguaccucuggacccccguguccugagccagugugaggcuuugugagaaugagcaagggggcgaaaaugaacccaucagcagcagaggucagcccccggggccaccacagcuguggggaagaaaggcaucaccaccaggaauguaggggcacuugggaggagcaaaaugaaauacuuucucuccugccccuaaaaauccaggagggcagguggcagaaggcaugagccccauaggccccuccuugccuuggugccugucaacaaagcagaagcaggcauuccugcgaggaagagcagcucagagcaggaagcagggcccuggagggucccugggggcuuguucucccccaucuaaugugccccagagaguagaaagcuagaggaacgaaacgugggggccucgaaugagcucucggcugcagaagugaaaggggaagugagaagcccucugugggagaggaagcgggaggaccagcugacagucacuccagccaccuccccucuuuguuccccauucgguuucuuuggcucacccucaaaacuguggcccucacccagucugcagcagccaccccauccuuacccagccagagaggcuggagacgguaucgcguggccagggauuugauggaaaaauccccagugcccuacucugucaagggaggcuccuacuaauaggaaucagagcccuauaaauaauguaccugguggcaggugagcagggaaauugcuuggcuuguagcugagacggggaggcucaagggauucuauuagaucccccacccugucagucaccuucagccaagacuggaggcagggaugggggaagccccaggucacagcaaggauuucagggcuuaucacauccauuccacugccuccugaugggacaacacuggaacucucucuccugaagcggccuggcuccuuccugcccucgaaagcccaggcucugcccaaggcucccaagguugguggagcuggcagaauuaaugcgaagauugcccgugggcaucugagcacuuuuccccuggcaggcccugcccuggcccaucucagcugggugugucucccagcgccccuuauggcuucacagguaaacaucacccuccuggacaucaaugacaaccaccccacguggaaggacgcacccuacuacaucaaccugguggagaugaccccuccagacucugaugugaccacgguaggugguggcagagcagcagaacugccaggcggcccuucccaggggucugugccccucccacugcgauuccagggggccuuccccuauggggcugguggacucugugucccucugagcuggcucuugcaauagaguucuagcgguucuccugcauggugaaaggcagucagaggucaagggaaagcccucauccggccuccagugucaguaggccucaggcuuugucaaagggagcuucaggcagcccagggacaguggcaggggagcucuggccgguuccgcuugugagccacacgugcccuuagagcccaggacucuggccacccccucuggagagcucccaccccuacacugcacaagccccagcuccaccccagcaccugucuuucacugcugugccccugcagucauccaucugggucaccucccccacgggcuggcccccacggcugcccagcagggguuuuguucaccucaggaauuuucuggcacagguuugccagguuugcacaggccccuguguguguugugugcucaugugcaggaaugugcacaauucagggugcagaggggagacacggucaaagccagggcaucuccagcggagaccagaauccuggggaaacugaggaagcccaggucccacccccacaccaucugcucugcugggagguccacauuuuucagccuucuccucccccacccuguacaccacguggccuuacuugaggaggcuuguccccacaugaacauccccacugccacccacccagcccugugggggacaugaauccuggcaauugacugaacaccugggaugugcucugagccuccccugagggcuucucaggaacucucuccuccucacuguaaucucacaaggcagagggauuccguugccacugcacuguggaggagacagacuuagagcuuaaaggcuugcccaaggucccaaagcuaguaaagggugcggucaggacucgaacccuggucugucugacuuggagacaagggauuagaaaccaccuggcccaguccuuauuccucugggagggggcacccacacaccagcugacagccagucagugaacaauguggaaaggaagauaggcaugacggccaauccuucccucccucuuuguccuuccuuccagguugaccuccucucccauccagagccacugccaaguauggcucuggcacuggaauaggcacaguggaauagggcagaggugagggaucuggaaucugcgauuuuuuucaaagccccguagaggaauuccuuccagcccagggccagguuuagaaaccaggacccucgcccuuugacacagcucucuaggcucuuuggugggugcucucugcugccgccuugugggcacugcacuggcccaggguaaccuccuccccaccccagccagggauuccaagagcuggggcuggaucucaccucugaacaccuucuggucaacccucaccuuucccuuagguuuuugggaaauuccucccaaaggggauugaggggcaggugaggaagguugcucugggaaaagggggcugcacaggacaccagccuggauugccguuaucaaauaguacacccggcagacaaggcgugggugugccaggugaggacugcacacagucuugggcaucugcaagcuuugguccccccgcccuucaccaggucuccugcccuccacauguccuucugagccaugagcaggcauggacaauggaccaaggaccugcugcccagugccuccucacuuuccaggaaauccacgagcuaucagggaaugccuacugcaugccaggccccacgcuugucaggcugaggguacaggaagcaacaccaggccaggugcaguggcucacgccuguaaucucagcacuuugggaggccaaggcaggcagaucgcuugagcccaggaguuugagaccaguaugggcaacauaguaagauccccacccccuuuauaaaauuuuuuuuaaguagccaggugugguggugcacaccuguggucccagauacucaggaggcuaaggcaagaugauuuuugagccuggaugauagaagcugcagugagccaagaucacaccacugcacuccagccugagugacagagugagacccugucucaaaaaaaaaaaggaagcucccgcccugccugccuuuggggagugucaugucacucuucuauucaaaccccagugguucccaucucacccugugcaaaagccagagcccuugccagaccuacaaaacccgcagggucugccccauugucaccccugaggagucagccgcaucaucccuaucuguaguacagagcggguguggcuguuccaccgcuggcgucaggugggcacaggcuggagauuuuuggugccccaggguaguauuugagaccugaaaaauaaaugugaugaccugaaaguucaaagauaaaagggcaaaaucaaaauuaaaacuuguuauaugaaacaucuaucagaugaaagauggcagcuuuaguaacuaugaaauuuaguguuugugaaaauuucauuacauucgaggacaaauuggagguuagauuuuucuagaauucuugaaaauuuuccagaauuuucuggaauucccaguuacguaugaugauugccaggaaaucagaaaucaagaagcuuauauguuagucaaguuugucauagccaaauauuuugaaaaggaaguuauaaaaauuauuuccaauuuuauagccauaaaauguauauaugcauacauauguauauacauggguaugucucauuaccuuggagaggacccccuggagacuucuagggccucacagugccccagguugagguagggucuguggccaaagugugaggugagguggcuacagagggaauagcuaacagaguuucaggugacagaaggaggaggugauauuugaacaggggcuggcccaccaccugacucaucucccaccccacccuucccacacccaccgcacacacccacgcccacaaccaccacccauccccaacacacaggccuuucguuucccugcacccacucaacucucccccagcucagagccuuugcacgagcccuuuccucccugaccccugcucuuuucauagguagcucauucuguuucaucugucccagcuuaaaacgucagcugucuuagagaggcccugccugacuacugucuaaaguagcucugaccccucuccaaauucuguuuccugcagagcuggacccacaaucugugcuuauuuguuuuguaggcuauuugcuuauuaagaggcacgugguuuagugauuaagcaggcagccucugguaccaaaaugcccaaguucucacucuagcuacaccacuuaccagcugugugaccuugggcaaguugcuuaaccucucugugcuccaguucuucucaucuaaaaaauagggcuaguaagaguccccacccgauagaacugugaucagcgcuuacugagccaagacauaggaagcacuggcacauggggaguggucgguaaaugguagcugucaccaucaucacuaucauuaccaucaucugcuuccuuugcuggaaucgcacuugucuuguucacugucaaaccauacugccuagcacaguuccaggcacauuguagguguucaaaauauuucaaaauauguguuguugaggacugauacagcuggugaauaucuuaccuuuccuuuccccuacccccuagcucagccaggagguggcugggucuuccuugucggagguagacuagggcguauggcccaagacucucucaagagcccucucuagacauggcaugggccacagcaccuggagucggaggcacaaggcaaccccagugauuuucagagcuugcaugcagacaagugucuucccacauguggcuucauuugggugcauuuggaauuggugcagugugugcaucugcaugcacuggguauggccuggcaugcaggcacugaggauguccaccugcacuggugugcgcuggcggaguggccgucucucugucugcaagggagauuuuggucccacucuucuuccuggcuccugcagcugccuucaaggaccuggcugaugggcauugauuuagagccuuucaaagcccuccagcaaaauaaaggagaggggagaaggagagaauuauuccccaucaggcuaggagaaaaaugacgggcgugaaaugggaaauaaaugaggggaaaguggugagauucuacaaaaucgcccagcagggagccugcaggagaggucacagcccuccacccucuccuguacucccaaccugcccugugaccagagagugggucaagagacccaaaaccauugcccaugcccugaccaggaucacuuggaagcagcuacccuggcacucucuggcaugguaggggcaggaagagggaauggaagaggagaaaccacccaccaugugaaauguaucucagccuguucagcaacaggccuggccuggaacaagugauuuagcugcucucuuccucaguuuccccauccagaaaaauaaaauagggagaaaaucaucucucccccaggcugggugcggucgcucacaccuguaauccuagcacuuugggaggccgaggcgggaggaucacuugaggucaagaguuugagaccaaccuggccaacaugguaaaaccuugucucuauuaaaaauacaaaaauuagccaggcgugauggcuuuugccuguaaucccagcuacucgggaggcugaggugggaggaucacuugaaccccagaaguggagauuacagugagccgagauugcaccacugcacuccagccugggugauggagcaagacuucgucucaaagaaaaaaaaauucucccuuuucaaacuguugagagaagcauuguagaaacacaaggaaugcuggucuucuauguccaucugugaaacgacuuggccuguuuuaaauuaugccuggaguaccuaagagcccuaucuccuguuugcaaaauggggguguugggcuucccuuuauggaggcuagggaaacugaggcaaugugcccacagcaagauaaggacaccucagaccuggaaggcagggaccuccccuccucuacccuuuggugcugcgaggcugggaagggagaggagggccgagcagucccuggugggagugggggcugcccccaccucucugaaggagaagccugccuagggugccacagcauucagcccuccaucagccucucucuccccggccuccccaggacccauggacaggggcagaugggaguucucagccagggcagcucaucugucuguucuggucugguggccccagagacaccucuggcuggggauuaagcagaggagggacagauucugcugccaaagcacaaaaggcuccacaucaaguaagaugaaggagcugacaagccuggcugucaucaccgaguguccugcaguuaagaauaacacuguccugauguggccccagggacuguagucaccucucuccccccaccaccacugaucuuguccaccccuggugccacaguggccucugcaaugcagggucgggggugagcgagggguaaggggccaccucaggagccuccaggcugggagcugggucagcuccaaggcuggugcugugugacccuaagacuggccugugccucucugggcucugcuuucuccuuguggaagguagggcgguuggaggacgagggagcuuccccacagagcgggggaucggugcacgcagggggccucggcgaagaugaggagcccucaaaggcugcagggggcccuuugccuuuuguuuaugaccuggcugugugggaucugggacacuaagggacagcaggcugugggguucaccgccccuggguuaggauggcacugagcacugaccccuucaugacguggggguuauaaguggggaaccaggcuguaggccggggaguugaaggggccagagugucugagguccaguccugagacccugccccuuaucagggaccauguaccucccuuccagggagcuccacccucuccuuccuuaacacucccccagcccugcgacugccccagcuaacugggucccaccuucugaaacugggccccagccauggcuuccuucacaugcccugucaucucuggugucacaaucuaaugcuucaaaggaaggaagggagggaggguuugaugaggaggaacccagucuccaaaauccaggguuucaaauccuuucaaaaaucuuagcuggaauacagacuccccagccauucccagccccuccccuagagaacuccugccucccagcccucucggaccccccuaccgggcccagcggggaugcccacuuccugggccagagccaggauguccccuccccaggaccaacgucugagcucagauacucccggccagcccagagacacccuccccaggcgcggcucagugaaggggucugcucccucccgggcaggugguggcuguugacccagaccugggggagaauggcacccugguguacagcauccagccacccaacaaguucuacagccucaacagcaccacgggcaagauccgcaccacccacgccaugcuggaccgggagaaccccgacccccaugaggccgagcugaugcgcaaaaucgucgucucuguuacugacuguauggaccccucucgccccucacggcccccacaccuuaggcugcgggugucccuggugacugggccucugggguaccuggggcccacccaggaggucuaugucugaucaccaagaguagaguaauacccacgccccaguugugacuccuagagcacccugagggaacggagggagcuggggaggggagcugugaggccuaggcugcuuccuggaggggccuuugggauggagggcucugaaucugccacccucucaccacuugccuucuuccuguccguuuucucuugcacccaucuuacccuguccuuggccccuucucgcccuggucuucccagguggcaggcccccucugaaagccaccagcagugccacaguguuugugaaccucuuggaucucaaugacaaugaccccaccuuucagaaccugccuuuuguggccgaggugcuugaaggcaucccggcgggggucuccaucuaccaagugagucucuaucaucucauuccuaccagcccagaggugggcagugggugccugaggagccuagcccaggcugaaaacuuugcagggcuggggcaggggaggagcugggucuugaaggacagaggcucuggagauguggagggaaguguggcaggaaaaggauagggagaugggcaaaggcagagguagagagagggagagaggcaaagauggaauucuggaagucauguccaaguuucucagggccugauuauggaggucuggcccaggaccuuggaccuuccauucccuaagccugcagaugguucuagaauacaaagaaggccagaugaguguagcccugggcaucugccucucccaugccuucucauaagccccggaucagcucccuuuacuacaguagaggggccucugucuacuuugcagggcucuaaagagacuugcccaagaccccuuggccaagcacauggucugaucuugggccuggcuucuuugccuccuguuccaucauccucugauuagagggauccugaaggugcugguuuaggggagaugacauccaggguuucaaguccuuucaacaccucugcccuccgggggccauucagaaacacuggagacccuccugguuaagagcaugggccguggaguccaaccaacggggaugugaaucccaucuccagcaccagggugcuguguacuuggagcaaacugcuuaaccucucugagucucagcuucucaucugugaaauggagauaauaauaguaccugccuggcugugcuguggggacucaaucagacacacguaugaagcacccuggaacuuggacacaggaaacacaguagcuguggugaucacugugugucggucacgagggcuuauaccugagacacaauggcuguaucagguuagccuguucucauuagaagaagaugggguuguuugucaggaugccagagggggugagcuugguggugccccacaggcccgcugugccucaguuucuucaucuguaggaggaggugaaugguguucuuuggcagguccccaaacucccagcagggagcgccucaauccagggaacggcagucgguccccgaggaagcccccagaccggaggggaggcggggugagagcaagucaacccccaaacccuguucucugggggcucacaaccagcgaagaaagaugcccaccaaugcaacuucugaguucauagaggaaggagcggggagcguuuaacuuggaaacuguccucacauacacgaugagggcccucccuugaacuguggcucccuggucccaccuaggaccucaggagauacagauuucugcugguuguggagaagagcguucuccaggggguagagcugugcgcaaguaaaguaaaaguacugagccccccguccuggaaagcauucaagcugaguccagacaccucucguccaguuugcuggaugugaaauagaucagacgaccuugauauugucucccaauccugagagucuuggcuuaauccaaaacucuuauuuuauuuauuauuacacauuuccccaaaugccuugaauccacuucaguaaaacauucaggguaccagggucuugagucgggcaaucugaucaggacuggaggugcagaugagaacaguguaggaauuugggaggaggcuugccugugcauggccacaaacaguuuuuuaaaaaaauaauaauaaugaaauccucaagugacuuuuaaaaaagaacccuugauguaauuuuauuuuuguuguuacuaucucacaaaucaaagcaaagcggggcaggggaagucugugaauccagccuucuacgugguugaacuccagauaauggugggguccuuaagcuggaacagcugcuccaaaucugggagggcuuccuaauggggagagcaggggaugaaggggagaaagcgcuguagagaccugagcucuuauucuaaaaagucccucugccaccccaucaccggccucacuuggugcaucuggacgccuuucagcugacaugcgacccccuuagagggugccugggagggugcccuggggacaguggccuggccuaaggcuuggaggggagcagaugugucuagcugcagccaaguguggcuuggcagggaggaggagcacuucuugggggagaagcauccaucccaguguccccuccccacccucaugcugccccuccuugcccucaggugguggccaucgaccucgaugagggccugaacggccugguguccuaccgcaugccggugggcaugccccgcauggacuuccucaucaacagcagcagcggcgugguggucaccaccaccgagcuggaccgcgagcgcaucgcggaguaccagcugcgggugguggccagugaugcaggcacgcccaccaagagcuccaccagcacgcucaccauccauggugagggggcgcaggggcuucugcugugugcucagugugugggcacaggccugggucaggggcagggguagaggggagcccaugucccccacugcugucuauuggacuuguaggcacaggcucccuuguuaaugaggugcccuccccagcuggagccauucaacacagcagagccuucuccacaccugaccacugccuucagugccccagagcucaggggcaguggccuggaccugcugccaaagccccaucaaccccaccccuccuagccucugaucguggcaacagcagagagggcuugagcagggcccgggacccucagggucaugaacaggcagggagggugcagagcccuuugucuucuuuggaaggccagaguuuuuguuugggagacauaaaggagaccucccccucccauggguguggaaccccuggacuggcaguagcagggcaucacccugggaagagagcagcugggacucccagacucccuaagauccucaucccccugggacucucaugcucauucccagugucucugcccucuauuggugaagggacgggguacuguuuccacucuggaugagucuuuaauuuucaggacaggaugcagacaugagcuguugccaaggggccaggaauaaccccagggaaauaagggcagaguuuagcaggcaagacauggccuguucccugagccuguucaaucccauccuagcucugcuggccuccaugggaugguagggggcgggggaggguguaguuagcucagcacaggcucagacacugacccucuucaguugagaccuaagauggugaggauuucagagagcacaacauucucucucccauugguccgaagcuugccuguggguuucuguugccaguuucaggacccccuuauuggccgaugauggacagggaauaugucccagcuuuaagagaggaccccuggagggccuuucuccaagacucagcagaagccauaacaucaaaugggcccaggaucucuccuggugauaccauucagaggaacccaagugggguggggaucacuucgcuaugaagguuguccaagccccaucugccugaggaauaggggccuagcaugcagagcggaguaaacacaucuguaagggaaauuaaaccuuauuucggggggugggauuuucaaagugagcucccuuugcugaaaguccguugcaugcugaggguagaccuugaggcuccagcccuccacugugccacugugugacuuuggacaagucacucagcugcucugagcucccgcuuccucagcuccacagugugucuaauaaugcccaccuccuagggugcucagagggcugcaugugguccuguaugggaagcacucagcaugggcuuggcacgcuggacaagcucguaaauggucacugucgucaucguugucaugauuguccguguugccauggucguuguuaggugcguacuggagagagguucuaagguuuucucuccucccuuugacagcugagcagcaauaagcccccagggcacagggacagcgggagggucuggagcacuggugggccugguccuggccccggugggcauggggggcccugggcuuauggccaggagguguugacacagaugccacuuggagcccgugacucccuugggaauucauucccuacuuggucuggugcuggagacgcugcucuggagcugggucuucugcggcagaagccaggccuagccccggcgcccguucugccccgcagugcuggaugugaacgacgagacgcccaccuucuucccggccguguacaaugugucuguguccgaggacgugccacgcgaguuccggguggucuggcugaacugcacggacaacgacgugggccucaaugcagagcucagcuacuucaucacaggugcugccccggccuccgcccaccugugcaggccuccuggggcccugccuccaccccucccagauggacagccagacuaggugggggcaggugaggguggaaaagaggucagggcucuacuguugggcuuuagccucugguggugccucccgaggauuugcuccuggcucuucccaagggcuuugcagcuggaucacucuggacuggcucccuggggaccuccugaaccuguugguugcagggacggggagcaucuaccaagguucauucuagagggagguaaggccccaugauuccuagggaggagcccugagccccacuccccgccccaagucugggugacagagcagugacuuggaggaauguggccucauccuuccuuggggaccuguugagaauucccaccuguuuagaggcagaugguuuugaucucccuaaaugaaaugguuuuagcucaaaaauguugccuggcuguugucugcagagcuguggccacagaugaugaggccauguccuggcucacaggggaaagugagcugcaauggauuagugaugucugccacagugguaggauugguagaugguggcgcacaugccauggguuugccauuccuggaugagaacacagcuucuuagccuccccgacacacgagagaugcugggacacaugggggugcagucuuccccauuccucaacccucuuuggcccuuuuacuggcucagucuucucucuguccaugaccugccuaccaacacacauguugccucugcauaugugugccuguacacacgagcagggcacacaccagccuucccaaugccuccccaugaagcaaggaugcccagcucacagcccaucuguggcuuugcugcggccaacgugaccucccagcccucagccuucccuuucuucccucaccucccugaaggggcccagcacccucaggcccacuccuuacagucuggcccucaagucggcccuagggagggcuuaguuacuaagaccccucacauggcaccagcuccguggcuccacugcccacacuauuuacguccuaguucugcccugggcuccccgggagucagagugugucccuugcagaugguacuucagacacuggggagcacuggagguuugggggucaggaggcuuucccuaggggcaaaccagcaagaacagggggagcaccuggcagccugcaggaugacucuucagcaccccagaguggugggcucccgcugaccugcccagagcccucccggauuuucagugcacauucugcaaggagcugagcccaguccugcccaagcucaccacaaagcuggugccguggcgcccucugcugcccagaacaccacacugcucgccagcuggcaggggaggggucuccacgcuguucugggaguuccuuccugacucccguccaccgcgagaggagacccucacacuucccaccugucccagaacucaaggagacucaguaaucccugucuccuguacaccugccuugacuccucccucuguggagccuccauguccccacucaggaagcuucgcuccucagcccaucucaccuccgagaugaggggccugggggaugcucagccaaccccagaguucucagcaacauauacaagccccuaugcagguuagcugcucagacgcuucugcaggacgggcagggagcagaggggugaaggauaagcccagggacccacgcauggagaaacccagaguggcacaggcacaucacugagugagggguucuccucugugagguggaggcuaaaugaaauggucugcaugaaguaccuguaaacaggaggugcuucgugaagguuaggaacggauuccaggcaucuggcacccccgcugagcccacccaagcugcacccgcaucagagcaccucaggcagggccgaaucagcagcacagccucccacuccuggacucaccaucgcgggucccagcucaggagcagaguccccgcuuccccuggccgggagcucuguuucccagccggaagcuuccucuccuucacccacagguggcaacguggaugggaaguucagcguggguuaccgcgaugccguugugagaaccguggugggccuggaccgggagaccacagccgccuacaugcucauccuggaggccaucgguaugcaccagucccgcacccaccaacacagugaucugggcagaguucacacagggugccucccaggagcuggccuuuugcuaaaggcugaacucugcccagaugccaguggagaaagggccaccaggcacucaccaaacauuacucagcacuugccgggcaugaggcucacugcauggugccacaugcaagacacuaggaugguaaggugggagcuacaugggagacccacauguagacaaauuacugcaaauccaggcaagccagcaggaagggaaaaggaugacauaagaguauugggcaguggugcaaacacagagugggagaggucacgggaggcuuccuucacgaaucggcaucugggagugccuuugagugaguuaggacccuuucaguugaaaauuuuaaaauaaaauaaacugacuucagcaauaugggcucacaaaaccaguccacugggagauguaacucccaguaugacuggauucagggcucaggugacaccucaggcuucagucucugcacuggcuggcgcugccuccuguguguugauguauuagucuguuuucacgcugcugauaaagacauauccgagacuggguaauuuauacaggaaaaaggguuuaaugggacuuacaguuccacguggcuggggaggccacguggaacucacaaucauggcagaaggcaaggaggagcaaguccugucuuacauggaugguagcacgcaaagagagaaugaggaagacgcaaaaguagaaaccccugauaaaaccaucagaucucaugagacuuauuuacuaccacgagaacaguguaggagaaaaugcccccaugauucaaugaucucccgcuggcucccucccacaacauguggaaauuaugggaauacaauucaagaugagaucuggguggggacgcaaagccaaaccauaucaguuggcuuuauucuucaacucacaugguggcaggucguugccccagccucaccuguacacauucucagguucaagugcagcggcauggaagacagcacuugucucuuuccccucccuggcagaagcccucagaucagcucuagauagauccauucugccccagugcccauuccugagccccucacuguagccagggaagugagaugugcugguuacuuaagccuaagucacaugcccauccugggcccuccugcuccugggcuuuuccuucuucaggccucagggcagccucaccccccaccccaaccuccaggaagacagugccuaguggccagcagggccugcuggugagguggauggcuacaggcugaauccagccuaggaugugcagggagcugggggcagucccaccuacccagcaucccaggccucaaagccuggaagggaggguccacagggggacauucaggacauggccuucccaggggagcacagggcagugcugauggacagaaacaaggggugcccacugcagccuuggaggccacauaagguuucaguacaugaagaagcagggagggcacuucaggcagaggcaccagcccaugcaagggccuggaggugggaaagugccuugugugcacaagcaugcgugcaugcaccgcagcuggcccauggaguggcccacacuggggaaggggaggcugugaucagguagggccauguguggaggccuaaacauuggccaagaaguuuggucuuuggucucugggcagcagggagcccuugagggccccagaggggaagagugguaugaugagaccugugccgccgggugcuccugguccucccaggaaguuugcagugagcugaguaagaagggaaugaauucucugggccucacucuuuccaaccaucaaucccuucccagcccgcccaugcccagaugccucugcccucugcccugcucuccuccccuccuggaauggcugcccacccucuggagacuuguuaucaccccugaguccagcccucacuuugggcauugccuggcaggaggagagggcuucugccagccuucuagggagccucccacacacacaccaaucccagccagagcaauaagccaacccccaaggguggugggaggcuggucuggagaggagcuuuggagggugagaagaccuaccuccagugagcgacagcacugccacguauggucagcuggccuggggaagaaggauggcgucacccuaggucuccaggcuacuccagcugccugcaccacccccuggggugaccacucuugccuggacaugcagcgcugguuacaagcuccuuccuccagggaggacaacccaagagcugccuggggcugagucagugccccauccucaccaccucccagcccugggaggguccugugggaacuggagggacagagucuccggggaccuuaagcuuagaucccaagcaaagcccguguuccugaaugcagaggggacguuuguuugaccuauccaauauuuuauaaagaaugaccauuaguugugaaaguuuaaagaucaggagauuuuauuuaaaagcucagauguucaauuucucaugagaaaucagaagaucuggugucucugggcccacauucugccuguccgcuguggacuggaguggaggacagcugcccuuccagcggggcccauccagguguuugacccaggugcuauacccgccagucccugacagcaguuggcuuuuugcucuuaguaccuguaucugcauccuaaauuugccacgacaaacuaccacaaacuuaaaacagcagaaguguauucucuccugguucucaaggccagaaguuagaaauuaaggugucggcagggucacgcuuccuccaaaggcucuagagagaaucaguccuugaccgucccaguuucuggagucgcuaggcauucgguggcuuguggcagcauaacuccagccucugccuccaucugcauguggccuccuccucucugucucaaaugucccucugccuuucucuuguaaggacacuugccauuggguuuaugggccacccagcucacccaggaugaucacuucucaagauccuuaacguaauuacauuuucaaaggcccuuuucccaaauaaauuaaucuucacagguucccagggguuuaacaugggucuguuuuuuuugggagccaucauucaauccacuugagugccucaguuaccuccucuguaaaauggggaugacaguaaagugucugcuucaugggguugcugugaggacugaauggguuagaagaauggcuggcacaugguguuaucuaaguauuugauacuguuaguguuauuccuaagcuaaaaaggaagucaccccuugcaaaggcuagggcagauggggcggaacagggcaccucucuggccggugcccgggagugugcaaagucacaggaagugugccccucucucaggcagcugcuaacaccugucuuccuucaacucccacagacaacggcccuguagggaagcgacacacgggcacagccaccguguucgucacuguccuggaugugaaugacaaccggcccaucuuucugcagagcagcuaugaggccagcgucccugaggacaucccugaaggccacagcaucuugcaggcagguggcccguggccucuggggcagguggugggcugggggaggcggagccacacacggcccugagggcacaugcucaguggcaccagaggcggaagcaggugggggcccaggguggguccgcugcucuggaaggugcuguggggaaagggggacccaggcccucucccaucccagggagugugggcccccagguugcagagcugaggauagggcucuggcuccccacaaacaggaggaagacuuggccucccccugcauaucucccgccccacccagaagggccuuucagaguagcggggagaaagagacgucacaauuucccggaaaggaguugagaagagagccagggcccagcaaggcccagaacagagcugcuuucacagagcccuuggccgaggcuccccucuugggaaguaaacaggcacaagaagaaagggcuccuuugcccagggagcaggcgcaacagcuccaaggcucagagggagagaagggaggacccugaaaacaauuugggugugcacccacaccucugcccagaggccucaguugcuggguggggagggaggcccggagugaaugagucucuuuaccaacuaugggguuuccgacucggaggcugagccaaacagggaaucugggccugcccacuggggcaggcucccgggcuugggagggacagaagcgugggaggcuggcaaugcuccccucccugcaucgggaccaggaggcgggcaggaaagggcuggggagcagggagcugacucccagaaacacagagagcccagaaagcccugaggauuugcgagagugugguggcuagcuccagaaggaggaaguagaggguucucucgaucagggccucagcuugugaggacuuggagcauaccccccuggccuggugccugaaacccaauugagagcccucccccuccuggacuuuuccuucuucaggccucagggcagccucaacccccaccccaaccuccaggaagacagugccuaguggccagcagggccugcuggugagguggauggcuacaggcugaauccagccuaggauuugcagggaggccccaggggaagcaaaccaggaagagguuacugagcaggaagggaggaaggaacaaaacccuuagggaggaggccugccccacuuucuaaacccaaagacuugguuucuauuuacacaauacuacucuuacugaaauccuagagccagcgaguuaauauagggcagcccugaguucucccauuucucagggagaaaugcagcgucucaggaugacuucuccaagguccucuugguaaguuucuugugaagccggacucacuuuuugagaucagauugacuuggaaggaagggacagugggcuucuccaauagagccugcuuggagagaaaucuuucuagagucaucugagggaagaugaggcucuguguuaugccagcuuccaccaagacuccugccucagaggguggggacacacccaggcugggccacgcuucacucuguacacagaagccucauacuucugugcacagaacuggggagucaaagugaggggcuggacaaugucuggcucucugcaagcucccaagcugguaggaaagagaagacauagacaaaaaggacccaugcugccaagagaauguuccuuuuccuccccaagagagguaggagacaguaggggcggcuccaggcaggagggcuucacagagugggugugugugaagcauaagccacaguuagugggugacaggucuuucaguuuuccuggaguuuuggaucaagaugaggcuagaaagauuaauuggagccagcucccagagggcacugcacacugcgcugaggagcuuuggcuauauccauuuggcauuagggagccagugaagguuuuggagcuggggaguggcaagccagagcucacuccuuggggagacguggcuggcugcacugugggucacagcaggauggggguggggcagcuuuguggugggauccuggccagcugacugggacaggagcugggcagcccagguccucccucugcccacccuucaaauuugggaccugaccaaaguguuuaacccucgcguugugaggagaggucaaggguuugggauucugagaagcccauccuggggugggacugcuuugacgggucaucagcaaagcacucaccaaaaccacagauagcaucccuagugugggcaggacuugggaccccacagcuguccuggagagguccagaccaucccacccucggggaggcugccgcuuucccugggugagguguggagcugcugugagcuguccuccuccgaguccagguggcaucaccuccagcugcuggaaaugcccugccucuugccacucugucacagcacccgcccuggccucugaagggagccuccucgaucaucuucaaucccuuccugauugaucccaacgugggugcccugaagaggggccaccaagacggcugccaagaccaugcuuggagagcccuguuugcuccuccucccagcuggcacccaggcaucuguuccaccaggagggaggcagcugcucccacagggcaccaggcagaugcuggcagcacccgggaaacccaaggaagagagccccgagguuuugccccagcacugggccagcacagaugccaggacagugucuuggccccgguguaggcugagcauuucacuugacuaaagggaaccuuugccauuuggcaacuucuccaugcugggcuuuggcaccuggagggcaaggcuucuguggcgagcgagggugcugcuucuaggaggugguuacgagccccagguuguacccuguggagccucaggccaaaggcccagaugaccacgagugcacaucucuugaccagaagucuuucaucaagcagcagcgagggggucugcagagaggaaggugcucuucugaggaucaucuuugggaaagggcgcuggccugggcaugcaaggagcuucggggggugagugugugucccagacugcuugggccacugucuuccugcagccugcagcaccggucucugaagcaggaggaucuacagguagaccuagggggaugugggggcauguuuguggacaccccauuacaucuugguagauuccauguagucacaguggcugcgguuguccucggggcccggcaggggcugucgagggacggugggccggccauggcggaagcugugcagggagaggcgcaaggagcccaggcgcuuccagagccggagcuggggcucacuggggcucccagggugguggggcaugcacucgugagcccugcggcggcucggguccagcgcggccggcuugcagagcgucaugaacagcagacagguggccagcaggaggaagaugcaggccagggcgaugagcauggggagggggucaguugccucugcaagggucccgggagugacgggagcugagagaaaggcgagggggcugauggcuggggagcuggcgaggcuggggcccucugugcucauggcuccugcaacagcaacaagacagaagcucaaaggcagaucagcuggacccagggcagcggguauagggaagacuuaccuagggaauguggaugggggcaaggcacuguuaaacuggacagcaucauggccacaucacagguuaagacagcaagguccagagacaucacaagucuaaguguacacacagcugagcagugauggagcugggcccaagcucaggcccucuuccuguuccacccugugcccaucugccaugcagacaagagggcgguggccuguccgcauuuucaaaucaauccucaugaaucaucacagggucuuaggccuggaaacuuaagaccaacucugucaauaacuugcucuguggccaggaacgaguuauggaugguaagaggccgcagcugccagggucccuagcaguaaucuaauaccaaagcugcaaacugggggcccacggguguguuuaguuggguccuugccauguuuuuaucaauguaauuaugaauauuuucaaaauaauaacagauuucacaaaaauauaugggugccugaauucucuugaaaugucagaauuucaccacuggcauuggcccauguuccugccucaucccugugucuggggcugagcagccgcugcccccuguagacagggcacugaccuccagcuccccacccucccccacaggcccaccacacaccuuauuucaccugccuggccccguggggauuccugugacugcuuccccaugcaguccaacuugcucccacgacaggugggaaacugagguccgaagaggggauuuggcauuagggagccagugaagguuuuagagguggggagugacaagccagagcucacuccuugggaaggcuuggcuggcugcauugugggucacaguagggugggguggggcagcuugguggugggaaggccaaggccacauugugagccaauggccaagugaaggucagaagcaggucuccugacuccuggccccauggccuugccaccccucuggcccccagcccuuucggagcucagugagcugcucugggaacaggugggaaauaaacccacaaggaguugacaagggggcuggaaaccccccagggacaucauacaccugacagggcauuuccuuucccacugaagaucaucccauuagacgcagugcagcagacgguccuugucgauggaaaaccaggcugagcuuuuggcucaauaugucugggguuguaauaaaaaugcucacagauccuggccagcagauaacacaugaccagaggguacagaugagcagggccaccuggagagcacuggcugggcccucucaaggaaguggaggggccucagcccagaauggugcugucagugccggagugcaggcccaguguggucagcucugucaguuucccaagagaagccagaaaucuggauuuuuuuaaaggcaaacauucuagacguuuaaauguuggcagcuaauucaaauuuguugaaggcaagaaagaagagagguggggugggggagaacacagcaaaagccaaauaaacuugauuucaaaauaaugugaaaugaauuuucaaauauuugaaacacuacacaggccaaaccaaacacauaagcagaggacguccagcuugcaggucagcaugugugauauuuaaauucuacugacguggacaagcaaucccagggggucugauaaaaagucaugauuucccuuuaaccuuggggucuuuccuuuucaugagggugggggauagcagauuuuccuccuucccagcuugcagcuuagauaacaguugaguuucuagcacggaagcucaggaggaggaaagaugucaggucacgcucagagaaacccugccacagguaguggggaggggagugggccaccuaguuccccacccgagggacuccugucccuaccccaggcacucaccagcagccgcaggaccucacuccuggcucccugcgcccagccaacugagggcaugcagagcaccccaccucccacccauuccccaccaccaccccucccagcacuuccaggcagaaaacgaccccucccagugccuggcuggaaagugugaugcccgucuagcugcccagggccuccgccuuugcggcaucaggccuagagagcacucuggcugggcagcugugcauggguuggccuuuccuugagucugagcagggaggagggauggggugugcccaccgcucauucccguggggagaaaaucagccaucccucucuccuacccuggacaaugcuuggccaggaguaagaaaagggcagucugaaaugggagaugccucaauccuacuaguucuaauguuauuucaaggccuucaaaggaaucuggagacccuacugggcuagcaaauaggauccaggcuucaggccuugggaccugcuuuaauuuaaaaaauaagugaggccaggcguguuggcucucaccuguaaucccagcacuuugggaggccaaggcaggaggaucacuugagcccaggaguuugagaacagccugggcaacauagugagucuucauuucugaaagaaaaaaaaaaaagguuuuuuaauuagccaggugugguaguaugugccuguggccccagcuacucaggaggcugaggcagaaggaucauuugagcccaaaaguuugaggcuacagcgagcuagaaucaugccacugcgcuacagccugagcgacagagcaacacucugucucaaaaaaauaaaaaauaaaaaaaaaauaaguggaguuguaauuagcaucugaguaguuccuguggcaacgagagauuccuaagugcuugaaaacaacacaacacccuuccuggagcacgaggcaaguccagcugccaggccccuugacacccggcuacugaccaaccagcaaaggccagcuaguacugggagaggaugccuugcccggaccaaggccaggaaucaucuggagggcaguugaagccacucccuucccacuggggccagggugcaccagcgggcccugcucuggacauaucucugcaagcucagucuaggacccuccucuucccuuggaguuccacagagcaggaccugcugugggcagagaagacugcuguguggccucgggcuagucccuaccccuuacugggccuuguuuccccucucuacagaaccagaggacugccuaggucugagcauacccucacauucucccaggaguccccagcaagggucuccaccacacuucccucuccaagccuucuccugcagucccccaagcacugaccucagagccagaccccagccguccggagcuccguggagaggucuucucagcuguggaagggaggcccaaggagcccugggcagugccugugaccccagcccugccaggcucugcugugcccugcagcccucggucagccuggccagcagaguggccuccccgucacuccccagcuggaccuggcuuugucuagaagaguuugggcccugccuugggggaggggauagcuaagggaguagggauggcaacuggguugggaagagggagaggggagcuguccagagacucugggaugcccccuggccuucccaccgccucucuccagccugucuccuuggagcccucucagggguggaagacucuggggagacgcagggggaggguuuuacugccucugcggccccauggcgcucaccuuccccugucggaaguuugaaugguauggucggcggcagccagagguucgcuauucagugccugccagccaccagguuacccuggagaggggcuacaagccauggcaggaggggagcagggagagugcuggucccuggcagccccugaggccccuccugcagcgucccugggccccauuccuuccaggcuuuucccucagcuuguagaaaagcaccuucccuuugaaggugucuggcuacagaagcgaggggugaggggcaucuucaaaggucagggggaucccagggcagaaagcauaggacugacggaccuccaaggccaugcuccccacagugcgggugggccacgggagaccuccacuggaggcucuuuccaaaacacacacacacacacacacacacacacacuucccucccccagccuucuuucuccccagaagccagagcuucccugacaaccagcugccugcuuaggagcccaagucuuuggcagcuuccccaccagggaccuccaagcucccagaaaugcaacucaagacaggagucauggcccuguccaagaccugagccucagacccauucccuuuuuuggagccccaguuucugguuuuuagcuguucccuccugcccuugcccauaaaaagaggcacugucugccaaccccaagauggacaagagauuuccuauggacuguuaaagcuggagagguccucaggggucaucuaacuccucuucugagagaaaagagcccccgucuucucucagaugaccaaacugaggcccagagaggugugaccugcccaggggcacccagcaagugaguggugggggacuugguguuuccccugugcugggugggcaggggcaggcaguaggcauccaggguaggcaaagcauccggcccaaagguguuuucaaugcccagaguccccauugggauuccugcaccuuccaucacagcauucacugccuucauuuuccuuaacuuccucuccugaaaccaacugaacacuucaucuguggcccccauuccuccugagaugacagaagacaaagcuuccaggguggugcaggcugcuggagcagggaggcaucaaggaaaucucaccauggauaggcaugcaagggcaugcucugggcaacguggcucucuucaccauccugagcccuuccagaucuggacaauugaagcacccuguuacaucccuccaccugccagcuccuaagguuucucagggaauggagagagaaagaacugcacggcaaggggcaauccagccauccccagcucuggcauaaauccagagggcucucuggagaagguggcaucacucauguugaccuucaccacacauccccaugcuaggcaccagccaagacgcuuugcaagaugacuucugaucuuccccucaacccugcaaggcuggucaucauugugcccagucuagagaugagaaaacugaggcucaagggggcuaaaguacuuauccauagugccauagagaguaagugacaaagccuaaauucaugcuugggugugccugacccagggcccuuguucuuuuugcuccaguguacucguccuccuccccaccaucaacaugcucaucagaauccuuagacacacuuaccgcagugcccggaugugcaucgaggccagcgccugcuacaggcuccucgcucugccuucauaccaccaugucuauacucccuguccuguggagguuccagggcaucagugcugcugauugaggcugucauuccacucuuccaaccacagcccucugcugucccugcaugagcccuucacuccagacugggguccuaguuccuuccuuagccuccccagcugccucuacuucagcuaacacuguuucccagcacaaauguucuucccaaccuucucugcuaagccagguuuccuccauccuuccaaacccagcucccuccuuuggaaaccuucagccaaucccaccuucacugcuuucuugaucuuugcuagcaggaacccauccccaucuucucugcaguuuuguccagugagcaacgauaggaaagccuacauuagggcuucggguggcaagaaagaaaauccauucuauauuaucuuaggcagggccagacaugguggcucaugccuguaaucccaccacuuugggaagccaaggcgggaggauugcuugagcucaggaguucgagaccagccugggcaauauagcaagacccugucucuacaaaaaaaauaauaauaaucuaggcagaaggagaaguguacuguagcaauacugggauacccuacaggaucaaaggaaaaaucaaacagggagcgaggcacagaugggcuccuggaauaacugggcccaaggaugcaaaccagggcugaauguuguauguguccugcauucgugcuuacugagugucagccuaguuccucucccuggagcucugcuccuaagucguucacauauuugacccuacugugugccaggauuguuguuccagagaccagggauaucgcagugcacaaagcccuuucuuccuguggggauaugggcaauaagcaaagauagcauguaucagagggugaccagggguagggaaggccaggacauuggagugggggcuauaauuucauaugcagugcucagggagggucuuaggagaagauauuugaacaaagaccugaaggagaugagggcaugaacaugcaaauaucuggagggagagcuugccaggaaacagccagggcagaagccaugaggccagcacacgcuugguguucaagaaacagccaggagaccagugugccagggcaguuaagaggagagaguggugggaaguggggcccagggaugugcaagagaggggcuguugauauucccacauuuuacugcuagaaagacugacucaaucucucugggcccaaggucaacaaucccagagaagaaugugauuggcucagcuuugaucaggcacccaguccuggaccaauccccucugaccgucuuggcagggucaggaagaaaauggcagcucccaugcacaccacagggcugaagugagagguggugagacaagaaggggcagacccaaaagaagugggagagcccagggccuuacaaagcaauucaccacagauccaacaggacagcaugucauaggagggucuagccucuuccugcacugcccugggggguguuuguucuccacuuguuuugggugggcaguggguaaaguagguauucaguuauuggcuugacaggacucauguuggggucagcuaugguucugccaguagccucgaggcugcacuccuuguaaaaagggcugagcacuaggcagugucucagagugacaacaacguccccccccacacacaagcccaccagaggaaacacauaaacacauaagccugagucgcagccacgccagccaggccgaucugaagcuagacuggggugauggugcgugugaaugagcauggagccauugugugggaggagggcuccugggcuuccacgaagugaccguuacaguguacagugccggcugggacccaguguggccagaauaacuucaggccaaggaaaugcgggcaagaaguagccaugcaguucagccacccugggagaggcuccugggcucugaaaggcugccggguagggaauguggagggauggaacagccugagaaagccuggacccagcgagcugcagugccaucuuucaccuucucccccagccucccugcgaaccuggaggaggaucggggcagagcugguccuggacagggcugcaggggccaucagcggucggacauccucuuggggauuagaaagacauacacguccccuugucucccacacccccagccucugagggagaccacagguuuuggcaggaugggguaggaugcgugaagggaaggaaaggaacucuaaaaaccucuucucucccugcuggguggcauucaagaaguaacucgugucucauucuuccucagcugaaagccacggacgcagaugagggcgaguuugggcgugugugguaccgcauccuccaugguaaguggggcugcccuaggauggggggcgguccuccugcccaggggagggcagagcuucucuaggcugccaaaggucugggagaugaggccaagagaacccccagggccauauacauggggcgaggccagagggaggaaacagggacauucuccuuauucacaccaggugggugagggggaagcuuuuuugauuauuuguuuuugagacggagucucccucugucgcccaggcuggagugcaguggcgugaucucggccuacugcaaccucugccuccuggguucaagcgauucuccugccucagccucccguccccaguagcucaguccccaguagcugggacuacaggcgcaugccuguaauuuuuugugcuuuuaguagagacaggguuucaccguguuagccaggauggccuugaucuccugaccuugugauccacccaucucagccuuccaaagugcuaggauuacaggcgugagccaccgugccccuggguuggcuuuugauugccguguuccugaaguccugcuguccugcagagcuucccaaagccauggcccugacagagagggcccagagcccagggcagcccccagcagcacgcuccccagggacugggucucauugguccaaucagaauccagugcccaucccugaaccaaucgcuauggccagagaauaaaaugugcugauccucccacuucucgaaucagggguaaagucacugcccacaaauguuauggacugacaguagaggagaguagauccccaaagaaaaaucagggugcugugcccaaaagaugggggaaugagugcuggaccagcccugagauguccacuaaauccuggauucaaccacccauggagaauuugguuucagucccucuuuuuggagugccccagguucuucugaaauauuaaaaaggccucacacuacccacaucuguggguguaggagcagggcgagggggaccagcaggagccccaccugcuggggaccaucaacaccaagaugaaggcuuucaggaaagagcugcaggccuucccggagcaggugaaacgcauuggggauggccugucugccuugccccaccucacagaguccuccagcuuccucuccacugugaauucugugucccagaagacccgcagccuccucacaaggaggggacuggugaacuucugcccccaaccauggcaggccagcacagcaggagacuucugggcagggccgguguuccagggggucugucccuccacacagguaaccauggcaacaacuuccggauccaugucagcaaugggcuccugaugcgagggccccggccccuggaccgggagcggaacucaucccacgugcugauaguggaggccuacaaccacgaccugggccccaugcggagcuccgucagggugaggcuaggggcgggcuggggugcugaccucaggacggggccaagcccacagcuagaacagagaaggccauuaguuggcgccuggugugggcagggccaccacugauuuaggugcugaaugacaucugggccuaaggguucggugacaggugcccagccugggacuuggacuugucauuuugcugugaguuuguuccuccagcuguggaaaggagucagugauacugaugucuguccuaagggaugaaagagguguccuuacuguacuaaccccuguauccacagagcucucuaggguaagucaaggaaaucucacuugggugaucuuggagguacagaugcuaaccucauuuuacagaugagaaaacugaggcacagagaaguugcuagugauagaaucaggacuggagcccccaucuucugaauccaaguucagugcccuuuccaaugaaagugacccuaauauauuccagucaccucucccagcugccucaucaaauguauucuuuccugcccagccuuaucugugcagccaaaaucaaaucagccuuaguccucccgaauggcugaaaaccuacacacagauguucccacugguuguguuauguguacuaccgccagcagggggaugacugagaugaaugagaugaccucucaaggccgcuucacccccaccccuacacacucagcagcccccagccccuuccccuaaaccagugagucagaccccagacaucaggaguaggagggagaugggaagagucaggcagagcaagcagggacuuucacccagaacugagugcccggcuccucuuaucagccccaucuccacccccugcuucccccaggcuggaaacaaugagcgguggucaccggguacucacgaucacaaacacgaugggucugauugcucaggggcugugcuggggugggugacucagcccugacccagcuccugcugacaccuccaacgcuuugccccaagaagagcugggaagacaccuggguccuugcaacugcccugagugagaccugcccuguggaaauggcugagagggucagauccccugguucuuacagggcccuggugauggagacucagacacaguaaccuggacaugcacauagccaugcuggcuugcaugacugugaaucuuauucgugggcuggucaguacgcccucaucagagccugccuuguguggggccuacuucagggcacagagugacugaugucagcgaagcugggguugggucuccagacuucaggcuuccuaaccacagcccuccauguggcccucgcuccccgcucccucacccaggcguggugggcuccugccuccucccaucagugccucagcauuguggcugcaaaccuccuuuagccacaaaccuucuguauacacaaaaugauaugcagcaucccaggguacaguguaaaacagaucgaagccagacugugacaaucagugcagggguggggcucccagagccacaccugcucagcuacuuacguccugcccgucuccccugaacccugaggaauaauaaacccucacacgugcccgauauuuuucuaaaugccucguguacuuuaaccuccguaacccucauaauagccuuaugaaguaggcacuguuaauacccccaucuuacagaugacaagacugaggcaaagaggaauuagccgacuuguucagggucacacagcgguaaggguggagccaggcuucaugccuuggcagccagcuugagccuguccccuuaaccacuacacuccacugccucacauaagccucuucaaagcccagucagaaaccacugccucauccccacaggguaauuuuaaggugagaauuugagggcuggccccuggggcaggugcuugguggcacuguaguacacagccuccacacccaugagacccgggagagcugggggccuuccugaaggcaauguggggacucuggcuuuccgcuggacucauuuucccagcagcaggggagagacggcuugcaggaaccauccacauccuccaguuccugccucagagaccggggacagccccagugaggggccggggaguacagagugagacaguccccuuagagacugggugucucaggguguucacgacacauacacacacacacacgcacauaugcccacgcacaccuccucucccuguccuccuaaccacuagcaccccauuuugcagaugaggaaacugaggcaaagcacugcacuggcacagcacuggacaggcacagcacuggacagaaagcaggucugguucuccaggaagcccaguugcucccacuugcucagcaagaaccugacagaccucugcuuccuguacaucugugccucucagguuugcaaaccaucuugccuccuccugucucugcugcuaaaaacaggcugaaaccgaccagaggcugguggcauguagccagacucauggaggacaggccacaccccagcucccugccaccucucucaucuugucauuguacugucagccuggcccuguuuuuuccccacaacccuuggagucaaggucauuuggacaagcagauugaggaaggguaaggcgcacaguuuugcaagaggagugguuaguuucuguuuaccgaaaaagaguuccugaaauucauccaugcaaacucccccccgcacccacccuacccaggaucuuccccagccaaguucugggugaagccaaauuuagguuccagccugugaacagcugugcucuggaguggacauguuaguuugcauaguggguucugggugucuggacaugaaaauucuaaugacacagcagagcuuugggaacccuagaagcagcgaugcagagaaacuuuuacacccauaugccucucugcccccagcccugccacccuccccaccccagaguccuccacuggucaggcugcuguuuucggcuucuaccagccagaagcucugucacuucucuccagcugauucccagcuaauccccaaagagaaagcagggcugaucccagaggcagugaccagaugccagacacacacgccucugcugcacaugcagaggccccucccuuagugcuggucaccacaugcaaagucuguauggggcaucacagccccuuccccauuugcuucccucucuacuuugcuggcaaguuccuaccggccccagcucuguuuggcugggaagagggugccucuccuguucuggggccagcucaccccagcauagagcaaagagcuaaaagcuaaaaacuccugggcuccagcaauccucccgccucagccucccuaguagcugggauuacagaugcaugucaccacccccggcuaauuuuuuuuagagacagagucucauuauguugcccaggcuggucucaaacuccugggcucaagcgauccucuugccuccgccucccuaguagcugggacuacaggugcgugcuaucaccccuggcuaauuuuuuuuuguaauuuuuguagagacagagucucacuauguugcccaggcuggucucgaaugccugggcucaagagauccucccacuucaaccucccaaauuucugcgauuacaggcaaaagccaccaugccuggccuccauaaacaccuuuuaaacuguauuacguucaugauguacagugcacacauucauaaagagaacuuagugcugguaagcggugaggaaaauggugcguaauugcacaauucagaaacagccacugccuuggaugggggccucagaagcaaacccugagacaaggauuggugugaaaguaauguguaagaagcgcccacaggaaaagguggaacagggugcaaccagcaaggaaaaacagacagcaaagugucauggagggagcuaggccuccgucccccagggagcccuaaagcguccccucacugccccaaacagggccagggaagcuggagucuuugcucuccacgcccaucaaucauuggcucagggcugcccuaggggacggaaguucccaggcauuucugcucacugggcugguuuccaacagcccgggugugggugcaguggggugggguuggucuuccccaaagagccuuaggggcugggagcuggccgugagaaggugcacaaguaaagaguacugagcacugacauucucuacuacaacugccauuguauuuucaccucuauuuuccaagauauauuuuaauauuugauugggaucacuuugaauuuuuucaagaacuuuugcaggcccuggcucauuuugucuucauaacaaccuuaggaguggcauggagugugaacuauuuuauuauuauuaauuuuuuuuuuuugagauggagucucgcucuguugcccaggcuggagugcaguggcgcgaucuugguucacugcaaccucugccucccggguucacaccauucuccucccucagccuccugaguagcugggacuacaggcgcccgccaccacgcccggcuaauuuuuuguauuuuuaguagagaugggguuucaccguguuagccaggauggucucgaucuucugaccucgugaucugcccaccucggccucccaaagugcugcugggauuacaggcgugagccaccgcgcccggccgaauuauuaucuuaauauuaccacuuuauagcugggaaacugggggccccaaagagucacuaauuagucagauguuccacagcauuagucaaaaagccaagagcaagaugaaguucauuccgaaacaaguaauguuugagcaccugccacgcgccaggugcugugcaaggugguggucacagugacccaccagacaggccugggguccuagagggagcucacagcaggcccaggaaagcagugaccacacaaggcggccacagugggccaagcccugggcuucccagccuccaccccacccugaccuugcaccccuggcccggcucccacaggugauuguguacguggaggacaucaacgaugaggcccccguguucacacagcagcaguacagccgucuggggcuucgagagaccgcaggcauuggaacgucagucaucgugguccaagccacagaccgagacucuggugaggcuggcaggaggaagccggggaucccauugcucagagcaaaccuccccagcucacccagccccuccuucgaaacggucaucccugaugcuucaggcuccccauuuagccaugucuaggccagggaggggcugcugggauggucuugaucacuucccaccaguggccccagccugagaggguuggaaucagggagaguugucccaaccacuggguggacagaggggaggccacaagcuugagaaguccagcuccgucaucccaggacccagcagcucccacuagccuuuagagaggggcugggcagagcugggagggguaaagaggaccggucagaaagcuggcugcggccuggccugcuccuccagccccuccacgccuuccaggaccagcucagggccuagcacacgcagacccccugacccuguacaaggggcaguacccuuccugugccgcagggcaguagccugaaggcagccugaaccuugcugagggcccaagccccagaggcggccacagcccgcagugcaaaaugaaggggaagcaugccgggucucuguggcccuccgugcggccugggcugucuggccuguaccccagucagggauacagcugaaaaggagcauuuucuggagacccacugucccccagagaggcucccugagcugcucauccuucaugucagcuacucugguggcucccaacuccucucucagcauccucagauuaucuguggcaugcaugggaugggguggagggaggaauggcugcaaauucucaggcggaaucucaggcauguuaggagaguuuagggcacauacgcggcuguggccccuugaggucugugaacuucagcuuaggaaucccagcucuagcuccugauugaaugguuuguuucaaggcacaggaauuuggggcguagggaguggggaggaugggggaaggugucccugacacugaagcccuucugucgaagggaccaaaccaaggcuuggccaucugugaggaugcguucuagaucaaagccuccacuacaagagauccuucauuucccccaaugcuuguauguccagauaucaaagggagguacaugagcuugaauuuugaggcuccaggagcagacccaacucuuucuguccuaucucuggugccaaggccaagccccagaggaaggcucaacagugcaugcuggaccuugccauccacauugaccuuaacacauccucugcugcaucucugaggaugauccugccggcagagguggggcagcccaugcugggugggccacccaggggguauggguguggcagcuugagaagccacagcgcagccccacucaguucuaucugggacugcacagccucuguguccuccuacaggggaugguggccuggugaacuaccgcauccugucgggcgcagaggggaaguuugagauugacgagagcacagggcuuaucaucaccgugaauuaccuggacuacgagaccaagaccagcuacaugaugaaugugucggccacugaccaggccccgcccuucaaccagggcuucugcagcgucuacaucacucugcucaacgagcuggacgaggccgugcaguucuccaaugccucauacgaggcugccauccuggagaaucuggcacuggguacugagauugugcggguccaggccuacuccaucgacaaccucaaccaaaucacguaccgcuucaacgccuacaccagcacccaggccaaagcccucuucaagauagacgccaucacggugaggggcugggggcagggagcaccauuucuuccaaucuaaccaacauugguugagcuccuucugugugcacagcacucuccucuuugucauaaaauguccuugagauggccaagugugguguuagguaccuguagucccagcugcuugagaggcuggggcaggaagauugcuucagcucaggaguuuggaggcugcagugagcugcguuugcaccacugcacuccagcccgggcaacagagugagaccuugucucuuacaaagaaacaaaaaaaaguccccgagaucaauaucccuguaacacauccauuuucauauguaggaguaagauaaaguuuauaccuaugc

SEQ ID NO: 192142 - RNA, 83654 nt, Homo sapiens
ucggaacucgccuggggcgccgccggcggcggagggagcgugacugcgcugcgcagggcgcuaggaggcauugucgccguaaguggagccaaaagcggcccggagcgggaccacacgcuucuugccccgcaaaguaaauguaguccgaggucaagcguugcaggggcugggggagagagggcgagaaguguuccgauuuuugcagcguccccuccccucccccaggucacccgguggaaaagagcagcggugcaccagcggaggcucuggcggugccaaggggcucggcaugcgcgggcucuugcuugcucacugcaccuggaccccgaugguucaggggagugggugcagaggugccagggaauagggagcucggagaaccgcucccaggcgggccuccauuccucgcgggaggcgcccuugcuuggagaggcugcugugcauuucguccccgaagcgacacuuucgggguuugcuuccgcucuggggagcugcagacgccugcuccagagcgugccucucggccuccgggcagcgugggagccccggggccucugcgaucacuaccauucuucccucugccagcuuuauucucccaguccccgccugccgggccagcggacgaggugccauuggcugcaggcaccgggggugaggcggauccuggcacgcggggcugggggacccuugccuggcuaccgcgcguagugcuggaggcucaguccgaggaugccuagauguuagcgagggagcacgcgcugagcuucccgaaccccaugccacaaaaacaaggcgccagcaggucccgcucacgucccagcgggcuucuuucccugggguggggaagugggucaacuucguucugaucugaagggggguuugggacuauuugggucgcuccucaccuccccacccgcuccccggcuuggcaugguccagagcccgggcuggagccagcgguagggccagcuugcacacauggcuccggaggcuccgguugcccauccgagccccugccaggcucuaacguucccaacugacaacaccaguaacuaaauauaggagcagaugguggggacgggcugucgcagcggcuccuuugcagaggucuccggacugcagauaagguagaguuauugaugguaagggcuggagucagggggccaggucaggguuuaagcaaaaaucaccccucccccagccagccugaguccaggugaaaccagguuauagggacaggagggcuguauugccagcucccccaaagcaggacaacguuuuugucuggcauugaauuuauuacauccaaacuuccucucuacaccuguuugauuaccuacugguaaugccuuggugugggaaacauguaaugguucgcaaaguccuuucccaaaaguuacauaucaguuacuucccacaauaauccggugaggaaggugguauuuccauuuuacaaaugggacugcucacaacacuguuaacuuugcaaaacuauggauuaggcugccuuccucaaaaaacuucucuuaguucgcuacacagaagcagaggacagccuuguaagagggcugcaguucccuuccucaguaaucugggagcccauuggcucccugucucucucucuccugaaucucuuugugcaccugcugcucaccccugucccuucccccuggccaugccaugugccuucaugccccccuaggccuggcccuguagccuuacuacuaucaggcucauccugccucccagugggaagcuuguucuagcccauacccagucucugccccuuuacucccacagugggggccuuauggaagguguccaggagacguuugcuggauuuaaacauuucaccggaccaggaugcucacucugaggaaugggguugaggguguguggagagggccaugcuuugaggauguaggcagugugaguaugagcuucgacccugugcugaagugucucugggauuuggagugcuuucccugacauuuucuaaggccuacccucuauugccugggacuggcuggggccaguagugccagcuggcuggggugccccaagcggcgaucuggcccaugugggcugauggugucuguuucugccuuuuggaacacucugugacucuccacuaccaccaucccugcagauggcauugaccagguacccugaggagcucaggccugucagcuggacuucaugaaacaauucuuccuuguggagaaaggggcaguuuuaggugaagggaggauggcuuccuagcuaguuaauaagcguggugauuuuaagcagcgggaaccuuuugggggucccgagcacauuuuugcuguacucagagcauccuccauccucuggcauagaaggaaggggcccuucuuccuacugaauugcccugacaccuagacuuuacauguuguuucuguuccuguaccuguguacacucugacccacacaauaggacgucugaacuugccaccaguggugaaauuuuuaaucugacuaguuuucaucaguggucuaaggcaaggguccucaaccccugggcuguggauggcauagguccguggcuugugaggaacccggcugcacagcaggaggugagcaccaguaagcauuaccgccugaacucugcguccugucagaccagcggccgcauuagauucuccuaggagccugaacccuauugcgaacugcgaaugcgauggaucuagguugugugcuccuuauggagaaucuaaugccugaugaugugagguggaauaguuucauuccucucccacuacagugggaaaaauugucuuccaggaaaccgaaaaggauggggaccgcuggucuaaggcaccaccuccccaucuggugguagcuaguagaauugcaggcauagugccugauugaaaauauucagcccaggugaucccaccaggccuacccccuacccugggcagcuugguggcuucccuuccuuucccucucugcugugaggccaggauugcuucagugcuguucuucagaaagcucuuccucaucagaaucgcaagucggagcugcuuccugcauuucuuucucccucuuccuucuuaucccucauaccuaggagaugcucaguaaauguuuaugauuauugaugaugaauuggagauggagaaaggagggagcauggaauggugggaagaguccuaggcuuggacuuaggauaccuggguuuuuuguuuucaucuagcugauuugccuccccucuuggguccucagcuuucccauucauaaagugguuagaacaagucaccaagaugcuagcaacauggcuaugauuuaggcuuagggguacggucuucgaggcagcauggugaaguuguuggguccaguuugccacaguccuuucuauucccuucugcccugcacuggcucgccuuaugcagauuggccaccuggcacuauuaggcauuugguuuuugacccuucucaauuuagacagugucuuagauuuguuguaagagucucuugaccuguauucagauuggaaacacaaaugaugucuguugaucuucaccauuaggggauacuaacuaagcaccuguguucaguguguggagagaagcacaguauaggucuauucccuggccccaagcugcccacaggucaaugggggagacaaguguugguuuguugauuuauuuauuuuugagacagagcuuugcucuugucacccaggcuggagugcaaugggacgaucucggcucacugcaaccuccgccuccuggguucaagcgauucuccugccucagccuccugaguagcugggauuacaggcaugugcgaccaugccuggcuaauuuuuuuuuuuuuuuuuuuuuuugagcgcgagguucacucuuuguugcccaggcuggagugcaaugacacaaucucggcucacugcaaccucugccuccuggguucaagugauucuccugccucagcuucccgaggcgcccgccaccacgcccagcuaauuuuuguauuuuuaguagagauggaguuuuaccacguuggccaggcuggucuugcauuccugaccuuaggugaucugcccaccucggccuuccaaagugcugggauuacaggugugagccaccaugcccgaccauuuuuuuuuuuuuuuguauuuuuaguagagacggaguuuuaccauguuggucaggcugguuuccaacucccgaccucaagugauccacccgccuaggccuccuaaagugcugggauuacaggcaugagucacugcgcccggcugacaaguguauauuuaaaagcucauaaauaauccaggugacuugugcuaagucauuaagugcuacugaaacucagaggaaggagagaacacugaggcaauaagaggagauuuccuggagguggacagauagaaauuccacucauuccucaaagaugaguucccucaguguuuuguucagacucacaugaguauuaaacugggguuauaugcugcuguuacauccacauaugcacugcuuuauccucuuaacuuuuauugaguauuuacguguccugggcucugagcuagacagguguauacauuuugugcucucaauccucauauuaaccuagcaaguuggguauuacuagaucuccuauucacaugaagaagaaacaggcucagaggaguuaagaaacucucccaaggccucucagccaauaaauggggguguugagcauuugaccugucuccaaaaucaguguuuucccacuguucuguaugugugugucucaaaccuuuagugucagccucuuuaguggaaaugcacacacauacuaaacucacaguaacucccugaagcagaugggugggcuuggccagcccuggcuuggccuugccugcccugcuuguccaguugaccacgugggaacuuuuucuuggugacuguuagcucuuagcacuguccccaugccccuucucucugcccuucgccuucuucugccuuuggcccuuggagugaguucacuggagcuucuugagcugucugugaagcugggacuggggucugggggcaaagaaggggugcugaccuuggacuugagcucauuccucucucuauggggugcugcuauuuuuauaaaaaagugagcacuggcuauggagcugggcugacccuauucuugccgcuuacucacuuugaccuuggccaggucaccuagccccucucugugcucauuuccuucucuguaauaaacagggaguugaggguguuugcaaguccuuaugucuuaacaccuuaucauuuuguuuuccucaccuuucuuucagucucuuuuccucuagugauccaauuucucuucucucauuuccaucuccaccccccggccccugcccgcuuuucuugcagauaaacucagcaucaggcugauaaucaggucugcaggcuaguacuguaaccucuccuuccuguuggcacaugggaaaggaauucuuagagaccacccaccgccaguccguguguucugaugggaucacagggcucugauuugccuucguguccccacuuccugccaugcacaaggcagauauggguggggugaacaggggagcuggggaaauuguccugggcaggguguggacaggggaccagcuuagaggcugugggauggagggacaggugucuuucuccugcaguuggcugcgcccuaccuccuucccaaugcccugccuauagagugaaucacaggccagcacaccccugaguccucacaccucccuggcugcuggcucagaccugguccccaugucuggugaggucacacauguugauccucccagaaaaccaguagaacccagcugccagacuggcagaccagcuugugcaaaggccaagcuggauguggccugagcucucggcccugcaagaggaggugaguggccuggggcccucccugcaggcuuccugacagccuggguccugggggagaaggaugcuggagggggaugccugggugggccccuggcuggcaggcgggcacuucauggcacugcgucuuccccaggcucaggcccuuuugugagaagcagaccagccugggggcuggcggcaggacaccugugucugcaugcugaagaagaugggugaggccguggccagaguagcaaggaaggucaacgagacgguggagagcggcucugacacucugggugagugagggcagggcuuuucccaacuucccuggaagcaguugugagaucagcuuagaaaugaaacagagaugaaagacacaagcgucagugugcaaccucauccugagaauaaguguuuuguggaacuuucauugcaacaguguguaauuuguguaagacauuucuuacuguggguccuggucaaagagguuugaaaaccacugagugauggcgccugccugcuuguccuuugacugcugaugacugagugugugugcccuuggaccaggugaaaauacagagcugguccuggccaaguagcaucugugugccaggccccgugcugggcgccuccugaauguuaucuuguugaaucuucacaggcucccuggggugaaugaagccagcugggcgugguuagccucagucaucccaugaagaaaggggacggcaaaauggguuucuuugagguugcccagcuaggagaccccuuuacacuccacuauuuuucuugaauugugucuuauauauuuuuuugcuuugaauuggccagggcauuuuauuccaucaauuaccccaagacuccuaagcauuuaggcaaaccaucccauuuaaucgaauucagcagauacuuauugacuguccaccaagugcaaggggcagcaggggauacagugcaguuaccuguguguccugugugugcgugcaugugcccgaguguguuugugugcaugugugcaugugcauguaugucacccauggaaugcaggcaccacuguagaggccuggagcacaguccugccuuggggaugaucuugcagauaggcaggcagaauuggaguuagguacauggagaggaauuucacaggcagguaggggugugugugugugugugucugucugucugucucacaaaggagcgcuuccuuccaugguaguuacugccuuagcaaagucacagagacuggaaaggcagucagaggcagagaggugguccaggaaguggagagacacucagccuucaggaugagcuugaucacugccucuuccaggaagcccuccgccuucccucauccacccuuugcucccuuucuccucuguagcaccccuucagcaucuguagagcacagggacccugugguuguuugcuucccccugcccugccccagagcccagcgcagugucaggcacuuuguaaacguguggaaguguuugcugagcuuagcuaaggcgagaggcauuuccucuaucagcaggcucgcugaagauugucauugguguuggagggaagccuuuggaaggagccuuaagcuagugagcugaugacugugagcccucagugaaggaauuccggaauccuguacuggucaguaauaugguuguuuaaggcucucuaccacugagacugcgguucagagcuaggcuuugagucacaugggccuggauuugaaucucuacucugccacccacucaccugguacuguagcagauugcuuaaccucucagagccucaguuucuucaucuauaaaaugggaaugguaauugugucuaccucaucaagguaguuaagaguaauuggaaugucuguaagguguuuggcacauagggagcucaauaaauggcagcuauuauuuuuaauuuuugcucauucccaaaagcugguggcgagaccuaagcccuuccccuugcaaaugcacuuucuacaggugucagccagccacgucugugcuggguguucuucucacugccuuccaauggaggguucagugcaaaucgacagaugucuguggugaguaaccuaccccugcuucaaaaugucacagggggcugggcaugguggcucaugccuguaaucucagcacuuugggaggccgaagcagguggaucgcuuggggccaggaguucaagaccagccuggccaacauacuaaaacauacuaaaaauucaaaaaauuagcugguguggugguauacacauguaaucccagcuacuugggaggcugaggcaggagaaucgccugaacccaggagauggagguugcagugagucaagaucucgccacugcaccuccagcuugggugauggagcaagguuccaucucaaaaaaaaaaaaaaaaggcuucacaggggauagggacacagcagcuccacuucauucagauguggcaagaguggagaggccgcaggggagggaaaacaauucucaccggggcguuggggaagcugcuuaggggaugggugcuguuugagagaggauguuucaggaggcagcggugaggagacaggcacuccaggcaguggcaggggugugccugaguuggaggagaggcccugcccaguuaccacagcagcacuggggcagguggugagggauggugccuggcaggcggagagccuggaaggcuguguugaggagccccugaacuucaaccucuguggacuggagauugcaaggucaagugggccaguggacaggugggcauuucugugagcugaagagugggcacccugcaucaggugaagugugcagggcggcuagggcagggcaugcugcgaccagcuccccugcacugccugggagccauacccaccaaggaacccaagcaguucucuggccacccugccagaccacugccaugccugggauuggaaccuugauuucugacaccagagccugggcccugucuccaccaugcagcccuggggugggggcacauguuuggugauugccagggucaugacugcugugaagcucuagucaaguugggagagccuuuagccauggcgaucuugccugaagcucaagacuuucauguggaggggacugggucuuaaaguugugguugaauaacagggauccuuugcaucugugcauuggccagagaagaagcaaaauuuccaaccuggccauaguaggcaccuguaauccugacccuuaggaaauggagcugaccaggcuuauacacucuaagggggcugggucuaagcaguuagcauguauugaguaccugcuguauacuaguugcuugggggcucccaggaauguguguaguagaguccuggaccugagaccagcccaccaccuacaagacagucuucagagaacagugacacacaggcuccaugcuaaggugugucagauggaacacagguuguccuaauucagaggugggagauauugcuggguauugaaguagaccaggaaggcuuucuggaggagugguaauugaauugaaucauaaaguaacucuauaugguucucauguaaaauagcuaacaaucugaagcauccuaaacaucuagcaccagaaaauugcuuaaauaaauuugguuacagcuauacaaugcuuuuuuuuuuugagauggagucaucuugcuugcccaggcuggagugccauggcacaaucuuggcucacugcaaccucccucuccuggguucaagugauuuuccuucagccucccaaguagcugggauuacaggugugugccaccaugccuggcuuauuuuucuauuuuuuuuuuuuuuuuaguagagaugggguuuugccauguuggccaagcuggucucgaacaccuggccucaagcgaucuaccugccucagccuccuaaagugcugggauuauaggcaugagccaccacacccggccuauauaaugcuauuuauguagcaucaacaauggagcguaauauuucauuguaugauuaaauaaagacuggcacauucucggccgggcgcaguggcucacaccuuuaaucccagcacuuuggguggccgaggcgggcggaucacaaggucaggagaucgaaaccauccuggcuaacauggugaaaccccaucucuacuaaaaauacaaaaaaauuagccgggcgugguggcgggcaccuguagucccagcuacucgggaggcugaggcaggagaauggugugaaccugggagguggagccugcagugagcugagauugcgccacuggacuccagccugggugacagagugagacuccaucucaaaaaaaaaaaaaacgaaaagaaggauuggcacauucucauauauaacgugaacuggaaaacaucaagaaugccaaacuguauguaggguaagguacgaauuauguuaaaccugugcauauauguaggaaagaaaauggaaggaaauaaccaauauggaaaugggaguuagaaaauacuauuuugcauuuucuaaauguucuauaaugaacguauuacucuuaaaauuagggaacagauuuuagggaaaggaccaccugccacuguggaaauaaaacacacaucuugacaacagaugagaguucagggguagcucauucucaaagccgaggccccugggaggagacauaggcuucccuggcuuuucccguccugcuggguucccucccgggguggugcuccagagccacaggugcugcugcagagugggagauccccuguagagacugggcuggaagagcucaguuacaggcuugcucucaccuuacucagccaaguaacccugguaagcacuucacaugcucccccagugcuccuggggcaccccuggcuagagcuggagccaggccugcuuccuccuguaacucgaggcgaggaucccagccuuucucacuccacuccaggcuucuccauccccagagacgugggcuccuuuccauuuggccccugggaggcccucagcuugaguugaagcugcuuuccucccagucucucaccccuccucagcaucaucuucucgauguuucuaaggagcaugcagaguugcaaacugccccuuagguagucugcuuccccugagccaggcucucuuucccugccccuuuuccaucuggguuuccguggguccuggaccgcugaggggccuuagucugaccccacccuucccuccagccugugguuguggggccaggcuucccugcaccccgcuccucuccgggucuuaggcuccuggcucugcagugugcauggggacuggcuuuuaaagaauaaucgugacacagaggagcaggauuugaaaaggccugaggcccgagacucuacuacacacaucccugggagcccccaggcaccuaguacacagcagguacucaauacauguuaacugcuuauauuuuugguagagacccugucucuaccaaaaauaaaauuuaaaaaauuagccaggugcaguggcacacaccuguagugucagcuacuuugggagguugaggcgagaggauugcaugaguccuggagguugaggcugcggugagccaugaucgggccacugcacuccagccugggcgagaaaaaguucuauuuaaaaaaucugauauaauauacucuaguuucucuucagauccaauaaaucuuuugcuucuuacugaaaaaaaaaaucugauuuaagggaauaaucuuauuucuuucuuaugcucuauuuuuuauuucuuuaaucauuuuagaaacaaggucuugcucugucacccaggcuggagugcaguggcgcaaucauaguucccugcagccuugaauuccugggcucaagugauccucccaccucagccuuccaaguaguugagacuacaggcacuugcuacuacaccgacuaauuuuuaaaauauuuuguagagauggggucucacuguguugccuaggcuguucucaaacuccuggccucaagcuauccucuugucucagccuauacuuguuuuaaaucuuuacugcuuuuucuuuuuuuugaaauggagucccacucuguugccuaggcuggagugcaguggugugaucucggcucacuguaaccuccaccuccuggguucgagcaauucuccugccucagccucccaaguagcugggguuacaggugugugccgccacaccugguuaauuuuuaauuuuuguacuuuuaguauagacaggguuucaucauguuagccaggcuagucuugaacucccagccucagccucccgaagugcuaggauuacaggcuugagccaccaugccuggccugcuuuuucuguaacaggacauucuugaggguuucagucuguuguuccugcugacucuugcucacaguagguuauucuggguggacuuuauauaauauaauaauuuggacccugugcuccugucuggugaacuaucaucuguguaauccugggucgcagggcuguguccucuggaggggucgugauugcuuuggucaggugccugagugugaccagccuagaagcacgucuucuguuaaugucucagcccugagggcuucuguauaugaauuaagggcugugaauauucaaauccuaaguauuaacaggucugugauuucagaaucuuaguggagauuuuuguuuuuuaacaauucagugcccaggcaaagacuaaacugcuuguugucuuaucagguaguagauuuuuauuauuuuauuauuuuuuauuaucaaguaguagauuuggcucauuagagccuccacuucucagguucaagugauucuccugccucagcuauccccaaaaauuagcugggcaccugccaccaugcccagcuaacuuuuguauauuuagcagagaugggguuucgccauguugcccaggcuggucucgaacuccugaccucaagugauccaccuguuucggucucccaaagugcugggauucagauucucuauuuuugaucuuuuggacuugcccuuauuaaaugccaggcaucgugguaaacaguuugcugguuuuaacucauuuaauuccccaugacaacccuaugacaaaggugauguuaauacucccauuuuacagaugaggaaagaaaggugugagaaacaucuuuuauccaguguguauguaugguuuuuuuuuuuuuuuuuuuuuuuuuuuugagacagcgucuuacucugucacccaggcgcuggagugcagugacaccaucucggcucacggcaaucucugccucccagguucaaguauuuuaucugauguuuuuaaguguuuuguuguacaaggguauucaacuucccuccucuccugcuuugcuuuugcaguaguuuuccucuguuuuauagcugcuggagcuaggcugaguguaggugaccugcuggugacacagcuguuuggagugggagcagaguucauaggucagccuagggcacagcccugcuuuuccccauccacccugcugccugccccgagggauggggguggggaugaggaggagggcugagagaacuaagcgaggccaaugaugugaaccucccucuucccgccuucucccacccacacaccugccucuccucccaggucuucuuggaaccacagugagcccacccuguuccuugaaaaggaggaaaaaaagcagaggugaacaucuaccuuuguauuuaagauuuacaucauuguuaggcugucuugaguuaaagaaacaauggggacagcccccauggacugcuuucaugggcaaaugucccucugucaguuccuucacuccugcaggauuuucugaaggguagguccuggguaaccaacaucaggauuguaggaguacugguuaaaaaugcagauucaggccgggcacgguagcucacaccuguaauccuagaacuuugggacgcugaggcgggcagauugccugaggccaggaguucgagaccagccugggcaacacggugaaaccccaucucuacuaaaauacaaaaacuuagcuaggcgugguggcaugcaccuguagucccagcuacucaggaggcugaggcaggagaauugcuugaaucugggaggcggagguugcacagugagcugagaucaugccacugcacuccagccuaggugacagagcaagacucaguccccccugccgccaaaaauaaauaaaaauaaaaccucaguucauuucagaaaaaaaaugcagauucaggcugggcgcgguggcugaugccuguaauccuugugguggguagaucacuugaggucaggaguucaacaccagccuggccaacauggugaaaacugucucuacuaaaaaugcaaaaauggccgggcgcgguggcucaccccuguaaucccagcacuuuaggaggccgaggcaggcggaucacgaggucaggagaucaagaccauccuggcuaacacagugaaaccccaucuguacuaaaaauacaaaaaauuagccgggcgugguggugggcgccuguagucccagcuacuugggaggcugaggcaggagaaucauuugaacccgggaggcgcaucuugcaguaagcugagauugugccacugcacuucagccugggcgacagagugagacuccguuucaaaaaaaaaaaaaaaaaagcaaaaauuagccaggcauggugaugcaugccuguagucucagcuacuugagaggcugaagcuggagaaucucuucaaccugggagguggagguugcagugagccaagauugugcuacugcacuccagccugggugacagagcgagacuccaucucaaaaaauaacauaacauaacauaacauaacauaacauaacauaggcagauuuaugggcaauacuccagagcugugaaaauagaaucugugagggcgggggcugguaguguggauuuuagcaggccucccagaugauucugccaugccuugaucuuauguauuuuauuguuauaauuuauauauauaaaauuuacccuuuuuaguauauaguugaguucugacaaacauauguuuuuauaaccaaccacaacaagacucagaaccuuuuuaucaccucaugcuccccugcagccaaacccuccccaucccugguaccugggagucacugaucucuuuuccaucgcugugguuuugccuuuucuaggauaucauggaaauggaaugauagaguaaauaagcucuugagccuggcuucuuucacuuuagcaucacguguuugcgauucauccauguuuggugggaaucaguaguuuguuccuuucacugcugaacagcuuuacaugguguggguguuccaugauccguuuauccuuucaucugcugaaggacauuuggacuguuucauuuuuuaacaucacgaacaaagccuguaaacauuugcauacagguuuugcugugaagcaaaguuuucuuuuucuuuuucuuuuucuuuucuuucuuuuuuuuuuuuuuugagaccgggucucacucuuuugcccaggcuagagugcagugcagugguaugaucuuggcucacugcagccuccgcccccugggcucaagcguccucccaccucagccuccugacuagcuaggacuacaugugugcaccacuguaccuggcuaauuuuuguauuuuuuguagagauggggucucccuguguuggcgaggcuggucucaaacuccugggcucaagcauuccuccugccucagccucccaaagugcugggguuaugggcacaaaccacggcaucuggucaguaaaguuuucauuucucucagauaaauacauaggaguaggauugcuggguuguacaguugucccuccauaucugaggggauugguuccgggagccccacagauaccaauauucaaggauacucaaguccuuuguauaaagugcuauaguauuugcaucuaaccuacacacauccuuuuguauacuuuaaaucauuucuagauuacuuauaguacauaauacaauguaaaugcuauguaaauaguuguauugcuuuuuaaaauuuguauuauuuauuuauuuucaaauauuuucuguguuugguugaauuuguggguacaaaacccacagguauagagagccaacucuauauauuaaguauauguuugacuauaaaaaacuaccacacucuuuuccaaagagauugagagcuccaauugcuucacauccuuuucaacacucgguauguuuuuuacuuguauacauucucuaggguguaauguaucucauuguaguuugauuuauuuuuucuuuuuuuauaguauuaagagguguaucauuguaguuuuaauuuacaguucucugaugaugagugauauugaacaucuuuuauuuuuauuuuauuuuauuuuuuuuuugagacagaguuucacuucuugucacccaggcuggaguacaguggcacaaucucagcucacugaaaccuccgccucccagguucaagugauucuccugccucagccucccgagcagcugggauuacaggcgccugccaccaugccugguuaauuuuuauauuuuuaguagagacgggguuucacuauguuggccaggcuggucuugaacuccugaccucaggugaucugccugccucagccucccaaagugcugggacuacaggcaugagccacguuccuggccgacguuguacaacuuuucaugugcuuguuggcuauccauucguuuuuuguuguuguuuuuuuuuuuuuuuuugagcuggagucuugcucugucacccaggcuggagugcaguggcacaaucucggcucacugcaggcucuaccucccgguguucacgccauucuccugccucagccuccugaguagcugggacuacacgcgccugccaccucgcccagcuaauuuuuuguauuuuuaguagagagggguuucaccguguuagccaggauggucucgaucuccugaccucgugauccgcccgccucggccucccaaaaugcugggauuacaggcgugagccaccacacccggccuauccauucguuuuugauuaaaucucuauucgaaucuuuugcccauuaaaaaacauuggguuuucuuucuuuuuaguuuuguuuuuucgagguggggucuugguauguugcccaggcuggagugcagugcuguucacaggcacaaucauugcacacuguagccuggaacuccugggcucaagagauccuccuauuucagcuuccagaguagcuggaacuacaagugcaugccaccugccuggcucacauuuuuaauuuugaugaaauuuaauuuaucguuuuaucuuuuauacaugauacuuuugguauuguaugugagaagucuuugccuaacccaaggucaagaagauuuucuccuaucaggaucauuugguuauugguuaagcaugcagauccacggacccuauucuagagcuuuaaaaguugaaucucgccgggcgcgguggcucgcgccuguaaucccagaacuuugggaggccgagguggguggaucacgaggucaggaguccgagaccagccugaccaacauggugaaaccccgucucugcuaaaaauacaaaaauuagcugggcuugguggcacacgccuguaaucccagcuacucgggaggcggaggcaggagaaucucuugaaccugggaggcggagguugcagugagcugagauggugccacugcacuccagccugggcggcagagcaagacuucaucucaaaaaaaaaaaaaaaaaaaaaaaaguugaaucucagagaggaccuggugaucugaauuuuaacaugaacugugucugauucuucuuugccuugaauuuugagaaucacuggcuuacuguuugcaauuuggagcuuccuguccugauggcugcugcgggguggggcaggggcauugccuggcaggguucuggaugugcaugugggagaugaugaauaaauacggacauggaugugaugugcuccuggggagggaccugagcagcuaggcugggagcuguggaaucaaacagggagaccaaggcuagcgcgagggguguguccaccuuucgucccucccgggcccaccugcgcuuuggcugagcgcuugcuucuuucuguacuagccagcagauggcgcccugucacaggccaagccaaggaccggaagccgagcccagggaccuggccaggcuguugcugggugagcuguugcuggguguucugaccaaggcuuccacucccuucuuguguuuauguuccuguccaaccccugcagggaccugauguugcaaccccuuuucugaacaagaguacucaggaaacacuuaauagauacccacugaaucacaacauuuucuucguucagaaauugccacuggcuccucuuucaaaaaacacacuuugagcagcugcugugugugcccugccuggagggcaaugcaugugcccgggagugcccagucuggaggggaggcagacaucgcucuagcacacucuuacacugaaagggggcugccagggacuggagugggagcugcuuuucuggccuggugggguggugaucuuggcccucaccagggcuuguuggccuguaguuccuggcccagagcugaggccggcaucugguaggggugaggggaguguguuuugcugugauguuuccuggccuggcgaguccugagggucagccuggcacaguccagcucugagagcaugggggagggacugcguucucacacagcagcucccagauggcuggggcugccuggcuuuguuugccacaagggcugaggccucagaucugccauccuuggcucucugccucucgcaggaagcaggugggaguuuaccagggaggagagggggcuggagguccccacugcagggucugugcugcucucccagggggacugagcuccucuguaaggagacagaccuuucccaacucugccuccucuguggugugcuguguuggggguugacuuggagccuucugccuagcaugccaccucuagacuugcucugucuggauuggggcuccugggaggcuaagaaagacccuucucccucuucuccugugcccccuggggagggcuuucuucccuugagggcucugcaccuauuugaaaggaaggcuuuguaucccugggugggcacuucucugucuugacaccuuugguuuuugagcuggauaauucuuuguucuggggagcuguccugugcuugguaagauguuuagcaacauccuagccucuacccacuugaggcaagaugccuuaguucauucaggcuuccauagcaaaauaugaacagcagagauuuauuucucacaauucuggaggcugggaaguccaagaucaaggcacuggcaggcucaguguuuggugcaggucugcuuccugguucauuaacagauguuucucaccauguccuccguggguggggggccagggagagacuuuucugggguuucuuccuuccucccuuccucucucuuuuuccuuccuuccuuccuugagagaauguucugggguuucuucuccccuccccuccccuucccuccccuccacccuucccucccuuugcccaggcuggagugcaguggcucaaacucuuaggcuaaaaugauccuccugacucagccucucgaguagcugggacuacaggcacacaucaccaugccuggcuaauuuaaaauuuuuuuuuuuuuuaauagagauaagucucaccaucuugcccagacuagucucgaacuccugggcucaagugauccucccaucucagccucccgaaaucuugagauuauagguguuacagguuugaaccacugcacuggccugggggucucuuucauaaggacacuaauccuguccaugggggcuccacccucacgaccuaaucaccucccaaaggccccaccucaaaugccaucacauuagagauuagauuuuaaccuaugaauuuuggggugacacauacauucaguugauaacacuaguagcacccccugcccucacuccacccccaguuguaacagccaaauuugucuccagacauuuccaaauguccccugggggcaaaacugccccccuugaggcacgcugcucugggaggucaugucuguaaggggccaagccuggcacuggguggagucagcucugucaggacagggcucacgccaagugaagcugggugaggugaaaagaugagaguucuguuuuacaggaggcugugguccagaaaugaggaagcugggguucugguccucacucuaacuccccauugcagggcccaguucucaucugucaaaugugggacuccagcgcugaccuuuagcaguucugucuguauuaaacccucaucggcuucuucuacacaaugaguaaaacccaagaucauaccacaaagcuguggaugaccugacacuugcaaaauucucugacugcacuuugaguagcuuggggcuucccucaucuuuacagcccagacuaucaguccuuugaacuauuaagccuuucuagccacaggccuuugcacauacuguucccuuugccugggaugcucuucccuguucuucacgugucugggcccuucuuauacuuuaaggcccagccuaaaugcuucuuuuuuucugagacagagucuuggcucugucacccaggcuagagugcaguggcacgaucucagcucacugcaaccuccgccuccuggguucaagugauucucgugcuucagucuccugaguagcugggauuacaggcguguaucacuauuggcuaaauuuuuguauuuuuaguagagacgggguuucaccauguuggccaggcuggucucgaacuccuggucucaugugauccaccugccuuggccucccaaaguguugggauuacaggugugagccaccaugcccggccugaauuuaagaucuuuuuaacuggcaucugccucaaucucaguugacuguuuuuggcuaaggugcuuauuuuugucgugcuccaguucauccucgagauuccugguuuugucacauucacuccggcagauguguauuuacuguguccugugucuguguaccguucugcagaggaugggaugggagggugagggugggggagggagccaaugacugggccccggcaggugugccuucaaguugugcacuugcugugauuuccaccuugaucguccuuuccccaaaucuuuguaugcccugcucuuuuuuuauucuuuuuuauuuguuugcuucucuuaacacuguaccucucagaucuuauccuuuuuauucuugucucagcuaaaugucacuuccuccuagaagcccuuccugaucacccuagugaggguugccccugccccugccucaguuaccugcucucccauuauaccguuuuguuuucuugagggcaguuaucacugcuugccauucccucauauacugccuucucgccacacuagggcguaagcucccugagggcagagacucacucucucuugcucaccaucauauccucggacagugcuggcauauaguggauacucaggaaauauuugucugaugagugagugcaucugauuuucccagcucuggagaggugauauuucaugucacuuaucaaaggagaaacugaggccucaugagcugcagugguuuguguggacgcucacagccagcaaaucuuaaaaucuugugcugagauuugaacuugaaucuguuggccuccugugccuucauucucucuuucucucucucucucuuuuuuuuuuuuuuuuagagauggggucucacucugucuuccagucgggugcaguggcaugaucauagcucacugcagccucaaccgucuaggcucaagugguccucccaccucagcuuccugagaguagcugcgacuauaggcgugugccauuaugacaguucccauacccucuuuaacaugccacccauuucagugggaccuaauuucugcccucugggagcucucugcccugcuaggaagagugagacaaacacguugacaacuuucaugugagacacaacgggauagggacccugacagagcuggcagaaaugcagugggcccagugugguggcucacaccuguaauccucgcacuuugagaggccagggcgggaggaucacuugaaccccggaguucaagaccagccuaggccauauagugagaccacugucucuacaaaaaaacuaaaagaaaaauuaaccgggcaggguggcgugagccuguagucccagcuacucaggaaacugaagcaggaggaucacuugagccugagaggucuagguugcaguaagcuaugaucaugccacugcacuccagccuuggcuauagagugagacccugucucaaaagaaaagaaaugaagagcaagagaaggaggaagaagaggaggagggggaggaggaggagggagauggggaggaggaggaggaggaggaaagcaaugaggaaccagguguggugacucacaccuguaaucccaaugcuuugggaggcagacugggaucacuugaggccagguauuugagaccagcaugggcaagauagcaauaccccaucucuaguaaaaacaaaaauaaaagaaaugcggaugggcgcaguggcuuacgccuguaaucccagcacuuugggaggcugaggcggguggaucaugaggucaggaguucaagaccagccuggccaagauggugaaaccccgucucuacuaaaaauacaaaaauuagccgggugugguggugggcaccuguaaucccagcuacucgggaggcugaggcagggaauuguuugaaccugggaggcagagguugcagugagccgagaucacgccacugcacuccagccugggcaacagagggagacuccaccucaaaaaaaaaaaaaaagaaaaagaaaaaaaaugcaguggaacaacggggguucaagggcaggagcaauuacauuaguugaggacaugaacagaggcuuaguggagaggaggcauuuaaacaaguccuugaaauacaguguugacgagaacuuuugaagcuaagggagaacauucuacuuaaugggaacaguaccagcaaaaauguagagguggaaaaauaaagggaguugcagggaauaauaagcagccuggcuuggccagagggcaagagcuuugaugaagaggugcaagagggauaucuagaaagggaggugggagcuggauccuucuguguggaugcuaggcuuuggacaguggggucagcaccuccaaacuagcauggagaguauaauuuugagacaaggucucacucuguuacccaggcugaggugugguggcaugaucuuggcucacugcagccucaaacuccugggcucaagugagacucccaaguagcugggcccacaggugcaugccaccacacccaguuaacuuuauuuuuuauacagacggagucucacuauguuguccaggcuggccuugaacuccugggcuaaaaugauccucccaucucugccucccaaagugcugggauugcaggcaugagcgacugugccuggccuggcauggagauucuugaaugggagagugauguaauggaaagugguguucagguguucgaauggaagggcggggcugggguuuggagggcagggagagggauucuucuguguagauacagccacagccuuugucaaggcagauuccaggaucacagagcuaguuucuuucaggcugcaguaaaaccauaguagaauaauuacuuugcugcagacuaguguguuucuugcuuugaacucaacaccuagauaaauauuagcucauucuuuucuucauucccuaaaagcgaauuuguacccccauuuuacaaagugggaugcugagaccaagcuucccgauggugagggguguaacuauguucagagcguuugcccagcgcuguacugggugcgaggggugguccgcagaggcugccugugccccuacauaagcucaccucuuguggguccuggaggcaggcugcagaucucuaccagccaggagaaaacaguccaggucccacgcuaagacaaguguccugagguuugaggugggugcccuuucuggggagguggggcuaggcuggugggcagagaggggagggaggggcauucuagacugcgguagccagucagcauggucggugagcuugaggaguggcaggugguugaggccagccaugccaggcaguggugucugucuggggcagacguggugcacaaggcacugguuggcgacauuuguugcugcuuccugggucccaucagucaugcaucugugagaucaggaggacaaacaacuguucugagaagccauugcuuacagggguggauuccuugcuauaucaagcccugaaagauuguccgaggaggagaaaguugcuguagaaaucuggucaguugguaacugcagcccucuauccccagggugcugugucgguucagcggguguggcucucgcagcuuccaucugcugcccccucgcccucugcccugcuccaaguggauugcguuguuuggcaucucaucacacccgaagauaaccuugagaguaguuuugugcaucccacauuuggagagacauaggcuguguucauuucuguguuucacagauagggagguugaggccccauaagugacuugcccaaagacacuggguuaaaggcagcagcagauccggguuucuggacuuucucuguagggcgauguucucaagaagaugucaaacucuacccuuugccuacuuaguguguggcuuugagcaaguucuuaacuucucugggcuuuuguuuccuucucugcaaaaagggacugauugaugcuuuccuugcaggaagaccucagggccugcccaagccucuccaaggucuggcuuggccacguggccuccuccacucggaccagcuguggucccuuuagagccauuaguggccauacuguuagugucauccuggcugcuguuucuauucccuuuuguauguauacguuugugaugagucaucagugaaaucaaaauaauuuaaugucucaaauuguugacugugugucauuugauuguauucugugugggauuuacuuuugauuuuaauugaauaugggcuucuuuucuccuuacuggcuugccaggaaggaggguuuuuuuuggaaagucccagagcccaugauagcacaugcgguugucuccucguccagggcuugugagaauaaaugcaauccagaggucauuucucuccuccagggaugacagagcugaagcacaucuuugucagauucucaaauaaaaguaauacuuuugcauccucauagcagcaucucuuacuuacugagcacaaacuaccugccaggcacugugcuaagagccuugcagacguuuuauuucaugcucagaaccaccuguucguuggauccuguuguccucauuucuuuuugagguauauucaaauacuguaacguuuacauuuuaaaauauacaaugcaguauuuauuuguauauucacaagauuguauaaccaucacugcugucuaauucuaagccauuuucaucacccaaaaaagaaacccuguaccaugcggaguccuuucccauuuccugaucuccgcccagccccaggccauuaccagucuacuuucugucucuauagauugccucuucuggacauuuuauguaaauggaaucaugcaacauuuguccuuuugugacuggcuuccuucacauagcaaaauguuuucaagguucauucauguugcagcccaugucaggauuucauuccuuuuuauggcugaauaauauuccauugaauggauauaugacauguccuuuaucuguucaucagcugauggacauuuggauugucuccacuuuucaacuauugugaaaaugcugcugugaacauuuauauacagguguuuuuuuuuguuuugcuuuguuuuuuguuuuguuuuguuuugagguggagucucauucuguugcccaggcuggagugcaguggcgcgaucuuggcucacugcaaccuccgccuccuggguucaagcaauucuucugccucagccuccugaguagcugugacuacaggcaccugccaccacacccugcuaauuuuuguauuuuuaguagagacgggguuucaccauauuggccaggcuggucucaaacuccuaaccucgugaucugcccgccucggccucccaaagugcugggauuacaggugugagcuacucugcccagcacuacauacagguuuuaaaacuuuauuuauuuguuuuuauuuuuuugagacaaagucucaaaaggucuggcucuguugcccaggcuggggugcaguggcaugaucuuggcucacugcaaccucugccucccaagcucaagcgauccucccaccacagccucccaaguagcuagcugggacuacaggcaugcacuaccacacccagcuacuuuuuguauuuuuuauagaaccaggguuuuacuguguugcccaggauggucuugaacucuugaacuuaagugauccucccaccuuggccucccaaagugcuuggguuacgggcgugagccaccaugcccagauugcauacagguuuuugaaagagcucuuguccucacuuuacugaagaagaaacugagauuggaguuaaguaacuugccugaggucccacagcaagaaagaguuggcccaagaaaggauucaauuuggauucugagaagaagauauugcuuucuaggucucuugugugguuagaaguuauucugacugaguaugauagccacuggcuggagggccucaugcucagcuuucuucucugaggccaacucucuguagcacauuauuuccuagagaggcaggggcuucugcagcaggacgugagaaggcaccucugagaugcaggauucgugugugcguuugucagagggguguccacacagcccucugagcgugcggcugcucuccccagcagcucccgugagcuuugcccuggcaggacuuuagcucuguucccuauguccccaucaacacccaucuccacugauccagguuuuugggcguuugaggaaaaacauaccccaagggucacugcauguuggggauguuccuuucuuuaaacuggagauauuuguaagaagucauuaagugcuuguaaaacucuugcacaauauacaaguccaugaaauaggaagugaaagaaaaaaaucccccuaaacccacuggcacuuucaaguugagugguuuccccacgucucagaagacgcgccuucccgaagugccuuucugcccuucucuucccgacaacccucccgggcccaguagcugugugugcuauugcggugggacuuucuggacguaugugguccucggugagcucuuccucccaugcccuuuucucuauaaggggcaugagacaggaaacaggcucagaaacauugcucuagagaucgggaguaaaacacccccaaagaccugaaagugguugucccugggggaggggauuugucaagagggagcaaguccggcugcuuuuugucuuaagccuuuuagagccagccagcucuguaagcacuacaacaaacagcuuuguuaaagugaugccuaauugugcccagugaugcacggcacgaucccuugaugagcaguuguuuugcucgcugucugcauccugugugucccuacuuuggaaauugagugacauuucagagacuggcagcucaagucauggggggcuccuguuugacagagggcugucugaagagccuuuguuuaguagaaucauggagucagaggaugucuggucugguugagaccccaaaucaucuaguccaaacccucauuuuacagaugaggggacaaggcccaugaagaaguagugucucugagcucccccuggcugauaguggaggggcugggauaagaauuaggccuccugaguuacagcccagggcggccuccacaccgagggucacgugugccucugaguaccagaagcaugaacaaagcgagagaagagagugaagagacucugucucugcugcucuguccugaaauagucugcucagaggggaagcaggaggaacccagggcacaaaaaauuuccaugagcguguaaaccucaugcccuuaggcaggcaggagcagccagcacucaguuacugucauuaccaccccauuaucaucaucaauacaggaagcagcuacaucaggaggaggccuggccccucuaggccagugaugcuucagcuaaaacacagaugccugggccuuacccccagaguuucugauucugugggacugggguggugccugagaaugugccuuucugacaaguucuggggugaugcuaaugcugugggugaugcugaugcccuuggagaaccacugcacuggaguagcccuugcuacuuagugugguccuuggaccugcuggguggaaaugcagacucuuacgccccaccuagacauguggcaucagaaucugcacguuggcaguguccccaggugucacacuuuaguuugagaggugaugguauggugcagaguucaccuggcugcacguuagagucacccagggagcuuuuacccucccuuccauucccaagccccagcccccacuaauuaaaucagacucucugggagagagacuuaggcaucaagagucuauagagcucccaagguggcuccugguuguggccaaguccuagaauccacaguggcagcugcaaggggccuuggagaugaucaguugcaauuuaccaagauuugaaaacuaagggcauaaggacccaaggucccacagacaguaagugacaaauccaggcuguugauacccugaugacucuuucaccagcucuuucaacucuaaguccccuuuuauauaguuccaugggaacugcaauauacuaguguucccagggaacccauuguaaaucauggaagaucuaucugcucauuggaaacccaccaccucccaaucuguuucagcauggcaggcuguccugaaugcggguuacauauucuagggaggcaguguagcauggugguuaggagcaaacccuuaagcucagcagcuuacuaaccaagacuccuggcucugugucuugauuccuccucuguacaacaggaauaguaauaauagugcccaucucauggaucaucugaggucaggaguucgagaccagccuggccaacauggugaaaccccuucucuacuaaaaauacaaaaauuaguugggcgugguggugcaugccuguagucccagcuacucaggaggcugaggcaggagacucacuugaacccaggaggcggagguugcagugagccgagauuacaccacugcacuccagccugggugacagagugagacucugucucaaaaaaauaaaaaauacaaaauagugccugucucauggggauguugugauguuguggggguuaacugaguuaaugcaugacaagcugagaucacuaauugcaagcagcaggcacuuuguaaauguuuuuuauuauuucauuaacugguugaccuugaauaagucauaugacuuagaacaauuuguuugacuucuccaugacucaguuuccuuaacuguuaaccagggguaagcauaguagugaccuauuuauagggugguugugaggaauggagggaauaaaaggucugaagccccagcacagcuucuggaacacaccuggugucaaucagugguggcugcaguuauguguuagagacucaacaccggugcaggagaaaguucuggccaggccagagucugagcuagguugguccugcuccucucacgggagcagccagaaccaugaggauugaaguuucuggggauguuuuugccuggaaaaaaguuuauaauguucugugguugccagcagcugggggaugggaaaauaggggguuaacaaguaaagaguuuccguuucgcaagaugcaaaaguccuggagauuaguugauugcacaacaauguaaauauacuuaaagcuacugaacuguacauuuaaaaaugguuaagauggcacauuuuaaaaaauauuuaauuuuuaaaggggaguguuagguucacaagguucacaagcaaaauuaagaguuaagaauagagauuuuccaauauacuccccacugcccacaaacaggcauugccuucuccaugaucaacaucccccaccagaggggcauauuuacuacaauuggugaaccuacguuggugcaucauuguuacccaaaguccaugguucacauuaggguucacuccugguguuguacagccuuaggcucagauuaauguauaaugacaugugucugccacaugucacuuucaccgccugagaauccucugugcucugccugcuaaucccuugccacugauaaaaugcuacauuuuuuuuagcaguuuuuaaaaggaggauuuauuugacaaguuucacuuagcacaauauaccuaaaaggaagucacacuacaaugaaagauuuaaaucaaggccucagaauuucauacaaacaccaaggccaaaauucuaaaguauugguauugcguuucagauuuuucccauuaacuuaaaaaaaaaaaaagcuuaaacguacaugccuuacaaguuauuaagugaaacuagaauuaacaaacaugccaaaauguuucuagacacagcuccuaccuugaguuuuacaaaaaacaaagcaugucuuuccacaugcauccaguguucaguguaauguggcaaagggcaacauuuaacauaauucaacuucuuucaccuaaauaugcuuacuaaguacacccuauaauauaacuaacuugagaaaagcuggaacuugcucaacaguuguaguuuacucggcuucacuguuacauccuagaugaguauuguguuaaaaaauauugagccuuaagucuucauaacaauccugauuuccacuagagaguaagcauaaaucacaagcuuguauugcagaaacuguaaaguugaccaagagucagugauuaggaucgaucaauuacauuucccuccacaacucacacuggacguguuagacaucccucccauuccucaugccuauagaugcauggcuuccaugauucuaguugcugcuauucauugcuccuuggcuacuuaugcaauguuugauugaaaaucacgggaguuuucccguaaaacuuggucauaucgcucgcuaaauuuuuguuauguguauuuuacaauaauuaaaaagaaaauguuuauaauguccuuugucaucauuuaugugaaggauugccaugcagaagagagggcagcaggacuggugaguggugaaggguggcaguuauuaauacaguucguuaaagaacucucuaacaauuaaacucauucuauggaaggaggagggagcccucccaucaccaguguucaaggagaacucuaugaccucagauggagacauggagagauuucaggccucagauuggaggcuguguuacucaguguuucccaaguuugccuauugauaagaaucaccuggggauauuguuaaaaacaaauuucauggcaccaucccagauucacugaaagguagaauaucugggggaggaugaaaggaccagccucuucagaugauugucucuuuuuuuuuuuucuuucugagacagggucucacucugucaccuaggcuggagugccauggcacgaucucggcucacugcagcccugacuuccuaggcucaagcaauccucccaccucagccuccugaguagcugggacuacaggugugcaccaccaugacuggcuaauuuuuuauuuuucuagagacagggucucacuguguugcccaggcuggucucaaacuccuugguucaagcaauccugccucagucucccaaagugcuaggauuacaggcaugagccacugugcccagccuucaguugauucuaacucagaaguuuggcaaacgucggccaaaggacccccggucuccuaacccugagauuccaugaagaaagcuucucagugggagugggucacacuggccacagaguuccuccaguagccuugggagccuuacuucuuggcuaggucacaagcccaugugccuacuggccugagucccugacacccucgccucugggcccugugacuugguuggcagggaaguccugcuccauuucccacucuugggcccugucaccaggcccacuucucagcaggggcuggcaggggucaaaguucuauauuucuaagucaccaugcaagcucaaucaggcgcuccugaauuccagcugaguguucugucuucuuggauuuugcuccuucugcccugguucugcccacugauuacuuuucaucaagcauucauuagaauuaacgagauaagcuuuaauaaaggacccaagcaauuugaauaaaaggcuucuuuauuaaugcaaaaaacuguucuaauuagaaguuuggggacaugcaguuuggucuucuugcaauaauaauuguaauuaggaggaucaucacagcuuguguuuauuguacugcuaccgccucccccaaggaucuuucuguucccugcugcagcccaggugucaguggcuggggcugcuagggaaagucuagcugcugucuacauggugcuggaggagccuggcauugccccuuaccuaccaugccauuccugaccccugucggggucugugaccgccauuuagcacuaaaugauuccaaugccaggagccuucuucucugagcauucaugcagcaugggcgaggcucugagaaaguguagaagaaggcagagcucaaggagggagucccagaggggugacaguccuuugcucaugcuguggcucacuccuggguucccuucccucucuccuuuuugucuguagaacucucauccauccaccugaaucuagggugacccuaaacaucccaaucugccagugacugaggagggauuccccaggaugcaagacucucaaugcuaaaauuaggaaaguccugcuuaaacugcccuacucgucacccuacuugaaucuuugguuuugaaucuuugcauucagaucccaucacuguaccacaaugaccauggacaauuuaccuaucaacaugugccucauucuccugcugugaggguaacucagguugucaaaggaauuaaaugaguuacuauagaaaaagugccuagaacugugucuggcacauagcaaauacucagugcuguuagcuguguuuauuuuauuuauuuauuuguuuauugagacagagucuugcucuguugcccaggcuggagugcaguggcacgaucucugcucacugcaaccucugccuccucgguucaagcaauucuccugccucagccuccugaguagcugggauuacaggcacgcaccaccacgaccgacuacuuuuuguauuuuuauuagagacaggguuuuaacauguuggccaggcuggucucgaacuccugaccucaggugauccaccugccucagccucccaaaaugcugggauuacaggcaugagccaccaugcccagcccugcgcuuauuaacuugaaugggaccuuugagaucaccagcuuggccucugcugguuuaggaauucucucuguggagacucugccugaccaugcugcuugaugcgguccucacguccucacccaggagccuuuucuuuaugccuuggugaacuauauacugucugugcugaggacccauagagaaugagaccuucucgaugacaucccacagcucuuugaggaccacucucuccugucugcagccuggaucuucucuucccuggguggggccccccuucccuagugggaccuggcccccagucacaucuuggcuguguucucuggcagcagugccgucuguuccuauaaacucagggcccaacauugaacuuggggcucauggggcuuuuuccuucugcaaacugguagaauggguauagauggugcccaaccucugaauuagaccugcagaggaauuuccagagaacagaaggugacuggcucgugcagaaggcuguuggccccuuuccccagaggcauugagggcucugaacuugaagggccuacaggaguuuguagacaagaccucgguuucccaugggggaguucagcauauacucccuuucucuggccuggccuagagccaggcaccuaggcauguuuuugacucaagggggcaguagaguggagugguugggaccccuggcuuccugauccaccuaaccuggauccaaaucuccccguccucacuucuagcuauaugaccuggggcaagucacuuuauuacagucuccugugugcagaggggauaguucguacuuacauagcacaugugaaauaguaagugguguuguuuaugguuguuauuauucccaucccccguguguggcauacagcauauugcuccuuguguacagaugggaacaugacuguguaaggaugauauuugcuccuggaucuccauuuucuugucccgggaccauggagaacuguucuggagaucauggaccucuccucccagcaggggugagaguccaugugcuguguuaguggcuggugauggggcugggaugagggguguuugcaucacaucccagcagggcccuucuguggaacuccuggauugccuuugacguugguggcagccaggcuguucuggguaggagcuugguggugcaccccucucaugcauccuggccucugguggguacuggaggggucacauaauggagaaaacagauggaaucccuggggacacaaaaaagucauagguaagucacaggauacugugcagaucaguaccuggcacacaggagggccucgauagcuauuuguggagagugaaagaaagaagcaggugucggaggugacauuccaggcccucggcauccucuaauguggccuugcggugugucaguuggccagaugaagccgcagagggcuuguauguugcuuguuuuuuguguguguguguuuuuuggguuuuuuuuuuuuuuugagacggagucucgcucuguugcccaggcuggaguauaguggugugaucucggcucacuguaaccuccuccucccaggcucaagcaauucucccaccucagccccccaaguagcugggauuauaggacgcgccaccacacccggcagauuuuuguauuuuuaguaaagaugggguuucaccauguuggcuaggcuggucuugaacuccugaccucaagugauuugcccgccucggccucccaaagugcugggaauuacacacgugagccaccgugcccggcacuuguauguugccuaaaucagagacuggaaggguggguggugugagguugggaugguguguagauggcccagguggucggaaugggacugugggcuggacauuucugggcugaucuacuccggaaagacaggcugcuuugaguacccuuggaaauaacuugcauggcuuuauggcuucuuccuccguuguaagcacuuucucucccuacuguggggagugguggucccugaaagcuccuauucacagcucugccccagcccaaugcagaguuccuguguuucuuggaucugcuuuucccuauuucccucacugacgaagagcuggcugcccucaauuuaucugcgaauuugccagguuauuuuuuccaauaaaaguuaacuuuagcacuuagggaacaugaggcagguggaucacuugaggccaggaguucaagaccagccugggcagcauggugaaacacugucucuacuaaaaauacaaaaauuagcagggcaugguggcaugcaccuguagucccagcuacuugggaggcugaggugggagaaucacuugagcuugggaggugaagguagcagugagccgagaucacgccacugcccuccagccuggguggcagagcgagauccugucucagaaaaauagcuaauuuuaugauacauuaauuuuuuauuuuaaaaguaaaguaucacuguauacagauacuuggcaaaugguuuuauauaaauauagaaugguauuuuacuuacuuuguauaaaguaaacaaccaugaagacuauaauuuaguaacaaauugcucaaauccuuugaaauaaccacuguuagcauucugguuauuuuucuuucuauugucuuucccaggcauguauccuuuuauaccuaguuggaauuacaaugugcauaugguuuuuauguccugcuucagaaaaaaacccuacgcucuguaacaugaaugauucaacaagagaaacaaucaacacaccuggguugauaauacuauuuaaagagcucuacaaacauuugggagaaaaaaaugccagagcuccaaguagaaaaauagugagacauggauaggauuuuccauaggggaaacaaaugguuaauuaauauuuacuuuauuuuauuagagauagggucuugcucuguugcccagcuugagugcagugaugcaaucauagcuuacugcagccuugaacuggacccaagugauccucccaccucauccucccgaguaccuggaacuacacacaggcaccaccacgucaagcaaauuuauuuuauuuauuuauuuuuuugagacagagucucucugucauucugucgccuaggcuggagugcagugauacaaucuuggccucccggguucaggcaguucuccugccucagccuccugaguagcugggauuacaagcgcccgucaccacaccuggcuaaauuuuguauuuuuaguagagauaggguuucaucauguuggccaggcuggucucaaacucaagugaucucccugccucggccccucaaaaugaugggauuacagugugagccaccauauccagccguauuuuauuuuuuguagagacgggucuugcuguguugcccagguugguugugaacuggccucaagugauccuccaaccuuggggauuacaggugugagccaccaugccuagcugaaaaacaguuaauuaaccaugaaagacagucagucucauuauugaaaauauugcaaauuaaagcaggauaccauuucccuugaucaacuuagcaaggcuuucuuuucuuuuuaaugauucuauuauuuguuggauagguuacauguaaauuggcauaaauauucuggaaagcaauuuggaaacacaucaggagcuauauauuuguuuacuaauuauguuuuuuccuuuguaaauaucuuacguccuuuccuucucagguggucuuaauuuuuucuuuauucaauuauauugaguaguuucaguaauaaagaugacucuguaugcauccuauuuacagaucccuguuguuugcuuuacucuuuuuaagcuucuaaguguuuuauauuuuuuuaaugcaguuaguuuuguugaucuguuccuuugugauucuguuaugcuccuagauuugggaagucauccucacuuaagagguuguauaaauguucaauuaaguuuacuuuuuuuaauuugguuuaaaaauauuuaacguguaauucuaucuaggauguauuuugauucuuagauugagucuuucucagaauuguuaagggguuauucugacaucaguugauuaauccuucccucuccaguuuauuugugaagcuuccuuuagcauuuauuaugacauuauuucuggacuauauuuuuugaacuacauaauuucuuucuaugaucuauuuuccauuuugcccucuguuuuaauuauuuuaggcuuauaauauugguuauaaccucaccuuuuuaagagggucuugcuuauagauuucccuaguugaacuuuaaaaccauuuaguuaacuuaaaaauaaauaaaaaaccuugugaggauuuguguaguaguuacauucaacaauauauaaauuaauuucuuuaaaaaaccgguguuucaauauuuugacuugucaucaauggacauguuauaucuucacauacaaaacuauuuuuaaaaaugucuuugugggccgggugccguggcucgugacuauaauccuagcacuucgggaggccuaggugggcagaucacuugggcucaggaauucaagacuagccugaguaacauggcaaaacuccaucucuacaaaaaauacaaaaauuagccggguuugauggcacgugccuguagucccagcuacccgggaagcugaggugggaggaucguuuaagcccaggaguucgaggcugcagugagccgagaucgugccacugcacuccagccugggugacagagcgagacccugucucaauaaacaaaacaaaacgaaaauaaauaucuuugugaacuuuucuacuuuuuuuuuauauuggucagauacauuuuucauuaugcucauuucucuauauuuuauauuguuguuaggaauaguaucuuuaaaaacuguauuuucuugcuggugcauaggaauaucauugccuuuugcaugcuuauuugauuagccgcuuugcugagaccauuuuaauuuauguuguuugucacaugacuguuuuggguuucugagguuauacagucauuucauaugcaccuaagaaucauuuugucuguuuucaaugucugugcuuucuauuuaauuagccagaccugacuugacuuuucuuuucuuuucuuuuuuuuauuuucuuuucuuuuuuucagacaaggucucacugucacucaggcuggagugcagugaaguguagaggcucacugcagccuugaccucuuggguucaagcgaucuucuucccacuucaacccccaaguaucugcgacuacaggcacacaccaccaugcccagcuaguuuuuaaauguuuucuguagagacagggucucacuauguugcccaggcuagucucaaacuccugggcucaagcaauccuuccacuuuggucucccaauguacuggauuuacagacaugagacaccaugcccggccuggcaagaacuuucaugaugcuauuuagggauacuggugaugaaagacauccuuauuuugcucuuuguuuuaaagggaaagcuucuuccauuacuuugauguugcuccugggauguaugaugagaucugccuacuccuacccaaagggacugguguaauucacaacaacuccaacaaaacuucuuuccagcccuuaauauaucggucacagagcacuagagggcuuguuguuuggaacgauuacucuuuuuagaauccccagguugccccaaacucugagcccacagugccuguuugcuuccagcucagcccuugcuuucucucuucugaaagccugacuuuugggagcuuguuccucccuggcaggauuuagcagucucuccugccaaccccaccugcugauagaagagcuggugcuugacacugggcagccgcagggcuggguuaccaagugcagcccuggaccagaggaggcauuaacaacaccccuuauaggcugccuggcagaggagcccuguggacccucagucaucuguacuuuugcccuuuucccaccugucccuuuucccccccaaaaccacaucugugaggucaacuggaaccccugccuuacccaugagucugcuggacuucugguacuaugcucugggugucuucccaguccacugggaagauagcacaaaaagggauuaauacaacacagggugaagaggucuuguucgcauuauaugaggcucagcuuguggagcaacuaacugcuuaggacagucagagaaagcuucauggagaaggugacauuugagcugggucuuggaaauucugugaggcagaugagggagaaaggcuucaauugugauuauuuccauguauuucauauuauuguugcuguuaggaauagaaucuuuuaaaaccauauuuuauugcuggcauauagaaauauugaguuucacauguuuauuuuggagcaaucgucaaaggcuuagaagccugggagagccuggccucuuuggggaaaagaugagaguuucugagagauaaaugggguggugcugucacgcucgaugagugcugcugggguucgagguugggggcugacuggacaccagcaaaaggggugacccagaagacuucuggaagagaugagauggaagcuggccuggaagcauagagaggcuuuagaucgaguggcaagaggagguaaaguggaaggggaggacugcuacaauauuuguagcauuccugcuaaguaucuucuaggcgcuuuguuagucauuauuuuacuacauuuaauuuuucccaacagcucugcuaggcagcuggugguaccuucauucuguggaugaggaaacugaggcucagggaacuugagugacaccuugaugaacuggacagacuaauuucugaaccccuaugcuuuuagggucuaucugcugcuguucacauauauaauaauauauacaauuauauauguauauauaucagcuuuauugauguauaauucacaugccacacaauucauccacuuaaaguguacaauucagugguuuuacuauguucagaguugagcaguuaucaccacaauccaaucuuagaacuuuuuuuuuuuuuugagauagucucacucuguugcccagguuggagugcaguggugugaucucagcucacugcaaccuuugccucccagguugaagcgauucucaugacucagccucccgaguaguugggauugcaggcaugugccaccaugcccagcuaauuuuuuuguuuuuuuuguauuuuuaguagagaugggguuucucuauauuggccaggcuggucucaaacuccuggccucaagugaucuggccaccucagccucccaaagugcugggauugcaggcgugagccacugcgccccgcccaaucuuagaacauuuuuauuaccccuacaaagaacucccccacccuccauccccugcagccuuggcuaaucuacuuuccgucuguaugcauuugccuauucuugacauuucauauaaugaaacuguacaauaugcaggccuuuguaacuggcuuuugccuggcaucacauuuucaggguucagccaugcuauagcugcuauaacauacauugguacuucauuucuuuuuuaaaaauuuuuuugguggggagacggagucuuguucuguugcccaggcuggugugcagugguaugaccugggcccacuguaacucccaccucccaggcucaagugauucucgugccucagccuugugaguagcugggauuacagguacauaccaccaugcccggcuaauuuuuuuguuuuuaguagagauaggauuucaccauguuggccaggcuggucucgaacuccuggcuucaagccauccacccaccuuggccucccaaagugcugggauuacaggcgugagccaccacgccuggccacuucauuucuuuuuguugcuggaugauauucccuuucauggagagaccacauuuugcugauccaguccccaguugguggacauuuggguuguuuccacuuucuggcuuucgggccauugugaauaacgcugccaugaacauccacauguaauguguuuuugcauggauguauguuuuugucucuuggguauauaccuaagaguggagugacugggucauaugguaacucugugcucuguguuuaaccauuugaggaagugccugacuguucugcacaguggcuucccaacugcugcuuguacgaggcuugccuucagcgugacaggacuaggaagaagaucaaaccauaaagucugugugaauugccuguuuucaaagaaguagacuauuguaaagcagucuuuagacugcaucugcgcugucgagucuuugaugauucuaaagggacuuguggauucugcaggaucucaaaggcacugcuaugaaugccagucaucuuugugccggcagacacgauucuggcuaguaggcugugguaacagagauggugcuaacacaaauccuuagguucagggugcaagggagggacaggugugaguuaaugccuaugaggagggcuccuggaagagggagggcagggucugaagccugguccuggggagacaggugggagggcaaggaggcuggaagggggcauggagguggggucugugugagucugggacaaguucucgggcagcuguggcugauaacucugguuuguuuuuguucuuuggcugcagaccuggccgagugcaagcuggucuccuuucccauuggcaucuacaagguccugcggaaugucucuggccagauccaccucaucacccuggcuaacaacgagcuuaagucccucaccagcaaguucaugaccacauucagucagcuccgagguaggcccuggucagcuccagccaggagggcauggccagcucucaucguucaggcucugacccugucuggggagugccaccagagcuggucccuggucagcgacacccaugaaaucauucccauggguugacuuugaaaauggaccuguguucucccugcagcuuggaacucucuaggucacuucugccucuagcuggcugugaagcagauugaacaaggaucaagggugugguuccuggagugauucucuuguucugaacagaccagcaggguguuuggguccugaggcccugggaguuguuauuucccaguagucuugaaugagcccccuucucaccuuccaaucuaguguuguucuccuguguugcucucucaguucaggagugacagaugccagggauguuggcauuuucuuuucuuuuuuuuuuuuugagauggaaucuugcuguaucgcccaggcuggagugcagcggugugaucucggcucacugcagccuccaccucccagguucaagcgauucuccugccucagccucccaaguagcugggauuacaggugugugccaccacaccugggucauuuuaauauuuuuaauagaggugggguuuuaccauguuggccaagcuggucucaaacuccugaccucaggugaucugcccgccucagucucccaaagcgcugggauuacagguaugagccaccaugccuggccgauguuggcauuuucucugcugggcauauucagagcaugugguuguaggugcuugccaucaagguggcaggaguccagcaggugagccucguagaugcucuagaaaugguuccucuggauggacaagcaguguggccugacugcugcagugccugcccucuucuccagagagcagucucuccauccuucuacgagaggucacugcugcucagugacccaugugacagagcuguggcaugggcgccuguuguacguuugugaacgaguggagugggagaauugcggagggcacaggaagccuaggggggcagauccugcuucaucccagacucacauggaccccaacuccaugccccccuuccagccuccuugcgcucucaccugccugcccuggagaccaggcuucagagccugcccucugucuuccaggagccuuccucacaggcauuaacucacaccugucucucccuugcaccuugaacuuaaggauuuguaacagcaccaucucuguugccacagccuccuagccagaauugugucugcugguacaaagacgaccagcauucauagcagugcccuugagacuuugaagaauccacaagucccuuuggaaucaucaaagacucaacagcgaagaugcaguuuaaagagugcuucacaauagucuacuucuuugaaaacaggcauuucacacagacuuucuuccuaguccugucacacugaaggcaagccucauacaagcagcagcugggaagcugcuguguagacaggucaagcaguuccucaaaugguuaaacacagagcacagaguuaccauaugacccagucacuccccuccuacguauauacccaagagguguaaaaacauauguccacguugccaggugcaguggcucacgccuguaaucccagcacuuugggaggcugaggcagguggauccccugaggucaggaguucaagaucagccugaccaacauggcgaaacucugucucuacuaaaaauacaaaaauuagccgggugugguggcgcacaccuguaaucccaacuacuugggaggcugaugcaggagaaucgcuugaacccggaagguggagguugcagugagcugcgaucgugccacugcacuccagccugggugacagagcaagacuaugucucaaaaaaacaaaacaaacaaacaaacaaaaaccaaaaaaacaaaaccauacauccaugcaaaaacacauuacacguggauguucauggcagcauuauucauaacagccugaaagcuggaaaguggaaacaacccaaaugucuaucaacugggaaauggauccacagaauguggucuccccaugaaagggaauaucaucuaggaucuaggaaugcucuacgugauagggauaugaaaagggucuaagauccuguuuagagaaagaaauacaugaaaugcugaugaugcaugagggacccgagcaagccuaucucauagggcugacuuuaggcuaggcaagcuuccuagaggaggugugggcauugggcaggccaggagggagagggugcaugaaguggcaaacacagugcagggacaguggcucaggagggagcuacaggcaggacuuggaaaggccaccaugcaaacagaaggacaaggaggagggauuagucuacauagcuguuucugagugaagcucacagaguuuguugcauuugugccugaaaagcuaaaaucccuaugacuuggaggacagggagaggcuccuagagcaggauuuccaggucuggaacuuuccaggccaccuguguuugucccaggguccucuagugcuguacucagccaauugggauuggauguuugcuuucccgaggaggauagaaugauugaaaauggaggguggggcuguccgggcccucagaaagggcacagucaggcccuuuggguaagaggagaguucacuugugcuuuuacuucauuagaccuucccuugaacaccugcgucucccagaccuagguccggaggcccagaaacaaaggccaauccaccagggucucccccugaggagaccaggguugcaggacacauuguccucaccacccagugcugugauacggguauggacaaaaugcuggaagggacugcugggaagaggaaugaauucuuccugagaguggcaugggaagggccuggguauggaugcaagagcuuugaaacugcuugacaucuggggagagccuugugggaugaguaaguaggcccuccccagagggcauggggaaaggugccagagaaaugcuacuuagcccaugcaucugugggaugcggaaauguauuuacguagcaccuucugguuagaagucugcugaaguugcuguuugaacuccuucucugcugccaguggcuccugacucccucacgcugccucaaaucacaaagugccugcuaauugaauucacagaggcagcggauugagggaugcgguggcagcagggagggugggagcugagcacccuguugggcucucccccuacccugagagauggcucugggccugagccuuuguugugguuucucuuucaaauagaaaagcccucuucuuuuaugugugaagaggaggcuuaaauaggccuggcugagcucagcaggccugcucuguccuccucugggugcuugcagaggugggcugccuuagugcuggggagagaacaagcugcuuccucccugccugccacaaugucuccuggggcugcccuggggacucuucugcaaggcccaaggcccuggcaggggugggucaucucuaggugauuccauccccuugauguccuucauccauuuuauggaaggaaaaaauaagacaugagaaagccaagggcacacauggaauuggucugauggcaggugggcccugcagagaguggguccccauguccugcuguggcucuucugucccuucugcuccuguaucccuguuuccccucuuccucaagucuuagcucuuuuuagugaguguguccugggacugccaggccagagguguaggagacacaccuauggcaauaaacgaagaccacccaaaugagaaaagcacaggcuauguauucggagcuugcuacagugaaggagucagccaccaucacuuguguguuggcagagacucaaaggcaggcagcagagugguagaguggaaaaaagggaagacuucagguacucucugauuguuggcacgggggaguucuaacuagaggcggagcauccucugugauugacaaggagggcauauuggcuuucuuuuguugguccuuaauuggaaguggggacaaaaaucaggaagcuguuaguuguuaauugagucccagccauuugggaccaguuguuauagggauuguuguuuagcuuccugaaugauugcuagagauagcagucugacuuccuacaaaucugacauauggcaggcuggcauccuggcugguuacuguagaucauggguugguuuccugggcaggcugcugcggguugugaguggaguucuguuuuuauauuuggccuggucauugccuguuuguauauucagucucucacaucccugcccgucaacucaauccagcagauucccacaagcauuggguucgguguggcugugggaaugcacgggugagugauaacagcagagcccaaauucacaaggugcucagcucucccggcuccaugcugagcauucucccuguaucaugucauuuaguccugauagcagccgugucauuuggaaaugauaagaaaacugagaacuggacguggccccggaggagccccucaucuugcugaucuugcaggggaggcagguuuaugagcagacaccaugucauaaugugaggggcggugcagcagacguuuguccacggucuguggguguccagguguuggaagucaguuuugcuuucaguaauuagggaaucagaaagccuccagaggaaauggcuuaaaauguggauuugacagauaaguaggaguuuaccagguaaauaagaaggaguuucuaaagcaucuuugggacagugaaaguuauguuugggaaauaacuagaaaaaugguagaagacugaguguuacagagcggagggaugguguguuguuagggacuggcuggaaggagucaucugccugggugggaauguuugggaagaguucugggagguugggaggggauaggcccuguggaaaaggcagagaagcauccuagcagggagaagcugugugaggccaggccaggaaggcacggaacaggcagggccuugaagccaagucauaagggagguugcgagcuccuucugcccuccaaagcgaugaguucccucaucucaagagccugggccugggccagggcagccggagcuggcugcuggggcugcugcagggcaggggagcggcuuugguuggucgggagcagcugugugugggcgcgggcgggcggacugggagguggguugcuccagucggccagccuggggccuccauggagacuugcugaccccaagacccugcaucuggagguaacacagccugguggaacugggccccagagggcuugugaguaguuggggagcauccagcaauguggaguugagaaguucccuggggcucguggcucauuuucucugauuuuucagcagcaccaggcuucuugccucuuucuguuuccccaaguguguguucuuuacacugucccugacagggagaugccagccagccauaaacuccgggaagaagugugguuuccuccucagagccaggcccucccaggggugaccucggagaugugcccagggugagcccacagggugcaugacaccuggggggagccugucugcagagggcuccuggcugcucacugggcugccccuuacccucaccacagggcucuccaggcagcagcuccuggugccugccagagaaaauggggcaauuuuccucauuaucucagcaauuaggacagucaggagggaggcaccaggcuuuaucuuuaccucuggcaaccgccuuggugccagagggggccacgccucagccuuggcuccucucugcacacuuuggggaguggucuuccugcuccaagggcccuacaugccuggugccugggggugggugugggcagagggcauggagaagcuagguuaaagcaacugaguucauccuaacaggccaggguggugaggacggggugggucccucuguuccucaggccaugccaucaaagcugcugcuguccacguguggucaggagucuuaggcgguauuugggggugggaagggggugugccagugaacaguguaugucagugccccacaggaguuacuauuuucuggaguucugggaagggaggagacggggaguguccccugggcacauuacauuuccaaacccggggagcaagggaaccguccucagaaaggcuguugggguguuggggucacagugugcuguuccuccccagcuuccuacuucacuucagcccacuggguuuacuuuuucuaauagcugauguuacuuaguggacaaaagagaaaagaagagggggcucaggaaugugcagggacagcagggcagacauggaagcuuugugcggucaaugggaugcuuagguuugguuguagcaugggaucaggcagaucuacucugucagaaacacauuuucuuuuuuuuuuuuuuaagauggagucucgcugugucacccaggguggagugcaguggcacuaucucugcucacugccaccuccaccuccccaguucaagcgauucuucugccucagccucccgaguagcugggauuacaggcacuugccaccacgccuggcuaauuuuuguauuuuuaguagagacaggauuuaaccauguuggucaggcuggucucaaacuccuggccucagaugauccacccaucauguccucccaaaguguugggauaauaggccugagccacagcacccggccagaaacacauuuucugguucuuucagugcaacccaccacuggaauaguggggucugggagaguccaucuccccugaguuaugcacaaggggcagaccccaauugcagaugaucaagaguuccuaccugguaccaaggcagugacaagguuguggccuucugcaucaguuuuugccaucaguccucaagggugccccaccccuggagcuaccuggaugaccucagugaagcaaaggccaaacuguuugugaccccugcauggcugcuucugggcagugggucagcccuuccuagcaguguuaaggaacccaagcaucaugggcuucagcauccuuaguagaaucccagagaugggaucacugaggucagagggcauuuugaggcucuacuacauauagcagaagaaccgcccagcagagaccaaccaaccuacagagcuacaaaaaauaaguuaaauucccuaugaaggggaguuggggcagccuggagauggauugcugcugcaccagcaggagagcaucgcuuccauccugggucuuaaccaccccuagaaaccagcagaccucaacagcccccuugcaccccccagcccagaauucuguacaguguguugggggaggaggguacaccuggaacaccaggaccguguggcucugagccucugguaccucuguccuccagagcccaagcuaacacuucuugcaacccuguaaggcagaagacugcaguuucccuucacuucccucuuccaggcucuaagugcagcucuccuuugcucccagcucugcgauucagauguuuccauaccugccucugcucuucuuacccauucccaagcaccucucuuguugcuguuuaugucucugccacaccugcagagcucuaagucuucauuugaaaaacguauccuauuuacuuauuuauuuuugauuaggcaguagaugcacacaaugugauauuuugaggauugaaaggauaguggggaaaaauaagucugcucuucuacuccuguccccagacauccaaguccguguccagagacaaccaccauuagcaguacuggagauauuccaugccuauguaaauauaaauauacuucauaauaguagcauuuauaauaugccaccaaggguagguacuguuguaagcaaacagagcauaaaguaacaaguaacuugcccaaguucacacagcaagaaaaaagagcuaccuuagucuuuucuuuugaaacaggucucccucugucacccaggcuggagugcaguggugcaaucucggcucacugcaaccucugccuccugggcucaagugaucuuuccaccuuagccucccgacuagcugggacuacggcacacaccaucaaaccuagcuaauuuuuuguauuguuuguagagacagggucuugccauguugcccaggcuagucuugaacuccuagacucaagugauccgccugucucagccucccaaaguguugggauuacaggcgugagccacugcaccuggccugccuuagucuuuuuauggaggcagaauguuuaguacuucauuuuagucuguuccagaccuuguuaaaagugcuuuuucugcccuuccccuuguccacccccaaggagugaguguggcaucuggaaaugcccucugaccccugugggcagcagcugucucugugugaagccuccucagcacugagcaugggcugguggaaggacacugcccaccugaccgucugacucugcccugcuggggaguccgugcagucagggacugugauugcucauugccgcagguucagagccgaggugcugauugagguuuggugagcagguauuuuuggaguuggcacauuccuucgagcauggguuguauaauuacugcaggccagccuugucuguccccuaauggaauuggcaagcuucucucucagcugggguuaaucuaaggccucugagucagccuuggcaauuguccaagauaaggaugguacaggaaguaauaagaggaacuuggggaagaagagguccauuuaacagacaccggaaaccacaguucaguagguuuaaucaauaaggaaaugucaugaugggggcugcucucaggcuggguacaacguugggaguggaauggagugggaucuuuuuccagagccccgguccauccugggagcccugguuguuccacucugaacccuggccuggugcaggaagaaucuuuggaaccccuaaugcagucuucugggaccagaagaucucagcccucucuguccagaagagggggcaguaagaccuugggcagauggccugggugcugugacuccagaggugagaagcaaagccagacguggcuguggcuguguugggcuggaagcccaacacacuggccgaucccguggcuggggcuuuggccacacuuuuauucuuccucugaacuggaaacaacagagaaaaccuuaaaugccugguuuggggccauauaagagauaaaaagaaagccaaggcaucagcagccuugcuggccccaguuggccuucguggccucaguuuccuuaucugagaaauggggaaacaucuacuccauagugauuuugugagguuggagauauugcuuauaaggugcccuguguaggguuuggugcaugcaagauucuugaugagugaugcuucugauacagugauggugaagacacuggggggcuuaguuguagacaagagaggucucuggccaaguagucaggaugaugguccagucauaggaaucucucuccacaaggaauuucagugagaacagaacuggagagauccccaaguccacgucuucacggauggggacccugaggcucagaagggagaaguggcuuuucugaccugccuccaggaagauguagggcgagaccucaguucaggguccccggguccccggucaggcucuuugccauggaagcaggugguguggucaccugcuucucagcuaaugcuaagaggcuguuuuuaacugguuguguauauauaccucaccuuaccgcacagaggauuuguggagcuugugacgcaggcagcuuggguagagcaguggaaaccacagugggagcagaagcaacucagagacccugcugggccguggcuucugagaagugaagcuggauggcugggaagaacuugcucucuugccggugccuccccaccccaucaggaugcaugccccauucugucuaauucaaggccuuucuguggaaugcuuccuucccauggagcucagauuuggcuaccuggagauuuacucuaacaauuuugguggaauuuggcacauacauugacauucauaaagcccuagggguuggacaagugggugacugacaggggugggacauccauccccaggaaccugcugucuuugcccucccuuggggagggggccuagaagcagcuccaugguuugguucccacucaaaaccuaccagguuuauuauaaacaacuuuauucuuauaaauuuggcaacuuagaagaaauggaccauguucuugagaaccacaaaccacuaaaacucagccaagaugaaacagacaaccugaagagaccuaugacuaucaaauaaguggaauucauaaauaaaaagaucccaaagaagaaaucuccaagcccaggugauugcauuggagaauucuaucaaacuuuuaaaaugagaauuaacaucaauuuuacacagccucuuccagaaaauagaagggaagggcauacuucccaauccaugcuaugaaguugauauuacucugauaucaaaugcagacaaagacaguauaaaaaaugugaaagaaaaagaaaauacagaccaauaucucccaagaacacagauggaaagauucucagcaaaauauuaccagucaaauucggcaauguauaagaagaauauaugacauguguaagugggauuuaucaguuauuccagguaugcaagucuggguccaacuuuagaaaucaaucaguguaaucuauuauaugaaaaggcuaggcugggcgagguggcucacgccuguaaucccagcacuuugggaggcugagguugguggauugccugagcucgggaguucgagaccagccugggcaacauggggaaaccccgucucuaguaaaauacaaaaaauuagcugggcauaguggcggcaugcaccuguaaucccagcuacucgggaggcugagacaggagaaucgcuugaacccgggaggcagaaguugcagugagccgagaucgugccacugcacuccagucugggggacagagccagacuccaucucgaaaaaaaaaaaaaaaaaggcaaaagaagaaucacacaaucauaucauuugacaaagaaaaagcauuugacaaacuccaacucucaguacacuagaaauacagggaaacuaccucaacuugguaaagagcaucuucaaaaauccuacagcuaacaucagacuugaugaugaaagccuuucccccaagcugggaacaaggcaaggauguccacucucauccuuaaaguucuaaccacugccauaaaacaacaagaagaagaagauagcuuuucccugggcuuuuugccgaacugguuuuuuucacucugaccucaaaugccuuccuagcgaucugaaauaaccuucuuuucuuguuuacuauuucucccugcacuugucuguaagcuuguuaagguugggaucuagucugucucauugccacgauuucccgcugucuagcagagccugcccugugguaggugcugaguaauauuuuuugaguaaguggagacuguguuggcaucauuggcucugacuggcuuccugcaauccaugugucacaguugcacugacccucucuuauuuucccuuuugauuccugcuaucauguuggcuuugaauuuuguuucugcaaagguuccauaauccaggaaccaagugucaugugucuucuaucucuaagagagucucgcucucacucuguugcccaggcuggagugcaguggcaggaucuuggcucacugcaaccuccgccucccggguucagguaauucuccugccucagccucccaaguagcugggauuacagcuguguacugccaugccuggcugauuuuuguauuuuuaguagagacagaguuucaccauguugugcaggcuggucuugaacuccuggccccaagugauccacccacuuuggccucccaaagugcugggauuacaggcaugagccacugcgccuggucuuguugaguguauuuaauuuucaaagauuacccuuuucugaccgggcaugguggcucaugccuguaauccuagcacuuuggaaggccgaggcggguguaucaccuguggucaggaguucgagacuagccuggccaacauggcaaaacccugucucucguaaaaauccagaaauuagcugggugugguggugggugccuauaaucccagcuucuugggaggcugaggcaggagaauugcuugaacccagggagcggagguugcagugagccaagaucacaccacugcacuccagccugggcgaaagagcaaaacuccaucucaaaaaaaaaacgccaaaaaacaaaaaacaaagauuacccuuuuuacauucaguuacaaggcugagcauauaguaggugcuuaguaaauaugugauuaggcugagcauauaguaggugcuuaguaaauaugugacuuguguagcucauccugccuuucacagcccucuuagcucaucaucacagccugcgauaaauaggcaggaaagaccuucucaugaggccaccuggagagaggaugggcccaaggacaccugaugaguuggaacauaaccagguccuuccugguucuccucuugucauucuuuggccacugaacaagcaaggauuuaaugguuauguauucugagaacagguauugaagggauuaggcguguaaaacuggaugaagugaggugccagcguggccugcuucucuuagggaggggacaaaugcagagcccaugagacaggacagugauggacgagaugaggagucaggcucuggacacggcuggcugggguucacauccugguuuggggguugggagaggaacgucacauaccuuggggagagguugggguuucugugaccuugggcaaguuauuucaccucuuuguaaauugaugguaauggguuagagaaaaaucacaaugaugauuacauguaaauccccagaacaagugccucgaauguaguagugcucuauuagcauaguaauaagcguuaguuaucauuauuacuuuuuuuuuuuuuuuagauagagucucacuuuguagcccaggcuggagugcaguggugcgaucucagcuacugcaaccucugccuccugggauucucgugccucggauucuugugccucagccucucaagaagcugggauuacaggcacgugccacccugccugacucauuuuuguauuuuuaauagagaugggguuucaccauguuggccaggcuggucucgaacucuugaucucaagugauccgucugccucagccucccaaacugcugggauuacaggcgugagccacugagccuggcugagaucuuuuuacucaguccacugauuuaacugcugauauccuccagaaaaccucacagaacauccagaaaucauguuugaccagcugucugggcaucccuuagccuacucaaguugauaaauaaaauuaaccaucacagcccccacauuagcuuccacggccgcaucggccaugacccccaagacugcagacaggggcaagcucccaacaggcucuuggaaaugucuccagggguagaugcuucuuauuuuucucagccacugugggaauacaauuagacucaugccugaguugguuugauaaaagcccauuuaaaaaaauucugaacaugucugccgggcgcgguggcucacgccuguaaucccagcacuuugggaggcugaggcgggcggaucaugaggucaggagaucgagaccauccuggcuaacauggugaaaccccgucucuacuaaaaauacaacaacaaaaaaauuagccaggcgugguggcgggugccuguagucccagcuacuugggaggcugagacaggagaauggcgugaacccaggaggcggagcuugcagugagccgagaucacaccacugcacuccagccugggugacagaggcuuauaauggugaucuggauagcagcguucugugguuuaagguguggcuauucaagaaccuggcugccaggggaagccuggguuugcgugaagcgagcacuggaccuguugauggaaccuuggguuccgacgucccugaagauggaaaaauggaaggcaguccaggcccccugcacugucugccuccugaggggagaagagucauuauuuaucacauauuuucugagugacacaaggugccugcaagaggcuggauguagggacaaagaugaaucagauguaguuccucccaagaaccccagugugcuggagcagggcauuugcaguggggcugguacccaggcgcgugcguguguguguguguguguguguguguguguguguguacacagaggcgcugggaagggggcaggggucaguuuucacuguagggauaccugggaggggcuguggggaccucagagcagcugcauuguggggcuguggaagagcaggcauggagcacugagggaggggcagggccagcugcaaaauugguggggcacagagagaaaugacuccagaaauuaggggucauuuuucuaaaaguuacauaggaagauuuucccuuucuuuuacagccucucucagcaugucauggugccuuucauuuacuauuucauguuguucuaaguaaggaaagaucaaaauugagcaugaauuuuaccauuuaucuuuauguuguggaaugccaguuuuaagugcaauuaugagagcauuaaaaucauguguagaaucaugaaauucauauuuuguggcuuauuuucucgggaggugccuggaguaggccagaaggacaaacucaaaccagacucagaaagguuggaaggcagaagggaggaaggacagacucagagggcccgggggccccguccacagugcagggcacccacgcaaccacccucaggccugacagcugcuagguuucugcccuuaccagaugcuggacugacugccuuccacccuggccuggggugaucugaggaagcugagccaggucuucccugccuaagaguccaccacccucagccuuggcaggcaggcaacuccaaggcucuuuaaaccuguucgucaggaccugcucagugccuagcucagggguggguaagaggcucacuccugcuaagccccaguggcccugggugagggugagggagagcuguugccugcgugcuccacccugagacacauggaacacaagccugauucugacccucccugccgagguggagggugcaguaucauugcagaacagggaugggagggggaggccaggcgggagagcaggccgcuauccugggaaggcaguaggagaucggaucaugugugagcucagacuccaugacccagcuccacugacaaaacucagauucaaggauaaaauuauuaagacuuucaagauggccauacaaggcauuccaccccaagugcggggcccuucugaucaugagaccucaugugaauacacuggccccaugcccacaaagccagcccugggagaagaacugggggacauucuucagguuacucagcauuucugggccucaguuucccucgggucagacaggguggggagagacucacuguaaggccacaccuggauggggacuggacagccccuggggccucaccucuaccucucccugucaugcugcuucaccuguguucacagacuuaauccucucacagcccuagagacaggcauuaugauguuagcuccuugcuacaggugagacgauguccuuucugcggggauuaaauaacguccuaaggaagaacagugaaaguaggggcacggcugguguguacccaagcauggggacuccaguuccuccucccaucagcccugggcugugcuccuccaccaccugcugcccuugcuuccugccccccagcucuccucccugcacagggcccugugggcgcccggcuucucucacuagauucagcuucagcccacacuauaucuggccccaucucuugguacugccucagccggguucccagcagagggacucccccggcccagcugccuucccacacaggucccugcacaggucgcuggccagcuuucagagcagcugcucucggagcaggaacccacccacauugggucagcugugguuggccaggggagaaggggcacaugacacugaaagaauguggcugccccugguggcuccuugagcagggagggccauggagagugguguccccuaaauggaguguggggagccccgagggggagaggccgcccauccugaccugccccgucagggcccggaguugaggcuuugucugagggaggagccagcaccuccugaccccucgcugaggcccaggcuucugcugggagagccuuccauuccaaagucagcagcaggcagccucagcuggagugacagguggcaggccccgggcagcgguaggagggugaccccuccucuagcacaaauaaacauggaaucagcccugugcggggcucccucuguggccuagggcuuccucugugccuuccuggcccaggcagggugagagccacagcgggcagucacuguggucucgggguggcccccuccucauccuguucucucuccuucccugcacguggcagagcuccaccuggaggggaacuuccuacaccgccuccccagcgaggucagugcccugcagcaccucaaggccauugaccugucccggaaccaguuccaggacuucccugagcagcuuaccgcccugccggcgcuggagaccaucaaccuggaggagaacgagaucguaggugagugggccuggcccaccuggcccugggcugcugcacgaggcgcucaugggccacaggacucuggagucgaccuucacaggugggaggagaagcuugggcuuucugucugagaugccugagcaaaggacauggggccugggaagguagacauuuugaggcccuguugccuaccgggugcugggugggacacuugcuuucccuggcagguagacggccuuggcuuucaccacagugcagcucugaacuagccaggccacuguaggccacaagcucucccucuccaguucucaccuaccagccuaggcggucucagacccuucggcucuggcccucuguguacuuuuuccucccugaguccccuggcuucacagagaccucuucacaggagugagcagggcccacuagacagccauguucagcacagccucucuaugccuuccagaacaaacacgcugcucccugucagcccagccugccagggcccucaccaccagggaaccaggggucugauaggugccuucugcaaacagcaaaccccaggagguuggguucugcugaggucaggaagcggucucuccuuccucuugcagcgauuaugugucuccugucucaucaggaccucagagagccgagccucaacuccagcuaguggucuaaccugcccagacaaccugggcacuggguggggucucugugugcccuccccuccgcagcacccuccuucaguggcucagccccaguucauccucucucacauggccucugauguggaaaugcuguucuaaugccaaugauguucauaauaacccccuucagucaugcuuucauuuucuuaagcccuuuuauagccauuaugccauuugauuaaaagcaacaugaggcaggccauuccccaucagaugaguccuagcaguuugggcccaucugauggggaauggccugccuccuguggugcgagugcccaucugucagcggugccacaggcaggacucugacccuggcugggugggaggugggaccagcugaccuuugagguucugagucuuuccuuggacagaugaaucaaacgaggcccaaacacaucaugagagugcaucggguugcacagugagacugccgcggugccaggauaggaauaugugauuccacaacagcccugugcccaggauagacgucucuugccuggccucugggaagccccugggggugggcugugguucagucuuaugcucccaagaccagaguccucaaacagcuugcaccuggauuggcuccugggucacuggggccucugaguauucucuaagcagaaggagccugcccagagcagaaggagccugcccagaagugccuuggccugcgcggcucucccucccgugcuguccugcuaaucccaggggcuugcuuuugagcccuuugcccccugcauuccuggccaggcccuucuugccuggguccuucgucucccgucucuguucauuguggccccucaagaugccuccacuuccuucugcugcucauccaaauggggcaguaacugagcaagaacagagcugggugugcagcggguagacaggugggucucaccagcgccagcuuuggcuuccccauauccuaacuguggccuuggaaggcucacagcagcucugugaaucucagcgcccucucaucuuucagaugaagcuuaucccccacccccagaaggugguucaagauaagaagguggcuuuugccagauaagggagcgggucgacugggugucuauguuggcugcaguccaagaagugacuugcaccgaagugggcagcaaggguggcccagaucuccugguccuuccccuucugaaaggcugacaauaucucuuagcaggcacagccacagagcaaagaucggcuguuuuggcuccucuugcauagacauaucucgcuuuucugcagaaugacaguaauaauuucaacauguggaagcaucuuacuucuuaccaagaauggucaugugcagucccacauccacagggugauggucuccccuugacacagguagaaacugaagcucuaagccuucauggccaagugccuaucacacaucuggccagguaagagagacaucagugacugggcuguguuucccaaucaguucagccugggacagagccccugcugccuggccucggccaggccuuggugauauggaaaugccaggggcuguugcuguccaggaggggcuccugguuuaccccaaguggccagcugcuccugaaagagcuugacugaucccagggccuuguccacugcaggaggccuugguuguucuuccccugcccccgagcuagagagagggggcauauggaggcagccacuguuuccuugcuggagucucucugcuucuauuuucuaucucucccugauccauccgaguuacuugaguggcuucucaacucccaaaccagcaggagagccaggucacagccuucauccccaggcuggagggaggugagaaugaaagggccugcuggaggaaggaggggcugcagugacagcgacgaagguagggcugcacagucuuccauuauggaaauaguucugcacucuucgcuacuuguagcugagcuccugcagcaccucacugggauaauuguagaaacuuaggaugccuucagaguggcuuauuuuuuccuuccagaaugcuuagagggugguggaaaaaauaaaacaagauuuuuaugggaaauaaauuugagaugcaugaguggccuuuaaagcuuuaguaaguggagaacaggcagcucugaaacaagacccaagugaaucagaaggacagccacccuaaagggaccuccccaaagcggccccaaccuggcgcuggaaagacggggaggcucucagcauccaggcagcugccaggaucaacucagucauccucuuguuuccgaauagagcugccacgugaucuuccuccacccucugagccauucucaggaagagaaggagggaggucugggaucucaacagggcauagaggcugagagggacaaggauacuucugucugcuuucugaugccaaccacugggaggugguaccugaccuuggugcucacugguagcuaaaugcccucacguuucaggucuguguggcacguggauggcuuuuguugccaccuugagcacacggcccuccagucuaugugugugacccuucucugcccuccaccuccaccagcaucgggcgugguguguggcauacagcagguacucagcugggugggagcauuauguagagcaggaauuccaaagccucgaagcuccucugaaauaagugagacaugauagggcagaguuuuucaaguugcguacuaugaaccugcuagugaauuguuaagucaagucaguggguugagaccagcaauuuuuuaaugcaguaaaauagaaaaugucagaguacaucaucacauauaaaaugguaauuacuauguuguaacuuuuaauuucaguuuuacuaugugcaugcacagaucuaucuaucuaucuaucuaucuaucuaucuaucuaucuaucuaucuaucuccugggacaugaugaaaaaugguauuucuuacucuuagucaugacgaaaaaauauugaaagccacucuuaugaguuguccugcagagauuugggggucuguucucagccaacucagucacccguccucccuagcucaugccccaaccacauuauacagccuuccuccucucaucccuccccuucaccugccccgcauggcccgugcucucagucuggaaguccuuucucaugucuuaccauuuucucugccuguggccaaauccccugagucugaaggucugggcccgguucaggugaaagggaagcagagugggucaaggggcuucucccuuucccagcugacucccuggcagacacacagcagcaggugucucccacccagaugagaggcuuccggggucuuggggacuggccugccaggacacaguuguuuacucuaggcacuccuaagagggagaaaaggguuuguagcuuauaauauuuguucagauaagagccauuuauaaguuucugggauaugagauaguuccuguauuuuucaaaucagaaagugguguauggaaguuuuaaaguauuuauaaauaagcccaccugggaaaugucauuucugaagaaggaggggcuacagagaugaaugagaugcgagucucaaccucaaguugcuuacagguauuagugucagcaaacacuagauggcuagauagcaccuggucacagguguaggggagggcagaugugccauggagagcuagagagaggacucucagugggaggguggcuguccucguguccuugugggaggguuucuaaggagguggaggcauguagucugacugagugaugacauagggacaugauggguuggagcagucagcuuguucaccccagcagccaacacacaugacuugaagguggaugcagcggcaguagggccucaccacgugcucaccgguacuuggugcugcuuagcaauucaauccuggaacaugugagggugaagacaaacgucacauauuagagagacuucauuuugccccguaggagacuauuauuucaguuaagcuggaauuuaacuuucuguaaccuucaguucucuguuucuuucuuuuuuuuuuuuuuuuucccuauacacccacugcuccagagagcacaagagauuagaggaaaacaagucuucauuaagaauuuaaguugggcaugguggcucacgccuguaauuccagcacuuuggcaggccgaggugggagaauugcuugagcccaggaguuugaggccagccuggacaacauggcaaaaccccaucucuacaaaaaguacaaaaauuagccgggugugguagugugaaccuguaguuccagcuacucgggaggcugaggugguagaucaauugagccugggagguugagguugcagugagcugugauugcaccacuguacuccagccugggccacagagugagacccugucucaaaaaacaaaaaacaaaaacaaacaaaaaauaauugauuaaauacaguaacaacacuuuuuuuuuuuucuuugagauggggucucgaucucucacacaggcuggagugcaguggcaugaucuuggcucacugcaaccucaacuucccaggcucaagugauccucccaccucagccucucaaguaccuggaaccacaggugcacaccaccaugcccggcuaauuuuuguauuuuugguagagauggguuuuugccauguugcccagacuggucucaaauuccuaagcucaagcgaucugcccgccucggccucccaaauugcugggauuacaggcgugagccacuguaccuggcuagcggcacuuuuaagaggaaaaguaucugugucauauaggaugcuuugggcugcauuuacuuaauucugcccuuguccuguuucaccuuacuaucccagccgauauuucucaaaguguggucccaggaccagcagcagcagcaucgcuagagaacggguuagaaaugcacauucccuggccuugcccuagaccuacaucagaaacucuugggagggggaagcagucugucguaauaccugccccugacccccggcuuucugauucacauucaugcugaagccugagaagcucugccugggcucucaauucucaaaguggcuucaauaggcuggcagcaugggcauuccggaaggcuguuagaaaugcagaaccuuagguuucacuucauaccuccugagucagaaucugcaccugagcaagaacccccagugauuuguuuguauaauaaguccucauuuaauaaggacugugccaacaucuggccugcugcccauccguuagacccaccaacccucaguagaauggggucagcaggaaguagggaaucuuggccgaaacaaauguuucuggacccaaagcucugccuccugccaggccagacaguggcauagugggaggcuucagaccucccagcuugccagggagggugccuugaccugccagugccagcugcccucagaacuuccucugggcucacgaggcagauugaaccauggucacaaaaggcuucucaguguccccugggacugacugccugucuucagccuggaugacacagagagggagacgccugacuggaccugggggcucacgccuguaaucccagcacuuuaugaggccaaggcaggaggaucgcuugaggcugggaguucaaaaccagccugagcaacauagugaggcccccaucucuacaaaaaauuuuuaaaaaaacauuagccaggcaugguggugcauaccuguagucccagcuacucaggagacugaagcaagaggaguacuugagcccaggaguucaaggcugcaaugaacuaugauugcaccacuguacuccagucugggugacagagggagaccuugucucaacaacagcaacaacaauuuaaaaaaaaaaagagagagggaaaaaagaaagggagacucccauggugaaaacagaagcagaagcagaagccagggcucccucuuacaccuccuucugcuucucuccugaugaccuguggcagcuccccugcaggguagagagccucugaaucaaacucugcucaauccugaccacuuuccacauucaagugggaggcagggacccucugggcuggcacaucuggaaggacaaugucaaaccuguggcacuucucuccugccccuggaucuggggcuccaagcccaucuggagggauguugauuuguucccucccugggcauggaguucggauugcccccugagcacagccagcuuuccagagucugacccuugcccugaccucuaugcgcugagugucacaagucccaugacaggaugacuugcccuccgaggugguagcuucuugccugcaugcccagcagcuucaugccuucugccccgcaugcccuugcuuggugucugcagagcucugaguugugcucaccaggcauugagcaguaggugcaggcaucgauuguguuagcaagcacuuaggagguggucauuagacaaacagugcaaggagcgcuugccagcugugcagccgcaccgagggagagguugggauuaaacaaacaggugucaacagcaauuaaugcaaauuaggcauggcccccagacacgagggugcaggaagcuccuguuugcagccccugccccacuuguguccaccugcagggaaguagcaagccacacacuuggucuuugcccaaauggcauucucugugccaaccacuguguggugaaaccuggaugaaccaaaaccuccaacuguccaggauacuguuggugcucugcugguagcacacaggccaacagcaagaaguucuuugacccuuguuuaaaacacaagaaaagggccgggcgcgguggcucacgccuguaaucccaggacuuugguaugcugagguagguggaucacuugaggucaggaguuugagucuggccuggccgauguggugaaaccccaucucuacuaaaaauacaaaaauuagccaggugugguggcaugcaccuguagucccagcuacucgggaggcugaggcgggaaaauugcuugaacccaggaagcggagguugcaguuagccaagauugcaccacugcacuccagccugggugacagagccagacuaugucucaaaagaaaaaaauaaauaaaauuaaauuaaaaaauaaaacgcaacaaaaggcuuccaggcuccauuuacugccacucuccacuacuaccugucccugucucuguccagagugcuggagagccgccugaugcccugaucuccaagcccagcuuugcaaggaugccuuauccaaggaauaaaaggcuuguggggauauggacauggguauguaaccauaauggguuuguugccugaugcacucggcaagucaguacgcugagacacuggguugcagcagagaaagagguuuaaucauagggucacugaacgaagacaugagaggauaccucaaaucuaucaccccaaggaauuuggaauuagaguuuuuaacaguuugggagugggcugaagcguggagaucacugauggguggaaaagagcagggugaggucaugggacagggagaggaagcagcugugcuuucaugcugacccugauccucugugggggggcgucuccaaacugguugcugaaauuggggaucugaaaaacaucuuaagcuauccuacagcaaaaguugaugauucuaauguuagcaauccugucuauaggaauaacgggguugugaaucaauuuguaaacagucuuuggacccuaaagucagaaauccuaucuacaggaacaacugggauacacaaggucaggaucuugugcugugugacuuucagcaacaaggaagugggccaaagugcagcccaauuaaugcuuaauuauaacucuauuucaguccauaauguggcaugcaauucuugucaacccucuggggacacuuuugaauuugggcauuugggaaauguuccuucauucaccaguugcuguuuuuaacuaagugauuuacuuugugcuggagcugagcugcaccaagcuggagacacaaauagaacaaacacacucccugcucucauggagcuccuggcauugucccgugcacuagugaccauuugcugcacacccagcucuucucuaagcacuuuucaaggaugcucuuguuuaauccucaugacaaccuuaugaggcagauacuguuauucuccucaggugaggaaaccgaggcacagggagauuaaauaacuuggccaaggucacuccaucugagccgggauuccaacccaaguagucuugcugcagaguccuagcuauucaggacagugcuuugcacgggagagauuuuugcccauagcucuagggggauagaaagccacaggaacauuauggcugaagugcauaauuuugguuggaaggaaaccucuuuguagaaagaacaguauaagguaaugaggcagguuucccuaggccagguaggcagucagccccgcuccugcuagcuccugucaacucugcaagucaggggaggguggcacccagaauggaaguacugugcaaaaguuuucaccagauucucucauuaaucuucaccgagaagaccagcgaugcucaaacuaucugugcauucaaaucauugggcaggcuuuuaaaacuccauguccugaccacacccuaugccaauuaaaucagagucucugauggugggauucgggcuucaugauuuuuuaaagcucucaauguaguugcccaaugguuucuucuugccugcugcccaggaaagcaaauucacugagaacagcagguuuugcagcaaagaaagaguuuaauaaucacaaggccagccaagccagaggaugggagagaauucucaagucaaccuucuugagaauuuagagguuagaauuuuucaaggauaguuugucaggcuagggaauggggaaugcugauugguuggguuggggauaaagucauaggggguugaagcugucuucuugcacugagucaguuccuggguugggggucacaagaucagcugagccaguuucuugguaugguuacugguugauaugguuuggcuguguccccacccaaaucucaucuugaauuguagcucccauaauucccauguguugugggagggacccagugggagauaauugaaucaugggggugguuucccccauaccuuucucgugguaaugaauaagucucacgagaucugaugguuuuauaaaggguuuccccuuucaccuggcucucauucugucuugccugcuaccauguaagacaugccuuucaccuucugccaugauugugaguccauuaaaccucuuuuucuuuauaaguuacccagccucugguaugucuuuaucagcagccuaaaaauggacuaauauaccgguccagguggugccagcugguuuaucagaaugcagagucugaaagauaccugaaagauaccucaaacaccaaucauacguuuuacaguugugauguuaucuguaggagcaguuggggagguuaggaaucuugugaucccuggcuacaugacuuccaaagcauaauucuaaccuuguggcuaacuuguuaguuuuacaaagguggucccugagcaaggagggaauuaguuuugggaaggggcugguauugucuuuguuuuaagguugaaguauaaacaaauuccucccauaguuagcuuggcuuaugcucaagaaucaucaaggacagcuugugaggcuagaagcaagauggagucagcuaugucagauuucucugccugucauaacuuuugcagaggcaguuuuauccagaugauuccagugugcaaacuagauagaaccacugagcuaggccagaacuucugaggaacccuucugccccaggugugcaccaccaauucugaggcagggaacacaggcacaugagaggggacagcaaaauugucauucuuuccugaggcucuucccagagcaccuuaaccaaagcagaggaacuaagagaggccugagagcagccugugggaaggcauaggccuuccaguggccggagugcagaaggaaggaggagggugcagagggcggggaggauaaaugucaggcaugggcccagccguuucagcugcuuauuuggcugucuccagaguggccaguaagaagacugagucauuuuugcaaagaauuguuaugaucuggcuuugauugcaugucagauaugcgugcaggggacucuuuggagggaaaggcugugguggguggcccccucaaugcccauuagcccacccuugcuggccaaccuggggcacagaggaggaaugaaagccaaagguuuuucuccuuugcuuuucuuucccugcagcucauacuuaaggacagaaaaaugucucuagguuuauugguagauucuuaaaacaucccgugcuucccauccuauugaugggggugcccgccauacuuccugcaccucacuagcccccuccucccuggagagcaccgauggucccaccccacagaucaugagguggaaggacggucuuaaagaugaaagguugugguucagagaugugaaggggcuugccugagggugcacagcuuuaaauggcagugccaaaauuagggucugugucccuggcccuguucacccugccaaauggcccaucgucagcaggagacucagaacuccaguccacccagcuuuuucugcaggcuagaacucagccugcaggauugucaaggcugugcagugugcuccuggcucucugagggcuggagcuguucuauuuccauuugcuucugccccaccucugccaggaugcccaguccaggaccauguggcaguagggaaggcucagccccuguccccgccugacuccacccagaagggugugguggaguggucugagagauguguguguguggcuccggagccuucuuguugcagcaugacccccugucccugccagguuaccacagucugcuugcuugucucuuguggcauuuugagaggggguaugcagcuuagcgcagcacagcaaggcguccuugaucuugguuguuuuuguguccaggcaccagagcugccuugaggcugagaugugggccuagggcuggccuggauucucuagcaaugcuggaaucagaggccagcuagcaauucugguuaccucuaugcuaggugcucaccucccuugacacuuccccagguccugaccccuccuucucacagggucccacugugggcaccacacuggaccaggaaagcauucuggagccaucguuuguaaucauccugcuucucagccgguuccacugauguaaaacaaguuuaccugucaauauugcuaacaauuagugagacgggggcaagcugaccucagggaaguaauuuuguguaaacacugcccacucugcuucuacuauuauugauuacucuaaacuucccacagacauaggugggaguccaggguggcugucuacagugggaggagggccagccagugcauaguuuaauucugcuugagguuuuugccuugccauaggccacugaguccuugacuuuaguccucaccuaagacaugaggccuugcaacagaagcccacacacuugagggccaugggaaaguuaaagggacauuccucuggcuucauaaaaggauucuagaaccucacauccuacauucuacagucauaggcucaaagagauagaaguaaccccagaaugcccuguagacucaaagccucucauuaucuggaauaguggaauguuggaggccgagugcaguggcucaugccuguaaucccagcacuuugggaggccgaggcagguggaucacuugaggucaggaguucgagaccagccuggccaauauggugaaaucccaucucuacuaaaaaugcaaaaauuagcugggugugguggugugcaccuguaaucccagggaggcugaggcaggagaaucacuugaacccaggagguggagguugcagugagcugagaucgcgccauugcaccccagccugggcaacagagcaagacucugucucaaaaaaaaaaaaaaaaaaaaaaaauggaauguugaaaacaaccuggauguccaacaacaagaacaggagucaaagugguacauccaucccauggauuaugaugcagccauagaaagucaccaauuuguaaccugaaaagauauuuacagcauaucaugaagaacagcaugucauagcaugcuaucugggaggccauuuggaaauacguagguaugugaguguauauacacacauacacaaacacauuaaacaguggggaaggccauauaccaagacauuaauagugauucauucuaggugaugggacgugaugauuuuacuuuuguucaucaauaucuuugcauuuucuaaauuagauuacuagugucaaaggggaagacuaggauacgugucuuaucauagcguugguccacagaggccuggcccugacuggcaaaugugcacagaaugggugaggccagggaaugggccccaacucuugaguguagcuguagucacagaguugauuaagcagcauugauggcgauucugcuguuugcccagcucaggguggucucagccugaagggacucauggucuaguucaaaagguuagacauucauucauccaacagauauggagcacccgugagcacugugcuuugugucacauuuacaggagugaacagacauauucacagguugcagggcauggugcaugauacgaguguguauaaagaaaauguucagagaguuuggagggggaugcaggggaguggcaaaggaagccgcccuugagcugggauuugaggagcagcaggacguggugaguggugaugggagcauggcccaugguauugaaggcaaagcggaggucccuuuccucuccacaacaaaguccagagaccacugggcugucuagccucaggacauuuauuuaaccucuccaagccucaguuuccccauccacaaaaugcaggucauuucauauucuccucugcagccuccagcuaucucccucucuugucaggaugcugugagcauaaaugaucuuucagcuuuauccagaaacucccaguugccuucuugggcuugucacuugcgaguuugacugcucugauguguugguucugccagcuuuggcauguuugauggucccaucgcuccuuccucuaagcugcucaaaugacuuuugcgguuaaauuaggggaaagagcuauaccuaaucccugcucugugccugugaaagcuauuacuggccuucaguagggugguucagagaaugccacagacccuggagaggccagcucuguggcagacguggaaacagcaagccgagaccccggcagugccgcucccacuaggccuggagucguggggauguguuccggggcugggcugcagugggucuuccugccaugcccagcaagccuguggcagcagcaugacagggggacccccccauccucagaaguacuagccacugugugggccacuggccuucccaggugagggacagaggagacacgggaguccagaguagggaggguccuuagcaagcuccuguucagccuccucuggagaaacuggggaaggaucaguggucuucaguagcggauggggagaaggggugacagcagcucugagccaccauuucucaagugggaauaucuugacaacugagguugugaucucuuagcccgggcuucaguccuuacugaaucgcucagugaaacuugccugucauuguuaucuucugggggccgggggccagugcaaggagaccagguucuggccuuggccuugccccucugcguuguguguugaaguguaugggcucugggaucaggaacuguccugccuccaccacuuacuggcguggcaaccuugggcaucaagaaacugagaaucaaguuuucuuaccugagaaaugggucauugugaggaacugucuagcauagggccucaaacaucaguucccagaagcagccugcuuugcugggcccauuuagacaaaggugcuacaccuccuugcgccuugauuuccuccuguguccaauggaguuugaugccccaugaaauaaaagccaagugcgaggggucuuucuuacucugggugaucaggggcagaggggauggcaucuguaccccugcccacgcugcuggcugugccgcuggggaauggcugcaacagaacuccugaauaugaagaugugcaagaguccaaggaauuagcccuuuucuucccagccauuauuaauagggaaaaugggggcccugcuugaaagaagagacucaagaacuaccauaggcagcaccuuucuuuagcccccacacccagcaagaggcugggacgagcgaggccaggcugcuggcagcugugugguaugacauuuguacccacaugagcuccagagaaagcgaaggaggugagugggcacuccuagcacuuguucuuucuuuuccucuucuccgaggagucacgucugcuuauaacccugccuucugaaaacagccugucucugcgucuuuuccugucugagccuccauuugccauggacuccuggccucucccaccccuccuugcuggcucgcucgccugucacaugguuccugcuccaggcaggugaugaccagccccucccugccacaccccccaaccccggcugcccuauagccagucuucuuauuggggacacagcuccuggaguaagcaauuccugugucccccagcauucaaggccguggacugggccccuggucucauacgcagagccugccuucagggaacugagaggccaggucaccccagagucuaaggguaggcaagcuccucccguuagggaaccuggcugccaguuuacggggcccggggacuccugcauagcgcuucucuguggucaagagucuucuccgucucggugucagccuugcuacccacuggcugggugaccccaggcaaaauuacuuccucccacugagccuggguuuucgcaacuuucaggacccuccuaccuccuguggucucucugccaugaucuguacagcuucuugucaauggccuaugaauaucaguauguccaggaacuuucuuguuggugcucucagcggaggccaaaucuggggcuuuggccuucuaugagugguggugaggggcuccgggagccauagugcuuuuaggagacaucugaggcucaacccuuguuccuuucuaugugagccgacaucuggguuaucuggguggugaacucaggcugagacucugcuggccaaacucugugggcuuauccccaggcaucugggcugcugcucagcggaugcaggccccagaccagugacagggagcagggaaccugcacuagcuggacacauguugcuggagcacugugcuguuguacugcaugcaggcaucuugucgacuucugggaccucccugcaaggugagcaguaugacuccauuuuacagaugagaaagcucaggugcagggauccugccugaggcaccacagucacuggaaagccgggcguauccuucugacuccagagcuuguuuaucuuaauaaccacuacccacccacucucaacuaucaugugaagcgaaggaucugggggccuuugccuaaauaagguggugguguuuucuaagcuccaggcuucagcagugucauggacaagaagggauagauuuguucuaugcugugacccacagcagaacaaggaggccuggaagauucuagaagcaauuugagaacaucuccaggaagcucuuucucucaggacgggucagcagccucuuugaaagccuuuguugggggugcaggauaggaagcuccugggagauucaacaggaauucuagagagcaguuaguggagguauauacacauauucauugacagagcaaucagucuugcuccugggcauauauccaaagacuuucccacauuggcuccuaaggacagauagaggccacuugggugucauugcuggcagaguagagagguacaguguggugggugcacagcaugguauacuaagcagcagucaaaagcagauggauucgauguacacaguccucguggauggaauguaaaacacggcuuagucagucacacuuacuauugggcacuaauacucuuccccauugaaaggaaccaggacuucuuggagaaguggcugauuccagggcugggaacagggaaggcucaagacgugucuuccuagaaauucaggcagugcauccaaaaagugcuggagccaugucaaaagauacaggagccaggccaaaggggcucccaguggucaaaucuggacaauuugagcaucagaauaaugaaguccaauaaugaauuguaaaucacuagaaacauaggagucuauauugauaauagauacauggaagagaaguagaauacugaggacuguugacauuaggaaaucauuuugcagccaucauaaagaucaggucagguaagaaucuuuaguggaugcuaagucuaagggugaugaaugcuaaauguuggugagaaccaacauuuaggauauuugcacgcucuuaagauguguccccacagacuucuuguuagaugcaagggagaaaaaaaacacacaauaguaauuauauaguggagaaagcaaguuacacauugaucaagugaucaaaaguaacaauagaaaugaauuuggugugccucugaugugauaccccaggaaggacaugcaccugugcagucuucagcugaggaugcgaagucucgguugaaucgugaagaaacaccagacaaacacaaaaugaggaacuuuuaaaaagggaagggggcagugcacuacuccuccaauaucaaugucauaaaagacaaaggggcccaaagaguuagaaguaaaugcaauccuugauuccagacuggcucugguacuagagggggaagugcuguacaggauguuagggcaccugaccacacugaacugugggccauggguuagauacacauucuaucaaugugaauaccuggaacccuuaacugcacugugguuauguaagagaaugucccaauuccuaggaaauauacacugagggccaugacguauguaugguacacucaaaugauucagaaaaaaagcguguguguguguggggugggggagagagagagagagagagagagagacagaaaaugcaugcacaaaugauagagcaaauaggauaaaaugauaacaauuggcgaaucuaggucgggcgcaguggcucacgccuuggaaucccagcacuuugggaggcagaggugggcagaucacaaggucaggagauugagaccauccuggcuaacacggugaaaucccgucucuacuaaaaauauaaaaaauuagccgggcgugguggcgggcaccuguagucccagcuacuugggaggcugaggcaggagaauggcgugaacccgggaggcggagcuugcagugagccgagaucacgccacugcacuccagccugggugacagagcgagacuccaucucaaaaaaaaaaaaaaauuggcaaaucuagcuaauggucaucugguauuuuugcuaguuuuuauuuuuaguuuugcaacauuuuauacauuugaaauuauuuccaaaggaaaaaaggaggggggaagagacuuaagacaauaauauucaacuuuucugaguaaaaaaauuuaagacuucugaaacugaaaguccuaaagacauuugaauaaaaacguggcccaugcuaugugguuccauuuauaugaaguucaggaauagacuaaauuaaugaugaagaagaucagaggguauaaacuggaaaggggcacaagggaacccuuuuggggguucuugaaauguuuucuauuuuuaucugggugggggucucauacaucuggguauacaucacauauauacccagaagaauggaaagcagggucucgaagagauauuggcgcacucauguucuuagcagcauuguucaucauagccaagcgaugggaacaacccaagugaccauggacaggugaaccucaagguucauucacguuaugacaugggucugaaguuucuuccuuuuuauuauuuauuuauuuagauagaguuucgcucuuguugcccaggcuggagugcaguggugugaucucggcucacugcaaccuccaccucccagguucaagagauucuccugccucagccucccaaguagcugggauuacaggcaugugccaccacacccggcuaauuuuuuguauuuaguagagacaggguuucacuguguuggucaggcuggucucgaacuccugaccucaggugauccaccugccuucgccucccaaagugcugggauuaccggugugagccaccguggcuggcauuucuuccuuuuuaaggcugaauaauccugcauuaucaaugccacgugccauaauguggaugagccuugaggacauuaugcucaguggcauaagcccgucacaaaaaggcaaauacuauaugaguccacuuauaugagguaccuagaguagucaaauucauggugguugccaggugcugggaggagggagggauggggaguuuuuguuuaaauggguauagaguuucaguuuugcaagaucgaguucuggagauugguuguaaaacaaugugaauguguccaugcugcugaacuguacaccuaaaaaugguuaguaugguaaauuuauuuguauuuuaccacaauuaaaaauuaaaaauaauauuuaaaaaagauuguuauuggugcuuaguaaaauauauauauauauauauauauauauauauauauauaaagaaguggccugauaucuauauagcacaguaccauuugccuaaaguaaaauauguguauaauauccauuaguguguucuaaaauuaaacacaaaacaaccacaaaaacaaaaagcccccaaccgugggcaauauuuugugccuaggagaggacaggagcuggcucuugccaucacuaucggccugagguugugucggacugcaugggaugaggucuggccccguccugugcuagggugggagguuuucugggauccggcugcucacggaauuggaucggggaagagcggaugcagccagagccucagcuugcacagggcacgcgucgagggcaagcguccuaguguugucugagugauccuaaagguuaggugggaggaacuauaacagguuaccaaguguuaguauagcugcugccuuauucugguccuuuaaaaaaaaaacugaggcgaaauucacauaacauaaaauuaaccacuuaaauuaaccacauaaaguguauaauucauuggcauugaggacauucacaguguugugcaaucaucaccucuaucuaauuccaaaauacuucugucaccccaaaggaguccccauauccuuuaagcaguugcuccccaauuuaauucuguuugaggaaauauuaguuauguccauuuucaagauuaggaaaacaagguacgggaaguaauacaaauuuuuaggugguaaagcuggggcaucagcuuagggcugucuuaaauuucaugucuaugacacuaggcugugcugcgucuucaguuauaacugagaauauuggaccuggaauuaauuauagaucacuacuaucuuuauauuuauuacacuguggcauuuuugaugaguguuggaaaaugcccuaguaucuuauguaaguuagguggaugacagcuugaaacuugauuuccaaauucuacacguuaaauuuuggaaacuagagcugggacaggagauauguuuguuuugauuccagaggacauuccaucucuaagugaugauccagcauagugaugauccaauauagucuggaacuucccagauagcucuuauggagcagugauauagguagggcacauuaucaggaguccugauaaauucaaacuguaacuaaccucccuuagauagacccaagauagucaugucugcuucuuuagggacucuuuagggguaugauggagcagauggcaugauagaguggcauucccauaguuaagaagaauuuccauaggccacuguaugcgacuuccucucucuuggcaaaaauauucuuuaugcacauaauagucuuuguuuuuuaauaguuuuauugacacauacuauacaauucacccauuuaauauaugcaauucggugguuuuggcauauuacauuauuuuuuaauugugauaaaauauauauaacaaaaugugccauuuuaaccuuuuuuuuuucuuuuaagaaauagagggccgggcgcaguggcucacgccuguaaucccagcacuuugggaggccgagacgggcggaucacgaggucaggagaucgagaccauccuggcuaacacggugaaaccccgucucuacuaaaaauacaaaaaauuagcugggcaugguggcgcgcgccuguagucccagcuacacgggaggcugaggcaggagaauggcgugaaccugggaggcggagcuugcagugagucgagaucgcgccacugcacuccagccugggcgacagagcgaaacuccgucucaaaaaaaaaaaaaaagaaauagagacuggggucucacuauguugcccauccugacuuugaacuccugggcucaagagauucuccugccucagccuccugacuagcugagacuauagccuggcugauuuuaaccauuuuuaagcauacuguagcucaguggcauuaauuacuuucaccauguugcgcaaccaucaccgcuaucuauuuccaaaauauuuucaucacuccaacagaaacuguagcuauuaagcaauaaaucccuacuuccccuucuccuagccccugggaaccucuguucuacuuucuguuucuaugaauucaacuacucuauguaccucacauaaguggagucauacgguauuugucuuuuugugccugccuucuuucuuuagcacaauauuuucucuuuuuuuuuugagacagagcuuugcuuugucgcccaggcuggagugcaguggugcgauuuccccucacugcaaccuccgccucguggguucaagcaauucucugccacagccucccaaguagcugggauuacaagcacccaccaccaugcccggcuaauguuuuuguauuuuuaguagagaugggguuucaccagcuuggccaggcaggucuugaaauccugaccucgugauccacccgccucacccucccaaagugcugggauuacaggcgugagccaccacgacuggccuagcacaauguuuucaagguucauucauguuguaaccuguaucggaauugcguuccuuuaaaaggcuacauaguauuccauauaucauauauauauggacauauauauggacaacauaguauauaucauauuguuuauccauucaucuauugguggacauuugacuauuauaaauagugcugcuaugaacauuuguguaaaauuauuuguuugaaugccuguuuuuaauucuuucaguucuaccuaggaguaaaauugcuggguuguauggcaauccuacguuuaacuuuuugaagcaguugauucuuauuuuuaaggaugcuuuccuccaugugguuguuauauccuggugggcccgauggcccuuugcacagggcugggcaccaggagcugagcccacgugcagugggcaauggagagcugccccucaccaucaggugcucagaguccucauggcccauuguccuucuuuucugucugguuggccuccaccacucuaaccuguccauucuguccccaauagaugugcccguggagaagcuggccgccaugccagccuugcgcagcaucaaccuccgcuucaacccacucaacgccgaggugcgcgugaucgccccgccgcucaucaaguuugacaugcucaugucuccggaaggcgcaagagccccccuaccuuaggccacccuccucaugcccacccagcaaggggcagaggccacaggccuggaacccuggaagggagggaggcccaugggaggccaagccugggggcugggggcgggugggccgagcagcacgugguggguggggugcagcuggucuggauagauagcuuacagcaguagugggcucuggaaugcccaagggaagaggcaagguggggccugcagccuggacucggcacucacagcugcugugcaaacucaggcagaucuccugcccucucugagccuugucacuugaaaaaaacaggacccuuucccuccuuugggcucccuggagguuuuuaagcaguacgugccuccaaguuaccuccagaucagcaggcacaggugggcauugccagguauuuucugagccccugcggguuugaggccuuguuuuuagugcugagagccaguugcugcccugagaagagaagacaaccuccaucuauuuauugcuuccugagaacugaccuggaugcggcccucugcagggcccagucuucaguccuguggucccuggacuggugggaaccugaacuaggaguccugggagagcuguggugggaauaugggcuggcacugcugcagggcaagaacauucauguaggagcccgaggaccagcaggcugggaauggggagcaagucacgucagcucugucauuccccacaguuaacaaauuggcggggugggaaguccugagugcuccgucccucuagcaucacuccugagcugcgggagagguggcccagagaacagcagagucaguuacaccugcagcucuugucuaaagugauuagauggccacccucaccacuguccaguccagcagcagccuggcugccuugucauggccuccugggggcagaaggcgauguggaccacgggauuuguagccagccagcucccaggccaacgcccaaagcccugaugaccugguucuucugaggcccucaaccuggcaucuuaggguauggucaggcaacagggugaccagcuguccugguuucccaggacauggaacuuucaaugcuaaaacugggacaguacccagcaaguggggaugguugguccccuaccaggagagggccuggggcucuugcuucccgagaacgccuguggcuugaagaaccuugacugcuugguccucagguaucuaccucccaccuucuccucaucuguggagcaagccaacucagugccccagaccccaccugaucugcaucuuuguuugcaucuccagagacaccugaggccccagagcuugaggcaaagccaggccguccaaauccugugugccguggacgaguggccacuuuacuacuccuaaggcuaagauguugagagcucagaccacugcucagagcaguaaucccugcucagaaugcucccaguucccucgucccugcccaggucucuugucucuugggaaggaacugauaggucgggccauuguugggccaucacugagcgcucaguaucucaagagacucuguucauucugcucguaucccaaggccugguuggucaaacucugggcaaaggguuuucaggaugaggaggucaagacaggaucuccagagcuaccgaguucaucuguggguguugggggcaagugggggcugaaguccugugcaggcugcgcuggccccaccugccuugugcccuggagugggguuucuccuuguugaagaagaggcauccuucucugaugugcacaaacacaauguaugaccagagccuugcaacucaaaguguggucuguggaccagcagcggcagugacaccugggagcuuguuaggaaugcagagucuaggccucacccuauaccucccgacucagacccugcauuuuagcaagacccccagcugauuccuauaagcacuuuagaguuugagaagcaaggaccuaggcuggggauguccuccgagcagagggugaaguuucucucaguucucucccugccacuuccagggaucugagccugugcucagccuccucccuaacccacccugggagacacuuggccuguuagauuguuccagagucugcauggcacuccugaagaagggagugugaccugcagucaccaggagaugaggguuaggugugcccagcccuccagacccggccuuucugguuaaccccugcaugccaagcugccugcugccccagguccucaccucaggccuuugaaggggcagcuucuggaaguuguuuucuccucugcuuggagaguuugcccuugucugucuuggaaagugugggcagccacagaugcccccaaaucagagcucacagugagugagccccuaagcuucagucugcaauaaagaaugcauugguuucauc

SEQ ID NO: 192143 - RNA, 28263 nt, Homo sapiens
auuccacagcggccgcaacgugucgagagccguaaguaaagugucgcaaagcagaaggaaggcgggagucccgacugcaaacauugaggaaagccaggcaguagaggccgcuauggcgaacguuccgugggcagaggucugcgagaaauuccaggcggcgcucgcucugucgcggguggaacugcauaaaaauccggagaaggaaccauacaaguccaaauacagcgcccgggcgcuacuggaagaggucaaggcgcugcucggcccugcgccugaggacgaggaugagcggccugaggccgaggacggcccgggugccggugaccacgcccuggggcugccggcugaggugguggagcccgaggggcccgucgcccagcgagcggugaggcuggcagucaucgaguuccaccucggggugaaccacaucgacacggaggagcugucggcgggggaggagcaccuggugaaaugccugcggcugcugcgcagguaccggcucucgcacgacugcaucucucucugcauccaggcgcaggugagagcgagcccggccaggccggccccuguuggcaaauggcgagggauggggaggagccccugccaaggccaagggcagacguuguaaggcgcaauucguccccacguuuuuguagcucuggacugagucccaaagagcgucuguggucuucaaaaaagccagucuuauggacuuauugccuuguaacuagaucucccacagucggccguccccagacuccguguccacccucgucgcccacaccaauaucgcuugcugcugcuucacuuagacguggcgaugcauugguguccgagacccuccuacaucgucaugcgcuuuccucuccaccaguccaacuccuguucauucuguuaagaaaauccaaaguaauuuaaaucuuaacgucucaaggaaaugacaaugaccggaguacauucuuuuuugguuuugucuuguuuuuguuuuuuucuuagagauggggucucacugugucgcccagguucgaguuaaguggcaccaucauagcucauugcagcuuccaccucuugggcucaagcaguccuccugccucagccuucauaguagcuggaaccacaggcgcaugccaccauucuugguaauuuuuuuaauuuucuguagagaugggggucucacuauauugcccaggcuggucuugaacuccuggacucaagugauccuucuggcucaccuucucaaagugcugggauuacaggccugagccgcugugccuggcucggaauacauucuuaauucaaaauaaaauguccaaaaucugcagcuuccuuucuuaccaaauucauuuguuugcaucuuagggaauucuuccccauucuugaaaaccuaucucaagaaucacuuccuuuaguauuaauaacuuucuugggaccauuuugggccaaacugaucucucccuccuaccuuugaauucuuauaauacuuuuuguuucccauuuauaugguacuugguuucuuaaauaaaucugggcagggcacaguggcucccaucuguaaucccagcauuuugggaggccgaagugggaggauggcgugaggucaguaguucaagaccagccugggcaacaaagugagacucugucucuuaaacaaaacaaaacaaaacaaaaaacccacaaaacuagccaggcauggugguacacgccuguagucuuagcuacuggggaggcuagguugagcugggaggaucacuugagccccuggaggagccaugaucaugccacugcaacugcagucugggugacagagcaagaccuuuucucaacaacaacaaaauccacaucaauauucuaaaguaauauuggucaacaccugugaaaagaaggggugaaaaaaagaaaaauacuuuaaaaaguuaaaauaauauugggacaggugaacauggauguuuaucacagcaguguugauuauuaaagaaggaaaaucgcagggcugaggcaggaggaucgcuugagcccaggaggucaaggcugcagugagccaagauuguaucacugcacuccagccugugcaacagagugagacccugucucaaaaagcaaagaaaaggaaaacaauauaaaugucaguaggaauaugauuaaauuccguuacauccaaacagaagaacaguacacaauuauuaaaaauaauaauuuauauuaacaaaaauuggcaauaugaagagggaggaagaagacuauaagccauauuuagaauuauguagaaaaggccggaugugguggcucacacuuguaauccuagcacuuugggaggcugggaugagaugaucacucgagcuuaggaguucaagaccaaccugggcacauagugacaccucaucgcuacuaaaaauaagaaaaaaaaauuauuccaggcauggcugcuuugcuaggcaguauguucuuugggcagccaucggggccccaaccaccaccggggcucuggggccaggcuuccuuuacuuaccagcagcuccagggccucugagaccuucuaacaguacuuugguggaugacauggagucaucuuuccagacuugcuuugccucuccguuaagucaggacuaugucaauggcagcaaucaggaagaaauuggaacugguguugaucgguguauacacaaguuucuggauauugcaagacagaauauuucuuuccuacaaaaaagauugcaauuaucuguccagaaaccagagcaaguuaucaaugaggaugucgaugucuccgaacuaagaaaugaauaacauuggagacaugcacugguccagaagcacuugacaaagcuaaggcauuggcagcaagugcuggaggucaucacgugcaguacaaaaagcuagcugacauccaucaaggcuccuuggucuaccuugagcaggcauucaauaucccugcacuucugaagugcaccugagcaaaaggguaaaggcugugggccugagagugggcuggugugggagagccccaugcagaugguuugccacacaucccuucuuguagacuuggcauuuuggaagaacucuuugacagagaaugaguugauuuuaguuuuaugcucccaccuaaaauuuuuucacuauuuuuauaagauguuaauuucuugaguacuuuauuuauaacaugccuguaccuuggguaaaccaaguaaacuuuuuuuugucuuaggcaaaguuuagacuguucguaugaugauacacuuucuuuuuuauguggguuuuuuuuuuugcuuguuuuuuauuuuuauuuuuauuuuugagacagaaucuuccucuguugcccaggcuacauagcaguggcaccuucacagcucauugcaacuuccacccuccuggcuuaagcgauccuuccaccucagccucccaaauagcugggaccacaggugccugccaccaugcccagcuaauuuuuguauuuuuagagagacgguguuucaccauguugcucgggcuggucucgaacuacugagcucaggcaauucuacccaccccagccucccaaaguguugggauuaccaguauaagccacugugucuggccuuuuaaaaauuuuugcaugacuuuucaucuuuuuauguguguuucccauuuguuugauaugagggaaaaauuucuaauagcuugagaaucaaggggauggggauuuugguuguaggcauuuuauaauaauuaaccccuuagcagugguguagaaaaauagguaaauuuuuuguuucaagacuuaaaacuaccucaagaagaacaaucuaauguaacaguauuuguaacgcuuccagaggucucagaugaggaauuuuuuuguaaaugguuuggaagaagauuaaaauauccuggguuagcguaguaacauuacgguaggauccuuagguugaugcugacuuuuguuugggguaaguuuauauuuugugugguguuuauuuacuuuuuuugaagaggaggauguaguaggagcaguguuacaaaucaguuuaaguaauggaguagacccuguugucaguggggcauagaugaguuaugagggcuaaagcuugcucugauggucucuuuuuguuuuguuuucuuugcuuuuaucuuuuguuuuacauuuggggaggggagagauuuuccauuaaggaagguuauugcuaguggauuugauuccaagggucuggggugucacaguaggguuggggaggggcugcagggugauccuuggcuacugaaccuccacagagagcauguggugccccugcccuuucaagauaauuuacucucuuguuaguuuugcaggccaccucagauucucuguugaauugcuguuaagaaauacagaccaguguuguuucugggcucucguugggugagguuuuccugaguuuuaugucucuucuuaguucacaucguguuacccagaacacaugcuucacugucuucugaacaggcaguacuccuguggcucugugucuuggcuuguuuaguuuuuuucagccuugaaggcuccuucccacacuuacugacauccacucauguuccugguaugaccuggauugcugccuggucccugcaaccucccaaugcccuuucugcugcauucccagagcacaggacuuuucucuuuucuacugaccuugcuugguucucccuuguggguuaguaauuucugucugucucuuugccccucacuaauuguucacccaugagaauuagguauuauuccuuuuaaauauacagggaccauauagucuuuaucuuuuauacaugauacuuauuacucaauuuugugugugcaagguaucuggcacauggaccugugauuaguagccugaggucaacaaaucucaguuagaaugcguagguuaaacaaagcuuuuuuuuuuuuaaauuuaauuuaauuuuaucuuuauagagauggggucucacuauauugaccaggcuggucucaaacuccuggccucaagugauccucacaucucggcuucccaaagugcaaggauuaugggcaugagccacugagcccagccuaaacaaagcuuuuaaaagcuccugcaaccucaagguuguuaaccuggucaucucaugguaauuagaaacucugauuggcugcuuuagauuucuugauuaaaaaccuaaguaaacugauuaaguuuuaggcauucuuucaaagguuucucagugaaaagauugggaacuauucuauuuggugcuuugugaaaauauuuugaauuaguauaugugccaguuauugccauuucuuaaguccaaaauguuuuucuggucaaauaaauagcaguuuuucaaaaacaaaaauuagcugugugugguggcaugcauguguagucccagcuacucaggaggcugugggaggacugcuuaagccugggagaucaaggcugcaguaagcuaagauggugucacugcacuccagccugggugacagaguaagacccugucucagaaaaaaaaaaaauuuauagaaugauccuauuuuuguauaagacuaaguauacacacacacacacauacuuacauuauauauacacauauaguaaaaaguuuauauacaugugaauauauacaaauacguauguauguguguguauauggaagaguuuugcaaguaucaguuaaugggaauucaugauauucuaacugcuuugucuuaaucugguguauucuccuuggggaacuacagaacuuggcucuauauuauuuaucaaaagagauugauauuacauuagauuaucaagagauuucugucuucucuggguuccagugccuuaggaauaauuuuuaucugguauuccuucugauccuuguuaucaccaguacacacuggcacuaccaucuugauuacuucacuuuaguaaaauuuccuaggaaauuaguagauugcuguccccacuccagguuauauauguauaggaguacuuuuuguuguuauuguucacagauucauugaguugcaauuggcauauaauaaacugcacauauuuuuaaggguacaguuugaugaguuuugacauauauauuuauaccugugaaacaaucacugcaaucaagauaugaacauaucugucaccaccaaaaguuuucuugugcuccuuuguagucccucccucucuccuauauucuuuuccucccuucugcuugcccccaacccugcauuuuguagaauuuuauuuuauuuuagagacagggucuuacuauguugccuaggcuggccucaaacuccugggaucaugugaaccuuucaccucagccuccugaauagcugggacuauguagaaauuuuauuuuauuuuugaagacggggucuggcucugucacccaggcuggagugcaguggugggauuucggcucacugcaaccucugcuuucugggcucaagccauccucccaccucagccuccuaaguagcugagacuacagggucacaccaccacgcccagcuaauuuuuguauuuuuuguagaggcaggguuucaccauguugcccaggccucaagugauucgccugcguuggccucccaaagugcugggauuacagguaugugccacuguacccagccuauguagaauuuuauauaaaugaaaucauauuguauauacucuuguuuugguauaccuuuuuuccacucaacaucguuauuucauucuguaucuacugagcugaucgugucuuuucauuuucagucuguuaauaggguggauuacauugauuuuuguaaauguuaaacuaaucuugcauuccugggauaaacuccauuuggucguagcguauucuuuuuauauauuguugaacugaauucacuaaauuuuuguuuaaaaucuuugcaucuguguucaugaaggauuucagucuguaguuuucuuguuauaucuuuguuuaauaugagaugggaaguguacuguccuuuucucuuuucuggaaguguuuguguaguguugguguuaaacuucauuacauguuuggcagaauuuaccaguaauacuuuuuuagcuguuuuuauuuuauauuuuacuuuucuccuuaccuaguuugauaguggcaaggauaugauaugugaaagaugcaagaccuuccauuguagcuuuucuacccuuaguaggauuuauauuguauuuaaagaauaauucacauaaaggcugggcacgguaccucauggcuguaaucccagcacuuugggaggccaaggcggguggaucacuugaggucaggaguuugagaucagccuggccaacaugaugaaaccccaucucuacuaaaaauacaaaaauuagccaggugugguggcaggugccuguaaucccaauugcucaggaggcugaggcacaagaaucgcuagaacccgggaggcggagguugcagugagccaagaucaugucacagcacuccagacugggcaacagagcaagacucuaucucaaaaaaaaaaaaugguaauaauaauucaaauaaaaugucaauagugauuaucucuguggagucaagcuuuaaaaaaaaaauccaaaacaccaaaccuaauuuaauuuuaaaaauaaaggugggccgggugugguggcugacgccuguaaucccagcauuuugggaggcugagguggguggaucaccuaaggucaggaguucaagacaagccuggccaacauggcaaaaccccgucucuacuaaaaauacaaaaauuagcugggcgugauguugggcgcuugcaaucccagcuacucuggaagcugaggcaggagaauagcuugaaccugggagguagagguugcagugaguugagauugugccacugcacuccagccugggcgacaagagggaaacucucaaaaaaauaaauaggcugggcaugguggcuaacaccuguaaucccagcacuuugggaggcugagguagguggauugccugaggucagcaguucgagaccagccuggccaacauggugaaaccccgucucuauuaaaaauacaaaaauuagccgggcaugguggcgcaugucuguaaucccaguuacccaggaggcugaggcaggagaaucgcuugaacccaggagguggagguugcagugagccaagaucgugccacugcacuccagccugggcaacagagugagagacugucucaaaaaauaaaauaaaauaaaaaauauuuuggccaggcgcaguggcucaugccuguaaucccaagacuuugggaggcugagacuugaguccaggaguuugagaccagccuggacaacauagugagacuuugucucuauuugaagaaaaauaaaauaaaagugauuugaucauuccacuggaacauagcacuuuggucuuccggcuuuacaaaauauauccauuguauauauauuuuuuuaagugacuugaucaguccucaguauccaggacuauaggucauacugauaauguuuugagauuggauaguucucuccucuauguuacuuaugagguccuuuccaggaccucauuaaacuacauaaguaauagaggcuugacauaauagaggaccuuauuaaaccucauaaguaauagagacuugaagggugauaugguuuggcucuguguccccacccaaaucucauguugaauugugaucuucagucuuggaggagaagccuggugggaggugacuggaucauggggguggauuucgucuugcuguucucaugagaucugguuguuugaaaguguauagcacuuccuucuuugcucucuccccuuccuacuccagccauguagaauguuugggcuuccccuucaccuuuugccgugauuguaaguuucccgaggccuccccagccauaccuccuguacagccuguggaacugugacccaauuaaaccucuuuucuuuauaaaguaucuagucucagguaguucuuuauagcaauaugagaaugaacuaauagaaagggcucugccuuccuaauaacuuacugauuguaauuuccugaucuuagaccuacaggccaccuuuuccuuacucuuuaguucaacuuauuucuccuuugaugauagacagugcuugggaaacuccuuugaccaugacaccaguaagccccacugcagcacacugcaacuaaccuagguagucuagagacucaccuaguaccagaaacugguuagucacacucuauuuuugggacaggguuguguuuggccugcuauauucaggguagacugugccacagaaagcaacaauucuugguaugugacaaaucugaaaccaugaaaccaugauuguaaguuucccgaggccuccccagccauaccuccuguacagccuguggaacugugagccaauuaaacuucuuuucuuuauaaaguaucuagucucagguaguucuuuauagcaauaugagaauggacuaauacaaagggcucugccuuccuaauaacuuacugauuggucauguuacauguuagucaggcuggucuugaacuccugaccccgugaccugcccgcuucagccucccaaagugcugggauuacaggcgugagccauugcacccagcccaaaagauuuuuaaaacaaaaugugugauauaguaauauauaugcuucuuuauuaacacauuauauaaugugucuaauaucuaugaugauuguaaaguaaugaugagcauaaaugauauuuugagauaucugcaaacuagcauaauagaaagguuuuuuuuuuucauuucuauuguucacaaagucccagguccuauaauacugcuacaauuuauuuccuguguucauaaugaaaagaaaugcuguauuuuaauaggagauuggugaaaagaaauuuguauuuuuuucccuguccaaauucauggacucugaauucucuuuauggaugccuuggggauccuuagacuugagguuaagaauuucugcauuaaaaacuuccuucccuaguggcaaaagaugguagaaggccagccucagaaguauccuugugccugaaggacugacuauuccaagggaagugagguagacuaaccccacuacauacauacauacauacauacauauauguauauauauauauauuuuuuuuuuuuuuuuuuuuuugagacagagucucaaucuguagcccaggcuggagugcaguggcacgaucucggcucacuguaaccuccaccuccuggguucaagcaauucuucugccucagccucccaaguaguugggauuacaggcaucugccaccacacucggcuaaauuuuuuuuguauuuuucaguagagaugggguuucaccacguuggccaggcuggucucgaacuccugaccucaagugaucugccuacuucggccucccaaagugcugggauuacaggugugagccacugugccgggcccauauauauaauuuuuugguuuugguuuuguuuuugagacagagucuugcuccaucacccagguaggagugcaauggcacgaucucggcucacugcaaccucugccucccagguucaggcaguucucgugccucagccccccaagcagcugggauuacaggugcacgccaccacuccuggcuaauuuuuauguuuuuaguagagaugggguuucaccauuuuggccaggccggucuugaacuucucgccucaagugaucugccugccucggccucccaaagugcuagaauuacaggcgugagccaccaugccuggccuauuucuuuuuuuuuuaaaaaaaaaguucucuggaagagcauaguauuuugaaaguauuauauguuucugauccaucuuugucuauuaucucagaaucucaccauggcuuagcugauuguuccuuacucaaaggcccacaucauauuguugaccugcuggggcucgcaguaauacuugaagacugggacgccgggaggauccauuuccaacuuacucacaugguuguuggcaggauucaguuccucacaggcuuuuugacugagggccucagacuguugaccucucucauuuccuuuccauaugggcuucuccauaggguggcucacaacauggcaguuggcuuccuuaagaaggagcaggcaauugaccgggcgcgguggcugacgccuguaaucccagcacuuugggaggcugagguggguggaucaugaggucaggagauugagaccauccuggcuaaaacggugaaaccccgucucuacuaaaaauacaaaaaauuagccgggcgugauugcgggcgccuguagucccagcuacuugggaggcugaggcagaagaaugguaugaaccugggaggcagagcuugcagugagcugagaccaugccacugcacuccauccugggcgacagagcgagacuccgucucaaaaaaaaaaaaaaaaaaaaagcaggcaauagauagcauccaaaauggaaaucaaggguuuuguuaacuaaucuuggaaaugacuuuccaucacuucugugauagucuagucgugagaagcacaucacuaaaaccagccuguacucaaggggaagagguuaccuaagagcaugaauaccccgaagcagggaucauuggggguuaauuuuagcagcuaccugcugcacuacauaaggucaauaucauugugaauaauuaauucauugguaauccaacucuacuauuugguugguuauaaguauugacuucaaaacuaugaaaguuacuuuaauuggaagucuuauaucauuguuuguuucucuuuuucuuuauuuuccagaauaaccuggguaucuuguggucugaaagagaagaaauugaaacugcacaggcuuaccuagagucaucagaagcacuauauaaucaguauaugaaagagguauguuacaugucagaugaguuuuaaguuuugauugaaacuaguuaagaauugauaguaagaaucccucauucguaauauuggugugacucuucacugugcccuagaacuucucuauagagccaucugggaagucaccucauagcugaaauuauugcauauuaaagacuucaggguuuuaaaaaaauaauccuuguauaggacauaauggccaccuagucuaaauacaauuauaaaggaaauauuauucuaguguuauccuaaaauacuauuugcauguuuuuguauuuauaaucuaaacauucuauuuuaguuuuccaugaaaauagcacuacuugaaggaaacaagaacuacuuuaacaaaacaucugaaaucuuugaagcaaugguucucaaauguuagcacccaucaaaaucuggagagcucaugaaagcacagcagacugggcauccaggcucugauuuaguaguucugggguggggccuaggaauuugcauuuuuaauaagauccugccugggugaugcuuaaaugcugcuggucuaaguacuauacuguacuuugagaaccacugcuucagggcaaugguuuuucaaugauuuuuuuuuuuuuuaacccgugaaacccuucugaaaaugcagcauauaaaaauugauugaguuacucugguuaagcagguuagaaggacccagagcccacuccacuacagauucuuccuccuccccacugcaguagcacaaaagagaugcuguagaacuuuuaggggucuggggagccaacauugaaaacucucacuuuaggggucacagccugcaaaggugacaagccacuguguuaccaucuguuuccuuaauaaacuuuuuuuuaauaugaaagggaaauaaucaggcacaauauuuucuuguggauuacuauuugucacagcuaucugcuuuaaaaauccauuaauacggcugagcaugguggcucaugccuguaaucccagcauuuugggaggccgaggcagguggaucacuugagaucaggaauucgagaccagcuugggcaacauggugaaaucccaucucuacuaaaaauacaaaacagcaggcaugguggcgcacgccuguagucccagcuacucaggagacugaggcaggagaaucguuugaaccugggaggcagaggcugcagugaacugagaucacgccacugcacuccggccugggcgacagugagacccugucucaaaaaaaaaaaaaauccauuaauaaagugcuuuuauaacauuaaaaaaguugaaauaacauuagauaucacauaaaagagacuaaacauacaaaauuauguuugcuaaauucaugcgucagaaugcuugacugcaaaaggauauaagaagcuugguaugccuguaaucccagcacuuugggaggcugaggcuggaggaucacuugagcccaggaguuugagaccagccugcgcaacacaggaagaccucaucacuacaaaaaauuaaaaaauuugccagauguggcacacacuguaguuuuagcuacuugggagauugaggcaggagggucgcuugagcccaggaguuugagguugcagugagcuaucaucgaaccacuguacuccagccugggugacagagcaagauucugucuuuuuuuuuuuuuugagauggagucucgcucuguuguccaggcuggagugcaguggcgugaucucggcucacugcaaccuccaccucuugaguucaaguaauucuccugccucagccucccaaguggcugagauuauaggugcccgccaccauucccagcuaauuuuuguauuuuuauagagaccggguuucaccauguugccaggcuggucucaaacuccugaccucaagugauccgcccaccucagccucccaaagugcugggauuacaggcauaagccaccaugcccagccucguaccuuggcauuuuaacuuucuuccugaaguacuaacaagagcagagugccacaaaaccaaauagagauauuagucuacccuuucuugcuuuuaggcucacagucuuauaugugaaauuguuaauuuaaaauguaaggucugaggccaggcacaguggcucacgccuuuaaucccagcacuuugggaggcugagguggguggauugccugacuuagagguucaaagaucagccugggccacauagugauacgcugucucuacaaaaacuaaaaaaaaauuagcugggugugguggcgugugcuuguggucccagcuacuucgggggcugaggugggaggauggcuugaguccgggagggcaguccaggaggucaaagcagcagugagcgaggauccugccacugcacgccagccuagguaaccaaauaagacccugucucaaaaauaaguaaaauaaaauguaaaagcugaacacggugacuuacacuuauaaucccagcacuuugggaggccgaggugggaagauugcuugaugccaggaguucaagaccaacaugagcaacaaagcaagaacccgucuuuacaaaaaaaaaaaaaaaaaaaguuacuaagcaucaauaguauuucauuaaaaauaguauuuguauggaaacauaacacauauagugaaauuccuuguguuuaguuguaccucuguuucaguuaagagacugauuugacuguauuaauauuacguaugaugugugaaagccauaacagugaaguauguacauaaaauaauauauugauuaauuccccucaucuagacagggguaagcaugguaagcagcccucggaauuguugaagaguucucugaagaauuacuuaucuauuguguuugccuugggccuugcuuccugucuuaguuguuuuuacuuuaugugaauccugggagcccacguugugaugcuuuuaguguuuacauccagaauguaaaaucauauuuuuaugaaagacguuguuccuuuuugaguuuaaugaauucaguuaaaagcaagaguguguuucuagaugggacuauccucauagaaguagaaugaggcagagguuagguaguucuguuuuggaagacguaagaggggguuguaagugauuuauaaauauuacuuaauccucaugagauagauacuguuauuacccuuauuuuauagaugacuaaacagaagcacaagagaucaagugacuugcccaaggcaauaaauaauggaaucugguuuuaaugucccuguauugaaaggggguaauacacuuuuguuauuuccuugagaaaaaaauauuagaauaaauauuaaaaucucucauuugauuuuuauuaguggucaguuuagaauacuacuacuguagaaauauauacauuuuuccuauuuguuuugcuuaugcauguuuuuaaaagagcccuuuuaccagacaaaauugccauuugaaauacuuaaagaggggucgggcacgguggcuuacaccuguaaucccagcacuuugcgggggccgaggcaggcggaucaugagaucaagagauugagaccauccuggccaacauggagaaaccccgucucuacuaaaaauacaaaaauuagcugggggugguggcacgugucuguaauccuagcuacccaggagguuaaggcaggugaaucgcuugaacccgggaggcggagguugcagugagccgagaucgcaccacugcacuccagccuggcaaaagagcgagacuccaucuccaaaaaaaaaaaaaaaaaaaaaaacuuaaagaggcugggcaccuuagcucaugccuguaguuucagcacuuugggaggcugaggcaggaggaucacuggaggcuaggaguucaagaccagccugggcaacagagcaagacccccaucucuaaauaaauaaauaagaauuaaaaaaagaaaaaauacuucaagaauuauauaugucuaaaagcagauugguggauuuuuugcauauuugcaguuuaacugcaacaacaguaaaauuuugucaaaugugaacuuuugacauuugguuaaaacaaauaaaaggguaucuuuuauuuguuugacucagauuuuaugguuaagaaaauuacuuguugaggcgggugcaguggcucacgccuauaauccuagcacuuugggaggccaaggcagguggauugcuugagcccaggaguuuuaagaccagucugggcaacauagcgaaacccugucucuacaaaaaauauaaaaauuagccaggacugguggugcacaccugugguuccagcuacucaggaggcugagguaggaggauugcuugaggugggaggaucgggagacggagguuacaguaagccgagauugugccacuccacuccagccugggugacagagacccugucucaauaaauaaauaaaaauuuaaaaaacagaaaauuacuucuugaguaacauaaaaaugaacuaggaaaaaaugaaauguauuuggcuuguagaaguugauuucuccagguccuccagaagagggcacuugguguuuacaguuuaaaacuuuaaagagcuuuuguuuuucuuaauuguagguugggaguccuccucuugauccuacugagcguuuucuuccugaagaagagaaacuuacugaacaagagagaucaaaaaggugaguagguauagaaaucagcccuugcaaauauuuccacauaucauagauuagugauuguucaaaaagucacuuauaaagguuauagaauguggauucugacaggaguaaaaccuccauuuaccacuuacuuguuauuugaccuuguucaaaccugagacucaguuuccuuaucugucaaauagauacaauaaacaaauccaacucaaaggguuggugggauaaucaaaauaaauauauaugaaauuuacuuauaaaacguaaaccaugguccggacacgguggcuuacaccuguaaucccagcacuuugggaggcugaggcggguggaucacaaggucaggaguucaagacuggccugacuauuauggugaaaccccgucucuaccaaaaauacaaaaauuagccaggcaugguggcaggcgccuguaaucccagcuacucgggaggcugaggcaggagaauugcuugaacccaggaggcggaggcagugagccaagaucgugccacuguacuccagccugggcaacagagcgagacucugucucaggaaaaaaaaaaaacaaguaaaccauuacacaaauauugguuuauuuuuucuuuacagauuugaaaagguuuauacucauaaccuauauuaccuagcucaagucuaccagcaucuggaaauguuugagaaggcugcucacuauugccauaguacacuaaaacgccagcuugagcacaaugccuaccauccuauagagugggcuaucaaugcugcuaccuugucacaguuuuacaucaauaagguaagcuucuugaaguaguuaucuaacagaguaccaauagugaguauaaaaauagaaccaguaguaccuugaaaauacuaucuuuuaaaaacagguagcuuguauuuuaugauguacaacugaagccgaaaaugcagcccaguuugcccguguacuaaaauuuuguagcuuuuuguuguaugaauuauuuugaguuuuaaaauaccgaguuuuaucauuguuuuacauguuaccuaagaccaauucuuuuuuuaacauaggcacgcuaucucaacucauuuuagugagauauuaccuuaaauugcagauuuuaccuuguagauauagcuuuaucuuuacguaaugguaaucucauaacucugagaauuugacugaggaaguugacuguuaaaugugggcuuugauaaaagcaugugaugcauuucaguuauuuuucagaauuaacucuguaauaauuuuuuaauguuggaaauaugucugcugaguuccaaaguucuaggucuuuauaccauacuucuuuuggauuguuacacagggacaauguuuuugagcuucuuaguuguuuaucagaauuucucauaaaaauuuaaaaaagcauugcucacaucauguugguguacucuuaauugacccauuuauuccuuuaauccuugagaguuuuuaaugcuaaaauaauuuuacaccaccuuuucuaaccagauuuuccuauuaauccuuaauaagacaucucagcaauauaaauuacuuuuauuuauauuucgaauucgcaagccucucugaaauuuugguaguucucugcuuaucagaguuccuucuuucaucucucugguaacccgcugccuuauccuugggccuuuauccuuuuugagcauuucguuagcguugguucuguaaaugcgcccgaugauuaaaguauugucccacagaauuucauucagaaaagcuauuagcaggagagaaagggcuguggugacugcagcaucgcuucuaggacuuuggucuaagaucaaguguguaaguaacgcuacugcauauaucagagcauucaguuaacuaauucucaugaauccauuucauuguccucauccaaaguguuauccagugccuccgcuugugacaucuuuuuuacagcuguuggaggccccuuauucauucuguuuagcaacuuuaaaauuacauauucacugugacuuuaauuuauacuuaaaacuccauggaaauuggcaguacuaagauaucuagauauuaaagugugauuaaaauuuaaaguuguuaagcauuacuuauguggagcaugcaguaauuuucaugagaccucccacacccugcacuuuuauuuuuuuaccaaaaucuuuuuuaaguuuuuguuaaaaccaacuaagucguauugcaaaaagagggauuugaaccauguuuuuaaaaaugcaauugucauuuauaucauugucaucuucaucugauuccagugaugagguuuugcuacuuggugaaucccuaccuggcagcugcuaaagucccacauuuaccagccaccuagagggcauaagacacucacuguucuagcagugguugcucacagggagccaaucuggacaaagcugaaaugacgauaaauguuaagggauuggauuauagagagauaauuaaaguuucauuauauaaacucuaacuuucuuuuggcuuuuaagauuuaacacauuuuuaucuauagauguugcugggcuaauacuacacguguccagcuauucucaagauggcuucugaauuugccauaauggaaagauacauuuaaugcugcaauuuuaaaguuauagccaaccauuuaaagccuuucagguauuacuaauauuaaguagacauucuauuuaaugaggguggcuuccaacuaaaaguuggacuuuaacuuugaacuucugcugggugguccuuugacuuacaugacaaauacaaaauguuucuauuaacaaggagaucuucucuaauuguuugagaaguuugccaugcccggaauugaauuaugaagucuucaagaguguugguaaagcaguuccauaagguucaucuguagaagucuguugacuuuaaaacuuggugggaagccuuauuguauguaaaguuuaaagauuuuagaacacaggaauaucuucuuaccugaguuuauccuauuugccuuuguauaguaggauguaaaggggcucucuaaaccuaauaaaaauuaaauccucaggcugggcaagguggcuuacaucuauaaccccagcacccugggaggccaaggugggagcauugcuucaggccaggaguuggagaccuguuuaggcaacauagagaaaccccagaauuagucaggcuuggaggcuaaaggugggaggaucccuuaagaccaggagguugaggcugcagugaacuaugauugugccacugcacuccagccuugggccagagugagaccccugucucguaaaaaaaaaaaaaaauauauauauauauauauauauauauauucagucuucugacacaauguaaauagucuaagaauuuauugugcaugggauuuuggcuacuuagacugaaccuaaaggaguuuuugagacaguuuaagucuaggaugacagccauuccuguauaucuauugauuguauaaggagagcuaacuuucaguuggcaguugucuuucaauccgaguggauuauuauuaagaguuugggggcauuaauauuuuaaccuuugagguuacauuuuaaccagauaauaugauaauauaucuuuuguaccuucugaaugaucugcaacucuacagggccuccuuuguaguauuuuuaucugauuuuauaccuuuucccauauuaaaagaaauuaugcaaguaucaguugcaaauaaagcugugugauaguugcauucacuguuguuuauuuccccaauagcuaugcuuuauggaggccaggcacuguuuaucagcugcuaaugucauuuuuggucaaacuggaaagaucucagccacagaagacaguaaguuuaccuuugcauguuuuacauagcuuuuaaaaaaaguuuuauuuugaaauuauuuuaaacuuuugaaaaguugcaagaacagaagagcuaucauaugcccuucuaaaugcaccaauuuuuaguauuuuccucgcuuggaaucaaauuuuauuuuucucucugaaccauuggagagaagguuacauacauuaggcucuuuuacccuuucauacuuuaguauauauuuccuaagaagaauauuuucuuacauaaucauagaucauuuaucaaauucaagaaauguaacauuggccaggcaugguggcccacgccuguaaugcuagauuuugggaggccaagaugggaggggccaggaguucaagacaagccugaucaacauagugagaccccaucucuauguuuuuaaagaaauuaaaaaaaaaaaaguaacauugauacaauucuuuuaucuacacugcauauuucuauuucaucaguuguugccauaauauuccuucuagcauuuguuugccaguacuggauuauacaguucaagauugcauaaugcauucaguugucacaucucuucaggcauuuuucgucuggaauuguuccucagccuuucuuucccuuucaucacuuaauauuaagaauauaggccaguuauuucauagaauuacugccagcugggguuugugugauguuuccuuaugccaugauucagaugauauauuuuugguuggaauacuacaugcauaagcgauguugccaaauacccaucuuuuuaaguauaguguuuccuuuagucuuagaaaaucacaguuaacaugugucuuugagucauuuaacagguuuuuuaauaaguucaucauuuucuuuaaaaauaguuuauuuuuaaaaauaguuugauucuauugcucacuguugaacaguuuccaaccuucuuacgauguuuuagauuuugaaacaucaugucuuccuuacaaauggacauucuaauuguggaucugaaaaaugcagagacucuuaagagcuaaaggaauguacauuaucaaaguaaauaguugcuuucuccccuaauauauuaacuacauuaauuauagauuaguugaagucuaagaggcacuugucucaaaaaaugaauaaaaacuaaauugcugagauauuauuuaauaauucacuuuauuuaaaguaauaucgugagauauuauuuuguuuuuacucuucauaauagcugaaaaaaugacagugaccaguguuuucaaaauguucuuauugagcauucucauauauuguugguuggcauauuuguugaaaauaauuuggcuguauguugugaauuauuuaaaauuguguaaacucuuuuacucaguaaauuccacuucuaggaaucugcccuaaggaagaaauccaaaauccagacagauuuuugcacaauuauacucauguuucaaguuuaaaaaaaauguguguauguguauaaacuuuacaaagcuuuguguugacagcugacuuuguagauuacagcaagaaagcugcucugcuauguaugacacucugacccagaagcaggucaucugaauaguuuagcaccagguucuccacaaccaucuguugugugacauagacguuuuugugauaguaaagaauuggaaacaacaaauuccagguuagaauuagaagaaugguuaaauaauagaauaucuauuuaauuguauauaaugguguacuuaaaaaugaagcuaagaguugauaaugauaugaguaaaguguuuguggugcgagaaagaaauaugcaaaaauaauagugagugcuucuggguaguaggauuuggggggggaucuuucuucccuuuuccccaagcccccugcuucaguaaagaucuguuacuuuuauagucaggaaaaagugauauuaaaaaaauuacaguacccaaugaaaauuacaguugugaccauuaacuuaaacaaaucacauguauauuuuagcuccugaagcugaaggagaagugccagagcuuuaucaucaaagaaagggggaaauagcaaggugcuggaucaaauacuguuugacucucaugcagaaugcccaacucuccaugcagguaaugcagucagaagcugccuuuuucuuucuuaaaugaggaaauuguaaguaaaaacucauaguggggauugugcucauuggggucacauuguguuuaauaugaaagguguguagaauguuuucguaaauauuucuuucuugguuuuaaaucguauucuucgaauugcuugaauccgggaggcagaggcugcgugagccgagauuggaccacugcacuccagccugggcaacagagcgagacuccaucucuaaauaaauaaauaaauaaaauaaaucuuacucaucauucaaggccuaucuuaaauacuaccucuuccuugaagacuuuucuuugguuagaauauaagcuucuugagagcugggaacgauaucauauucuuuuuuuuuuuuuuuuuagacaggcucucgcucuguuucccaggcuggagugugguggcgugaucaugggucacugcaaccuuggucuccccggcucaugcaguccucccaccucauccuuggaguacaggcgugugccaccauauccaguuaauuuuuaaauuauuuuguagagacuggcucucacuguguugccaaggcuggucuugaacuccugggcucaagugaucuuccugccuuggccucccaaagugcugggauuacaggugugagccacugugccuaaucuuuuuuuuuuuuuuuuuuuuuuuuuuuuugagacggaguuuugcucugucgcccgugcuggagugcaguggugugaucgcagcugcaaccucugcuuccuggguucaaaggauucuccugccucagccuccugaguagcugggauuacaggugccugccaccaugccuggcuaauuuuugucuuuuuaguguagaugggguuucaccauuuuggccaagcuggucucgaacuccugaccucaagugauccauccaucucggccucccaaagugcugggauuacaggugugagcaaccacaccuggccaagcccuuacuaaucuuuauauacuucccaguguuaucuuacacacagcauggacuugauaaaaucuaaaaggguagacuuuuaagaaauagcucauguaauaguucaaaaauagaagcagaacugauggcagugaagagcauggacuugaaauacacuagguagguaugaacuccagcucugccgcuucguagcuaugucuuuguggcaauuuacuuaauauauuuuugccucuauuuccucacaaguaaguuggagauaauaguacuuaauacuguuguuaugggaguuaagucaguauauauuaaggccucggaaaagugccugagacauacuaaguccuuaauaaauguuaacuaccaucaucauuauuaauuuaugcccaauccuaguuucuaagcacuagggaggauaauaaaauuaaucauuuagaugcaauauacuaaguguagauacauaggaagauuuccugggggauucauugugcuuuuauuuuuuuauauuguguauuaaaguaugauaauuuuuuuuuuuuacaugggacucugcuugauaaaaguauaauaaucuuuagugguuguauuagucuguucucacacugcuauaaagaacuacuugaggccagguacagcgccucaugccuauaaucccagcacuuugggaggccaagguggguggaucacuugagcccaugaguuugagaccagccuagacaacauguugaaacccugucucuaccaaaaauacaaaaaauuagccaggcaugguggugugcaccuauagucccagcuacuggggaggcugaggcaggagaaucacuugagcccaggaggcagaaguugcagugagccaagacugcaccacugcacuccagccuggguaacaaaacaaaagaacuaccugagacuggguaauuuaugaagaaaagagguuaauugacucacaguuccucaggcuuaacaggaagcaugacuaggagcccucaggaaacuuagaaucauggcggaaggcgaaagagaagcaagcaugucuuaccauggcaagcaggagagagagagagggcaaagggggaaaugccacacacuucaaaaccaucagaucucaugagagagcucacucauuaccacaagaacagcaaggaggaaaucugcccccagugauccagucaccucccaccaggucccuccuccaauuuaaugugagauuuggccagggacacaaauccaaaccauaucagugguaaauaauauagaaccuugugaaacuacuaaacgaaagaaaaccaaacaaacaaaccucaacacaucagaagcauaggucuugaaaagaugaagauaauuuuagaggucagaggguaaagaggaggcauauuaaggaaagacaggaaguagggagaauaacuguggggcuuuauguguagagaauuuggagccaggaagagcugucaaguuuauucuggucagguaaagaaagcuggaaaaggaggguugcagggacuauuggagcaaaacaguaggcuaauuuaaauaagcauccuagagagaacauguaaguaaacaagcagcccaagaaggaaggaaguauacaagauuuagagacuuaugaucuacauuugaaguaauugugucaagcaaaucgcacuaugauuugacccuuaccuuucauuuaguugauguuucuagucugggaacuuaaaacuucaucacuugguuaguuuaaacucacauauuugccaugcuacuaaacuacucagauuuuccuuaaacccaguuuuguuuuuugagaugggguuucugucacccgggcuggagugcaguggcaugaucuccacucacugcauccuccaccucccuggcucaagcaguccuccuacaucagccugccaaguaacugggacaacaggugugugccacugugcccggcuaauucuuuguauuuuuguuagagacgauguuuuaccauguugcccaggcuggucuugaacucuugagcucaagcgauccacccacgucggccucccaaagugcugggauuacaggugugagccacugcgcucaccccugacuuuauuuuuuaaccuuaacuucauccuuuaucaucuguauauuuaucugaaagaccuucuucaguucaagcuuuaagacauacauaaauuuauucaauuaaguauuuauuuaugccaacccugugcuagucauuggccaaggauacuaugaugaacaaaaaugaaccuagccuuuaacuucauguaaaaguacaauuuugcuaaguuccacaaaggagagacacaugauaugagaaggcacaauaggaggaaauaacaagcaagcucuggggaugaguaaguaggaguuaccuagacugaagaaaagaaggcacaccaugucaaggagcugaagcaacauguuuagaaguucuguggcguaagggaggaugauaucagaagggauggagcaaaggcugugagguuggagcugagggagagggagugugauauaagcuaaaguuagaguuagaaaggggcuggagcaaucaaggcuuugaagcauuguugucuucaucuucugagcauuuggaaaccuugaaggguuuguggaaagaucauuggugagacagugucaagugaaaagaagaaaaggccuugggaucuauuauuuauuuuuauuggccaagaagagcuuacccuauuucuuaaccaccuuaguuauucuuucuuuuuuuauuugcccccccccacccccaagagguagaggagauaaaacuuuaacuaggaagguagauuuaacucuuuguucacuuugaugucuuuaagagaccuagagcauuucugucugauauauuucacuaaauaacuaauagcauaaacaugguagcauuaaucuuaauggcauccuugugaaacauuuuuaugauguagauuacagucuuuuuguuuguuuguuuguuucuugagauggagucuugcacugucacccaggcuggagugcuguggcgcaaucuccacuuacugcaaccucugccuccuggguucaagcgauucuccugccucagccucucaaguagcugggauuacaggcgccugccaccaugccuggcuaauuuuuuauauuuuuaguagagacagaguuucacuauguuggccaggcuggucuucaacuccugaccucgugaucuguccgccuuggccucccaaagugcugggaguaauguaucacauauauauaauguuucacaauucucaaaguacuuuuacauguagcauuuaucuuauuggaaggaguaacuguaaauaaauuucaguuccucagaauaaaugauauguaagcagcuugucuauuuaaauacuuuuuuuuccacauuucuugaguuuuuaauauaaucggaagaaagaaagaaguuuucaaagguguuuaagauuaugauacccuucuaaaccaggcuggaaaguaagagacuucucuucuaaaaaacucugaaguuugcuuuaauauuauuuaacagcaggaggugaguguccuacuuaaccauaauuuauuuuuuuuuccuucaggacaacauaggagagcuugaucuugauaaacagucugaacuuagagcuuuaaggaaaaaagaacuagaugaggaggaaagcauucggaaaaaagcugugcaguuuggaaccggugaacugugugaugccaucucugcaguagaagagaaagugagcuacuugagaccuuuagauuuugaagaagccagagaacuuuucuuauugggucagcacuaugucuuugaggcaaaagaguucuuucagauugaugguuaugucacugaccauauugaaguuguccaagaccacagugcucuguuuaaggugcuugcauucuuugaaacugacauggagagacggugcaagaugcauaaacgcagaauagccaugcuagagccccuaacuguagaccugaauccacaguauuaucuguuggucaacagacagauccaguuugaaauugcacaugcuuacuaugauaugauggauuugaagguugccauugcugacaggcuaagggauccugauucacacauuguaaaaaaaauaaauaaucuuaauaagucagcacugaaguacuaccagcucuucuuagacucccugagagacccaaauaaaguauucccugagcauauaggggaagauguucuucgcccugccauguuagcuaaguuucgaguugcccgucucuauggcaaaaucauuacugcagaucccaagaaagagcuggaaaauuuggcaacaucauuggaacauuacaaauuuauuguugauuacugugaaaagcauccugaggccgcccaggaaauagaaguugagcuagaacuuaguaaagagaugguuagucuucucccaacaaaaauggagagauucagaaccaagauggcccugacuuaauccuuguuuuuaaagaaaggaaaugugcaauauugaagugaucuuuuucccuagucagacaggcccaauuccauugugauguuuaccuuuauagccaggugagugcaguuugaacuugagauacagucaacugaguguuugcuaggauccuaaggaacauaaaguuaauuaaaaacuuacaccuaauuauguaaauugccuuguuaaagacaugugauuuguauuuuagaugcuuguuuccuauuaaaauacagacauuucuacccucaguuucuaaauguagacuauuuguuggcuaguacuugauagauuccuuguaagaaaaaaugcuggguaauguaccugguaacaagccuguuaauauauuaagauugaaaaaguaacuucuauaguuacuccuucuaaaauauuugacuuccuaaauuccccccacccaaaaucuuucccuuuugaaaauacuaaaaacuaaguuauguuauuauaaaguguaaaaugguuugucuuaauuauaggagaaaaaggccuuguuagaaauaaaauaaacugacuuauuucacuaaugaaaac

SEQ ID NO: 192144 - RNA, 45570 nt, Homo sapiens
gcauggccaaggccgggcggccgccuugcccccgcuuccuuucacgcugucgcugcccguaggugguuguggccacugugcccggagggaggcggcgguggccaguaaugccugggaaacuccucuggggggacauuauggagcuggaagcacccuuggaggaguccgagagccagaagaaggagaggcaaaaggugcgcugagcaugggccgcgccuccuuuugggcugcgccggcuugggcggggaggggaacugucugucccugaugauggccugucagaaccgggccggagcauccgagggccucccuucgcgccgcccucggcccucuggggucgcucagggaccguuuccaccuccacccucccgaccuggagaaagauggcccugggcuuugggccucuccuccgcguggccccucagcccuucccguuggcgccugaaucucagaugggcagacucaagcucccaucaccauggaaucuguucuuucucuccugaagcagugacgcuugccauuucguuuucauuggcccucuuagaagaugauuaagaaaaaaugauugcuuugaauauguguugcuucugucaccccguccccugugcaagaauccuggggaaagcgaucuuagguuuacagaccucaauaacuagucuguagaggcuuaaggaaaagugucacugagacuugccaggauuugucagugauggagaucguguggguugcauuauuaauagccuuuacugucaguauuuucauucaauccgcagguguuuauugaaccuaauuuguaccauacucuuugcugaguaccaaggagguuaaacuaaauaaguaaagaaauggucucugcucucaaggagccuguagaggaguuguagucuuuccuccucccagcccccugcccuccaaaaaaaaaaaaaaaaaaaaaggaaaagaaaaaacauccugaaacacucagaggaucacaaggugcugaaaaaaugcccagguaaaauuauuacuggagacauuugaccuggaaaaaagaaaucagcugaagaggcuaagguggcaguauucgaaggcugacauucgacaaaagaaugagacuuauuuuguauagccuuagaaagcagaaucuaccucucugaccuuaucacuaagguaaacuugccauuucagcuaacacuuuuauugugcuaaaauacacauaacguuuaucauuuuaaccauuuuuaaguauauagcucugugacauuaaguauauuuacaucguuuugcagcugucaccaucauccaucuccagaacuuuucauugucccagacugaaacucugugcccauuaaacacucacuucucauuccucucuccuuccacucccggcaacuaccauucuacuuucgcucugugaauuugacuacugaaguuaccuagaguguaagcagaaaaccaagcagguauuuuaaaaaaggcuucuuuugaaauucuugucuuuugcaucccaauccuguccagcggucaaggccuaguuuaugucuuuccugacaacccgaauguaccguuaucuaguuucaguggcuaucuucaucauuugauugacauuuguuaugcaugucuauauaaaauuaguucauuuuuccuguauguaucccacauauuucccaaaaguucuugaggaaagugaccaaaucuuuauccauccuuauguuucacuauguuguuuuaaauugguggcuuucacauuguaaauucuccagaaauacauauugacugcccuuuaacuaugaaagauaaccagagauuuggaaacgaauuggaauaccaacuaaaagaaauagagcauuagaauacaggucugguggcuagcugcaguggcucaugccuguaauccuagcacuuugggacgcugagaugggaggauugcuugagcccagaaguuuagguagaguuuuguagagacccugucucuacaaaaaauaaaaaaauuagccgggugcgguggcucaugccuguaaucccagcacuuugggaggcugaggcaggcagaucaccugaggucaggaguucaagaccagccuggccaacaugguuaaaucccaucucugcuaaaaauauaaaaauugggccgggcauggugacucacuccuguaaucccagcacuuugggaggcugaggcggguggaucgugaggucaggagaucgagaccaucccggccaacauggugaaacaccaucucuacuaaaaauaccaaaaaaggccaggugcgguggcucacgucuguaaugccggcauuuuuggaggcugaggcagguggaucaccuaaggucaggaguucgagaccagccuggccaacauggugaaacuccgucuuuacuaaaaauacaaaaauuagcugggcaugguggcacaugccuguaaucccagcuacucaggaggcugagguaagagaaucguaugaacccgggaggcugagguugcagugagcugaaaucgcaccacugcacugcagccugggugacacagcgagacuccauuuaaaaaaaaaacccaaaaaacccaaaaauuagcugggugugguggcgcgugccuguaauuccagcuacucgggaggcugagauacaggaauugcuugaaccugggaggcagagguugcagugagccgagaucgcaccauugcacuccagccugggugacagagcaagacuccgucucagaaaaaaaaaaaaaaaaauuagcugggcgugguggcagacgccuguaaucccagcuacucgggaugcuaaggcaggagaauugcuugaacccaggaggcagagguugcagugagccaagaucacgucauugcacaccaaucugggcaacaagagcgaaacuccgucucaaaaaaaaaaaaaaaaauuagccagccguuguagcucgugccuguagacuuagcuacucaggagacugaggugggaggaucacuugagccagggagguugaggccacagugaaccaugguugagcugcugcacuccagccugggagacagaguaagaccugucucaaaaaaacaaaacugaagugaauaguggucugguauugaggugaggauaacuuugguucggacguguugagauauggagcuggugcuuagauucuuagaguuggaauguaggugaggaagggagucuggaaguacguauugagccaugaaaauaguacuaaaagugaacauagagaacagauacucaaggagcauccacuggaggaggaaggagaggaaccauugaagaagauaugugguagagguaagaagauagagguaagaagggaauauaaaguguaacugaaaccaaguagacggagagugccaagcauugugggucuaaaguggaauuauuuauuuaaucaccuugagauguuacugggcuuagaccgagaggucuccuuuugccuugcuucaacuucucucuguagugcagggcccagaagcaauucaagccccaaggcugaaucgauaaauaaucuuauuuuucuguagaaccuauugguuuggaaagauguggucuaguguaguuaacugcagaucauaugauguaauguguaacugcaaagcauuuucacacauauuguucaauucucacagcaauuccaauuuuauggaugagaaaauuauaugugaaauaacucuaaaaguuguguaaguuauggugaacauuuuggugguaguaguuuuuacuaucacuaauuacugcuaucuauuuugaauauuugaccagguaauucauuuuuuugagaguggccgagauuacaggcguguaccacaacaugcagcuaacuuuuguauuuuuguagagacgggguuuccccauguuggccaggcuggucuugaacuccugaccucaggugauccgcccaaccucgcccccccagagugcugggauuauaggcgugaaccaccacggcuagccaccaggcuaaaguccuaaauucccaaaucauuuauuguguucuguaaauaucacaacacuggccacuaguuugagauuuuaaaauugaaguugaaaaauaguguuuuuuaaaaaaauuaacugaauuuaaaacguaaaaaaaaaaaaaaaauccaggauuacuguccuuccguggaaguauaacaauuggacuucuauaugaauuauauaguuucuuuuuguuuuccuuuagccugugaauugucaaagugcagggaggaagcauaaugugaaaagagaaugggcuuucaagucaggcagugcuagauucaguuucuaguacuuauagcugcaggaaaucccacauguggaucuuuggcaaguugcuuaaccucuuacaacuucuguuuccuugucuauaaaauggcaaagguggcugggcacaguggcucacgccuguaaucccaccacuuugggaggccgaggcugguggaucaccugaggucaggaguuugagaccagucuggccaacagggugaaaccucguuucuacuaaaaauacaaaaauuuagcugggcaugguggcguaugccuguagucccagcuacuuggaagacugaggcaggagaaucacuugaacccgggaggcggaggcuguagugagccaagauugcgccacugcacuccagccugggugacagagcaaaacucuaucucaaaaauaaauaaauaauuaaauaaaauggcaaagguaauacagguucacuaucccuuauccaaaauccuuggaacuaguuguauuuuggaauucagaauucuggggauuuuuagaaagguagcaccccgguaggguuuggggccugaaaccuguaaucaaacaccuuaauauuaaauaugaguggucauacuaagcaggauaaaugaagacuauaaagagccucacguuaguucaaguuaaauuuugccaucaaaugaguucagguaagguuuugccuccaaauaaguuacaaaaaaaacuuucgguuuucagagcuuuauggauaucgcaauuucggauaagggauuauggaccuguacuucccuuauaggguuguuaugaagauuuaaacaagauaagcugaaaacacauuacacagugcuggguagguauucaauaaguauuaauuuuuuuuucucuuggaaauguuggaaguuuuugcuuguuuaguaauuuauaauucugggguugucuuucuuucccugaggagaaaccguuuuaauuuuccuuaaaucuuaugaugggauuagagaggggcuagaggcugagucuugagaaugcuaggaaggggaugagaaagauagcaacaguugaggcuuagagcuuggcauuaguaagcagucuggauuucuaccaggcagguuuucaaaguaacuguagauugagcugaacuggugggggagucaugcucuaacuucucuagagucuuaaaagaaaaccucugaccaucuugucauugcuucuuuguuuguucacagagugacagaaggaagucaaggcaccauuaugacucggaugagaaaucagaaacaagagaaaaugguguuacagaugaccuggaugcucccaaggccaaaaaaucuaaaaugaaagagaagcuaaauggagacacugaagaaggauuuaauagacuuucagaugaauucuccaaaucucauaagucaagaagaaaagaucuaccaaauggagauauagaugaauaugaaaaaaaaucaaagcgaguaucaucuuuagauacuucuacucauaaaucaagugauaauaaacuagaggagguauggaagcuuuuuauuuugcauuugacauuguuguugaacuauagguugauuugaauuuuuuuaggcuaauuagaauugauucuauaacauuucuugauuagugucuaguauucuuaguugcacuagagucuguacaggugaagccugagccuuuuuuccuuuggcccuuguuuauuucacuguauggccuuuuucuuggggcgaggugggagcaauaguuaaauuuaaaccuuuucuguacauuuggguuccuaaaguuauucggaauugcuugaugguuaucuacuugaauuucuuuucuuuuuucuuuuuuuuuuuuuuuugagucagagucucucucuguuucucaggcuggacuggaauggcacaaucucagcucauggcaaccucugccucccggguugaagcgauucuccugagucagccucucaaguagcugggauuacgggcacgcaccaccaugccuggcaaauuuuuguauuuuuaguagagacgguguuucuccauguugaucaggcuggucuugaacuccugaccucaaagugauccaccugucucggcuucccaaauugcugggauuacaggcaugagccaccacacugggcugauaauuaguaauucuuuauauuauauaaauacgauaauugcugauauucauauacauuugagcuuaaugcauaaucuuuggggaaaaguguugaauccuuguguuauggccuuuuuuuuuuuaauuugugaauuugcuguuuggcaggaagcacauguguuuguugaucuaaauaagguccuuuaaaucuguauuucuagcaguggaauguauggcuugcuucucacuuuggugggauuuugccugguaaaaucuguauuauaauagguuuaacaguuuauuauuuuguuuagaucacaugagaguucaggaauucuacuuaaaggaauuuauccuaaggagaugaugaagaggugugcagagcuguaugaauaaguacucuuaucauaguaauauuguugauaauaggaaaauauuuaaacauccuaaaugucugauaguagacauuugguuuaaauaaaacauacuauagcuguauaauagaauacagcuaucccaaaggguguacaauagaaaagguagucauuguaucuuguuaaaagaaaaaaauaggcugggcgcaguggcucacgccuguaaucccagcacuuugggaggcugaggcagguggaucaccugagaucaggaguuccaagaccagccugaccgacauggugaaaccugucucuacuaaauacaaaaaaauuaguugggugugguggcgcaugccuguaaucccagcuacuugggaggcugaggcaggagaaucgcuugaaccugggaaguggagguugcagugagccgagauugcaccauugcacuccagccuggucaacaagagcgaaacuccaucucaaaaaaaaaaaaaaaaaaaaaaagauuauaaaaugguauauacagugugauuuuauuucuauuuaaaaaauuuuaugugcauagagugaagacuggaggaguauguuucaaauauggcuuuagcugaguggauuauaaauaauuuuuaaauuuguuucuguuuccucuguaguuuuuaaaauuuccuuuuuuuuuuuuuuuuuuuuugagauggggucucacucugucaccuaggauggagugcaguggugugaucauggcucacugcagccucauccucccugggcucaggugauccucccaccucagccuccugaguagcugggacuauaggcguguagcaccaugccuggcuaauuuguguauuuuugggagaaaugguguuucauucacuauguugcccagacuggucuugaacuccugggcucaaguaauccacccaccuuggccucccaaagugcugggauuacagacauaaaccacugggcucugccaguuucaaaaguuucuacaaugacaguguauuguuuauuuuuguuuguuuguuuguuuuuuauagagacaaggucucacuguauugcucaggcuagucuugaacuccugggcuuaagugauccuaccaccuuggccucccaaaaugcuggaauuacaggcaugagccaccacgccuggccgacaguguauuauuuuuauaauuuuuuuuaucauaaaaagguaacagcagcauugaaguuuguuuaaauggcaugccauuugaauuugaaauuauuuuuuaucuaauuccaaguuugaaaauuguuaguguguguuucuuuaaacacaugaacaauaaagcuuacuggguagacacacuguuuuuguucuaugugcacauuaguauacaaaguuuucaauaaauguuaaaugauaaucucaugguaacuuguauauauguuaaagaaaucuucaagcuuacgguaacuuucucuuguauuagcaaccuaaauaagcuuucaaacgcuguagaauaaauuuuuaacuuauuuucagaaaaacuuuacauuccucauuauauacuuucuuuuagcuuaguuuauaggcuuguguuaaucuuuauaauuuugucuacaucuguaugauuuagaugaauaaauaaccuuuuuggcugggcauaauggcuuaugcuuguaaucccagcaguuuggaggccaagguaggaggaucuuuuuuuuuuucuuguucuucuuuugagacagaguuucgcucuuguugccccggcuggagugccauggugcaaucucggcucacuacaaccucugccuccuggguucaagcaauuauccugccucagccucccgaguagcugggauuacaggcaugcgccaccaugccuggcuaauuuuguauuguuaguagagacaggguuucuccauguuggucaggcuggucuugaacuccugaccucacaugauccaccugccuuggccucccaaagugcugggauuacgggcaugagccaccgcaccuggccaggaggaucucuugaggccaggaguuuaagaucugccuggauaacauggugagacccugucucuacaaaaaauaaaaaacuaagugagcaugguggcaugcgccugugguccuagcugcuugggaggcugagguugguaggauuugagcccggagguugaggccacagugagcugugauggugccacugcacuccaaccugggcaacagagugggacccuguuucaaaaaaaaaaaaaaaguguuccacuaauuuuccuuguaaguuaaucuguaaaaaauuaaaaacaguaaaugaggaagaguugaguauaaauuauuuaggccauugauuucauuuuuacagaccuuaacacgugaacagaaagaaggagccuucuccaauuuuccuauuucugaagagacuauaaagcuucugaaagguaugcaguuugguuguuguuguuauuguuguuguuuugagacagagccucgcucuguugcccaggcuggagugcaguggggcagucuuggcucacugcaaccuccgccuccuggguucaagcgauucuccuaccucagccugcugaguaguugggauuauaggcgugugccaccaugcccggcuaaguuucauauuuuuaguagagacgcaguuucacuguguuggucaggcuggucucaaacuccugaccuccugaucuguuccaguuggguuaccaaagugcugggauuacaggcgugagccaccacggcuggcccaaagguuugcaguuuuaauggauaugcaauuaaaaaucuaucacuagauuuuguaaaacuccugugccuuuucugaccaaaaggagaacauaaaaagcauagagaaguagcucuucuuuaauugcacuuacuuuuacaucauccuuuucaauauucugccuuguuuuuagcuuuaagauuuauaugcauucgucaaaaguuuagacuaauuuuuuaguaaugcuuguuugugguaggaauaacugugucaccagguggcaugucuuuaggcagacauagaagaauuaugauugucauuuucaaaugaauauauuuuuuccuaaugcuagucguaaagaaguauuuuaauuaaaucucauuuuacaggucgagggguaacauaucucuuuccuauucaaguuaagaccuuugguccuguauaugaaggaaaagauuuaauagcucaagcacggacaggaacaggaaagacauucucuuuugccauccccuuaauugaaagacuccaaagaaaucaagaaacaauuaaaaaaagccgcucaccaaagguaaucguuauaggggguaaaagcuuuaaauguuacucuaacagaaagggaaagaaaguuacacgaguccuaaguucuaguacccccaaaauagaaaaguuagcgcuguggcauaaaacaaaaauauguuguuuuucacaaaaagaaauuucaagcaaaguuaaagugaaguaguuuuugcauaugaaugugauguguauggauccauagaugucuuugauaauuucaugaauuauaaagccgguauaucuuauuuacaguuuuuauauuuaguugacccuuuucuucucuuuucuucaguccugaccuuugcuuuuaaauaaaugaauuuucuaaagagguguucauuuauuugucauucaguaaauguucagcaucauuuauuucaguguuaccuuuuuuucccuuuaguauggaauacgucaugaauuuucaugucauccuugugcaggggucaugcuaaucuucccugugucauuccaauuuuagcguaugugcugcugaagugagcacacacagauggacuuuuuaagaagaguauuauagaaaugauacugcuaguuuauauauuauugggguacuagacaucuuauuuuauaaauguaaaaucaaccaacagagaggacuaguaaaauguaagccuaaaauuugaccuaaaaagcugugugcacuuaagguuuguaaaagugaagaaaaaaaucagcaucauaauaugaacaacuguaugacuaaaaguaauuuguucuuuguaagacuccugagugguauuauaagagcaaauuaacauacauacauaaauauaauuaaaucauaauagucuuggaucagcuaucccaaaucagguuggcuguguugacuuacaggauaaauauuuuuggagaguuauguuuuucgggugaaauuaggaaaagacugaaauaggacauaggauauaaucucaacacugcuuuuuuuuuguuuuguuuuguuuuuuguuuuuuuuaaagacagggucucucucuguugcccaggauggaguacaguggggugaucauggcucauuguagccaugaacuccugggcucaagcaauucucucuuccucucagucucuccaguagguaggacugcaggcaggugccaccacacuuggcuaauuuuuuauuuuuuguagaguuggggucucauucuguaguccaggcugguuuugaacuccuggccucaagugauccuuccaccuuggccucccaagguguugggauuacaggugugagccuccacgccuggccccaaagcugccuuaaaaagcuuuuguauuagaaagauguuacuggagauuccagcuccgccauuucuagguguuugauuuugggcaagacuuuaauucucugagacacaagucucucauuuacgaaaaugguggcauaaugccacucauggguuuuuaugagaaucaaauuagauaauuccuguaaagcauuaguuccuagcacauggugaacauucauucguuuaacauuuuugaguuuccuguacuguaccaggcacuguuugaaguguaaggaauacaguaacccaaccugacauaaauuccugccuucauggagcuuacauuuuauugggugagauagacaaucagcaaauaaguaaaauaucaguaucuuaggugguuuaagugcugaggagaaaugauaaagaggggcagggggauaugaaaaugggcuugggaaccucacugaagagaccugaaggaaguaaggggggaauguaauaaauacaugcugcuguuccuuuugcuauuugugaugugucuuuaaauacuucgacauuaauguugagauuccugguuuuaaaugcaccuaaaaaaagucuucuugguuuuaauuuagauaugucuuuagaaaaguaucuuuuuguuuuuuaaaccucuugcucagguacuuguuuuggcuccaacaagggaacuggcaaaccaaguagccaaagacuucaaagauauaacuaggaaacucagcguggcguguuuuuaugguggaacaucauaucaaagccaaagugaguaaauauguuugauagacgugcaaaggcauauuugauacucauauuuaaauaaauaaugugaaaguuugaauuuuacauauugguggcauuucucucuucucacaguuaaucauauucgaaaugguauugacaucuugguuggaacaccuggucguaucaaagaccaucugcagaguggccgauuggaucuuucuaaacugcgacauguugugcuugaugaaguggaucagauguuagauuuagguuucgcugaacaaguugaagauauuauucaugaauccuacaaaacugguauauccuaauucaaaauaagcacauuagcaauuauuguucgaucuuaaaugcaaacgaguuuuuauuuaauaauuuuuauugcaguguccccugcguucuaacaaaacuaaaauaauuugguaucuguucuguccuugaaaaagaaaguaugauagcaucauuuuaacuauuuucuuagcuuucugugcuuuauucuauuuuuuuauagucaguaguuagauuuacuaacucauuuuauugauuucuuuguucauuguuccugcuuaaauucucacuuuccuuuuggguucaguucucuucauauugucccccaguuuugcaaguugaaaguuuuaauaauugcaaugaagucuguguguuaaaaauucaccccaaguuuuacauuuuucauuauuuuuuugaagcuugggaggauuuuuaagagcgggcuacaucgugggaaauuaagaaaacauuugaauucuuuuuguuuauuuaagauucugaagacaauccucagacuuuacuuuuuucugcaacuugcccacaguggguauacaaaguugcaaaaaaauacaugaaauccagauaugaacagguugaccuuguuggaaaaaugacucaaaaggcugcaacuacuguggaaguaaguagcuuucuagcaugauagauuuuagcuuuuaguugguauuuacuuuugacauuuguugaagcuaaauuuaaguuuuggguaccucuucaugccuaaucuuccuuuucugcucuuaguaagacaccuauauauuuuuauagucugagacugaguagcagaauagaauaaauagggggaaaaaaagcacgugaauaggcaaguccuaauaggaaacacacaagcagccauagagacagauuugaaguguuucuuucuuucucucuuuaaagccgcucaaaaacaaaaacaaaaaacaaaauauuuacaacgugacaaagaaggcgauuuauauugacuagaaaagaauagugcggagauaauuuguuaaagcugaggugaaaaaaagauagauccucaucccauucccccaaaccaaaaaaauuucucaaagauuuaaaaaauuaagcuguaaaauaacuuaaagcagacguaggugaauaaagaguuuuuugauuucaggaaagggaaugcuuuucuaacauagaaguugggcugagcaugguggcucacgccuguaaucccagcacuuugggaggccaaggcgggcagaucacuugaggucaggagugugagaccagccuggccaauauggugaaacucugucucuacuaaaaauagaaaaauuagccggccugguggcgggccccuguagucccagcuauuugggaggcugaggcaugagaaucacuugaacccaggagguggagguugcaguaagcugagauugcgccaccguacuccagccugggugacagagggagacccugucucaaaaaaaaaaaaaaaaaccacagaagucagaagaagaauccauaaaggaaaagguuuauaauuuugacuccaugaaaguuaaaccaaugguauguuuaaaaaaagaauuagggccgggcgugguggcuuacgccuguaaucccagcauuuugggaggcugaggcaggcggauaaugaggucaggagaucgagaccauccuggcuaacacggugaaacuccauuuuuacuaaaaauacaaaaaauuagccggucaugguggcgggcgccuguaguuccagcuacucgggaggcugaggcaggagaauggcgugaauccgggaggugaagcuugcagugagccaagaucgcgccacugcacuccagcuugggugacagagcgagacucugucucaaaaaaaaauaaaagaaaaaaaaggcugggugcgguggcucacgccuguauucugaacacuuugggaggcugaggcgggcagaucacgaggucaggagaucgagaccauccuggccaacauggcgauaccucgucucuauuaaaaauacaaaaacuagcuggguguggugacccgcaccuguaaucccagcuacuuaggaggcuaaggcaggagaauugcuugaacccgggaggcggagguugcagugagccaagaucgugccacugcacuccagucuggagacagagugagacaacaucucaaaaaaaaaaaaaagaaaaaagaacuaaagguaauauuuaccguauuuaugacaggcaacuagguaacaugucaucuuucuauuuaauagaugcauauauauguguauguaggaaagacuaggugacuaagugaauaguaguaucugcagaauguaaugcagugguuaaaaacaaucagugauaaaaaccaaauuauacaaugauguauacaaaaauuacacuauuuuaaaaaauaaauagugcuaaauggauuccuuaggcauuuauguaaauauacaaacacagguugaaagaauaaacaucagauaaugauuacuucugggaaggggcaugcuggaugguaaaaagaagcuuugugggccgggcgugguagcucaugccuguaaucccagcacucugggaggccgaggcgggugaaucacgaggucaggaguucgagaccagccuggccaacauaaugaaacccuuucucuacuaaaaauacaaaaauuggcugggcauaguugcgcacgccuguagucccaacuacucggcaggcugaggcaggagaauugcuugaacccaggaggugauaguugcggugagcugagauugcgccacugcacuccagccuggacaacagauugagacucugucucaaaaaaaaaaaaaaaagaauaagaaaaaagaagcuuuuuuauuuuguaaugguugaaaguuuugcaguaagaauguaaaauguauaguaaaaaacaguugauaagaacauuuucaaacauauaaaauugaauaguaaauugaauagaaagauugaauaguauaaagaacaugauauacccauuaccuauuaccagucuuuaacaaugaucuuuucuucaccccugcauuugaaacaaucccagucaucauuuuaucuucaaguaauuguauguauuuccaaaaugauaacuaagggcucuuuaaaaccacagucauuaucaguagaagaaaaacaguaauuuuuuuugagauggaauuucacucuuguugccuagucugcagugcaauggugugaucucagcacgcugcaaccuccaccucccugguucaagugauuccuccugccucagccuccugaguagcugggauuacaggcgcccaccaccacaccuggcuaauuuuuuguauuuuuaguagagacuggguuuugccauguuggccaggcugguuucgaaaucaugaccucaagugauccgccugccuuggucucucgaagugcugggguuacaggcgugagccacugcgccuggcauaguaauucuuuaauaucauuaaauaccuagugugcacauugcccuugcugucuuuuuuaaauaguuuguuugaaucuggauccaaauacaauucuugacguugcuacugauugauaugcgucuuaaacauuuuauaaucuauaguuccuuuuuuuuucuuugcaauuuucuguugaaaaaacucauuuguuggccaggcgcaguggcucacaccuauaaucccagcacuuugggaggacgaggaugguagaucaccugaggucaggaguucgagaccagccugaccaacauagugaaacccugucucuacuaaaaauacaaaaauuagcaaggcaugguggcacgugccuguagucccagcuacuugggaggcugagaaagaagaaucgcuugaaccaggaggcggagguugcagugagcugagaucgugccacugaacucuagccugggcaacagugugagacuccgucucaaaaaacaacaaaaaaacucauuugccuuaugaguuucccacagucuguuuugcugauuugcaucccugugguuuuuauuuuuccuuauuuuuuuacuguuaacaccacucaaagaugugguggguuuucuuguuuguucguguuguguuuuuguuuuuguuuugagagucuugcucugucgccccggcugcagugcaguguggcaugaucucagcucauugcagccuccaccuuccagguucaagagauucuccugucuuagccaccugaguggcugggacuacaggcaugcgccaccauguccggcuaauuuuuguguuuuuaguagagauguaguuuugccauguuggccaggcuagucuggaaguccucaccucacgugauccaccugccuccggcucccaaagugcugggauuacaggugugagccacuguaccuggccuccccguaaguauuuuaacauacauaucuuuuuuuuuuugagauggaauuucacucuugucgcccaggcuggagugcaguggcgcagucucagcucacugcaaccucugccuccgggguucaagcgauucuccugccucagccuccugaguagcugggauuacaggcgucugccaccaugcccagcuaauuuuuguauuuuuaguagagauggcguuucaccacguuggccaggcugguucaaacuccugaccucaggugauccacccgucucggccucccaaaguggugggauuacaggcaugagccacugcgcccugccuauauauaucuuuaacuagagugccauauuuacaguuuuuuaaauugagguaaaauucacauaacuaaaacuaaccauuuuaaaguauacagugucauauaguacauuuacaguauacagccaucauuucuaucuaguuccaaacauuuucaucaccccagaaggaaacccaacaaccguuaaacaguuacucuccauucccuccuuuuuuuuuuuuuuuuuuuuuuuuugagacagaguuuagcucuguugcccaggcuggagugcaguggccuaauuuuggcucacugcaaccuucaccucccggguucaagcaauucuccuuacucagucucccgaguagcugggacuacaggugcccaugacuaaguuuuuguauuuuuaguagagaugggguuucaccauguuccccaggcuggucucgaacuccugaccucaggugauccgcuggccuuggccucccaaagugcugggauuacaggcgugagccacuauucccagccuccauucccuccuuucuuuauccgcugucaaccacuagucuguuuuuugucuguauggauauaccuguuuuggauauuucauguacagucaugugcugcauaacgauguuuuggucagugauggaccauauauaugauggcauaugcucgaugguggucccauaagauuaaaaugaaucuguccuauacagguguaucaguuuuuaucuuuuaugccauauucuuacugugccuuuucuauguuuagauauguuuagagacgcacauacuuaccauugccuacaguguucaguacaguaacaugcuguuuagguuuguagccuaggagcaauaggacauaccauauagccuaggugcguguaguaggcuauacccuagguuuguguaaguacacucuuugauguuugcguaaugaugaagcugccuaacaauacauuucucagaacauaucccugucaugaagcaacgcaugacuguaaauguaaucauacaauaugugacuuuuuaugucuuguuucauucacuuagcauaauguuuuugagguucauucauauaauuuuuauuauguacaaugaaauguaaaaucuuguguacauuugccuauuuuugaaaaauucauauguguguaacccaaaccuuuaucaucauaucgaauauugccaucauccuggaaaguucccucaugccccgucccagucaguauccccaguucagagacaaccacuguuugauuuuucuuccacaauugauugguuuugccuauucuagaacuucauauaaauggaaugauacuguaugugcucauuuucuguaagauguuauucggcauuuuuuuuaagguucauauuguuccauguauaucaguaguugguuucuuuuaauuguugaaugguauucuguuugaauauacugcaguuuguuuauucuuucgucaguuuauugaugaccauuugucuauauuguuuuuaagugcuguugaggagagucuuugucuuacagucucccaggaaggcuaauucuugaccagauagaaaaaauacacaagagaaauauuuuaaaauaauuuuaaugaaacaaauaaugugguauuuucuuucuucaaagcauuuggccauccagugucauuggucucagaggccagcaguuauuggagauguccuucaagucuacagugggucugaagggagggcuauuauuuucugugagaccaagaagaauguaacugaaauggccaugaauccacacauaaaacagguaagucuuuuuuucaugcuuucucuaauugaaauuauggggaugaaucacugaacgaaaauuauauuguccuuuguggaccagauuugauagucauucucaaaacugaguuguaaggcugggcaugguggcccacaccuguaauccugugaccugauaagucaggauagaauuuuaucaguuuuguuuguuugucuugagacagggucucccucuuaugcccaggcuggagugcagugggacaaucauggcucacugcauucuugacuuccugggcucaggugauucucccaccccagccucuugaguagcugggacuacaggugcgugccacaaugcccagcucauuuuuugcguauuuuguagagauaagauuucaccauguagcccaggcuggucuugaacuccugggcucaagcaauuccgcccuccccuuggccugccgaaaugcugggauuacaggugugagccaucacaccugaccucuaucagauuuuaucaguuuuuuuuuaagacuuugaaaaugugaucuggaaaauauaaaaguugaaacaaaaugaauuucuauggguaagagaggguaauauuuuagaguuguguuacaaaacuacaaauuuuuauuaaauuaauaaaucagaauacuaaauccauguguuuuuuucuuucuuaaaaaauaucuuuuggcugggcacgguagcucauggcuguaaucccagcacuuugggaggcugagguggguggaucgccugaugucaggaguucaagaccagccuggucaacauguugaaaccccaucucuacuaaaaauauaaaaauuagccggugugguggugggcgccuguaaucccagcuacucaggaggcuaaggcaggagaauugcgugaacccaggaguucagugauguagcggggagcugagauugugccacuacacuccagccuggaugacagagugagacuccaucucaaaaaaaaaaaaaaaaagaaagggaaaaaaaaaaccuuuuaaagaaaaugucaaacauggacaaaaguugguagaaucauguaaggaaccccuauguauucauccaccagcuucaguaauuauuuuaucuauaugcuaaccuaccuacucuuucagaaguauuuugaugcaaacccuggauaucauauuauuauauccauaaauguuugguuauguaucucuaaaaaggauuuucaaaaaaaaaaauaacaauacuguuaucacaucuaaaaaauuaauauuuagaaauauuaauucauuucacauuaucaauugucuuacaaaugguuauuuucuuuuauuguuuguuuucuugaaucugaguccaaauaagguuuuuacauugugugauuauuaaguugcuuuuaauauauggauuacuccuuuaugcauuuuuuguagcuuuuuuuguuugagaaacuacauugccauaaaucuagaguauugcuuccccaugaugucauuuagcauguuccucugucuuccauauuuucugaauauucagguuuguuuguuuguuuguuuagggcagaacuacuucauaggugguguacuuccggcaggagguauauaugucuaguucuuuuugugaugcuaacauccaccaauaaucagugccaucaguccuuaugucacugucucuccagucauuuuuguuguuugugacuuguuauuaaguagauuccugagaaagggcuuauggaaacaguaucgccuauugauaauaucuuguuugugucuuuauaccucaaaauuauuuuggcucuauauaaaauucuugguucacauuuucuuuccuucauugucuuaaauauguuacuuuacuguuuuuggaauaaagcaucgguauaaaaagugagaugccagucuaaucuuuuuuccuuauaugugauuuucuuaaaaucuuuuuucuaagugauuuccuuuaaaaaucgguaguuuuacuagaauauauuuuggugguguucuuugucaguuuuucuggguacgcaguguacacuuucaauuuguaguuucauauguauuuuuuaaaaguuucaacaaaauuuucuugaauuacaauuuuuagcauuugguuuuacaguugcuuugguuuucuucuuuaaggacucuuguugugcauauauugacuguuuguuuugaaucucccuugucacaucaaaucuuuuuccucuuuuuccuuauucaguuuucaaaauuucucucuuuuuuuuuaagagacaggaucuugcuguguugcccacaugggagugcaguggcuauucacagauguaaucauggcacuugauagcuuugagcuccuguagcugggacuguaggcaugcaccacuacacaugccucaaaauuucgcauuuuuaaaaaaucuguuguguuuauucagucuuuuacucuuucuaguauagucuuaauuugugaaaaguuaucuuuuauuucuacuucuuucuugaguuauuuuaucucauugaaaaacugaaaaguuuuucuugauuuuuguucuuuauuacagcauuaaaauuuuuucuuuuagcaggcaugguggcucacaccuguaaucucagcacucugggauucuaaguugaggauugcuugagcccaggaguucaagaaaagccugggcaauauagcaagacccugucucuacaaaaaauaaaaaaauuagccagaggugguggugugugccuguacucccagcugcucaggaggcugaggugggagaacuucaugaggccaggagcuagagguuacaaugagcugugaucgugaugcuguacucuaucuugggugacagaguaugacccuuucucucucuuuuuuuuuuuuuuuugagagucuccuauugcccaggcuggaguguagugguacaaucucggcucacugcaaccucugucugccuccuggguucaagcgacucuccugccucagccuccugaguagcugggacuacaggcgcaugccaccacacccagcuaguuuuuguauuuuuagcagagacggguuucaccauauuggccaggcuggucucaaacucuugaccucgugaucugcccgccuuggccucccaaagugcuggaauuaauuacaggugugagccaccgcaccuggcugaguaugacccuuucucuuaaaaaaaaaaaaaaaaaaaaauucuguuuguguguguguauauauacauauaaaacuuuaaaaacuuuuauauauuauuuauauauuuaauauauauaauauauauuuuauuuuuuuuucggagauggggucucugucacccaggcucaagugcaguggcaugaucuuggcucacugcagccuucaccucccagguucaagugauccucccaccucagccuccugaguaccugaaaccacaggugcaugcuaccaugccuggcuaaguuucauuuuuguagagaugggauuucucuaaguugcccaggcugcucucaguccugagcucaagugauccacuugccucugccucccaaagugcugggauuacagucgaaagccacugugcccagccaauauaugauauauauguauauuuuauuuuauuuauuaucuuuuaauuuuuuguugagacacaguuucacucuaucagccaggcuggagugcaguggcaagaucccggcucacugcaacccuccgccucuuagguucaagcgauucuuaugggucagccuccagaguagcugggauuacagguacacaccaccacacccggcuaauuuuuguauauuuaguagagaugggguuucaccauguugggcaggcuggucucgaacugcugaccucaagugaucguuuugccucggcuucccaaagugcugggauuauagacgugagccaccauacccggccauauauguuuguuugaguucauucacaaugguaugcuuuuauuuguuuuguggauaagcuuuucuagaucacuuuauuugaggagauagucugcuuuuuuuuuuuuuuuuuuuuuuuuuuuuuugagacagagucaagcucuguggcccaggcuggagugcaguagugugaugucagcucacugugaccucugccucccagguucaagcgauuuuccugccucagcauccacaguacuacaguagcugggauuagaguugcugggauuauagucgguggcaccacgcccagcuaauuuuuguauuuuuuguagagaugggguuucaccauguugggcaggcuggucuagaacuccugaccucaaaugauccaccugccuaggccucccaaagugcugggauuacaggcaugagccaccgugucugccaaaauuuuuuuuuuuuaagagacagggucccaccauguugccagcguuggagugccuuggcuauucacagacacaauaauagcacacugcagccucuaacuccuggccuuaagggaucuucucucaucagccuccugaguaacugggacuacaggcaugugccacuguucccagcuuauucugccucuuauuguuuuuuuccuuccuaauuacuuucugugagauuugacugugaucucuucuguugcucauuuuuaaauuaaguuaaacuuugaaccuuagaugggaaggcauuggugagaauacuucuggcgucacagcucuagagcugcugcuuuuguuauuuuuguuagugcuuaaaaauauagucuguaaauuauaucugaguaaagcuguuaaaaaaaaaaggucuacuuucuaguucuagcugugucuuuccucauuuuucucuguaucuuuuuuuuucuuugauccuguuauucuuggcauccuuaguuuagauccucuguccagcaguuucuccucaguauggggcuuuguccuggaaagugagcauuggcuguuaauuuagaaaguuuuuauagggcccagcuugcuccaaucccugcagaccuuaacucuggcuccucacaaucacccucaaguauauaaaaauccucccagguucagcugcuguugucaacaauuugagaauaugccuuccagguagcuuuucaguaugcuuucaagaugucagaccugaaagacugggucccugaaucaccuguucuuaggacuagcaaauucccccacguagauacaagaauuauccuucccugcucaugguuuuuuuuuuuuuuuuuuuuuuuuugagaaggaguucugcucuuguugcccagauuggagugcaauggugcgaucuuggcucaccacaaccucugccucccggguucaagugauucuccugccugagucucccaaguagcugggauggcaggcaugcgccaccaugcccaacuaauuuuuuuuuuuuuauuuuuaguagagacaggguuucuucauauuugucaggcuggucucgaacucucgaucucagaugauccacccgccucggccucccaaagugcugggauuacaggcaugagccaccgcgcccagccucugcuuauguuuuagaaaucaugagaccauuuugucaguuauuuguuacaugugucaucuguggauuuuuaguuuuguuauccuaguugauguguguuaugugggaacuagagacucaaagucacugucuuccccagugucauuuuaacuaauuguguagcauuagcuuugauguuuaaauguccaguauaggccaggcaugccuguaauucuagcacuuugggaggcugaugugggaggaucauuugaggucaggaguuugagaccagccugggcagcauaaugagacacugucucuauaaaaaguuaaaaauuagccagggccagcugcaauggcucacgccuguaauccuagcauuuugggaggccgagguaggcagauugccugagcucagaaguucgagaccacccugugcaacauggugaaacccggucuccacuaaaauacaaaaaauuagccagguguggugaugcacaccuguagucccagcugcgugggaggccgaggcacgagaaucacuugagcuagggaggcagagguugcagugagccgagaucgcgccauugcacuccauccugggcaacagagcaagacucugucuccaaaaaaaaaaaagauuagccaguugugguggcacguuccuguauuccugucuacuugggaggcugaggcaagaggauugccugagcccaagaguuagagguugcagugagcuaugaacaugacaccgcauuccagccugggcgacagagcgaaacuccgucucaaaaaacauaaauaaaauaaaauaaaauaaauaaaguccuuuauaaacagauagaugguaaauagugaaagagugguagaggguaauugauuuaccuuucuuuucguugcuuuaaaauauucaguagcgguugucuugcagaagcuguuuuuuaaucuugaagaaauugucuugcuacaaaggcugggggagaauuccccuuucaguggacaguaaucuguuucugugauuuggagaauggaauucuccauccuccauucugcugggugacuuugcuauuuagauagaaaguacuaguaguaucucauuaugaguuauaugggauuuuauggauuaacuacagaaucugaauaguuuuuuguuuuuauuuuuaaauuguaauuuacuuguaaaaagucaaguuuuacuugguuucccccagaaacaaaugccuucuaaauucuaaacagcuggguuugguggugcaccuguaaucccagcuacucaggagguuggggcgggagaaucgauuaagccccaggcaacacagcaagaacccacucucuaaaugaaugaaugaaugaaucauuaaacagucucugugucucacacagagauacacacacacacacacacacacacacacacacacuuuuggaaaaaaaaauuauucaaaaguuggagaccuggaaaccaucacugauaccaugaauguaguauguuccucuuaggacaaauuaucaaguaaaaaaaaccccuguguucuuuuuuuuugagagagggucuuacuccgucgcccaggcugaagugcaguggugugaucacggcucacugcagccucagucucccaggcuccagugguucucccaccucagccucccaaccagcugggacuacaggcaugcgccaccacaccuggcuaauuuuuuauuuuuuguagagacagggucuccuuguguuacccaggcuggucucgaacucuuagccucaagcaguccucccaccucggccucccaaagugcugggauuacaggcaugagaaaaaaaccuguguugcaauugaaaaauucacuaugaaaaacuguccaacuuauuuauaguauauuuguuuauaacuuuuuuucaaaaauuagauguuucuucucuugaaauauuuuucuuaacuuggguuauaugauaaccacacagguuuauuuucuucuuuggcuaaccuuucccaguuucuguugaggucuuuuuauauucuugucuauacuuuaaauauugguauuccuuacagaucugauucuuacucuacauauuuuucauggaggaaaaaagaauagugauuaauagcacagacuugggagucagauugggguuuaaaucucaguuaugcuacuuacuagcauaauuuuguacauacguacauaugcacacauacuuacguacauauauuguccugcuuuuaagaagugguauuucaaguaucugcuuuuggugaagaaaaaguaaauuaaaaaaauauauauuugccaagcaugguggcccaugccuauuagcccagcacuuugggaggccaaggcagaaagauugcuugagcccaggaauuugagacuagcgugggcauuucauuuauauaguagauauauuuuuaaagggagucuuaugcaugaauuaaacaucuuaaaauguauuauggaaauuguauaagcuuccuauuuaaagggauacuuuugagcuggccgccaugguucaugccuguaauucuagcuacucaggagacugaggugggaggaucucuuagcccaguauuuugagguuguaaugagcuaugauuuugccauugcaauguagguugggcgacagagcaagauuccaucucuuuaaaauaaaugaauaauaaaaggauguuuuugaaauuaaaagaauuucccugggaagccaagacaggaaaauuucuugaggccaggcauucaaaagcagcauggaaacauagcaagaaucugucucuacaaaaaauaaaaaaauugccuagguguggugggacacaccugugguccaagcuacugaggaggcugaggugggaagcauuucuugagucuaggaggucgaggcuacagugagcaaugaucaugccacugcacuccacccugggcgaccgagugagacccugucuccauaauaaauaaauaaaauuuaaaaggugguauuaaaaauuacuuucuuuuuuaccauuuuaagauuuaggugggccaggcacgauggcuuacaucuguaaucccagcacuuugggaggccaaggcaggaggaucacuugagcucaggaguuuaaaaccagccugggcaacauagugagacuucaucucuauauuauuuuuuaaaaaauuguuuauuuaaagcauuuugcguagugcauuucuuuucuugaagcaaggagucaauuaguauaggaauauagaaguauagauauguauagauaggucuaaucacuccuguggcuccagucauugaguauaugguaaugauacccaaaucuuuuucucacugggaucugccucaagaauacuagaccuacuagccacagacacaccaaccuuuauguuccuaaaccuaaauuaauuaacuuucuacacuccuauacccacucugucuccagcauucccuagggcuaaaucauacaucuacccauugcuuaaaccagaaauuuauguauuauucuugaauuuauuccuuacccuuggccauccagccaacuacauaguauuuuuggauuauaucuccuaugguuuaaagugucccauuuauuucuuuuuucuuuucuuuuuuuuugagacggagucuugcucuuucaccaggcuggagugcaguggcgcgaucucggcucacugcaaccaccaccuccuggguucaagcgauucuccugcgucagccucccgaagcuuguauuacaggcgugugccaccacgccucgcuaauuuuuguauuuuuaguggagaggggguuuugccauguuggccaggcuggucuggaacuccugaccucaagcgguccacccaccuccgucucccacaguacugggauuacagguaugagccacuaugcccagccuggucccuuccuuccuuccuuccuuccuuccuuccuuccuuccuuccucucucucucucucucucucuuucuuucucuuucuuucuuuccuuccuuccuuccuucuuuccuucuuuccuuccuuuccuuucuuuccuuccuuuccuuucuuuccuuucuuccuuccuuucuuuccuucuuuucuuucuuuucuuuccagauggaguuucacucuuguugcccaggcuggagugcaauguugugaucuuggcucacugcaaccuccaccuccuggguucaagugauucugcugccucagccuccugagaagcugggacuacaggcgugcaccaccacacccagcuaauuuuuguauuuuuaguagagacgagguuucaccauuuuggccaggauagucucaaucccuugaccucaugauccgcccaccuugcucucccaaagugcugggauuacaggcaugagccacugcgccuggccucuuuuuuuuuuuuuuuuuuugagauggagucucacugugucgcccagacuggagugcaguggugcgaugucgacucacugaaaccuccguccucugcccccggguucaagugauucuccugccucagccucccuaguagcugggauuacaggugugcaacaccauacccggcuaauuuuuguauuuuuaguggagacgggguuuugccauguuggccaggcuggucuggaacuccugaccucaagugauccgcccacuuuggcuucccaaaguacugggauuacaggugugagccacugugcccagccuggucccuuucuuccuuccuuccuuccuuucuuuuccuuccuuuccuuucccuuccuuccuuccuuccuuucuuuccuuuccuuuuuuuuuuuuuuuuuuuuuugauggaguuucgcucuugucgcccaagcuggaguacgaugaugugaucccagcucacugcaacuucugccucccggguucaagcgauucuccuaccucagccuccugaguagcugggauuacaggugccugccaucaugccuggcuaauuuuuguauuuuuaguagagacgggguuucaccacauuggccagucuggucucaaacuccugaccucagguaauccacccgccuugcccuuccaaagugcugggauuauaggcgugagccaccgugcucagccuucauuuauuucuuacaccaguugcagaagcuaaacaucugagaaucauguauaauguaucucuuuccuuuauacaucauuucuacucccuugaguauguccuuccaauuucaucaacuaauaguucuugaauucaguuaugguguagccucuagccucuacuuaccuuuccagccucaucuuacacuucccucucauuuuuucauuuugugcacacacuccauacaugccaugguuuuguuuuuuuuggggguggggagacagggucucacucugucccccagccuggaguacaguggcacaauggcuuauuggagccucaacugcgugggccaaagugauccucccaccucagccucccaaguagcugggacgacacguaugugccccuacagcuggcuaacuuuuuauuuuuuauagagauggaauauccuuacauagcccaggcugguauugaacuacugggcuccagccaucucccgcuuuggccucccaaagugcugggauuacaggcaugagccaccaugcuggucagcucuugaauuuguagucuaccuugccuagcaacuccuacucauccuucagaucucaguccaaagcaucacuuuuuagggaauccuuucuugccccaagcuaggucagauuguccucuuauaaagccucauugccucuuagacccgugcaucauccauuacauucauugucuaaauuuauuugugguccuaauuauuugauuaauguccaucuuucugaccaggauauaaagacuaugaggacagaagcagucuuauuuuuguucaccuuuuuaucccuagugcccaacauguuguaggucauuauuauauuuguggaguaaauagguggucauugccaccaucuuaggccaccgauaaccucuuuauuuccuuuuucagaaacagggucuugcucugucacccaggcuggugggugggugacggaucauuaaaaaaaaaaauauauauauauauauauguauauauauauauauacacaaacacacacacacacaauuuuuuuuuugagauggaauuuugcucuguugcccaggcuggagugcaguggcacagucucgggucacugcaaccucugccucccgguuuccagugauucuccugccucagccucccaaguagcuaggauuacaggcgcccgccaccacacccggcuacuuuuuuaguagagacggggucucaccauguuggucucgaacuccugaccucaggugauccaccuaccucggccucccaaagugcuaggauuacaggcaugagccacugugccuggucguauaauuuaauauguucaugauauuuuucugcuuauaaucauucaguuguuucauauuguccucaggauaaaguucauauucuauuccaaucucaucucucacucccuaaccccucauccccgcucccuuuucagucuguuccagcagugcucaaauauuuguagguuccacuccccauucuuuauguaugauauuucuucuaccaggaacucccuagccuucugcuccuucuuuuaccuaguaguuccuuaugauguuaggucucagcuucagugcugcuuuccccucaaacaagacugaguuagauuucccucuuaaguauuccuguaacacucugaaccuauaccugugauagcacacaucauacuguauugaagaugccugucagcugguugucccagagccauuucuuuaugaauguucuggaaccagguauaauccaggcagauagcaagugcucacugaauucauucauguauauguuaagcuauuuagauaccaaggcugaaauacuguugggguuaaauuacuguuaugaacuucuguuuuuugagacagagucucacucugccacccaggcuagagugcaguggagcgauuacggcucacugcaacuuuuaccuccuggguucaaaugauucuccugccuuaaccucucgaguagcugggauuacaggcaugcaccaccauaccuggcuaaucuuuguauuuuuaguagagaugagguuucaccauguuggccaggcuggucuugaacuccugacuucaagugauccacccacgucagccucccaaagugcugggauuacaggcaugagccacugagccuggccugaucauuguuaugaacuuuuugacuuuaauauaguggccaggaauacuaggaaguguauuuauaauaccaggaaauuugcagcagagaugaagaucuaccuaauauaaauagguucagugucacuaaugcagcagagaugaagaucuaccuaauauaaauagguucagugucacuaaaaauuacagacauguaaauuaaaacaacauugggaaauuauuuuugccuauuaaauucacaaagauuacaaugauuuauaauauacacaagcuggguaggguauguugaaauaaauacucauagaguauugaagaauaaaagguacacaacuuuuuuuauaauacaguuuuuuaaauaauacaguuucuguuaaaaugcuacauguucauaauuuuugacccagaaauucaacuucuagauauguauccuacugaaauauacagauacugaggcauccagagauacaaguacaaaguuacaaaguuguucauugcaacauuguuuguuuguuuguuuuuuuuuuuuuugagaugaagcuucacucuugucccccaggcuggagugcaauggcacgaucucagcucacugcaaccuccaccucccggguucaagcuauucuccugucucagccucccaaguagcuggaauuacaggugccugucacugcgccuagcuaauuuuuuguauuuuuaguagagacagaguuucaccauguuggccaggcuggucucaaacuccugaccucgggugaucugccugucucggccucccagagugcugggauuacaggugugagccaccaugcccggcccauugcagcauuguuucuaaaggugaaaaugugaauacagcccaaaaguucaucaguaggauauugcuaaaauagaugcuggugcauccauaugaauaaauuauauacaguuuaaaaaaauuaaguagcauuuuaucuauagauguggauagcuaagauacacuaaauuuaucaaguagguuacaaaacccuaccuauguaauauccacguuauaaauaaauacauaaagucauaguauaugcuaguguaaugugaguauguguguauuaaaaaaaaaaaguggccgggugugguggcucacgccuguaaucccagcacuuugggaggcagaggcuggcggaucaccugaggucagcgaguucaagaccagccugaucaacauggugaaacccuguuucuacuaaaaauacaaaaauuagcugggcauaguggcaggcaccuguaaucccagcuacucgggaggcugagguaggagaaucgcuugaaccugggagguagagguugcagugagccaagaucgcuccauugcacuccagccugggcaauaagagcaaaacucugucuaaaaaaaaaaaaaaaucugacagaauauuuaccaaacucuuagcagugaauuauuucuaagucacuaguauuagggaagcuuuuacauuuuauguuaaauauuuucugucauguuugacuuuuuuuuuuuacaguaagcaugcauuguuaaaaucaucaaaguaagauuuaaaaacaugcaaaaggagcacagacuagauguuguugugcuaucaguugcaaguaugagcuguacacuuaauuuucucccccuuucucaaauagaaugcccaguguuuacauggggacauugcacagucacaaagagaaauuacacuaaaaggcuucagagaagguaguuuuaaaguuuugguggcaaccaauguggcugcccgugguuuggacauuccugaaguugaccuggugauucaaaguucuccuccucagguaggaaaugggauuugauuugggaaaaauaagagcaauuuuauaaauucccauuuaauuuacaacauauugcuugggaugugaaaaauaugucaucucuucuugcucuuagccauuuuuuguuagugugcuauuaaauuuaucagauucugauacuuuugcagaugauuaacucuauuguuuguauuugaagcauggagcaacaaaaucaggcagagaauuacaaaaaguugccauaaagaaaccugggaugagguggauuaaaagguuuuaaaucauauugccuuuaccccaaaauccacacauauaaauuguuuggaauguugaaaagggcaacaggauugaaauaaauauauuauuauuaacauuauuauuuggauuccggaaugacugcaacuugcuagauuuuuaaaaaauauuaccuuuuauaaucuuuaggauguugaguccuauauccaucgcucuggacgcacagguagagcuggacggacagggauuuguauauguuuuuaucaaccaagagaaagaggucaacuaagauauguggaacaaaaagcaguaaguagaguuaaauuauuucaggcuuauugucuaaauggugccuuaaaagagagcucuucuuauauuuauucuuacaaguaggucuucauaacuuuucucaguuuaagcugcauuuggcugugaagccuguggagaucuaaauuuauauuagcuucaagacuuuaauacagcuuuuauugugaagacaguggagcugacuuucucaucuuuuccuugaauuucucucuucauacuaaaaucagaagugcauugugauuucaguacuucuuaguguaaaugggugacuaaaagauugucuugguauaauaguuaagauucuuuuaaguaugguacaauagacaguuucuaaagaaacuguacauuuucuguggucuggauuuuuugugguauuucacauuuuuuccuauuuuuauauguguuuuuauaugcaauuucauauacuuuguaaaaugagauaguguaauaaggaaaaaagcugauagauuuaaacaucuguuuuguuuuguuuuuuuuucaaaucaggcuuguuuuacaagugaaauuccaugauuguaacuaaggggcaauucaaaaaauuauuuuucucuuucugaaauuuguaauugaugauuuaugagaaaaaaaagaucuuggcugggugcagucacucacgccuguaaucccagcacuuugggaggcggagaugggcagaucacuugaggucaggaguuugagaccagccugcccaacauggugaaaccccaucucuacuaaaaauaccaaaauuagcugggcauggugguagacaccuguaaucccagcuacuauggaggcugaggcaggagaauugcuugagcccaggagguggagguugcagugagccaagaucacgccacugcacuccagccugggcaacagagcaagacucugugucaaaacaaaaacaaaaacaaaaacaaaaaagauaaaacugaucuuuuaaucugcuagggcuaugaaaucuuuaaaugcaagaaauagaaauucaacgaacuauuaaaauauuaauuuaggaauuaauuguaaagacuuccauuuuucuuuaauguaacucuuucauuuucagggaauuacuuuuaaacguguagguguuccuucuacaauggauuuaguuaaaucuaaaagcauggaugccaucagguaugcuuucugaacuugcugaauaauuguuucuuuuguauuaggcuauucaucuguaagcucucccaguucaaauagcagaaaauuuuaccaccaguuuuaccagcagacauuuaguuauauuaaaauauaaaacaguggcucaugccuguaauuccagcacuuugggaggcugaggcgggcagcucaugaggucaggagauugagaccauccuggcuaacacggugaaacccuaucucuacuaaaaaaauacaaaaaauuagccaggcgugguggugggcgccuguagucccagcuacuugggaggcuggagcaggagaauggugugaaccuggggggcggagcuugcagggaaucgagagugcaccacugcauuccagccugggcgacagagcaagacucugucucaaaaaaaaaaaaaaaaaaaaaaaaaaaauauauauauauauauauauauauauauauauauaaaauguggcugggcacuguggugcacgccuguaauuccagcacuucgggaggcugaggugggcagauugcuugagcuuaggaguuugagacuagcuuggccaacauggcgaaaccuugucucuacaaaaaauacaaagauuagccaggagugguggcgcgugcaccuguagucccagcuacuuggaaggcugaggugggaggauugcuugagcccgggagguugaggcugcagugagccaagaucgugccagugcgcuccagacugggugacagagcaaggcucuaucucaaaaaaaaaaaauuacuccuucuuuuucccauuuuucuucuuaucuuuuauuuuuucccuaugucuugaccaagaauacuauuuuuaaaccauaggucucuggcuuccguuucuuacgcugcuguugauuuuuuccgaccaucagcucagagacugauagaagagaaaggugcaguggaugcauuggcugcagcuuuagcccacauuucuggugcaucaagcuuugaaccacgaucuuugaucaccucugauaagguagaaaucugugagaaaauuguacaugagugggaaaagguuaaaauugaacauaggaaauauuguagugaauuauugugcuuuuugugcagaaaaaaacuguuuugcucuaugagaaacuggucuccuuauuuuccucuacucccuaauaaauccuuuuuugacaaucaccucuuccaaauuuuucaaacccacagaaaaacugaaagaauaaugcaguaaccacauacgauccaccuagauucaacuguuaaaagucuguaucaugugcuuuauauccuuuuuuagcucuaauuuguaauuaaaaaaaaaaugacauguaauaauuguacauauuuauaggguauguggugauguuucaguacauccguacauaccauguauagguaucagaucaggaucauuagcguauccaucgucuaaacauuuaucauuucuuuguuuuaggaaccauucaauaucuuccuucuugcuuuauaacuuuauaaguuuuuuuuuuuuuuuuuuugagauugagucuuguucuguuacccaggcuggagugcaauuacgugaucuugguucacugcaaccucucccucccggguucaagcaauucuccugucucacccuccugaguagcugggacuacaggcgcacgccaccaugccuggcuaauuuuuguauuuuuaguagagacaggguuucaccauauuggucaggcuggucucaaacuccugaccucaggugaucugcccuccucagccucccaaagugcugggauuacaggcgugagccaccucacccggccuguauuuuuuuucuaaaucauuugaaaguaagucgaaacaccgugauaucaucccuaaauauuucaacaugcauccucugagaauaaggauauucugcuacauaaccacaauauaauaagcucaucugugaaaauuaaugauaguucuguaucaucaucuaauauuuaguuuauauccauuuuuuucucauuauccugaaaaugucugucugucuggguauuuggagagaaauauaggaaaugcucacuuugcacagaccuuuguuaacugaaacuuguaucccagaaccuacauuucauuuuguaaguuuccauggaauccugcaaaguaagaaauagacucugcacaauuaacacaguagcaugcaaaguaaguaagaaaugccuguguguguguggagggguuguguaaguguaacaccaucugaacuggccugcugccagauucguaucacaugucaaaacauaccacaccagaaccauuggugcagguagcucagagauuuuuuacuuauucaaguauaagugaggggaguuucuuggugaagagaauuuuaaauaagaguucuguuaugucugaguggagagagugagugagcgaaccugguccuggagacaucuauaagacuagagccugcuggugggauuuucaaauaauaacaaaacagacuaauuugggcagcacaucccugugauggggaggaggaaacaaaaagggcagggcagguucacuuggaugugacuuauuugguguagcacaaaugaaugcugcugggguaucugaugguuucuaccugguagguguuaauaguuuagcuaaaugucauuuugcuuugagugacuuauugggcuccauuccguuuauccauauguguacauauaccuauuuguauguauguuuuuaaaaauucaggaccuaguuaaguuuuacauguuacauuugguauuaugucucuuuagucucuuuuagucuggaacuguuuucucaucuuuuuaauuuuuuucugauauugauuuggugaagagucuuggucgguuguuugguagaauaucucacugucuggauuuguccgaaucucuucaagcaucauuuaacuuuugccuuuauccucuuuuaaacugaaaguaauaucaaagcuugacuuuuauauuuaggugaaauguuuuuggcaaggguacuuuauaguuaauauguaccucauauugcaucacaucaagaggcauaaaauguuagguuguuccaguacuaguaaugcuuaauuugcauuuguuuaagauggaaacugccauauuguaaagguguauuuuacucucuguaauuaguaacuuguggggugauacuuuagcauugagcagauauccuaucccuaguaacccaccaaaugcuuaagacaguauuuaaaacauauuucuuuagaaaauauugagauuugagcuaagaaguaccuaagaaguuauuuagucucaacucucauccaaugaagaaucccucuuuggcagaugggucauuuaaucucugauuaaauaucuuagaaacaggguguuaguggcuuuaaauuucuuucauggguuaaaccaaaauccagucuuuaucaggaauguccuauaggcuuuuccucuugcuaucuucuugacgucaugucuuaucacucuccccuuucuuauuucagccacccuaaccuauuugguuuuccucagacauaaacuuaacuauuacacaaggccuuuguacauacuuucauugucuugaauguucuuccccucuaauaaccauguugcuuccuccuuuacuucauucuggucucugcucaaauaucauaccagagaggucuuucuugaucacucuaaaauagcuuacuccucccuauacucuuuguucccuaagcccugcuuuauuccuguucgugacgcuuauuacuauaugauauuccauauauuugcuuuuuuguuuacuguguacccccccacccaaccccacauacagguguagguacaugcacaugcacuagaauuuacuguccaugagagaaaggacuacuuacugcugaaucucuagcaccuaguacagucuguggcacauacguagggcgcacucaauaaauauuuguuugcugaaugcauccccauaucuucuuaauguugauucuuuugcuguuagugaagcuuuacagaacaaauaauuuuugcuuauguaacacuccuucaaaaguuuaaagaaauuguucaggcaugguggcuuaugccuguaauccuagcacuuugggaggcugaagcaggcagaucacuugaguccagggguucaagaccaaccugggcaaccccgucucuacuaaaaauacaaaaauuagcacggcaugguggcacgcaccuguaguuccagaugcuuguggggcugaggugagaagacugcuugagcccagaagguugagggugcagugagcugagaucgugccacugcauuccaaccugggugacagagcgagacccugucuuaaaaaaaaaaaaaaaagguuaaagaaauuuauguuguauuuacuuuuuauuuuuuuuuugagacagggucuaguucugucacccaggcuggagugcaguggugcaaucucggcucacugcaaccucugccuccugggcuccugggcucaagccucccaaguagcugggacuguaggaguaggccaccaugccuggcuaauuauuauuauuauuauuuuuguagcaaugguuauuucaccauguugcccaggcuggucucaaacuccugggcucaagugacccucccgccucgguuuccuaaagugcugagauuacaggugugagccaccacacccagccaagguuuucguuccaagcugacuuugacuccuucaacauuuccuuaauucuucacuaccuuguugucuuucuuggcucugguuugcuuaauucuuaauucucucuuaaagcauaaugguuagaauuaaauagagucuuacagcaauacauaggauaguacuuucaauuaucuauaaacacuauucuucuaauaauguaguuucaaaaaaauuuuuuagcugcaauguuauacuuuuggcucauaagaaaugcacaguuaagucuugaaggauuauagaguuagaauuucauuguacugcugcugauuuauuuccaaacauaaugugguuuuuauuccuuaagggguuugugaccaugacucuggaaagccuagaggaaauacaggaugucagcugugcuuggaaagaacuuaacagaaagcugaguaguaaugcagugucucagauuaccagaaugugccuccugaaaggaaauaugguaggcuuuuccagacaauuaaaaagcuuuuuaaucaacuaccccaaauguuuacaaacacuagcaaauuuuguucuuucucuuugaagccuaauggcaugaauaaugcuguuuuuucucuguuaguuuguuuccaguuauaaauuuggggcauuauauauguaacccauuccuccagagcuguaagucauucuguucaguuugacuaucuaauacccaaauuaucuaaguuucugccacauacuguaugugguuguguacauguguuuauucucuuuuuauuuuuuaaauuuuauuuauuuacgacuuuauagugaugaggucucacuauuugcccaggcuggucuugaacucuggggcucaagugauccuccuaccuuggacucccaaaguacugggauuauaggugugagccacugcaccuggccuuuuuguauuauuauuauuauuauuuuuauuuuugagacagaguuucacucuugucgcccaggcuagagugcaauggcacaaucucggcucacugcaaccuaugccuccuggguucaagcaguucuccugccucagccuccugaguagcugagauuacaggugcccgccacuaugcccagcuaauuuuuguauuuuuaguagagaugggguuucagcauguuggccaggcuggucucgcacuccugaccucaggugauccucccgcuucugccucccaaagugcugggauuacaggcgugagccaccauacccuguccauguuauuauuauugugauuauuauuugguaaagaugggauuuugccauguugcccaggcuggucuugaacuccugagcucaagggauucaccugccucagccucccaaagugcugggauuacaggcuugagccacugcaccuggcauguguguuuauuuuguaagacuaaguagcuuaugauugcaguaguuaaacagcucuauaauuuugaggacaugcaguuugguuuuuaaauggccugcucuuuguuguuaaugaauuaaugauaugaauuaaauaaauacuuuaauacauuuauauagcaaaauuaaaacuguaaucuugugacugauuucuucuaaugguuuugaaaaaugauguuauguuauuaauuuaacuuuacugcauagguucauucuagcuuggaauuuauuaacuagauuguuuauugcaaauaaucaucucucucaaaguuuaauauuacuugccuuguaaaaggauguggggcaaguaugagacaaauauauacuuucaggaaaaaaauguagaggggagggaaaaaauagcaagauccauaggccaaacuaguugcuauacuugaguauuaaauuaacuuucagcuuauugacaacuaagaccauagaagaaacaucuuggguuauauaauucuuauuaucuaacaaacauugcagcuuuuuucuuuuuuuuuugagacagggucucacccugucacccaggcuggagugcaguggcgugaucuuagcucacugccaccuccgccucccaggcccaagcgauccucccaccucagccuccugaguagcugggacuacagucaugcaucaccacaccuggauaauuuuugcauuuuuuuuguagagauggaguuuucccuauguugcccaggcuggucuugaucgaauuccuggacucaaacaaucuguccaccuuggccucccaaagugcugggauuacaggcaugaacuaccacgccuggcccauuguagcucuuuguaaaugagacuuucuaucauuaaauuuuaaaagaaauuuauuagaaggaucauuuuacaagggacauggaacaacauauagggucuacacaaacucuucuagagaauacuguagauucuuagcaguaguuguaaauucuuauuggauacuguguuuaguuacuuuuuaaauuuagaaaauacauuaagcagccacugagucaugcauuauuaguaaaacaaaaaaaaucuacacauaugcaucuaauuuaaaauguuuugcuuuguuuugcuuuuaggguguuugcuuugauguuccuacaacugagucagaaagguuacagguauuuuuaaaauuuuaucuuuuaaaugguugaguacauucucuaacauuuagauugggauauuuugggaaacauagucacaaugucauuaucaugccuaaaucaaugaggaauuccuuaauauaaaauaaccagucugucucaaacuuaaauuuauuuuuaaagagauggagucucucucaggcuggagugcaguggcacaaucauagcucauuugcaaccuugaauuccugggcucaagugauccucccaccucagacucccaaguagcuagaacuacaaggcgugugccacuaugucuggcuaacaugagccaccaugcccggauaauuuuuuuuuucuuuuuguauuuuuaguaaagaugggguuucuccauguuggucaggcugggcugaaacucccgaccucaggugauccacccaccuuggccucccaaagugcugggauuacaggcgugagccaccgcuccuggcccccugccuggcuaauuuuuuuaaaaaauuuuuguagaaacagagucuguagcacagguuggucuugaacuccuggccucaagugauccucccacuuugaccuuccaaaguguugggaauauuggugugagccaccauacccaguaaaaaauuuguuauuauaaaucauuucaaacauauuuuuuagaugagggacuuguauaaugaaucuccauguacccaacacucagcuucaacaauuaucaguucauagccaguuuuguuucauuucuguguccaucuacuuacccacuuuucugcauucuuuugaaauaaauucuagguauucuaucauuucaaccauaaauauuugcauauuucuaaauauuaaugacuuuaaaaaagaccuuaucauaauaccauaauuaaacucccccaaaauaauuccuuaauaucauccaauuuuauuuaaauuuuuccauuuguuuccuaaacuuuuuaaauacaggguccauaaagcucauagauuguaauuugauguuucuuaagucucuuuuaaucuauagguucuuccuccucccucucucucuuuuaaaaaaguauuccuguguauacuuuacuguguaaaguaucuuuaucuguugaagaaggaaguugucuacuggauucccauaaugaagaauuugucuauuguaucucaguacauacuuauauaccuacuuugaaacaaaaaugaguauuuugcuuucgaagucuuuuuaaaaauucagaauauguuaaagacacauuuuugugucaauaacacaguucuuuuuuucuuuucuuuuuauauuuuaauuuuuuguuuguuuauuuugagacagaaucucgcucugcugccaggcugcagugcaguggugugaucucagcucacugcaaccuccgccucccggguucaagcgauucuccucccucagccucccgaguagcugggacuacaggcaaaugccaccacgcccagcuaauuuuuguauuuuuaguagagacgggguuucaccauguuggccaggauggucuugaucucuugaccucaugauccgcccgccucggccucccaaagugcugggauuauagucuugagccacugugccuggccuuucuuuuuauauuuuuaaauagagauggggucuugcuauguugcccaggcuggucucaaacucuuggucccaagugauccucccaaaguauuggguucacaggugugagccauugcacccagccacaguuacuuauuuuuaaugacucccaggcauuuggccauuuggguggcugguuuucuuaaccaguguccuauuuucugaaauuuagauuauuucuaauaauuuacuauuauuaggacugcccuaaacauugguauagcgaauucuuuaugcauugccauguuuaucucuuuaagaugaguuuuuaaaugugauugcuuggccaaaagguuugugccuuuuuuuuuacuuugguuauauauugccaaacccaccaguggaauguucguuugucuuuucccaaaaaguaccaguauuggaaagaaagauagccuuagcaacagggugucuuaauaacaacauuuuuuuuuuuucuuugagacaagagucacucugucgcccaggcuggaguguaguggcacgaucucggcucacugcaaccucugccucccagguucaagcaauucuccugcgucagcuucccgaguaacugggauuacaggcgcccaccaccaugcccggcuaauuuuuguauuucuaguagaguuggaguuuuaccacguuggccaggcuggucucgaacuucugaccucaagugaucugcccgccucggccucccaaagugcugggauuacagacaugagcuacugugcccggccaauaacaacuuuccuugccaacucaugaucacaauaaggaacaguuaguguagcaagauauaaaauagugaugcucuuauggguuacugauuuguauaucuucacuuguuuacuccaauaucaaaguguuuccaguggcuacauuuuuuaguccuuggcugguguugacuuguauuuaaucuccaucaugggcucuuuuacuuuuugcuugucaguauaccugcugaaaacaacgcacuacuuauuaauggccugucugcuuugugcugagauaccaaauagugcuguuuuagaauguagaaacugaguauaauguauauuuuuguacauuuauuuaauuaguauauuuauuuaauuaguaauacauaguauaguuuuagaauguauauuuauuagaauagaauauauuuagaauguuaguauuagaauagaauguauauuuagaauguuagaauuuauuuagaauguauauuuagaauguauauuuauagaauguauuuaauuaguacauguaauuaguaauacauaguuuaauuuuagaauguauaaacugaguaugaauuuaugaucucgaaaauugaaaauauuuuugcuuauuuucugguuuucauuuuuguuccagauacguuaacagaauagauggccuuuagcuaauagauaugaaaaaggugucuucuuguacuuaacauguuugcuuaugguuucuauuuugcauuuauauuaauccuguaaauuccccuaacaggcagaguggcaugauuccgacuggauacucucagugccagccaaauuaccugaaauugaagaauauuaugauggaaacacaucuucuaauuccagacagaggaguggcuggucaaguggucgaucaggccggucaggccggucagguggucgaucuggcggccggucagguagacagagucgacaaggaagucgcucaggaagucgacaagaugguagaagacgaagugggaauagaaaucgaucaagaagugggggccacaaacggaguuuugacugaguauuugauaguuaaucuaccagugugagcuugccuauuucugccuaaucauguacauuauccaccaaaaauuaggucaucauaguugagguaugugucugcuauuugcaaagaaguuggucguauuuuuuuaaaaaguauuucacaagaauggaacaaaucuacuuauccaguuauaccuuugaauaaaaaaaccuccuuuuauugucucuuuuca

SEQ ID NO: 192145 - RNA, 30102 nt, Homo sapiens
gcagcgggccuggcugcagaugcggugguggccgccgagcgccuggaaggagcugcuggacaggccgagggagccuccgcccgagaccgcgcagccgccgccgccauggguaaggcgagcgggccgaaaccgaacgcuaggcccucagucccgggcugagggccgcggccaggcgggguggacugggagcugggggagacgccgaggccgccagucggaacuggggcccgaacccaggaugggcggggacugccugggacucgggggcucccggggucgucauggcaacgcgcccccucccuuguuccggcccguucccgcccggguucugaggcauaguggccgagggcucgaggugccacggcguccaggagcgaggacagggccaggcagggugucacucccgggucggggagcaggcggggaggggcgaugacuuuucagguuuggggguggcggagggaagacgcaucucagguuuuggccugggugccugacgccgagggcgggagacggggaaugcugacgcgcaggagccugggugagcccgccgcgaugguccuggggggcccccaggccucugggcagccuugcuggggggagggggcaggaagagaggcagggaaggggcucuaggccccggcaaggugcgggcacuggcccugguacuccuugcgcgccugcggccggguuugggggucgcguacgggccggagaaguccuguagcgcagccggggcguggccgcggugugaacgccccucggcgugggaacugccggugcccagcaccgaucugccucccagcagcugcaaaacacccuuugugugguugucgcaucgcacguuaggaauuaugaugggcuguguuaaaaaugagaguugccacggauuaugaaacaugaagugguuucacucccgaaaaauagugggagucagaccacgaugcagauuugaaggaauucguguguggacauuuuuccaccaggcaguuuggccauagcaguuguggcuguuugcauuuuagguugcuuaggauucagugucaggcuucaugccuagcuaucuagaaaucggagcuggaauacuagaucauuggagacucuggguuuuuuguuguuguuguuguucagugaaggaaaaacgggcacauugauuacuuguaaauuugucagagauuaugaaauguuauacuaagugcuucguuuuuccacaccuuaguuuugucaucuguguuuguugaagguauucccaccagucacaacagugaugagaugauggggaagcgucugaauuucuaaguaaacugagaauaaaauuugcgggaaggaggacaauauuuuugugaauugaaaauaucuuacuugaugauacugugucuuaaaaauaucaauuaaaaaucaggccuuuuagaauuugcaucuauuaacuugguauucagacuggcgcugugggcauccucaacuguguggaugggugaggaacauuaauguaaaacuggucucugcuuuuauuuucucuuugaaaauaaaacagucaugcaauacagaacuacagucagaaugaagaagccagacagaaagaggguagacgaaagaauuggacggcuucuucuguguccccuugucaguguauuuuaccugucauguuuguuguggaugacacuggaauccuagaauuuuaacuaccuuuuauuuuauugccaguuuauucugaacauuuuugccuuggaauucauccuaagaccguaccugcuaucuaccuuuugcaugaggcccuuaaaccuguugucucucaccccaaauuuaucuccauagaagaucauuuuaaaaaacucauucucuaugaagagguaccaggaaaguuaaauacaggagaauggcagauuugcaggaucuugagaauaauucauuaacuuuggcuggaguggucauggaaauuuucuuuuuucuuucuuucuuucuuuuucuuuuuuuuuuuuuugugagacggagauucgcucugucaccagauuggagugcaguggcgcuaucucagcucacugcaaucuccgccuccuggguucaagugacucuccugcuucagccucccgaguagcugggacuacagccgcgcaccaccaugcccagcuaauuuuuguauuuuuaguagagacgggguuucaccauguuggccaggauggucucaaucucuugaccucaugauccacccgccuuggccucccaaagugcugggauuacaggcgugagccaccgcgccuggccggaaauuuuuuacaguauaugugagagauguaaagagaaguuaaucaagggugugguuuagcuggggagaauuugucaaccaaggaacagcaaacuacuguugguuuuuauaggggaagggaaugguuuguauauuuuucauugucaugucuuacaaaugauguuggauuccuuucuuguguuuucagcuacaaaagaccccacagcuguagagagagcaaacuuguuaaacauggcuaaacugaguaucaaaggacucauugaaucugcucugagcuuuggccgcacuuuggauucugacuauccccccuugcagcaauucuuuguuguuauggaacauugccugaaacacggucuuaaagguaucaugagauuuuaaaaaauuaauucauuuuagaauuuccguuuuucaagugcccuugagaauggguuauuuuuugaggccauaauuacguuacugugcacuaaaaaauauugaguggauugauuuugggagaaaauaucuuaugacuauguuuucuaauaauggaauaauaaauggucuucagaaaaugcuuaauuguuaauauuuuguaaacagaauauuugauuuuuuaauuuuuuaaacacauaaucugaauuauuuuguuuucuaggacaauuauagaguuauuuuuuaaagcuggugauacuguuaugagcucauauuaauaguucgaacccuguugaacaacugcauugaaauaguggauuguugaaauagaaaccuccuagauauauacacgaacauauguagaaauaucuucuggauggaguuauuguagaaaugugagccaucccugaagaugauaacagcagauauuguacuccacucucaguacauauugaauuauuguuacauauaaaauguugguuuuauauuuaauuuaaaaauauucauugcauaauaacugugcuuuuacuuauaauaacuguucacaguuuuggccucuaguucauacgaugaguaucuauguagagggcuauguaagaguuguacacuagagugacuauuauagaguaaaagaagcuugacuggccagacacgguggcuuaaugccuguaaucccagcauaugccuguggucccagcuguucgagaggcugaagugggaggaucaccuuagccugaggaggucgaggcuucagugaacucugaguguagcacuguacuccagccuggacaacagagagagacccuuucucaaaaaaaaaaaaaaaagauucaaagauuuaccuaaacuuuguuuuaauaaaaaguacuucaaaacaagaaggaagccuugacaucaaaauuugagaaauccugugugauguuauuagcauacucauuucuuuuucuuuagagacuuaaagcaauuucuuaaaauguauaaauacuagcgaaagauacucuuuuuguacauaaacaacagagaaguacacagagcaaaacaugguuuuuauucauucucuucuauuaaccucucuaaaggaaauugggcaccuguaaucccagcacuuugggaggcugaggugggugggucacuuugaggucaggaguucaagaccaaccuggccagcauggugaaaacccaucucuacuaaaaauacaaaaauuagccaggcuggugguguucgccuguaaucccagcuacucaggaggcugaggcaggagaauuguuugaaccugggaggcggagguugcagugagcugagaucgugccacugcauuccagcccagggugacagagugagacucugucucaaaagaaagaaaaugggagaauuagauauucuguuaucccuuuucuguuuuuuuuuucuuuaacuguaauuguaaucaugcuauuagcauuauucugugacuuccuucuuuaaaaaaaaaaguggcugggugcgauggcucaugucuguaaucucaggacuuugggaggcugagacugacggaucacuugaggucaggaguucgagaucagccuggccagcauagugaaaccccaucucuacuaaaaauacaaaaauuagcuggguguggugcugcaugccuguagucccagcuacuugggaggcugacgcaggagaauuguuugaaccugggaggcagagggugcagugagcugagaucaugccacugcacuccagucugggagacacagagugagacucugucucaaaaaaaaaaaaaaaaaaaaaagauauggcuuggagaucuuuccauuuacauagacaucuguaucagaauuaauagcugugcgauauuuuaugguauguauauggcauaauuuaaccaugcuccucuuuuuuuuuuugagaugggggucucacucuggagugagacuugauuuucaaaaaaucaggagugcaucuugauuucagaaaaaaucaggagugcaucuugauuuuccccaagacugcugaaauggaguuugccaaauuauggccaaaauaguuaaauuuuaaacuauuuuuagacuguauuuccuuuacuucacaacuuauguugaaccauguccuagcaguuauaggcuuaucuggaugaaucauuauaaagcuacuuugugcgugugcuuuucucccccugggaaaaauugccuaucuuggguguccuuggguaguguauaugauaggcacccuguauuugcaggagaucuggucaguaauaacaaaaauguauggcaauuucaugguuuuauauugaccaaaucucagaauaaaauacaaggaaaaggaaauucacaauuuuucauauuuaaaauuaaaauaacuucuuaggcugggcguggugguucaugccuguaaucccagccagcacuuugggaggccaagauaggaggaacgcuugaggccaggaauucaagaccagccuggucaacauagcaaaaugccaucucuacuuacuaaaaaaaaaaaaggcauuauaaaaaauaaaauaacuuuuuauuugugcuugguuuguuuaauaaacuuauaaagaucaaucagcuagggccaccagccuuuauuuugguauugguagagaaugagugcagucauuuuucacuuuaauuaccuuacugcauauuugauaugaaagaauggucacugugucuuuuuaucauguggaaaaaaauagcaggaugggcaacaggauccuacuggcacaggcuccagauccacugggauauguaguggauaaaagaggaaagaucucugaauaauuguauguuaaguuagaaauguugaaacuaaauauuuaaaaauaaguuacuacaguuuuuuauguugacauugugugcauuauguguucuuuuuuucaguaagaaaaucauuuuugaguuacaacaaaaccaucuggggcccuuuggaacugguggagaagcuguaccccgaagcagaggaaauaggagcuaguguccgggaucuaccuggucugaaguaaggaggccuauuacuuguucaucccuagccacagaaguguauucauuguuccuccaaaguaccucacacucuagcuuauugucuucucuuagucuuaaguccccuucuucuaauccucuuauaauaaaauuauguucauucuuuauggcucaacucaaaucccauuuccuuuaugaaguuuuucuuagccucuucgaucaaaauuaaccacucaccauucugccuuguauuguaggaaauugaaaguccuuuuaagauaggauauaucaguuaugcaucuuuguuuucugaguguuaaauuaguuugccuguaguagaaagucaguaaguauugaggaaagacugauuuaggcugaauccagggcacaggcucaggauauuccaguucucagauaagccaguuguauacccuaggacugguguacauuucuuugcuuccucugaaaauugguaccuauaaugucaccagccuguuucaucagacaaauguauguaaaaugucuuaaaaguuggaguauguuagcuaagaauacuuucaugaguauuuaaaauuuuuuguagguguaaaguguuaagacucaguucuuaaauucuuuuuuucuuugagacggagucucgcucugucgcccaggcuggagugcaguggcacgaucucggcucacugcaagcuccaccucccggguucaccccauucuccugccucagccucccgaguagcugggacuacaggcgcccgccaccacgcccggcuaauuuuuuuguauuuuuaguagagaucggguuucaccauguuagcuagaauggucucgaucuccugaccucgugauccgccugccucagccuccuaaagugcugggauuacaggcgugagccaccgcgccaagccuauauucuuuuuuuuuuuaguuuucuuuuuaauuuuuauuuucuuuauuuuuuuugagauggagucuugcuguguugcccaggcuggaguguaguggugcgauuucagcucacugcaaccuccgccucauggguucaagcaacuuuccugccucagccucccgaguagcugggauuacaggugcaugccaccaugccuggcugauuuuuuguauuuuuaguagagacgggguuucaccauguuagccaggauggucuugaucuccugaccuugugauccgcccgccuuggccucccaaagugcugggauuacaggcgugagccaccgugccugaccaguucuuauauucuuuagaguguaauuaaaauguaaguguucucuuuuguuugucuuuguuuauuuuauuuuauuuugagacggacagucucacccuguugcccagacuggagugcaguggugcaaucucggcucacugcaaccucugccucccagguucaagugauucucgugccucagccucccaaguagcugggauuacaggcaugugccaccauccauaccuggcuaauuuucguauuuuuaguagagauggggguuuugccauauugaccaggcuggucuugaacuccuguccucaauagugauggaauuggcccagcgcaguggcucaggccuguaaucccagcacuuugggaggccgaggugggcggaucaccugagguugggaguucgagaccagccugaccaaaauggagaaagccugucuuuacuaaaaauacaaaauuagccggugugguggcacaugccuguaaucccagcuacuugggaggcugaggcaggagaauugcuugaacccgggaggcagagguugcagugagcugagaucacgccauugcacucaagccugggcaauaagagagaaacucugucucaaaaaaagugcugguauuacaggcgugagccacagcgcccagccucccuuuaguuuaucuuaauucuuguuaaugagauaacuuuuuuugcauuaagcauuuucuguaagguuaaucguuuguuuucucauaguuuuacaacuuaggguuuauauauguuguggggaauaugguaguguuuugcuguuauuuuguuguugaauguucaaauguucaaauguuuguaaauuggaauuuauugagugauaaaaguaaguggcuacuguugagcacuguguuagaguaauaagguaccuguuuuacaugaauuaucuccuuuagugcuuaaaucagucuuacagguagagguuauuauuauaauuguauagaugugaaaaauaaaugccagauaaauuauaguuaaaaaguggcagaggcaggauuuaaacccaguuuuuagaguuaaauauaaaguggcugggugugguggcucacgccuauaaucccagaacuuuggaggcugagauggguggauugccugagcccaagaguucgagaccagccugggcaacauggcgaaaccacaugucuacuaaaaauacaaaaaaauuagcugggugugguggugcacgccuauagucccagcuacucgggaggcugaggcaggauaauugcuugaacccaggaggcagaaguugcagugagccaaggucguaucacuacacuccagccugggugacagagugagacuuugucucccccaccaaaaaaaauuggaaaaaaaaaaaaaucaaaugauauuuguucacaauugauauuuuugguauaucagguguaaagauuuuuaacaaagaggaaaaacagaauuucaacucucaaaaacaaaaauguaagauuugauucauuuuaauaugaaaauauguauucauauuuuguuaaaaagccagacucuacaauaguaaaaccuguuuucugaugguguucauuaaaaugcuaagcuauaagaaaugcguuaauuauuagaagugaagaucaagucucuuccuguacuaucugccaaaauguucucugcauaagaaaauauaaaagugugaaugauaccacucucuuuaaaaaaaaaaagugguauaaaaguugcuuuuuaaaaaaauuauuauuauauuuuauggagacugagucugucucuguugcccaggcuggagugcaguggcgggaucuuggcucguugcaaccuccaccuccuggguucaagcgauucuccugccuccgccucucgaguagcugggauuacgggcucaugccacugugccuggcuaauuuuuguauuuuuaguggagacgggguuucaccauguuggccaggcuggucaugaacuccugaccucaagugauccacccgccuuggccucccaaagugcugggauuacaggcgugagccaccacgccaggccacuuuuauuuuuaauaacagauagaacuuggguaagagagguaugagauuuaauuucuuaaaugcaaccaaauuaaagaaacauuugaaaaccaguaagcagcacagugauuucucuuuaauuacuagccuggcacccucuuagcuuuguuaugauuuuuaaaauucagauauaauguuaccuauguuuuugaaggcauuauggugccuuauuguagaauuuuuuuuuuuuuuuuuuuuuuuugagaacaaaucuuaccuuguugcccaggcuggagugcgauggugcaaucuugccugacuguacccuccgccucccggguuccagugauucuccugccucagccuccugaauagcugggauuacagacacccaccaccaagcccagcuauuuuuuguguuuuuaguagagacgggguuucaccauguuggcuaggcuucuuucgaacuccugaccuugugauccgcucgccucggccucccaaagugcugggauuacagguguaagccacugggcccggccuggugaaguuuuaauauuuauuuuuagagggcuaagcucauucagacuaaauauuucuuuuuuuuuucugagacagggucucacucuaucacccaggcuugaguacagugaugcaaucacuguucacugcagccucugccuacugggcuuaagcaaccuccugucucagccuccugaguagcugggaauacaggcacaugccaccacaccuggcauuuugauuuuuuuucacuuuuuuaauuuuuuuuauuuuuaaauuuaauuaauuuauuuuuuuuauauagagacagggucucccuauguuguccaggcuguucucuaacuccuggauucaagugauccucccaccuugaccucucaaaguguagggaugacaggugucagccaccgugcccaccuaaauauuucuuauagaaguauucucaccagaguccugggcugcauaacauuucauuaaaugauggugguuccaaaagauuauaauacuguauuuugacuuuaccauuuccauguuuagcuguguuuagauacacaaauaguuaacaauugguuaauaauugccuacagcauucaguacaguagcaugcuauauagguuuacagccuaggaacaauaggguauacuauauagcauagguguguauaccaucuagguuugcaaauguacacuccaugaugaaauuaccuaacaacgcauuuuucugaaaguaucauuaagugacacacuacuguguuuagagagucauuucuuccaagacauuaaauaguaccuggauguccuacaggaggaacagauuuacccagcucucagggauugguuugugugcucaaaaagauaaaccuauaaaaaugaaaacaaaaccauuauaaaaaugcccuuuuuccuuguuaauguuuaccucuagagacagaagaugugaucuuugggcuagggcuguuuucugaucaauugguucuucucuuuaggaccccucugggucgagcaagagcguggcuucgauuagcccucaugcaaaaaaaaauggccgauuacuuacguugcuuaauuauucagagggaucucuugagguuaguacuauuaagucgugaucuuuucauuuuuuauuuuauuuauaugcugucuuccaaaaaggauuuaagauguaauaugaaaggauauauaacauauaauaaaaugauauaaaauaagaggaggagcaaaaugagacagaaaaacaugauagagacauaacauggaucaggaacuagccuuacauaugaauaccauaagcuuuguuaucagccaggauggggaaauuuauauauauuacauuucuuccucuuuguuuaaaaauuuuuucuuuugcccugccuggaaacugccguauauaauacauuucuguuaguuuuauuuuucugaauaugguuaauucuauggauaaaaauuuguguuggaauuuguggcuuuaauuucauaggcuuuuuguuuuuuguuuuuuuuuuuagaauuugaauauccauauuauugcuucaccuguauugugggcacaguuuaaauugaaguccaaacauuuauuuuggcugggugugguggcucacgccuguaaucccagcacugugggaggccgaggcagguggaucacuugaggucaggaguucgagaccaacguggugaaaccccgucucuacuaaaaacacaaaaauuagcugggugugguggcgcaugccuguaaucucagcuacuugggaggcugaggcaggagaaucacaugaacccgguagagggagguugcagugaccugagaucgcgccacugcacuccagccugggugauaagagugagacccugucucaaaaaaauaaaauaaaacgaaggccaaacauuuauuuaagacagauuuucaaagcaaggcaaucaguucuccaagggagugggcccauggugguccuccauucauucuuguucuguuagagugccucucugauguuguggagaauuuaguccugguuuugguuuuacuugugaugcugguuuuacauugugguuuucccaguuguuaaacgagaaugaccauauguuaagcacccauggcuucucaauauucugaaggauaauuaaagugauuaaauaauguacaugggccuuauuaaagaaggcaugagacagugauaacuacuucucugaauguauguuggugagacuuaguuuuugaacuguccuauuucuuucacaacucucuuuuucaacaguuuuuagaauguagauaucccaaagugucuuuaauugaugauuaucuauuaagauuuauaauauaccuaucaaaugcauugacuugaacauggacuuugaaauguugcauauguucauuuucuaccuuagucuuuaucccaagggucuuaauaaauccgaggauugaaaauucaacucuaauaaaauauaucauaaucagaucagcagcagucacuauauccaucugagucagaaacgucccagggcucaguguugccucuuuuuuuuuuuuuauuuucuugagauggagucuuguucuguugcccaggcuggagugcaguggugcgaucuuggcucacugcaaccucugccuccuggguucaggcaauucuccugucucagccucccgaguagguggaauuacaggcgugugccaccacgccuggcuaauuuuuguaguuuuaguagagaugagguuucaccauguuggccagguugcucuugaacuccugacuucaagugauccucccgccuuggccucccaaagugcugggauuacaggcgugagccaccgugucucgugccacuuuuucuuuucaucccuccuugcuccucuuuucucucucucaaaaaaaauuucccucuuuuaucuccuucaguccuuuugauuuuucaauagagacauuuaaauuuaaaaaauaugaaaaguuggcuaggcgcgguggcucacgccuguaaucccagcacuuugggaugcugaggcccgcggaccaugaggucaggagaucgagacuaucuuggcuaacacggugaaaccccgucucuacuaaaaauacaaaaaauuagccgggugcgguggcgggcaccuguagucccagcuacucaggaggcugaggcaggaaaauggugugaacccgggaggcagagcuugcagugagccaagauagugccacugcaguccggccugggugaaagagcaagacuucgucucaaaaaaaaaaaauuaauaaauaaaaaauaaaaaauauaaaaaguuauucacacguauaaaggcuaauuugaaggcaccuaacugagauggcuuccauuucuguaagguagaagauuaggaagauaauggugauuuuaaauuuuaguuuuugaaauaaauuugugauuuaaaguccuuauuuuuuaaauuuucacagugaguuuuaugaguaucacgcacuaaugauggaagaagaaggagcaguaauuguugggcugcugguuggccugaaugugaucgaugcuaaucugugugugaagggagaggauuuagacucacaaguaagugaaagugacuagugccaaaugcagaguguuuucaguuugcacaguuccuccuugaucaggugucauuugaaguuguaaacaggacuguuaaacacuaaaggaauauuaagaguaacauucaguaaagguacuucugauaaaguauuuucuccccuuuaaauuaaaaaaaacuuuauuuacuucagguuggagugauugauuuuucuauguauuuaaagaaugaagaagauauuggaaauaaagaaagguaugauuuucauaaguuauuucacauauuggguuuuuuauauagcucuuuacaaaucauuauaagauccaucuauuuacagugugguuuuauuuuguuguuuuccccccugugacuucuucauuucauuuucacuuccauuacaagcuuuacaaagcagauuauggaaaaucacuuaggagaaggagguuuuauuaauaguaugaagugggaccuuugguuauaccuguaguuacugagacccauuuuaauagugguuuuuuggaauaaaagagaugaaagcuuauuauucacaaguuugcaaauacugguuuacuucaagaucgaacuauguuuuuuuuuuuuugagacacagucuugcucuguugcccaggcuggagugcagugguucuaucuuggcucacugcaaccuccgccuccuggguucaagcgauucuucugccucagucuccccaguagcuggaauuacaggcacccgccaccaugccuggcuaauuuuuguuauuuuuaguagagacaggguuucaccacguuggccagacugguuuugaacuccuggacucaagugaccugccugccucggccucccagagugcugggauuacaggaaugagccacugugcccggcccuaauuauguuuaaauuuaaaaauacacuaaugguauuguuaaguguauuauuagcaaguaauuuauucaacaaagguuauagauacuuaguacacaguuuacuauuauucuuauguuuuauuuuaaaggcaagacaauguuuuauuauuuuaguuuuauaauaauuuuagaugauuuagauuuuuuugugcuuaauaaauaccuuuucaacuagcacaaagcuacuuuuuuccucauuuaggaauguucaaauugcugccauauuagaccaaaagaauuauguugaagaauuaaauagacaacugaaguaaguauuauggauacuuagcacauuuaugaauauugucuuagguuuuuguuuuuuucccuucagcuuaccguauuccuuucuucuaagagucuuugagaagggguugaggggauagagagaaaauggaaaguaagaauacagagaauuauuggagauaauucauuuuaagcagaaaaugagagucagaauuuuuuuuuuuuuuuuuuuugagaugaagucucacucuguugccaggcuggagugcaguggcaugaucccagcucacugcaaccuccgccucccagguucaagugauuccccugccucagccuccugaguagcugggacuauaggcgcgcaccaccacaccuaauuuuuuuuuuuuuuuuuguauuuuaguagagacgggguuucaccacguuggccaggauggucucaaucuccugacccugugaucugcccgccuuggccucccaaagugcugagauuacaggcgugaaccaccacgccuggcccgagagucagguuuuuaauacagaaucuucaucagauuuaaauagaacuuaaaacuuauugcuguacccuugacaaaaaaggcuaagguaaaaguuuguaucaguuugaugguucagaaauucauuuuuccuacuucaaagggcuucauauguaaauguggcugucugucaucuucugugguggaaauuuuugcuuucuuacauugucaacuggucauugaagccaucagugaauacucuuguugagaagaauuuuugagaccuguauguaaaauagcaaagugcaauucuaauagaaauauaugagauguggccaggcgcaguggcucaugccuguaauuccacuuuggaaggccgaggcggguggaucaccugagguaaggaguuugagaccagccugcccaguauggugaaaccuugucucuacuaaaaaaaacaaaaauuagccaggggugguggcggucaccuguaaucccagcuacucgggaggaugaggcaggagaaucacuugaacccaggagguggagguugcagugagucgagaucgugccauugcacugcagcuugggcaacaaaagugaaaugugaaacuccgucucaaaaaaaaaaaagaaaagaaagaaauauaugagaugcauaguuuuuuuguuuguuuguuuguuuguuuguuuuuuugagacagagucucacucuguugcccaggcuggagugcaauggcaccgucucagcucacugcaaccucugccugcccccaggguucuagcgauucuccuaccucagccucccgaguagcugggauuacaggugcccaccaccacgcacaguuaauuuuuuuguauucuuaguagaaacgggguuucaccauguugaccaggcuggucucgaacucuugaccucaggugauccacuugccucugccucccaaaguccuaggauuacaggcgugagccaccacaccuggccuuuuuuuuuuuuuuuuuuuuuuuugagacagggucucacucuguugcccaggcuggaggguagagggcaguggcaugaucaagcucaccacagccuugacauugcaggcucaagcaguccuccugccucagucucccaaguagcugggaccacaagugugcaccaccaugccuaguaauuuuaaauuuuuucauagagaugaggucucaccauguugcucaggcuggucuucaacuccuggguuaaaguaauccucccaccucaggcucccaaagugcugaaauuacaggcaugagccauugugcccagccacauaaguaauuuaaaauuucugguaacuauaauaaaaauguaaaaaaaaccccaaaaauuaaaaauauauuuuauuuuacccaguauuccccaaauauucuuccaacaugcaaucaauauaaaaauuaggguacaggcacgaugucucacuccuguaaucccagcacuuugggaggccgaggcauguggaucacuugagaucaggaguucgagaccagccuggccaacaugguaaaaccccaucucuacuaaaaaauacaaaaauuagccaggcaugguggcaugugccuguaguuccagcuacucgggaggcugaggcaggagaauugcucgaacccaggagguggagauugcagugagccgagaucacgccauugcacuccagccugggcgacguaacgagacuccaucucaaaaaaaaaaaaaaaaaauuaggccaggugugauggcucaugcauguaaucccagcacuuugggaggcuaaggcaagaagaucucuugagcccaggacuucaaggcuguagugaacuaugaucgcaucacugcauuccagccucggugacacagugagaccuugucucaaagaaaaaaaaaaaacuauuauuagccuggcauggugguacaugucuauaguccuagcuacuuugaggcugaggcgagaggaucaccugagcccaggaguuugagauaagccugggcaacauaaugagacccccaucucuuaaaaaacaauuauuauuaaugacauauuuuauacucucuuuuuuuuggcacugucuacaaaauccaauauauauuuuacccuuacagcacauuucaauuuggacuagccacauuuuuaaguguuuaguagccacauguggcucauggcggccauacuggacagcacagguauagcgaguaauauuugcuauguaauuagaaaugaaguguuuucauuaaucacauuuaauaauuaguaaaauauucucugggugauaggauuaugaauaauuuuuauuuuauucuuuguacuuuucuauauuuucugaguacuacucagugaauauguauuauaaucagaaaauacaauuaaacauuuuuccauuuuaggaaaagaaacuaauaagcugugacucuugcuuuuccucuaaaguagaaauaggaaagacuucauauaagucuuuuuuaaauggaguuuuaauagaaaucguaggaaauauauguauauuuuguaauuuguauuucugagauuguauuucuaaaugcaagcuuguguuucuuaauuauuuauguuuaaacuucuaaucacuuuuugguaacagguaauauuaauauauucauauggcucaaacuucaaaaggcacaaaaggaacauaaaacaaaagucucccucuccuugaucuucauccaucuaguuucccucuucacaaguaauuaauauauuagguucuuguguauccagagauacuuuaugcucauagcaauaauauguauaucuauucucauaucucuucccucucccucuucuuacauauuagguagcauacuuucacacuacucuauaccuuacuauuuucacuuuuuuuuuugagacgagagcucuuuguguugucccuggcuugggugcaguggugcagucucagcucacugcaaccuccaccuacugggcuuaagcaauccacccgccugggccucccaaaguucugggauuacaggugugagccaccaugccuggccaacaauuuaucuugggguuauuccauucaguucaaaauaauuuucuuuuuuuuuuucgagacagaguuucgcucuuucacccaggcuggagugcaguggugugaucucggcucacugcaaccuccgccuuccaguuucaagugauucuccugccucaggcuccugaguaggggauuauagguaccugccaccaugcccagcuaauuuuuugcacguucaguagagacaggguuucaccauauuggcuaggcuggucuugaacuccugacuucgugauccacccaccucggccucccaaagugcugggauuacaggcgugagccaccguggccggcccaguucaaaagacuuuucucauucucaguuguuuaaaucauguguguuaaucaguuacagcaauacuggugucugacuuuuguauaccuuauguuuuauaaauguuucauugcaccgggcucaguggcgcaugcuguaaucuagcauguuaggaggcugaggugggaggaucacuugagcucagcagucugagaccagccugggcaacauggugagaccuugucucuauacacccaaaacaguacaaaaaauuagcuggucaugguguugugugucuguagucucagcugcucaggaggcugaggugggaagaucacuugagcucuggagguugaggcuacacugagcugaguuugugccgcugcacuccagccugggugacagaugagacccugcuucuaaauaaauaaauaaaaguaaaaguguuucauugcuuuuucuuuuucuuuucuuuucuuuuuuuuuuuuuuuuugagacaggguucucauggugucaacacaggcuggagugcaguggccugaucuuggcucacugcaaccucugccucccaggcucaagcgauccuccuaccucagccuaccaaguagcugggagcacaggcuugcgccacgacacccagcuaauuuuuuuuauuuuucauagagcugggguuucaccauguugcccaggcugguucaaacuucugagcuaggccauccacccacuguggccuccuaaaguguugguauuauagauguuagccacugcacccggccuuucauuguuuuucuaauaaaaaguaguuauuguaccuuuagaauauuucaaaauauagaaaacauauagaaaaaaaguagaauucacuuuuuuauggagucuuagucuugucgcccaggcuggaaugcaauggcgcgaucucagcucauugcaaccuccaccucccagguucaaguaauucuccugccucagccuuccgaguagcugggauuacagacacguaacaccacgcugggcuaauuuuuguauuuuuaguagagacaggguuucaccauguuggucaggcuggucucaaacuccugacuucaugauccaccaaccucggccucccaaagugcugggauuacauguggagccaccgugccuggccugaauucgccuauuauuccucacucaaaacuacuauugaggguuuguuuucaaagugcuuuucuugaugauuauuguauccucgcauaaaggcaaggugaauauuauuguccaauuuguugaaaagaaacugaagcucaggaagguuuugcaacuuucuuuuauuauuauuauuauuuucugagacagagucuugcccugucacccaggcuggagugcgauggugcgaucucggcucacugcaacguccgccucccggguucaaucgauucuccugccucagccuccugaguagcugggauuacaggcgugugccaccacgcccagcuaaguuuuguauuuuuaguagagacgggguuucaccauguuggccaggcugauuuugaauuccugaccuugugaucugcccgccucggccucccaaagugcugggauuaugggugugagccacugugccuggcugguuuuacaacuuucaaggugacacaauuaggaaguagaaaagcagggcucuuggucuuacgucuccuagacuuguguuugucugucguuaccaucaggacauccuggugcuauuugugaaaaacucaaguugucuaccuaagaaugauuaugucuuaaaaaugauuuaauaugaauggaaaaacauuuuucuuguuucacuaguaaaauuaaaauaccaauacuuguuucugaggcugguauaaaauuuauugcaucuauuguugauuuugcugaaacauacuacauauagaauauuacauuuuauuagagaagguuuugagaugguaguaucaagcaggccuuggacaacauucuuuuuuuuugagauggaguuuugcccuuguugcccaggcuggaguacaguggcgcaaucucggcucacugcaaccucugccucccagguucaagugauucuccugccucagccacccaaguagcugggauuacagacgcccgccaccacgcuuggcuaaguuuuguauuuuuaguagagaccagguuucaccauguuggccaggcugaucuccaacuccugacuucaggugaucugccugccucagccucccaaagugccgggauuacaggugugagccacugugccuggccaacauucuuaaaauauacaauaauguccagucuugauucauuuaaacaaaaaugcaaaaaguguguucaucugguauaaucugaccuuugacuauuuccuuugaaagacaggguguuuagcugccagauccuugauacuaagaaccugaugcuggguaucucaucuucauauuucucaaaccaugguugacuuuggaugucucuaaguucucaugaaaauggagaggggaaucaaaauggagcuugaauuaaagaccauuguuuauaugccucaugaaaccacauaauuauaaaguagacauuuaaagcucauccuuuuaaauauaauuuuaacaauacuuaguaaucuuugugucgaauuuuuauucccaaauauuuucaguuaaauuuaagaaggacccuaagaagacaauguaaaaaaaugaguaggccgggugcuguugcucacgccuguaauccagcacuuugggaggcugaggugggugggucaugaggucaggaguucaagaccagccugaccaacaugguguaaccccgucucuacuaaaaauacaaaaauuagccgggcaugguggcgcacgccuguaaacccagcuauucaggaggcugaggcagaagaauaguuugaacccaggaggcggaggcugcagugagccgagaucgugccacugcacuccagccugggcaacagagugagacuccaucucagaaaaaaaaaaucaguagcaccaaauggaauuuuaauacaaauauuauuuugcuacacucuuuauugcccuccuagcuaaaucaaguuauccaaguuaaugaaauuuuccacacucagaaauuuggacagggcaguuggugccugucaguaaacauaguaaaucuaggauaacauauuuuuucgugccuuuuugaguucgugugauuuugaaugaguuuuuuuguuucuuaauuucagcagcacagucagcagccuccauucaagaguugauucauuagaaaagucaaauacuaagcugauugaagagguauugucuaauggauaaauguauuucauggaccuaguguuugugauccuuuuccauuuuaaguaugaaugcauuaaacauacacacacacacgaacacacacucaucauugugaugcaauacuuguaauauagucguaacugaugauuauaaguucuagagaaaccauauauucuuaggcaaauccucaguuauaugaaucugagauacuauauuugagauacucagcuucuaaaaaugagccucagagaugaaacucacacaaauucuucaguagauaagcugugauuuucauuuuaaaaucuggaugaccuauauuuaccuaguguaaucaccuguaauuagaaaugcucguuaagugcaguaaaccaccauggcacauguauaccuguguaacaaaccuguacauucugcacauguaucccagaauuuaaaguauaauacaaaaaaaaauacacauuaaaaaaaagaaauucuuguuaaaaugauaccgucccucucuucccacuguuccacuagucagauuacuuuucuucacaggcaucacugcaugaucauguugaccauuuuuccaccuucucaugugcaaagcucaucccaugugcucuguuuucuugcaaauuuaucucagcucucuuuuuuguagaguugcuuucuagauuuuuuuuaauguauuaaaucacagaauuauugcuuauauauuuucagaaauauuuaggcuucuguuauuuguauugugaacccuauuuuccauguuaauuaacauucucauuagccuaaauuuuuuuuuuuuuugagauggagucuugcucugucacccaggcuggagugcaguggcgcgaucucggcucacugcaaccuccgccucccaggugcaagcgauucuccugccucagccuccugaguagcugggauuaaaggcacgcaccaccacgcccggcuaauuuuuuuguauuuuuaguagagacgggguuucaccguguuggucaggcugaucucaaacuccugaccucgugauccaccugccucggccucccaaaguacugggauuacaggugugagccacugcacccagccaaauuggccuaauuuuuccaaaccaacgaacacaugauaacuugcaugacugcaguuaagaaugcaucuuuauuuugaugguugggcuccugaucgggaccauuauagagcuacucacuaguuugugccucuucuugacuuuaguaggacugugaaguucaaguugauuccugauaaaauguuuagaaauguguuaauugcaaaccaucauuagggaauggucucugcuuugcuuucauaggaucuuucuuuccauucugggccucagagucaaaccacuuaaucauucauguuuaacucauggugagaccugucucuuguuuguuguagucacuuaaguuccuguuacaugucuagacuucaugggguguccaacucaguuaccacaaaugucuguauuacauuuucaaugauagcacaaucuucuuuccuuaugcauguuuuuaucuuuacacaagucuuuaaagccuuuguuauuuaaugcauauuucucuauuuguuuacucagacacuuuguauucaggacauacuguaaaucauacaguaaacauaauauguuuauuauaagcauaacaaauaagccuaauguguuucaacuauaaaagaaaauaguaggaauaauucaaaaggaaauaagaguauaauuuuuaaaauugguaucuugggauaauaacgagcguguuuuccuuaugaacguuucugugaaugugacagaccuuuugcuaguugugagauuuuauuuucugauguuuauggccaugcacauaaccugcaaagcaaguauaaggguguuuaaaaucuuuuuucuugcccguuucuuaauuuuuaguuagcaauagcaaagaauaacaucauuaaacuccaggaagaaaaucaucaauuacgaagugaaaauaaauugauuuuaaugaaaacacagcagcaccuagagguaaguauagacugcuuucaagcagacaaucucgugucagaaauuaccauuuuuggggauuuuuggaugaaguagguauuucuaugcuguauuaauaguagugauuauagaaugaaaaauuuuguuuucuuccuagguuaccaaaguagauguggaaacugagcuucaaacauauaagcauucucgucaggggcuagaugaaauguacaaugaagccagaaggcagcuucgagaugaaucucaguuacgacagguagguuauauuaaaaauuacauuagcaagaucauccugggaguaauuuacccucaagcaagcaccauuuaaaaucuuuuucagccuuauccuuuuuggugugguauguagcaagcucaccccuuaaucuucucaaauuuucuaagcuuccacuauaucaauguuuuauuguuguuuugagacagauucucacucuguggcccaggcuggagugcaguggugugaucuuggcucacugcagccucugccucccggguucaagugauucuuguaccucagccucccaaguaauugggaguacaaggcaugugccaccacacccggcuaauuuuuguauuuuuuguagagaugggguuucaccauguuggccaggcuggucuugaacuccuggccucaagugaucugccuaucuuggccucccaaaguguugggauuacaggcgugagccacugcgcccagccuauuguuguuuugagacagagucuugcucugucacucaggcuggagugcaguggugcgaucuuggcucacugcagccucugccuuccagguuuaagcaauucuuguaccucagccucccaaguagcugggacuacaggcaugugccaccaugccuggcuaacuuuuguauuuuuuauagagauggggcuuugccguguuggccaggcugggcucaaacuccuggccucaagugauccaccugccuuggccucccaaagugcugugauuauaggcauaagccacugugccugaccuguaucaguguuuuuuaaacuguaaguuacaguauaugauugugaaugaauggguuaugaccagcguuauagaaaaugaaauagaacagaaugacauauucaaauauuaggaaagucauauuuaaaauuaacuuguuuuuuaaccuuugaaauugugaaauauaaugccaacagaaaaauacgaauauacagcuuaaugaauuauaacacaaauaaccugcguaaccuccacccaggucaagaagagaauauugcccaucuuuuuaucaccuuuucuguuugucuugaaugcuaauaaauuucuuuuuuuuuucuuuuuuuuuuuuuuugagauagagucucgcucuguugcccaggcuagagugcaguggcgccaucucggcucacugcaagcucugccucccagguucacgccauucuccugccucagccucccgaguagcugggacuauaggcgcccgccaccacgcccggcuaauuuuuuguauuuuuaguagagacggaguuucaccauguuagccaggauggucucgaucucuugaccucaugaucugcccaccuuggccuccuaaagugcugggauuaccugcaugagccaccgcaccaggccaauaaauuucuuaaaauaaaucauaagaaacuuuuuaauccuucugauaaaaaauucuuaagaaauuaaacuguguuggccgggcacgguggcucacgccuguaaucccagcacuuugggaggcggaggcugguggaucacaaggucaggagaucgagaccauccuggcuaacauggugaaacccugucuguacuaaaaauacaaaaaaaaaaaaaauuagccagucauaguggcagaccccuguggucccaccuacucgggaggcugaggcaggagaauggcaugaacuugggaggcggagcuugcagugggccaagauggugccacugcacuccagccugggcaacagagcgagacuccgucucaaaaaaaaaaaaaaaaggaaauuaaacuguuauuugaguuacuuuggccuuuacauguacagacugcuucauuuccuuuuguuuaaggaaaauuaauauucaaucuaugaagcauaaaaaugauuaauucuuggaccguuaaagaguaaugauuaacagaauauagaaaaugcuuucauuuuaacaaaaacugcguuugaaaauauuuacuuacuuuuugagacagagucuuacucucuugcccccgcuggagugcaguggugugauuucagcucacugcaaccuuugccuccuggguucgagugauucuuucaccucagccucucugguagcugggacuacaggcgugugccaccaugccuggcuaaguuuuuguauauuuuugguagagacggaguuucaccauguuggucaggcuggucuugaacuccugaccucaagugauccacccaccuuggccucccaaagugcugggauuacagguaugagccacugcgccuggcccugcauuucaaaauauuuauugccuuguuauagggccugguugauucccuuuaguggacuuaaaagguguagucugcauauugaauggaaaaucuuucuuaaaguauaucuaauuuuuacauccugaaguggcaugugaauugaggauacauugaaauugcaggauguagagaaugagcuagcaguacaaguuaguaugaagcaugagauugaacuugccaugaaguugcuggagaaagauauccaugagaaacaagauacucugauaggccuucgacaacaacuagaggaaguuaaagcaauuaacauagagauguaucaaaaguugcagguaaggauuguucuuaaauuucauuuuauguaaauugaaagugaauauuuguagaaagguuuugguuuuuaagagaugagcccauuuuauuuuaacugugcaauauuauaaaggccaaugucuuuuuuuuucuaaaugaaagcuuaagaaauguaaugaaaaagguaucaacaaacaaaauaucaccugucuaaauuuuuaauguugaaagauuaagaguaugaagauuaaaucuuuugggaaaacucucaauuuaaacugcaaaacguuuuugugaacuuccuuuuccaguguaguucuaagaaagauuuaauuuugauugaaaugcuacacuaucaaaauaguaaauuuucuuucuuuguuuuuuuuugagauggagucucgcucuguugcccaggcuggaguacaguggugagaucucgacgcacugcaaccucugccucccagggucaagcgauucuccugccucagccucccuaguaguugggacuacgggcauauaccaauacgcccggcuaauuuuuguauuuuuaguagagaugggguuucacaauguuggccaggcugguuucgaauuccugaccucaggugauccgcccaccucggccucccaaagugcugagauuacaggcgugagccaccaugccuggcccauaauugugaguuuuguacgaugauauugcuauuaaguagauauguugccaaaacccuuuacaauuuaauuaauuugaaaaaugucauauuuuacaagaguguauucugucaucuuccaaaaauauugaagguggaguuuuuuuuuccuuuauuacauuuuauuuuuuaauuuuuuuuucuuuuuuucuuuuguuuucuguagagaugaggucucacuauauugcccaggcuggucucaagcgauccucccaccuuggccucccaaagagcugagauuacaaaggccucccaaagagccacugcacccggccuauuacauuuuaaaugaggacuaauagaggccaggugccauggcucaugcuguaauccuagcacuuagggaggccgagaugggaggauuguuugaugccaggaguucgagaccagccuggugaacauagcaagaccccaucuuaaaaaaaaaaaaaaagggccgugugcgguggcucaugccuguaaucccagcacuuugggaggccaaggcgggcagaucacaaggucaggagaucgagaccauccugacuaacacagugaaacccugucucuacuaagaauacaaaaaaauuagcugggcgcaguggcgggcaccuguauucccagcuacuugggaggcugaggcaggagaauggcgugaaccugagaggcggagcuugcagugaggcgagauggugccacugcacuccagccugggcgacagagugagacugucucaaaaaaaaaaaaaaaugacuaauagcacugcuuuauaucacacaauuauuuuaauguauaaaguaacucuguucauuucaaaguaacagucccauagcaaaaugguguaagaaacuuauaaauacucagguuaacagaucagaacucuacuugggaggcugagaggugggauagcuugagcccagaaguucaaauccaaccugggcugcauagugauacccuaucuauuaaaaacacgcacacacacacacacacaaacacacacacacaaaucaaaaccaccauagcuuuuguuuuuauaaauaggguucugaagauggcuugaaagaaaaaaaugaaauaauugcccgacuagaagaaaaaaccaauaaaauuacugcagccaugaggcagcuggaacaaagguacagcauuuccagucuuaguuucuuuuuuucuuuucuucuucccuuuuucuuuauucaguuccuacaccugccacaaaaaccauuaggaagacauagauuaggacauguuuuuuguuuaagcccagcaggauuuugcguuuuugcuuugguuguugcauggaaucaaguugcuuuauauuacgcugauucauuugaaguugucauauuguagauuuuucuuagaggccuaauaucagcaguuucaugucguucaguuacauaaaacaaauacacaaauaaaaaugucaaaaaaauuaaaaaugaacaaacagagugagauuaucccugauugauuuccaugcauauuaauugucauauucuuugccauucaccaucuguuuaucugaaaucaagcauuccgaauuggugguuuaguuuuguuucuuugagcuaggacccucaacccaaccgaggauauaauuuuguuuaaauugaauuguuuuauauuggcauuuuucacuuuuauuguuggaaaauguaauguauuuccauugcccugucauguuggugucaacauaugucuuuuaucauugcuuucuuugaaucuacuuaugaaaaacauaacuauuaaugcuuuauugacaugaauauucuuuuauugacauccucuuucuucuuuuuucuuuuuuguuuucuuuauccccauuuuuacauuuuggacauuuuuauuaccuuuuucugucuuugauuucuuuccauuccauuaugaagugacaacgauuuguuaacucaaacuaggacaauugcaaugucauuggugaaaugugccagcagugacacgcaggaccaguacaagcugguuaaagauauaucuuucugaagaccacuuguauuuaaacagacuaaaugaaaagagaaucaacaauuuuauaauauauuaaauagaaaggaaucuaaaugcuauuaaauauucuaaaaggauguuaggaacccuguacauuucuuggucagcugcugugguaauacacugccaucaagcagagugggugcacuuggauuuccagacauacguuccucaaaccuugugcacaaagggugauuugaguauugacccuuuggaggucaggauuuucaaaugcaguuuuaucuuuuuagcuacuuuuugaugaaaaauauaaagauuguuuaaaaauaacuuaaccuucaguuuuauacuguguuggcacagauauuuuuuucucauuggcccacucuuugcccaauggcucccuuacagauuuuuacauaugcuuuaaaauaauuuauaacccagacuggccaacacccugugcuucagcuucucaguuuuccgguucucccuugcccucuucugugauagcacaacuucaaggccuaccucacucugacuucuauuuuccuuuuuguaaccuuagagaaaagcuuggguccaaucccagcaccugaauauuuuaauuuaaacuuggauuuggagauaacuuaaauguuacucucccuuccuuggaagcagcauuuauaccccugaaauaugugaggguugcuccauugguaugguuuuaaggaagaaaggaagaggaagaguuuuuuaguuaguugaaccgaaauuucucuugugauuuccugcaaggaguuaauauccuuugaaucuugguaaauauuuucuuauaaaaauauugaaguuaaauacaagaaauccuagauggccaaagaaggcagggaguggagcuaagcacaggaaaaugcaacgacuuacaaauaaaaacaggaaagaugaaaaucacaauguuuuagcuaauuuuuaauauuaaauggugaggaacaaaaaugaucucuagcaaaugaugccaacuggcaccaaauucuuuuugaaucuuaaacauauaugcacacgugcacacacacacacacacagagcuucggcauaauuuaguaaaugcauaaagaugccguaagaaggacuuggcuaucauuuggaguaauugcaggucuuugcucuuggccuuguagcacacuugauuccuggcauacacauccuagcauaacauauaacaguguggcuucuucaccuaguguaggcauaaauccuuugcuuuucaugguuuuguaaaaagguaguaacauaccuauuaugcuuugaaauuugauucguuaugcucugcauaagugguaaaggcuguauugcuuugcacuguuaauuaugaacaagaaauaaaacaaauuugaagauagua

SEQ ID NO: 192146 - RNA, 153448 nt, Homo sapiens
uuccggccagccccucccccgccucccucgcguggccaccucccccucugccuucuccuacccagucucuuccccaacucuccccaccccuggugcucuccgccccgcuugccucccguucuuccccgcccgcuccauccgggucgcugacggcugucucuggacuggacagcaguggcguccgcuuuucucuaaggaacccgguaaaguuucccaggggccggggaggggagcagcggagcagcggcacagacgccggaggugcccuggugaucgucgccacuggcugacagaggagggucccaggagccggagacgugcuucagcgaccgcgcugccuugcucucugggcaggggccgccccccgucaccuugggcuuccccuacccugaagggcuugggcgaguuguggccccagcggguucgggggcgugugacggcguuagggaggggcaggccgggcugggcggaugcaggccggcccggcauagggcgcuuucuccgcgcuuccugggggugaggggcguggggcgagggcagggcuguggcucccuggccccggggcuggaaugucucaucugccuggggaugggcuucucucagguugaggccgcgcacugccaagccucggccgccggccucugaagcuguugcgagcggccgguugcgguagucgucugcuuggcugcgagguugggugugugcagaugauuucucuuucccaguccccaugagcugaucugggugcacguucagggaaagacgggacuaaacugcuucucauuucccuaccuguugcuggcgagaggacgccucuguguuuuaaagaaaagggugguuaaaccucgcgcgcugaagucgggguauuuuccuguauuacucuuauuuuguuuuuaaauaugggaagacaaugcagaacucuugggaauuaucgaguucugauaccccaaaagaaugaaaucaaacuucuguuaaugggaugaugggucguggaaugggacaccuugggcacuugcuaacaggaacauaggaaaauuggaguugaaacuucgcaggcucuguaagaauguggaugacugcuacagaauaaggcugacuuccuguaauuaugauauuuaguaacgcgauguguuuaaaagucuacguauguauagaugaaguggacucuguuauuugugucuuucuuuacaagugaggaaauauucagucagugugcuggaaaguucuacagauuucgccaucagacuauccauuccuauucuugaaaaaucugcagugcuggaguuauuugcaauucccccccgccaaucuuuaaauaauugucucagagauauagauagauauagauugcccacgggugauuuuuuuaaucccgguuaccacuuguaauaaaagagguugaauuuuggagagaauugauauuuaaauugcauguuuuuuuuucuguauuauaauuaugcacauugauuuaguuuuaaaauuagugagguuggaauguuaguauuuugauuugaaaucugggaucuuuggaggugauuuaagauuaugguuugguaagagaaucuucauuuucucucugggcuaaagaguaauugggagagucguuuaaauuguggaaaauugcuuuaaauuuccauuauugguuuuauuucuguuacagauaagaacuccauuuucuguugauguggagguagguauuagaaagcuuaauuauacuaggauugcaagguuauguuucugcaguuggcuaaauuuugcacuguguauauuugcuuuuugggcagaggaaagaugucuuauuucuuguucccauugaaauuauuuaaagcaaaaaguagaaaaaauugugauuaauuucaucaagguacuuauuccuauuaguuuagucuaucacaagauaaccagaagucaaaacuaguuaauauguuuuaaauuuugcaaaggaucauagaaagugucauauuuucccuaaaaauuucuguaugauacauuuuaaaaaauacaacugauugguuuuugaaacugaaugauacuuauguagcauguuauaaaguauauuuaauguuuaccauguagcaauuauuguagccuagcacuugaaagagcaauuauacauccuuuuuucuuugaagucauauuaacuucuuucuauuuccucagacauaggguaccuccaacuuuccgggguuucagaagagaauuuuuuauugaaacuggaagaccaaaauaauuacaagcauguugugcuggggaaaugcauccuuugggcagcuagguuuggguggaauugaugaagaaauuguacuagagcccagaaaaagugacuucuuuauaaauaaaaggguccgagauguaggauguggacucagacauacuguguuuguucuggaugauggaacaguguacacauguggauguaaugaucuaggacagcuaggucaugaaaaauccagaaagaaaccagguaaguugaaauguuuuuaaaauuugcuauuuuuaauaauuauaucauuuuaaauuugaaucaucguauaauuucucuaguuguaacuauauguuuaucaagcuuuaaaagcaaaguagaaguuauguauuuccauuauauguguauauuuguaugguucuaaguacuuuauguugugguuucuuuuuuuuuacuacuaguauuauaaaaccuuauuuuguaugacgauauaaaacaauaaagaaaaucagccugcaguauauaaaucuuugguacagaguguguagugugcagguccucuuuaauaaauucuguucagccacccuggauagauuuuaaaugcauaauuuacucuguguuuaccuuacuuugggaggggggaggaaaacaagacggaagcuuuuuacuuugacuugcuugccuaaaauauauuuuuauucuuuuuaucccucugucauaguauuuuaaauauguaauuuuauuugauuuaguuagaaauaucuuuuauuccucucaucuucuacuuucuguagcauugcuagcuauuaaagauuuugugacuaugaaguguccugauuuuguaguaguuguacaagcaaauuaaauaauuuguaggguaaugagaauuuugaggaauuuggucacauuucauguucuguuccuggauauuguauuuuaaaaucaaauauuucuacauuuaggaguaucauuguuaugugaguuuugcuuucaauuaugauaacuaaaaguuaaugauuucaggugguaaauucagaugagacugcagcuauacugacuuacuguuuauuuuaacuguaacaauaauggcacuucaguauuuucuguggcaguuauuuuaucaguuuauuaauuaggugguuucuguuguuacucagcuuuugagagauuaauguaaucuaagauauucaggcauuaaauuaaggcacgauucauccuucacaucaucucacgaccaugccaaaucucacuuuucuaacuugcaaauacuguaucguuuucauccuuucuuugugguuaaggucuuaguguauuuucuucugccuuaauuuguaauuuauuuuuuauuggauaaaugauagugacauucauaaaauagauuuuuaauucuugcagaacucaaaguaaauggcagcuuucuuguacucuaccugucuaagaacauuuuauggauuccuaccagauuuucaugaucucaggcauugagguggucauauugguagaaaugaaugguaauuuacugauacgcauuugaugauugucucugcuccagagacaaaugggcccuuuacuauuuuugcuuagcuuggaaugcugccucagguugagauuuucaugguacggaggcuacugcuguucuuuguacuuuagcaugccccauagaaauaacugaacaucucucuguauuacuuuaauaauuucugaaaggccauagggcaaguagaaaguaaaaagccagcacauagaaauugccaguauaguuacuuaggucuacugagguuuaaaauguuuaaguguuagagguagacacuguguacuaguaguauaaugauuauagugccaggaacagccuccaacuguauagaugagauucugagaaacuuaacuagcuagaauaggcuucuuuguggucauguugacauugugaugauugcacugugacaucuauaucaucuugauucauccuggaaccauuauuugguaauguaaaguuggggcaguggguuucccuaauuugggauaccucuuuaggauugccucauuguugucccgauuacaccacagccuguggaagagaaaagugacaggcauuagcuuugucuugagaaauuuagagucuggguugggaguuaagguauacaugaacaacuggagagaacuggaaauuagacaugaugugccaugcacuuugagccuaggacauuuaaaugaugggaaauauuaugggauagaauuaaaguaagauuucugggagaaaaugaaggcuuacauuuaauucuauuggugaucacauaaacagcuaggaaauaagucuggagcugaaauaguuuuguagaagggggggguccugauccugagaaaagcuuuuuauuaucagaaguucugguucgaugauauauugaagugaaccuagguuucagagggaagagaaacaaguucaaaaaguaguaguugcugugauaggaacuucaucuuuuaaucucagcuuugauugaauauuuauuuauuuauuuauuuuuauuuuuauuuuuuuuuuugagacagaguuucgcucuuguuucccaggccggagugcaauggcgccaucucggcucaccgcaaccucugccucccagguucaagcaauucuccugccucagccucccgaauagcugggauuacaggcgcccaccacaaugccuggcuacuuuucauauuuuaauggagaugggguuuuaccauguuggccaggcuggucucgaacuccugaccucaggugauccgccugccuuggccucccgaagugcuggaauuacaggcaugagccacugcuccuggccuaagauguuuuuuaaauaauguuuuuaacuaaauuuuaagaauguuuuuaacuaaaguuauuuauauuuggaauaauucguuaaugauuugugucauuuccccaaccccuuuuuaaauuugugaauuugaggacuggauuaaaagauaaaaaguuguuggaucuuauuuauuuuaaagucuucugguaauugagcaaguugguuauauuucugggacaauguaauaaacauaguucauuucccaggagguuuuuguuuuguuuuguuuuguuucguuuuguuugagacagagucucacucuguugcccaggcuggaaugcaguggcacgaucucugcucacugcaaccuccgccucccagguucaagcgauucuccugccucggccucccgaguaggugggacuauaggggcgugccaccaugcccggguaauuuuuuauauuuuuaguagggacgggguuucaccguguuagccaggauggucuugauauccugaccuugugaucugcccgccuuggccucccagagugcugggauuacaggcgugagccaccgugcccagcugacuucacaagaacuuuaaacuugugucagaaagcacauggaauggagggaacuaagaauuguuucuuuacauagguuggcuuuauaaauauacauauuccauaacuaauaaggaaugaaggagaaagagguagccuuauuaaggauaaauuauucucgagauucauaauaaccuacuggaggacuuggccugacaauguagugaauagauuuaaccuguggccuauugaaaagagguguuucuguucuggacuuuuuagggaccacacagaaagauuuaacugaauuccuuuauuauacuaaaggugcagauuauguucauguucaucucuguugucuuguauauguauguccuuuucuaucacuacuggcuuuucugaauuauuuccagagaagugaaugucuguuucacuuucauguuuuuuucuucauaagaacuuuaaaauacuuuuuaagcuaaugucucaauuuuuaaauuuauagcuaacaaauauauuuaaucuucagugcgcuagaccaauccauuuaaaugaauuguuguuuuuuuauacuuucaaauucaguucugaagauuuuaaguaugggaaguauacuuuucuuuacaagauccuuuucuuacuguguaucuaaucauagguauaauuuggugaccaugguuauguuuugcacauugauuuccauuuguuucauguuagaaacaguacuaaacuguucugugaccauaauuuguaaauaaagugguguucuguuuaaaaacaagcccuguuaucuaaaaaacaguuuuuuguguuuuacaacauucuuucaaauggaguaucucauuuaauucucacaacaguuguauguagcuaaggcagguaucaugguccgcauuuuacagaugaggacacugagguuaaaagagauuaagagacuaauagggucacuuggcuagcacaucuugagaccacccuaaaucuugugguuuuuauccuuaaucucacaaaucuuuuccuuugcuacauuuagaagguaaaagaauauuuguucaccuuugaggaagcugguuuccaucaguauuuuauuguaauucugaggguuuuuuauuuuuuauauuuuuuugagauggggucuuauucuguugcuuaggguagagugcaguggcgugauaauagcucacuguagccuuggacuccugggcucaagugauccuccugccucagcuuccccaguaguugggacuacacuuaugugccaccaugccuggcuaauuuuuuuuuuuuuuuuuuuuuuuugaaacggagucuugcucuguuacccaggcuggcgugcaguggugugaucucugcucacugcagccuccaccucccagguucaagugauucuccugucucagccucccgaguagcugggacuacaggugugugccaccacaccuggcuaauuuuuuuguaguuuuaguagagacaggguuucaccauguuggccaggggggucucgaacuccugaccucaggugaucugcccaccucggucucccaaagugcugggauuacaggcaugagccaccaggccuggccaauuuuuuuauguuuguuagagaagggggucucccuauguugcccagucuggucucaaacuccaguccucaagcuauccuccuguccuggcuuccccaaauugcugggauuuauagggaugagcuacuguggcagccaagaaaaaucuuuaaaaaauuacuaucuuauaacuaagcuuauacaaugaagacagcauauuuuauugucuucccccuuguacacaaacuuaaaaaucauuuuaagaacugauaagaagaucgagaguucuauuuucaagauguaauauuguaccaacaaaagcuaaaaaauucaaauauguauaguguauuacugaauggaagacuaacucgauuggcagaguuuauagguaauaguuuuaauaguaugauaaaauuuauugugguuuauguugaacucuuuuuaaagaugaugagcauugauucuuuguuuuccauauccucgaaugguaauuucuacuguugagucauuccaauaaaagcauuuuggucacauaguagugauuacuuggcuugccuuucuugcuucuucauuuuucugaccuguucucucuguucauaaaacaaauuuauaaacgagcugcuccuuaaaauauaguugaaauuuaaaaaguaauauaggaaaauauaacuaugggaaauaaaguuacucacuuaaggguggguuaaaaauaaaaauaccagauuaucccacacauuucuuacugaaccagaacauuuaaaccaaagaagcucauugcguuuuauaacucccgguuuucacaauaccuucuaaggaagagaaagauguggaugauagauuugaaaaaaguaauuacuugggucaggaguggaggcuugcuuugaacgcuuuacuuugagaaagguuagugcccaagaaucacagugucaaggguaggaaaaaaaaucauaaugcaaacagaugacuaccguuagagaaauguauaauaauacuuuacuuuguguaggacccuacaucugaggaauuucaagagcauuacacaauaacucaugguuccuuucaaaaugcuugugacacaauuugcaagaauuauccucaucuuaggggauaaauuuacggagaaauggcagcacacguugguaaguaacuugucaaaauagcagaugacuggugaacagcuauaaguugaaucugaaaguuagagucuaccagucuccuaccuuauucacuaaauugugcuuauguuuagaauuauuuacaguaauaucuucuguuugaggcaggucaaauacuagugcacagauuguuucccugccauucgauuugauggccuguuaaaucauuauuuuaccaagaugcuuacauucugauaccacuuugauacuucaguauaacucugugugguaugaagaauauuugaacaaacgaacagaaacuuaacuaugguaaugcccagucuuuucucuuuucuguuauauauuguauauauccccuugucuaacugcuaugcuguacuacaagccaagguccauaguaacugacuugcagaauugauuugguggcuaaccuuggaacuuggauuaguuauguuguauaaaguccgccauguagauacaugcaucucucucuaagaugcauugguuugguggaugcuuuauaaaacucuuaaaaccuacacagaagacaaaaauagcaguagaugccuaaucugagcagucuaacaaagggaaacuucuuuaaaguacuuggaaccagugauuuucucuuggguauguuaguguuuuuacaugauuagaagugagccacauacuuuccuuaaaagaucagcagugugguagauuugguuuuacaauuuggguacuuagcagauucuuguugcagauggcagucuagguagucuaguuaccauuaucuccuuaguaaagauucuuagguucuguauucccaauauaucauacaaauguagcacuguuuuuaaagcucauuucucacaaaggcauguauuuuuaaaacugcuuugaagacacaaaaguuacuucuguauuccuaggcuauaaaguauaucaagugcuugggauauguaugaaagaaucuaauagaggagguguacucaaauguuuauauaagaguuuauuugggcuuggauaauguuaguagaaaaauggguaacacuaaugaggaaacuauauuaaugagcucaugguugaccuucuuucuguuccccuggauuuuuuuuuuucauuuugaugaaauuuaaaaggcaauaauuaauuuuaaauuguaaugaguuaugauaauuaccuuauaugcgagaaaaaccuaugcuguguguaauuauacagacauuuuauuggaguuuuguuuuguuuuuuuagacaggaucuuguugucacuggaguacagugguuaaaucguggcucaaugcagccucgacuucccuggguucaggaauccucuuaucucagccugcugaguagcugggaccacaugugcaugccaccaugcccagcauauuuuuguauuuuuuauagagacaggguuccacucuuuugcccaagcuggucucgaagugauccucgcaccucagacucccaaagugcugggauuauaggcaugaaccaccacgccaggccuuauuagaguuuguuuguuuuuguuuuaaugggaaauuucuugcauuucgguggcuuauucuuuaaaccauaaguuuuauuugccuagauuuacucuuuuguguucauuucuagcauggcagaauuuugguuuagccuuucuuggccauaagacauucuggaauccuuuagaaugggcuuuucacaaauuauuugaaaauauauuaauuacuuuuuuauucauaucuaaguuuugccucauuuuauuccuuugcuagguguuauacuauucugaaauaacauauuuuuaguuuuucauaauuguuuucuauuauaaaaguauuacauguucuugguagagaauuacuaauacauaggaaaguaaaaacuauaaugccaucaugcauagguaaauaguauugucaccugagaccuuuucuauauucauauauguuucugauuacaaacugggaauguguucuuguaucucaacuuuuuucccccgauaauaauuuagcauuuucccauguuuuaaaguuuuaggaauauugggaauauuuaggaauauaauuaacauuucaucauuuagauguaccaaaauuuauuuaaguauucuauuuuuuggauuuuuuuuuuuuuuugagauggagccuugcucugucacccaagcuggagugcauggcgcgaucuccacucacccuagccucugccuccuggauucaagcgauucuccugucucagccuccugaguagcugggauuacagacgugugccaccacucccagcuaauuuuuuguauuuuuaguagaaacaagguuucaccauuuuggccaggguggucucaaacuccugaccuugugauccaccugccucagccucccaaagugcugggauuacaggugugagccaccaugcccagccuauuuuuuggaauuuauuuccagauuuuuguuauaaguaauacugcaaugaacauauauauaucaauuuaguuuuuaugucuuuuuuucuuuuucuuuuuuucucucucucucuuuuuuuuuuuuuuuuugagagagaaucucacucuguugccuauugucuaggcuggagugcaguggugccaucuuggcucacagcaaccuccgccucccagguucagaugauucuccugcuucagcuuccccaguagcugagauugcaggcaugcaccaccacacuuggcuaauuuuuguauuuuuaguagagaugggguuucaccaugauggccaggcuggucuugaacuccugaccucaggugauccaucugccacgacaucccaaauugcugggauuaccugccugagccacggcacccggccuauuucuuucuuuuaauuauuuuuuauguuuuggggacaggguuuuguucugucgcccaggcuggagugcaguggcaugaucucggcucacggcaaccucugcuuccugggcucaagcgauuccccucagccuccagaguagcuaggauuacaggcgugugccaccaucccuggcuaauuuuuguauuuuuaguagagguggaguuuugccauguugaccaggcuguucuagaacuccuggccucaagugaucugcccacuucgcccucccaaagugcugagauuacaggcaugagcuaccaugcccagccucuguuucuuaauuauuauuugagacggaguuucgcucuuguugcccaggcuggagugcaauggugcagccuuggcucacugcagccuccaccucccagguucaagugauucucuugccuuggccuccugaguagcugggauuacagaugcccgucaacaugcccugcuaauuuuuuguauuuuuaguagagacgggguuuugccauguugaccaggcuggucucaaacuccuggccucagguaaucuguccgccuuggccucccaaagugcuggguuuacaggugugagccaccacgccugaccuaccucuguuuauuuauuuaggaaaaagaacaucuuuaauuuuaaggagugagaacugaauuuauuuuuuaagcacaguugugucucauuuuaugaaguuuauacacauaagauauuuguaaaugaaaguuuuuaaaauguaugacaaggcugagugcgguggcucaugccuguaaucacagcacuuugggaggcugacacaaguggaucacaaggucaggaguucaagaccagccuggccuguguagugagaccccgucucuacuaaaaaaccagaaaaauuagcugggcaugguggugugccuguagucucagcuacucgggaggcugaggcaggagaauugcuugaaccuaggaggcagagguagcagugagcugagaucaugccauugcacucuagccuggguuacagagcgagacuccaacuaaaaaaauaaauaauaaaguaaauaaauaaaauguaugacaagcuuucuauuacaacaugaugaauaucauuuaaugaucuaguagggaauagaaaacaaaugcacaaauaauagaaaggcaauuaaaauaugcuaaguguuacaggauguauaaacaagagugcuguguagagauaguauacuaagcagauggcaacaggcaaguuugaggcuuacuaagggaagaguaguccauguaauugagaugucuugagaauagugagcaggaagguuaggcaaaauugaggucagauuguagaaauaaauuaaggagcuugaauuuaauuuggugaauaucuauucacucauaguuuguaaugggaauuaccauggauuuauaaaggaaagguugaaagggagagaaauuggagguaaagaaauaguuaggcugugaugguaguccuuuauuuuuuauuuauuauuuuuuuugagauggagucucauucuguugcccaggcuggagugcaguggugcgaucccagcucacugcaaccuccgccucccggguucaugugauucuccugccucagccuccugaguagcugggauuacaggcacccaccaccacacccggcuaauuuuuuuuuuuuuguauuuuuaguagagacaggguuucacuguguugaccauacuggucucgaacuccugaccucgugaucugcccgccuuggcucccaaagugcugggauuacaggcgugagccaccgugcccggccgaugguaguccuuuaaagcaagaaaggagcagguagaugauggagacuuagagaggcagaaagaauggacaggcuuugguaaccagauggaaauaaauaguaaauguaacggaaagagccagguaugauccuagguagaaucauuagcuauagauuaguauauucauuaguauagaaauaaggaauccaggaagaagagaaauauucucuuuuaagaggcaaguuaaaagauucugguaaggugaauuuugugguaaacuuaauaauauuaagugagcaguaagaaauguaguauuguaaguggggagaaagaucagggcuaaaugugugaaguguuuauuuucgauuuuguuuuauuuucaguucagauaggcugacauuccaacuguagacuucucccaguucuaaccuguuaaguaauuaauaauucauuaacaauacuuaacuuugugcuuuuggaagacugcuuaaggcacauggugauauaauaccguuguaaauuuaaaguaaucuaaaugguugccaccucuaucuguuuuguaaaccugaauuuuuauauacagauuuuuuuuuuuuuuuuuuuuuuuuuuuuuaaauggagucucgcucugucacccaggcuggagugcaguggcaccaucucggcucacugcaaccuccgccuccaagguucaagcgauucuccugcuucagccuuucaaguagcugggauuacaggcacccgccaccaugcccggcuaauuuuuuuguauuuuuaguagagacgugguuucaccauauuggucaggcuggucucgaacuccugaccugaagugaucugcccgucucugccucccaaagugcuaggauuacaggcgugagccacugaucccagcccauuugcuuauucuuucgcugacagaaaccuauuccuuuuuuuuuuuuuuuuuuuuuuuuuuuugagacggagucuugcucugucgcccaggcuggagugcaguggcgcgauugcggcucacugcaagcuccacuuccuggguucaugccauucuccugccucagccucccgauuagcugggacuacaggugccugccaugacucccggcuaauuuuuuguauuuucaguagagaugggguuucaccauguuagccaggaugguaucgaccuccugaccugaugauucacccgccuuggccucccaaagugucaaaccuauucuuaauuacuguguuugacuucaggacuucccuccaggucuuacuggaaacaaagcuuuugcagucagaaggugcaaugacauagguauaaguugcuuuugguuccacuaguagcugaaguaauuuuaacuauaaguuguauauaugcgggcaauguaggcaagagcuauugggaaauacaccuuuugcgauaaugcuguugguucugugaaagggaaacgguguggggaagaaagaggugaggcuaaaagcgguccuaaagagcagaauuaggaguaucugaaaagcaacuggaagaaaguuuagcuacuuuaccuauacauuauuagaagacauuugugacuuuuuuuuuuuuaggauggcauaacgaggauaaaguagaucuuaaauugcuucccacaauugauacaaaguacaguugaucaaucagcauauguguaauuucuaauccaaguauugcuuagcuauagauuucauaacuaggcucucuaauaggaaugaaccuuauauuuugaagaguuacuagguagaagccugagugguugauguuaccuguaccagaacauagaacuauucauauuuucaguuaggaaguugaaugagccucugcaacugagaauaaggggaaaagagaacacauuauaaguugguacugcauuguauagggugaagaaacacauaaaccauauaauuggagagaaauuuaguguugaaauauuuagaauguauuauuuauggcuggacgcgguggcucacgccuguauucccagaacuuugggaggucgaggcggguggaucacaaggucaggaguuugaaacuagccuggccaacauggugaaacuccaucucuacuaaaaaaaauacaaaaauuagcuggguaugguggugugcaucuguaaucccagcuacuugggagacuaaggcaggagaauugcuugaacccgggaagcagagguugcagugaauugagaucgugccacuguuauuugugucacugcacuccagucugggugacacagcaagacucugucucaaaaacaagcaaacaaaaagaacauuauuuacaccuuauaaugcugauuuaaaaaaauaauaacaguaaaccuccauuauaugccagguacugugcugaauccuuuauucauuauccaaaagucuuguaucuauccugcaaaaguauguguuuuggugagaacagucagacuccagaagauuaaguaauucugccaaaguugaaauuaaagcugaguaggaacaagagccaauuagaacaauggaagaaaagaaaccaaauuauuauaauagcaagagaaacaaaauauaauauaauauuauuauaauauauaauauuaugauauauaauauuauauaauauauaauauuaugauauauaauauuauuauaauauauaauauuaugauauauaauauauuauaauauauaauauuaugauauauaauauuauaauauauaauauuaugauauauaauauuauaauauauaauauuaugauauauaauauuauaauauauaauauuaugauauauaauauauaauauuaugauauauaauauuauaauauauaauauuaugauauauaauauaauauauaauaugauauauaauauaauauauaauauuaugauauauaauauuaugauauauaauauuaugauauauaauaugauauauaauaugauauauaauauuaugauauauauuaugauauauaauaugauauauaauauuauuaugauauauaauauuauaauauauaauguuauaauauauaauauuauaauauauaauauuauuauaauauauaauauuauuauaauagcgagagaaacaaaacaacccaggaauaaaguaguaagaaaugugcaagaccuauaugaugaagacuugaaagcauuacugaggagcacaaaaaacuugagcaaaugaaaaccacauuuauggauagggacacucaaccacaucaacccgucaauuuucucuaauuuguaaauuuaguaugaucucaaugaaaaugucaaauggcuuuugagggaaguagacaaauauauacucaaguucauauggaaaaagaaaaagcuaggaaaauucuaaaaacacaguaauacguauuaacuuuuuuuaaagacaguuucuaauauacauuaaguaaaaugagcaagguguagagaguaauguauagagagcuacauuuuggguuuuuuaaacaaggaaaaauacacacuugcauuugcuuuauagauacacaaaaaacccuggaaggauauauacaaguaauaacauugguaacuguugguguagaggugggaaaagaaguggugagaguuagauugauggagaacauacauaguagacucucacugcauaccuuuuaaaaaacaauguaaauauguuacccauucaauuuuuuuuuuuuuuggaauuagagugcuuacauaaaaauccuggcucuguugcuagaucuguuuucuuggucacauugcuuaaccuuucugugccuagguguucucuucucuaaaauuaggauaaucaugccaaacuccuagaguagcugcaggagaauuacuugaacccgggagguggagguugcagugagccgagauugcaccacugcacuccagccuggugacagagugaaacucucgucucaaaaaaauaaagauaaaaccuaacagugcaaagaacaaugccuagcguauggugaguauucaauaaguguuugccuagaagaaaaaccaauauuagagugggaauuuaaauuuaggucugccuuacgguaaugugguauuaugcuguuucauauuugccuaaugacuguauauuguccuguagggaaacuauauugcuuucauaauuaccuccagauauacaauacagaucuuuucauuuaugccugaaguucagacauuuauucaacagacaguugucuuccugcugugcccuugauauugugcuaggcauggaaguacuucuuugccuuuagucuucaauuaaccuuacuagagcucuuauucaaagacuaugccaaaauuuuaaaaaauuauuuguuuaugguacuuagagguaaugcuuuauuggagcgauauaaaauggauuggauuccuuuaccuucagacuuuaaagauacaauaaugugaccaaaaaagaaaagaauuaaagaugccuuuuuuuuucuugugagaagcacauacgugauggaaguuagauugaucauugauuuuaaaaagguuauuuaaugauuaauaauuauaagguggccaggcaugguggcucacaccuguaauccuagcacuuagggaggccaaggcaggcggauugccugagcuuaggaauucaagaccagccugggcaacauggugaaaucccauuucuacuagaaauagaaaaaauuagcuggguguggugaugcacgcuuguaaucccagcuacucaggaggcugaggcaugagaauugcuugaacccagaagguggugguugcagugauugcaccacugcacucuauccugggcaacagaacaagacucugucuuaaaagaaaaaaaaaaauaauaagguguaguuuguuuacugauauuuugaggaucauaggcacuugaguaaauauacuuaguuauacuuuuuuuuuuuuuuugagacagagucucacccugucacccaggcuggagugcaguggcgugaucucggcucacuuugaccucugccuccuggguucaagcgauucuccugccucagccucccaaguagcugggauuauaggcgccugccaccacgcacggcuaauuuuuguauuuuuagcagagacaggguuucaccauguuggccaggcugcucucgaacuccugaccuugugauucacccgcuuuggccucccaaagugcugggauuacaggcaugagccaccguuaguuauacuuuuaaaaccagcccugcccuucccaaaaugaugagcugaccuuaaaauguagaaugcaugguuugaucauacuucuguacucuuauuuugcauuugcuguuauuuucacaccaaucugaauaauauuuuggcuuaguguguuguugauaaacuguguacccacuguuauacagugcuugacugugagagaaauuuauaugucaagaaaaucaaggacaaauauauauauauauuacauggauguuugaaauuguauaaaacuguuaaguuguggagaacaaaaaaaggaacauuuaaaauggaagccauugcaguuagcuaucuuuaucugucaaaacaaaaugcaaaaacaacuccuuuuccuuguuuguuaaugcuugcacuuacuuggguucagaccuuaaauucacuuuaggaucuuuuccuuucccguagcaccaacauugacccaguugccagauuuugguuauuuuucucagugacugucuuguuuuuuaauuuccuuugcaaauagcuaacugugucguuuugaguuaauuacuuuaaacuauuggguccuuaguuuccuccucucucaaucuaaaauucuuuguuuucauucuggacuauuacugguguacaugagaacuguggccaguagcucuuuaacugaucucccugcuccaguucauucuuauuaauuccagguuaaucuuuccaagguauauuucaguuucucugucuugaaauuugcccagcuaaaguaccaucuccaucauuacuccuuggucacucuuauaagaauucaagucacacauuuuguguacuaccaaguacagcccauggaauucaauaacuuaauaaauugcaucgcugucuucccauuacaaugaucuucccuaccaugucaucuccuggaugguggaaaaccuugucuuacaugucuuugcuaaaaccacagugaaauacuauggugcacauagaaggaacucagggcaggguuguugaaugaacacaugaucaauguauuuuauugguugugucuuaggaaaggaagaucauagacucuuguuuuaaugaacuugaucaccaucagcuacauuagagcgaaaaauuuaaaauuuaaaacucuacuaauauauucugaggguucauucuuggcuugucuuugaaagaaauugaacuaaagcaacuauaugacuguauuguauuauguuggagucuuuauauuucaccuuuaccccuucuuuccucuucaaagcaacuaauuuuagcaguucauagacauccagauaguacuucuuuaaaagaaaagggccaggcgugguggcuuacgcuuguaaucccagcacuuugggagacugaggccaguggaucaccugaggaguucaagaccagccugguccaacauggugaaacccccccucuacuaaaaauacaaaaauuagccgggcaugguggccggugccuguaaucccagcuacucaggagguugaggcaggagaaucgcuugaacccaggaggcagagguugcaaugagcugagaucaggacacugcacuacagccuggguuacagagcgagacucugucucaaaaaaaaaaaaaaggauauuguaaugccccuaaguaaaaauaaaacuauauuuuggaaguaaauuauugaaacauaacuauguuauauuugaauauuaacaaaaggacagugguucaauaaauacagaaauguuuauaacuuagugccuuuaucugugaagcuuaaggauaacuuccucaugguguuaugaggauuaaauaagauuaaguaauuaaagugcuaagcuuagugccaggcacauaagcucuuuauauacguuaauuguauuccucuguauaaauauauaaaagggguaugaacuugucaacauaugcauuacaaauaauuucuuaaucuuguuagauguuucuucauauaaacauuuuauuguuugcugucaacuaagacacauaaguuaguguauauuaacuuuagauuuuaucagggaacccacuaaaauacuuucuuggcuauggauuguaccauuccaaauugcuacugguaauuauuaguaauaauuagagggaauaaaaauuuuaauuuauugauguuuuaguuuuguuuguuucuuuaauucugaauuugucuuaaaguuugugaugauuguuaaguccaucauguuagagauccuuuuaaaaguaucaguuaccaucagccugggcaacauggugaaaccccgucccuaauaaaaauacaaaaauagccagguauggcggcacacuuguguaaucccagcuacucaggagccugagucaggagaaucgcuugagcccaggagcuggagguugcagugagccgagaucgugccacugcacuccagccugggcaacagagcgagacucucucaaaaauaaaaacaacauaaaaaaauaaaaauaaauauaaaaguauuaguaaacaauaguugcacuuuguuuuauuuaaacaauaauuucacuguuauuuuucaguaauagggaaguuuaugccuugagugaaguagccuuugguuauuuuucucugcaacaaaauagcaauguaauuauuuaaaguuauuuaaauaauuaaauauuaaaguuauauuuaaaucugaauuacucauugauguuauucacuaaucccaagugauuaauaucuuuaucuuuaaaaagucagaaucauaaaaugggacagauauaugucucaugccuguaaucccaacacuuugugaggcugagguggguggaucacuugaggucaggaguuugagacaagccuggccaacauggugaaaccucaucucuacuaaaaauacaaaaaauuagcuggacaugguggugccggcugggcgugguuagcugaggcaggagaauuucuugaaccugggagguggagguugccgugagcugagauugcaccacugcacuccagccugggcaacagaguuagugagacucggucugaaaaaaaaaaaaaaaaaucauuaaauacuucaacugcacauucaguuguuuaauaaaacaaagaagaagaaaagaaaaaaaaauuauaaaaaaccaguguuaaauuugguaaucauuuucccaaucuuuucucugcauacauguguaagaauggagcucuacaguaucuuuuuuauuuuauaguaugguaucuugagaacuguaaaguuaaauuuuuaggcauggauuuuagguauacucugcauugcccuaguuuagaguuuugaguuguucagagagaagagaaggggaaaucuguauuuuuaacaacuaaugaggcaugguaggacagaggauuuugaaacuuaaucucuggugguuuuaaacauguacuaaagaguugaaaugaucucuuuaaaauagguauuugacaacguauauuccuucugaccucaguauuaaaauuuuucaguguggauauacuugucgcucuucauaaagcuauugauucuagauccuguuaacgugaacacaaaacaucaacagagauuuuuguucucuauauaaaaugaucaauguuuuaguuuguggucauuccuggacaugggcauucacagaacugccaaauacuugagucagcagaugugcacuuuaucaggggagguucaaggcagugcucugccuuuuuguucuagcugucauuacaaacaaguggccuuuuugugauauauuuaaugccacauuuuuuguauauuuugcccaucuuauuggugauuuugcuguuuaaaaugguccccaggccgggugcuguggcucaaaccuauaaucccagcacuuugggaggauuacgugaguccaggaguucaagacuagccugggcaaaauagggagaccacaucucuacaaauaauuaaaaaauuaauggggugugguagcucauguccguggucccagcuacucgggaggcugaagcaggaggaucaccugagccugggagguugcugcugcagugagcuguaauuucaccacugcacuccauccugggcgacagagagaccuggucuaaaaaaaaaaaaaaguguagugcuuaaauacauauuaaauaagauguuuuaaaacagaagcaucccuaaaacgagauuauguauuuaucaguugacaaaaauguucugaccagaggcuugcaggaaccuuaccuuguauuuucuucgggggcaaugauucaauauuugcuaagucaauguucauggugauuuuauaggacauaacuacugcagauagugagaauugauuauucccagcuagacuagaauaaaaagacuaauaaguggaagaaugaugugguuucuuagaaggaugaugcaguagugaaauaaacuaucaguauauagcauccuucuguuucuucgugcauuguacagaguauugugucauuuuuuaagaagguauaaaacaagucuggagucucuaucuuuguagcuuuuauuuuucucuuuuuguagcuuucguuuuccacaauuaagaauauagaauuuuucacucuguguucauaauggcaaagagaagaaaauugacaagagggagauguuucacaauucagacguuaucagagagagcagcacuuuaugauggugaaauugaucauauaagugaacucuuacacaaugaauuggaguugaugauacucuauaugaauuuucacaagcuuaauugauaauauuucugaggucccagaggacauaggauauuuuuacccaguuacucauucaacaggaaguacuuuguuauguaauauuuugcaacaagaaccuggacuugucuauccuguaugugagacaguauucuuuuuuuuaaugauauuugugcagaaaaauguacuugauguaguucguaagcaaacaaacacugaaguuggauuugccuacaaaggugauuggaaggacacagaugauguagaaaugaaaauuuucauuagguugaucauuuuaacuguuuuaaaaauaagccuaaaaaugaaagucuuucuuuaagaagcaaagaaggaugcccucuuucuccucgguaaaaugaugcgccauuaguguuuucaaaaguaugauuaauuauagaaguguaagaagaaccagaaguaaugaugaacaaggaccuauuagagauguauucgaagucguuaucuacaaaguggauauguuucaucugucuagcacuuuaucuuuucagguuuugccuaugucucugaaaaaugaauucagaaggcaauuuuuuccacuuguguuuuccuuuuugugccuccaaaaauuaaaugucucuuuuuuuuucuugaagagaaauacugugacucauaaauacugauaggaacacaaugauacuuuuuuuucacccuuuuuauaugaacaguuugaagcauaaagaaaaguugaggcugggcgcgguggcucaugccuguaaucucaacacuuugggaggcugaggcgggcguguugcuugagcucacgaguucgagaucacccugggcaacauagugaaaccccaccucuaaaaaauacaaaaaauuagccuguagucucagcuacucaggagccugaggugggaggaucacuugagccucggaggcgggguugcagugagccgagaucacgccacugcacuccagccugggcaacagagugagauccugucucaaaaaaaaaaaaaaaagaaaagaaaaguugaaagaauaguguuaacauuggccgggcaugguggcucacgccuguaaucccagcacuuugggaggccgaggcgggcggaucacgaggucaggagauuaagaccauccuggcuaacauggugaaacucugucucuacuaaaaauacaaaaaaaaaaccaaaaaaaaacuagcugggcaugguggcgggcgcuuguagucccagcuacucaggaggcugaggcaggagaauggcgcgaacccgggaggcagagcuugcagugagccaagaucgugccacugcacuccagccugggcgacagagcgagacucugucucaaaaaaaaaaaaaaaaaaaaauaguguuaacauuuugccauauguuuugucuguguguauuuauauuuuuaaauaacauaccuuuuuauuucagaauuacuguugacuauaaugauuauaugcuguuauuaaaccuuuccaacaaguuuagcaucaaacauuuguaauuucaacauuuuguagcccuuauuuaucaaaggauucaauaguuuuuuuaauggacuuguguggcaaguuuuuucuuuguuuuuuuuuuuuuuuggucuuuggguuuuucuacugaucaucaauugaugugguuuaauccccccuuaacucuccguuuucuaauuguguuauuggccuuuaaagguaaauguacuuuggugauaguaccuggaacauaguaaauaauaaauguuagcuguuagauuuggcaugaguuuuuuuugcaucccuuucuuacacggaacauuacugggccaggcuuuguaagugaauuuuuuuguuuguuuugcuggauucauuuauuucucuucauucuugcuugucauuaucucccuuuuuaggccaucuugauuugaguauucaaccagaauuugacuuggauguaaaaugucucaacaaaccauugauaugacuuucuaggauacuggggaaaaaugguugagauuauucacuuugaugagccauuuggaaaaaaauagauaacuuuuuaaaaauuauagugaaguuaucaguuuuguguauuugaugucuaaaaagucagcuauuaaauauuauucucaaguuguguguuuuuauaauaauguauugcugaagucauuauccauuuucaaaguuaguaucccaauaauuugauggggcuaaaauucugaaagaacaaaaauuaucuucaguauuuaguauguugaaaaagauuaaagagcucagauuaguuuuaaaaugaaaacaaugguuuuaauacauugcuuuaacuacuuacucuaagcgucuguuucuuuuauauuuuuuaaguuauauuuuauuuauuguuuguuuugaaaagacaauauauauucacaugguucaaacaucaaagcaauuuaaauacacauugagaagcuuggcucuuacauuugaccacgcuauuguucccucugccuauaucccuucuaaguaacuacgcuuguuaguuguuuuuuuguuuuugagaaagggucucacuuugguugcccaggcuggagugcagugaugcagucuuggucacugcagccacaggcucccaggaucaggugauucuccuaccucagccuccugaguagcugggauuauaggugugcauggcuaauguuuuguuuuuuuaguggagaugggguuuuuguuguccaggcugguccugaacuccuggacucaacaaucugccugccucagccuuccaaaguacugggauuacaggcauaagccacugcgucuggccuuguuuguuuuuuguuuugagaccgucuuacuaucucccaggcuugagugcaguggcacaaucacggcucacuguagcccugaccucauaggcuuaagagauccucccaccucaauucccugaguaguggaaacuacaagcauuugcccccaugccuggcuaauuuuuaauuuuuuuguagagacagggucucauuauguugccgaggcugguuucgaacuccuggauucaagccauccucccgccucagccucccaaagugcuagguggcaugagccacugugccuguucguuuguuaguuuccaaaguguuuuuuuuuuuuuuuuuuuuuuuguggcagugucucacucugucacccaggcuggagugcaguggugugaauuuggcucacugcaaccucugccuccuggauucaggcaguucucauagugagauuacagacacccaccaccuaggcuggucucuaacuccuggccuuaagaucuguccaccucagccucccaaaguccugggauuacagaugugagccacugugcccgacuuaucuuuccaaaguuuuaaaaauguagauaaaauauuagcaaauaugaauauguuuucuucuuccucuuacacaaaaaauagcaaaucauguacacuauuccacaucuuauuuuuuuucuuccccaauggauaauauauccuggggaucuuuucauaacaauguguaguuuccucuuuucuugauuuuuuuuuuuaauugcagagcauaauauuucagcguguagauggaaucuuuuggauacuggagaauuuccaguguuuugcuauuguauauagugcugcaaauauauauauauacacauacacagagguauaucuguagaacaaauuccuggaauuggaauugcuaggucugaagggugaaugcauguguuuuguuagauauugccacauuucucuucauagagguuguacuguuuuguuuuuagacuaacaguauacaagagugccuuuuuccccaugaacuguuaucaaacuuuuugauuuuuaucagaugaauaaaugguaucuugguauguggguuuuuuaaaaaacaaauuuaaaaaauacccuuucuuuuuagagcaguguuuuagguucagggcaaaacugagcagaaaauaaagaguucccuucuacuuccuguccccuaccaugcaccaccuccccagcuuucuggauguucugcagcacaauggcacauuuguuaaaaucaacaaaucuacauugauauaucauuaucacccaaauuccauaguuuagcguucauuuuuaguguuacacauuaaauggauuuuaacagauguauaaugacauguauccaucauuguaauaucauguagaauaguuucacugcccucaaaauccucuaugcucugccuguucaucccucccucccuguauccccuggcaaccacuaauuauuuuacugucuccaucguugucuuuuccagcuugucauauaguugggaucauguaguuuguagccuuuucagauuggcuuuuuuacuauuaaguaaauuucuuccaugucuuuucauggcuugguagcucauuucuuuuuagcacuaaguauuccauugucuggauguaccacaguuuauccauucaccuacugaaggacgucuuggaugcuucuggguuuuggcaauuaugaauaaaacugcuagaaacuucugugugggcugggugugguggcucaugccuguaaauccuaacacuuugggaggcugaggugggaggagcacuugagcccaggaguucaugaccagccugggcaacauagugagacccuguugcuacaagaaauuaaaagauuagcuggguaugguggcaugugcuuguagucccagcuacccuggaggcugaggugggaggauugcuugagccugggaggcugcagugagccaugauuaugccgcugcacuucagccugggcaacagggugagacccugucucacaaaaaaaaaaacaaaaacaaaacauucaugugcagguguuuauguggacauaaguguuugaguaaauaucaaggaauugggucauaugguaagaguagauuuacuuuuguaagaaucugccaaacuguuuuccaaaguggcuguaccauuuugcauucccaccagcagugaaggagaguuccuguugcuucacauccuugacaucacaacugguguugucaguguuuugucuuguggccguucuaauagguguguagugguauguuguuuuaaauuguaauucccaugggacauaaguugaacauauaaguuaaauaucuguuuguaugccugcuugccauuuguuuaucuuccuuggugaggugucaguuuuggucuuuuacuuguuuuuaagauaggauuguucguuuucuuauuguugaguuuuaagcauucuuuguuuacuuuggauuaauacuucuuuaucagcuguaucuuuugcaaauguuuuccccugggcuauggcuugucuucuuacucucuugauagauuuuuuauucaagcuuaacccauauggaaaagugcaaaauugaaaauauauguauagcuugaugaguuuucuaagugaaucuauuauuggcuucucaguguaguuugaauuugcauuucuccacaggccauuucuguuucuuucucugugaacuuuugguucacaucucuuacccacuugucaugcgaauuacugaccuuuuuuuuuuuuucccuaagaagucaauaaaaacuggggauguuauucuuuugucugagaugaauacuauuuuuugucugauuuuuuucaucaguuuuuugacuuugcuguugguuuugcuauaacaaguaauucaaauuuccucaaauggauacauggacuccuucucuuaccucagcucaggacuuagcuaguuuucacugucuuccaaaauucuucauguuuuuuuuuguuuguuuguuuguuuguuuuucuggagacacagucucccucuauagcccaugaaggaauacaguggcgugaucacagcucacuguagcuucaacugcuugggcucgagugauucuccccacucugucuccccacagaugugugccaccacgcuuggcuaauuuuguaaaaaauuauuuguagagacgaggucucacuauguugcccaggcuggucucaaacuccuggguucaagugauccucccaccuuggcuucugcaagugcugggauuauagaugugagcuaccucgccuggacuaucuuuuaagauuuacauaaauagcucauauuccuuuaaugccuuuuguauauguuuaucuuagcauuuagucacaaucuuuaucucaccuccuuuuccauaggcuguaaacucauugagggcuaggacgcuuauuuuauucucucucucucuccagugcuuggagcacaagaaguguacaauacaacuguuuaauauaaaugauugcuucuuuguuucguggauuuugguaccuuugacuuuacauugcuaucuuugacuuuacauugacauuugguaccuuugguaccuuugacuuuacauugcuaucuuuauagcugaugcuauuaauuuguuauuguugaaccaaccaagcagucuuacuuaccugucuugucauccuaucauuuucugcuacuuccuuugaggauuguucuggagagaacuugacuuuuucuggagccucugagauaacagaucuuuuaaacauuuacuucuucauaauuaagauuuaugggaauguuuugauauaaacaaaugaugcuucuaaguauuuuuucuuuuuuuuuuuuggaacagugugugucauaucuugcuugccuuuuuuguuuuuguauguuucuguaaaauacuuuuuuaaaagcuauacaaaaaaugagauauuaguguaauaaacuucauguacuggaagcuucaggaguagguaaguacuuaauacaucauuagaguugugcagguuccuagaggcuauauagggcuaaccucccucuccaaaaugcaagauaguaaucuagauacaauuugaauuucuguauagauaggaauuucagccucuuugguucagucuguuucauuauugaacagcugcauuuguaaauugagcuaaacuaugccucugaagaaacccugauugauccaguuuuaaccacuuucaacauaagacuuuuaguuuguugaagacaaugauuauagcuuucuuauuaagcugaaagaaaguuaauuuuaaaugguaucuuuuaaaaaacuugugauacuaguaaaaaaaccugacaaacacaucuugaggacuaagagaaacaaauucacuuuccuuauugauuugucaauugauggcuacugguaguagggccaguauuuuaagggccaauauuuuaaguuaauuucuguuuuaaaaauugaacauauuuuaacuacauguaucuuuugauauuaaguuggcaguccacaaauggaaacccugucagucaugguuuacugccuuucaguucucuacucaccauaucuaauagaugcuuuauuuaugagaucuuuaaaaaauuuguuuuccauucagaaauugcuaauucagauuauuuccuuaauuuccuuuuuuuaucuugagacacggucuggcucugucacccaggcuggcuggagugcaguggcaugaucuuggcuuacugcaaccuccaucucccagauucaagcgagucuccuguuucagccucccgaauagcugggaucacaggcgugcaccaccacacacccagcuaauuuuuguacuuuuaguagagaugggguuucaccguuuuggccaggcuggucuugaacuccugaccuaaagcgauccgcccuccuuggccucccaaaaugcugguauuaugggcgugagccagcacaccgugccuguuuccuuaauuucagaaucacuucauggcagcauauacauuguaauauaugugucaguuaugaucuuauuguuaaaaucaagcagcccagguuauuuaaaugauuucuucuuuuuuuuuucaccuggacucuuuuauuaguaauagauuugaauagaagguacauucugagagaaucuuuauaaacccuuaacuucuucccaaaauguucaggucacuugauauucugaguugauuaugcccuaugauauauuuaucugugguuuaccacaaugagaauuacguuuggaacauauuuguugaauaguucaaaauaacugguuauaucuaguguguguuuaagcauuucuuuagcuuguuuguauaaaaugaagaauguguuuuguucuuauuggaaguucaaaacuagaaugcaauaucuuuuuccuugauuucuguacuagaaugcaauauuucucuucuugauuucuguagagcagguuguugcccuggaugcccaaaauauuguagcuguuucauguggagaagcucauacguuagcgcuaaaugacaaaggccagguguaugcuuggggucucgauucugauggacagcuuggccugguaggaucagaggaaugcaucagaguacccagguaacaaaggugaccagaaagagguccuuaacaaucuuuuaaaauaaauuuguuaaucuaaauuguucugcuuaucuuugggccuguaagaguugacaucucauuauuucuccccuuugaguccuuugauaagaguuugguucuugcuuaugauguugauugagcuauugauugauuugcuauuuuuauauacucuauauuuucucuauaaucaauagaauuuaugucuguaaaaaaagcauagggaauacuugcuucauuacaaauuuuuuuaguggguuauacuaauuuaaacuacuacuaucuugaguauuccugcuauugaaauauuuauuaaauauugguuuguugaauguuuuucacuaacuuguccuuuuuuuagucuuuauuguuucuguugaauauagaaguccaacaugcuuacuguaaaaagaauuuagucacuuuccacuuuguacauagcagugagcccaauuuaauuaauucaucauauaauuauuucacaauuaaaaaauaagcagugccucaucaauguuuuagucuuacacaguuacauagggcauaaucguuuuuuguuuguuuguuuuugagacagagucucgcacuguugccuggguuggagugcaauggugugaucucggcucacugcaaccuccaccuccugguuucaagcgauucaccugccucagccuccugaguagcugggauuacaggcgcccaccaccacagcuggcuaauuuuuuguauuuuuaguagagauggggguucaccauguuggccaggcuggucucgaacuccugaccucaagaucugcccacuuuggccucccaaaguacucaugauuauaggcgugaagcacugugccuggcuaaucauuguuuuaauauuaaaaacucuaacagcaugaauuacauagguaaaaauauacagauuucaguauucaguuuauuucagauacauaaauaauacauuaacucauacuuaguuuuaaaauuuacacaaauucugaccucuuuaaacucuuuuguucuuuuuccuaguaauaguaauucuuauagaacaggauuuuaaauuuaagauuuuuaaaaaacuguguuuaggaugaaaagagauuugcauguuagaucuucugagucaguauucucaaaaccaugauucauggcaaaacuuucuaguuuccuuuauuuuuacucuaccagucugaugauucucauacuuaaacuuuuguugcuguucacuuuuaagggacuuuagucaguaauacauagguaaauaauaaauggaaagaaaguuaauuauaaggagagaauuuuauuauguauaaaauuuauaugaggguuguccaauaauaacaacuaugaaccuggauggggaccugaaagagaauuuacuugaguucuuugguuucaacaucuuuauuuuuguaugugcucaacaucuguauuaacuuuaagcuguauguuaagguauuucugcuuuucauccuucucaguuuuucaaaauuuuauggcuugaucugauuuguuguaacguauacauaguuuuuacugauauuaccagcuuuuaaagggccauuuaguauuucaguggaaauguuuuuuuauaaaaggaagagugccaagagaguuuugguuuuaauuucaguaccaaaucauuuuucagauguaaggcuuuuucuagguggcuuagagaugucagccagcuuuguaaauuuuacauauaguaucuauaaacagauuucuaaaaauugguguuuauagauuuuuguuuguuuguuucuugagacaaagucucacucugucacccaggcuggugugcaguggcaugcucacagcucacugcagccucgaccuccugggcucaagccauccucccaccacagccucccuaguaggugcgacuauaggcgugcaccacuaugcuuggccaauuuuguauuuuuuguagagacagaguuucaccauguugcccagcuggucuuaaauuccuggacucaagggauucaccggcuuuggccucccaaaguguugagauuacaggcguaagccacuguguccugccuaguguuuauagauuuucguaagaguaaucagaauaggcugggcauaguggcucacgccuguaaucccagcacuuugggaggccgaggugggugaaucacaaggucaggaguucaauaccagccuggccaagaaggugaaacccugucuuuucuaaaaauacaaaaaauuagccaggcaggcgccuguaaucccagcuacucaggaggcugaggcagagaauugcuugaaccugggaggcggagguugcagugagccgagauugcaccacugcacuccagccuaagcgacagagcgagacuccaucucaaaaaauaaaaaaaaagaguaaucagaaaagugaagauucgcauuagguuauacuuuugugacaacaaaacccauuuuuaaugccaguggauggauaauauuaaagaagaaugugaaauuaacaauaggauauaacugaaacaguuugauaaugaauuguuuccuacuucuaauuuuguuuuguuuugaagucacuacuuugggaaagaccaaguauuuuaaauagugucuguagaccugcauuucuggcuagauguuaauauagaauauauauuacaccauuuuauuuaaaaaauugacccaaauuuuauuaucguaguuuaauauaaguggaaacacauaacuuugcacacagacuucagaaaaauaauuguuggcaauaaagauguaguuuaucuuuuaaaaguucugcuucuuggacauauacauuaaaaaauuauggcaagauaguauaagauuauuauuuuugugaguacagcaauuucuggacuauacaaacuaaacauauuugaauuauuagcuuggucaaaaauacaauuuauuuucuuguuauucauuuuaagauauauuacaauuccugccuaauuuuagcaucugaaaauuuggaacauuauagauuaaaaagaaaaauuaaagaguaguuuuuaaugguauagaguaggucaguuuuuagucuaaauuuuucauuuuuuuaaaaaucuacuccccuauucugagauaaauuuuucaaaauugaaaugaguugguguuaagauuuuucuuaaauuacuaggaaaguuguggcuuaacuggaaaauagaaaauugguaauuguguuuaauugcaaaauauuuaauacuuuagcuccucaaauguuuaauuacauaauauaaacuuuuuacuaaacauuagugguuggaauuuugucuucagaaacauaacuaacaaugccugauuucugccuauauugccgcuacacauuaaguugggaaaacagaagaauacaacaguauacauauuccauaauugauaugcuuuagcagagucccaaaggaaggguauauaaaucuuaucuccaauguguguguguguauauauuuuuuuaauuuacaaaauuuauucuggcuucuuuuucuuuuuuucuuuuucuuucuuuuuuuuuuuuuugagacggaauuucacucugucacccaggcuggagugcaguggcgcaaucuuggcucacugcaacuuccgccuccuggguucaagccauucuccugccucagccucccaaguagcugggacuacaggcgccugucaccaugccuagcuaauuuuuguauuuuuaguagagacgggguuucaccauuuuggccaggcuggucuugaacuccuuaccuuaugaucugcucgccuuggccucccaaaaugcugggauugcaggcuugagccaccacgcccagccuuucuuuugcuuuucuguucaguguauuugaauauucaaaaauuagaaaugauuaaacacauuaucuuuuuuaugugacaaaggggauuacuuuugaugaguucuaacaaauuuauuuaauuauuuucuaauuuaucucuuuagaaaaaauggaacaugggaagccuuguuuuaccauucacaguauuuuuuaauuucuaaaagcuaaaacaaagaaaacaaagccaauaucccccauucuuuaggguauuaauacauuuauaugaagaugaaaggggauaguuuuuucuuuaacacaguaaugacgcagaagaauauacuucuggucucuguagcauauaaugguaaaagauauuagcauuuaauguguguuacaagccuuagguuaguauuuuggaaaggagaguaacugaguauaaauugcuaugcaaauuuagaaaauuuuuggcaaauuuuaugacuaauacuaaagccuccaagaccuuacaaauguaguuauccuuuaacaguauauucauuacguacuauuaauuaggcacuauaguaggugccaggcauuaucauggguauaaaacacauagucugccuucacagaacuuacuguuuagcagaggagacaaauauuaaaugaauagguaccugugguuaguagcgauaaaugcucugaaggaaaaaacauacaguacugugagaauguaguauuuugaaauguuucauuugcaaaauuguacuugauacucagaauaguguuuuuuuuuccuaaaauacuuaauaugcugaacaggucaauguaucaucugccuaguaugcauaaacaauaacaguaaauguuuaguaauuugagcacaguuggguauguucauguauuuuuuauuccuuacucuguuugcauugccaguguuugauuuugcuauuucaaagaaauggcauuuuguugaguuugaaaauuugaaggugcauuggauccugcuaauuuguuggauucugcuaaauuguagcaguacagcucucagguuuuguaguuaagagcauaacuucacuaaauaaaaauauuuuuaauacaauaauauggaaucagaguaacucuccuuuuuccugcucaaacuuugauuugcugaagcugcuucccgaaaaucaugugugucgacucucuggucagaauuugcuccggacucucuuauggcagaaucaggucaggugacaguaucagguaaagggaaauaagaaacauauuguguaccuccccaucccccguuuuuucuuuucuuucuuucuuuuuuuuuuuuuuuuuuugagacagggucuuacucuaucgcccauucuggagugcgauggugugaucuuggcucacugcagccucugccucccagguccaagucauuuuccugccucagcuucccgaguagcugggacuacagcgugccaccacaccugcuaauuuuuuuuuuuuuuuuuuguauuuucaguagagacaguguuucaccagguuggccagucuggucucaaacuccugacugaccucaagugauccgccuaccuuggucuccaaaagugcugggauuacaguaacccaccuguaauccgcaucuggcauccccccuuuuuuucuugaaaacauucauucaggaaaaacaguaacaugaccaggcaaagggaaagaaccaauggagaugcugggaugguugauguacauacaaaguuaauugaguuuuguaauguuuuaaaaaugagccuuuaaaguugcguugugguaaaacaaaacucaggaaaggggggaaggaaauuacgaaaguauaaggacaaaauacaagacagaagaaaauaagacuuaacauauuaguaaugauuguuauaacugugaauugaguaaauuuccugaguaaaaaaauugaaugucccugauuuagacguaaagcaaaaggauagcuuguaaggaauagguuucauaauuugagaguugguagaacauacaagaaucccuguugguucuuaagaaacccgauaaaggagaacgugcauuaaacuaggcaaaacaccaauuuuagacaaauuagauaauguacauuugcuuuccagauguauugccaaguuucuaacuguaagcugaugauuuaaaaacacguuuuuauaaugaaagaaaauaucugaauuauaagagcacucugaggaguacuugagguaugaguauagcucacuuugcuuaaauacugucuuuccaagauguguucuuuucaccccuuuaauuuuuuuuuuuuuguaucuagcucuuguuuacugauuuuagcauaaauuuuugguacgcuaaaauugagcuuguaugaaaaaaaauaauaugaccuaugugcauauaguaggccaucaauaaauaacauaaauagcauucaagaucaauuuguuaaauggaauuaacuggucuugaucugucuucuucuuuucuagaaauauuaaaaguuugucagauauccagauuguacagguugcuugugguuacuaucauucacuugcacuuucuaaagguaagcauuaguuuuuauuuuauuucucuucaguuuuauuacuugauacuuuuuugauugugcauauaguucuccagcuuugcucaucuuucugcaagauugcccugguucuugauccuuuucauuuccauauaacuuuuagaauuagcuugucagucuguacacacacauacacacacaaacacacacacacacugcuaggaauuugggauuuuguugucucuauaaaucaauucaaggaaaaucuuuacaguauugaaccuuucaauucuagaacacgguauauuuguccauuuaagucucccuuuaauuuuuuccauuagcauuuuguuuucccuggacaggucuuauacaccuucgauuagacuuuccccuagguauuugauuuuuuguuguugugaauggugucauuuuuuguuuauuauauagacaugaaauugauuuuugugucuguuuauuaaacaguuaaaaacucuucauagcugcaacuggggaagauugcuuccccaaucucauuuaaucucauagaugaacuuucuaugcauagaaauaaagaaggcuaaacaucauauuuauuagcuuuguuugcauuccucucuuaccaguuuaacuuacuaguauccuagcuaaggauuggaacaugggcuaguaaagaaucugccauauguauguuuuuuaccauuaaaauaaauagguuugcugggcgcaguggcucacgccuguaaucccagcacuuugggaggccgagaugggcagaucaccugaguucaggaguucaagaccagccuggccaacaugguaaaacccugugccuacuaaaaauacaaaaaauuagcugggugugguggcacacaccuguagucccagcuacucgggaggcugaggcaggagaaucgcuugaacccgggaggcggaaguugcagugagccaagaucacggcacuauaguccagccugggcgacagagcgagacucugucucaaaaaaaaaaaaaaaaaaaaagaagaaauagguuccauuugcuccauuguuacuauuuaguguuacuauuuagugaagccuacuacaaauaaagcacuaggaaccauggggaagcacagauaaauuaagagacagguuuagggaucauacaaucuagugaaagagacagacauccaaguaaauaacuguagucugaggcagaaaaaaauauguacuauuucagacaagguaaaaguaaaaugcugugacaaugauauaauuguuucuaauugauauaauugguaauaauaaggaggggauuaguauuugaugcaagucuuuaaagauuuauuaaagauuaauuuuuuuauuaauaauuggagaaauguugagaagaacaaggagaaauguugaguggcuaaggggguugugcugguguaaaggcauagaguuaagaaagugguguauuugaauauuggcauguaguuuuauguggguguugugagggagugggagacauacucauacuucaguuuaggcugaaauaaaaagagaagucuguuauaaagggccuuaaaugucauauuaaggaauuuggacuucuauaggcaguuaggaacauggaaucucuguguauucuuuguuguuuugccaacuccucuuuugauauuuugguagguggaucuaacauaaauuuaaacucaaagguuuuacugaggacaguuuuucauauugaccuuuuuguuuguuuguuuacucagcuuugugguguaggcaauaucuuauucauuugcuaaacuuuuuuuuuuuuuuuuugagauggagucucccuuugucacccaggcuggagugcaguggcaugaucucggcucacugcaagcuccgccuccuggguucacgccauucucuugccucagccucccuaguagcugggacuacaggcgccugccaccaggccuggcuaauuuuuugcguuuuuuuuuaguagagguggaguuucacuguguuagccaggauggucucgaucuccugaccuggugauccucccgccucagccucccaaagugcugggauuacaggcgugagccacugugcccagccgcuaaacauuuuuuagagcccuuaguaugaacuaggcauacuacaguauacaguaauaagcaguauacuacuuacuagccuucgugauauagucauucaauaaugauauaauuacauacuaugauaagggcuauaaagaaaaacuucaggguauuuagaacauaggacagcgguacuagaccuaaucugggagaucagggaaggaaggcuccugcugggagagaguugaaaugaacuggacaaagaugagggaaagguuuagguagagagaacagcaagugugugagaacuggccauuggagaauauaaaggaaggcaauacggcuagaguauagugagugacugauaugagaagagauuggaaacauagguagaucauacagcaccuuauaggccuuguuuaaaguguuuaucccaagagcagugagaaagcacugaaauauauuuuuuggggugagcaauauuaucaaaucugcauuuuuacaauaucucuaugcauguauacaaaugucuauuuauaugugcauagaacauuucuugaaggacuuaccaguaauugguaagagcgauugucccaggcugggugugguaacucacaccuguaaucuuagcacuuugggaggccgaggugggcagaucacuaggucaggaguucgagaccagccucgccaccauggugaaacccugccucuacuaaaaauauuuuuuaaaaauuagccaggcaugguggcacgcgccuguaaucccagcuacucagaaggcugaggcaggagaaucacuugaacccgggagauggagguugcaaugagugaagauugcgccacugcacuccaaccugggcgacagagcaagacugucucaaaaaaaaaaaaaaaagagugguugucucuugaaagaggaaccaggauucugauuuuuuuggaaggaagcuuacuuuuaaguguguacuauuuuguuguuucaacuuaaaaaaaucaguuauuaguguaucaguuauuuagugcaguuguuaguuuaauaaaaggaugucuaaaguugcaaaauacgauggcaauaugggagcaaaagugacaggcagggaaaacuauuauaggaaucaguuaagauggugaggaauggaucuauuugccguauuuuucuuuaggaagaaaacuggauguaaauuuggugauauaugauagacuggauaugugugagguuaaaaaaaaaaagagagaggaguauuaaggaagacucccuagguuuauaauuuuugcuacugagucacuuaggauguuacuuaccaaaauggggagcacuggaaagagguccagggaaguaggaugggggucaugaauucagucuggggcauccuaaguuagaaguuccuuugaaauuuccaaguauagugucagguaaacaauggguuauguggguuuuuugcucaggagagguuugggcuaguguuaaaauuuugaaugugaucagcagauaguuauuaaaguuugagcuugaaugagugccucuugggagaaacuauaaaauaaaaaugagacuugaauauuaaaaggagacuguugaggggcauaaggaaaugagauuauuccuuguuaugugauucaccgguucaucuguguagucaaucaaacuuaaaguguacuaauacugaauguucuucuagguaguaguauauguucauauaagaaauaaguauaauugcuaaaaauaauauuuauauucuuuugaugauaggcagaaugucccaaaauaauauucuuuauaugaaauuugaaaugaaaugauuauuuucaaauuaaauuuuuugcaugugagaaaaaugguuaauuuuuccauuacuguuuuacagcaagugaagucuucuguuggggacagaauaaauauggccaauuggguuuagguacugacuguaaaaagcaaacuucaccgcagcugcuuaagucuuugcuuggaaucccuuucaugcaaguugcagcaggaggagcccauaguuuuguacucacccuuucuggagcuaucuuuggauggggacgcaacaaguuuggucagcuaggucuuaaugaugaaaaugguagguucucauuauguauaguuuaaguguacuuuuugaaagagauggucuuuugaguuagaucagugauucuuaguguaagagagaaauguaucuucccugguauagagguggggaugagauguuauuuaaaaauuccauuuggggaaugcagugggaagauacaaaauauccuuuauucauuaaagaacuauaaaaaguauaucuggacaaaauguuuaguauuggauguuuauuaaaagacaauugaaaaacauuacuucaaauuguuaauccauuauuggccacuguuaguggaaaaaagcuguaaaauuauucuggggaaguaacaugaaguguuaaucuuugaguuuuucaaggaaauauuuaaaugauuugggcuguuaaauuaaucuuugguugggcuucacuuuuaacauugaugcuaaagucuuaaacauuuugaauuugaaaaaauuguaacugaaacaaguugggaucuuggaacuuauuuuucaugauuacauugaguugaaugccaguauuugacuuacaaaagcuaauuucuuauaguucaguauaauuguaaugacugaaauggacaaaagugaguuauuaaucuaguaacaacuaguaaugauaagcaaacaauacuuucagaaagaauuaaagaauaccuuguuuugcauaagaaaaauaugucauauuaggauaucauguaucuuuucugcuacaaaacagccuaaaguacauuuuuuuuuccaggcuuuuaaguaggcuccuguggguguaacuaucaugaagugaauauaaagaaugauguauguguggaaaauuagaagcaguuagauaauuuugaaauuucuugauuucugaguccuuugcauacuggcauauuggcuguuuagcacuuaacucuuaagucccuccuuuaucacaauaguauggauaggccugggaaccugacuuaguaagcuuguacuacaaaaucaucgaaucauaguuaaaauuauuuagucacaacuaucuacugagcuuggcaagcuguagaggaaacacaucuagaugaguuuugauuuuuaaaauacuauuaacaucucuuguuggaauuuucagauagguauguuccuaauuuacuaaagucacuaagaucucagaaaauaguuuauauuuguuguggagaagaucauacugcugcucuaaccaagguauuguacuucuaaaacuucuuuauuauuacucaucauaguucuuucauaauuaaugaauguucucaugguauuuucucaaguuuuaacuugaguguuauugguauuucaaaaauaauuuaucugggaaaaaagacuuagauuauucuugaaaaaaauuuaccuuauuuuucaauguuguuuuauguuauuaaaugugaauucugauauacuauuauaugugaugauaguauauugcugaauuucucagcuuuauaugaaauacugcuuaaggucauacuuugaauaaaauuauuccguuuuaguucauuaagcuugccaugauauaugcaucaaacccauuuauaucguguagcucagccuaauuugaauguaguuuccauuuggcuuauaaauacuucauacaagcaauagaggagaugaauuucucuguuauucauaggccaaguauugugcaagcaguuacagugaucacagucuuaucaauggcuuuaacucugaccucucacugucuuggguaugugccaauugaguaucaguacuguuuaguucuugagugacuagaaguuagaugaaaaugaaagcauucaguuaaccuuuaccagauaauuauuuauugcagucauguuaauguaaaguuuuucauuggucaaauuagaaacugguuaaauuucuuuaucuuuuuuggucuuacauaguauauaaaauugguaaaaagacauuaacguccgggcacagaggcucaugccuguaaucccagcacuuugggaggcugaggcagguggaucaccuguggucaggacuucaagaccagccuggccaacuuggugaaacucugucucuucuaaaaauacgaaaguuagcugggcauggcggcaggcaccuauccccagcuacuccggaggcugaggcaggagaaucaguugaacccaggaggcggaguuugcagugaguugagaucacaccacugcacugcagccugggagacaaagagugagaccucguuucaaaaaaaaagaggcauuaacuucuaaucaggcuuuaaaauucuacauuauauuucuacuugggaauuuuagcaggacaauaauuauucuucguuauugucaaauauagugaacucaaggcacuuuuaaaaauauaaugaccaauuaugaaaguuaauuuuaaaguauuuuguaguacuugccuuuuaguaaggaaggauuauuauaccugccaaucuuauuauuagguuggcgcaaaaguaauuucauuuuuuugccauuaaugguaaaaacugcaauuaauuuugcaccaaccuaauaucauauuuuauugauuuuggcauucagauaacaaauguaaucacugaagucuuauuuauuccuguuggcgagucuuaaauuuuacucguccuuuuucguuauugguauuuggaagaaauuuaucaaaauauaaaaaauaucauguguggugucauuccaaaaacuaauuuuauggcagaaagacuaacaauguuaaugcuuuucaaauucagccuuucagauaaccauucauccuaauguucuaggauaaguaacuuuuuaugucuauuuaguuuuaagaaaugcuaauucucuuaaucuuuuguauucuucucucagaagauaguagcuagugauauuuguuuauuggaauuuuggguguacauuauuuuuaacaaaauuagauaguuguuaauauccccaaaguaaaauauuuuauuuucccuuuauuuaaguuaaaauaccuguuccauauccauaugucuugcuuuucuggaagaauuucuuggaaauaguaaauagauuaagauugcuuuaugaagcaguuuucuguacaaaaccuaccuuaggaaaacugcauuaggaaagauuuuaaaaccaacuuuuaaaaacagaauaaauggaaagacauaccauguuuauagauaugaggauacuuccauaaagaugucacauuuuuuucaaguuuauuugcagauguauucuguaaaucacauacaaauacacauuuugauguagcagucccacuuuuaggaaucuaccccaaagauuugaaauugugugugcacaagaccauuuacugugaccuuuuaauggcaaaagacuagaagaaauccaaauguccaugaguuaaauaaauugugguacaucccuguaaugaaguacagugaaguguaaaacagaaugagguauuuaugcuguggaaugauuucuaggauauauugcuaagugaaaagagcaagguguauggaacagcuuucuguaagaaagggaccaaaauaugaacauauaucauaugccauguauauuuguuuguuuuuguuuuuguuuuuggacacggucucacucugucacccaggcuggaguacaguggugugaucuuggcucacugcaaccucugccucccagguucaagugauucucaugccucagccucccaaguagcugggauuauaggcaugcacgaucacacccggcuauuuuuuguauuuuuuuguagagaugggguuucacccuguuggccaggguggucuugaacuccugaccucaagugaucugcccgccucugccucccagaaugcugggauuacagguguguaauccugcacccggccuuauauguuuuuaaaaauacaguaaauuuaaaauuaauagccagaacaaaugugccuugccuuacaauuuuugacuuuggaaucuagaaacuguuacaugugauuaaaaagcaaaauuauggcugggcacaguggcucacaccuguaaucccagugcuuugggaggccaaggcaggcagaucacgaggucaggaguucgagaccauccuggccaacguggugaaacucugucucuacuaaaaauacaaaaaauuagccgggcgugguggcaggcgccuguaaucccagguagucgggaggcugaggcaggagaaucgcuugaaccugggagguggagguugcagugagcugaggcugugccacuguacuccagccuggucgacagcgagacucugucucaaaaaaaaaaaacaaaguguuauauauauauguaaaaauuauauguaaauuauauaaauaaaaauauauauaauauauaaaaauuauauaaauauucguccuuaaaaauugaaaacuaacaaguuaguggcacaacuacaccagaaauaauuauuuuaggugauuuuaaaauacagcauuuugcuguauaucacuagggggaaauacacuaaggauaaacuaaauccacaaagaaaucuuaaauugcauucuuuuucuuuuuuuuuugagauggagucuuguucugucacccagucuggaguacaguggugcgaucucggcccacuguaacguccaccucuuggguucaagugauucuccugccucagccuccugaguaccugggacuacaggcaugcaucaccacaccuggcuaauuuucuguauuuuuaguagagaugggguuucaccauguuagccaggcuggucuugaacuccugaccucaagaaauccaucugccuuggccucccaaaaugcuaggauuauaggcgugagccacugcgccuggcccuuaaacugcauucuguaacuuuuuuuuuucugagaugggggucucacucuugcucaaguuggagugcaguggcacagucauagugcacugaagcuaugaccgaauucuugggcuuaagcaguccucccaccucagucuccugaguagcuggagcuacgggcgccacugugccuggcuaauuuuuuuauuuuuuauuuuuuguagagauggugucucgcuuuauugccuaggcuggucugguacuccugguuuuaagcgagccucccaccucagccccccaaaaugcuggaauuacaagugugcauucuguagucuuacugcuagaaguaaauuugcuaauagcaaauaaauuccaauauauuacauauaaauaggagaaagcaaagaaguaguuauuuuacuguauuauaaacuaugauuuucagcuuaagagaaaagagauagaucuaaaacuauaggaauuaaaaccuugugaucuuuacuuugaaucgcaaguguuaguaugaacucauuuauuuuucuccaagaauaugcuuuuuguuuuguuuuuguuuuuguuuugccauaacgagugaaagguccuagaagugaugaaccauguauaaucuggacacaaugauaaucccuugauuguuguagauucuccacuaaaaggaaccagggcuucuuagagaagagucugaucccaugucuagggcaaaaaauauguauaagaauaccuuugggcauuuuguguuacaaaaaagcaaagauuacuacggugcucucagaagaacaacuugaaggagcuuucacuggauaucgagaagaaauaaugacugcaaaaaauggaaaacaucagaucuauaaaaaaauccaugaauuuuuguagugaucuucucuucuugcaaaucaauauaagcaaaacuuauugcuuaccuuuggaaguugcuaggacaacacucauuuuuuuuuuuuuaacuggucaauaaugggaaagaaucaaguauucugccuuucauuugcaaauuguauuuuagguaauuuaauaguuaaugaguuaaguuauuuauagaagaauuccagcucauaacgcuaggaaaaauaaugcaacuagaaaaaucaccauuuuacacucccugaugaaauaauggaucuaggcaaagaccauuaaaccuaauggggauguaucaggcugacacacuuugacuuauuuuuauuauauauauauauauauaauuaaaaauauaauaaauauauauauaauaaaaauaugugauauauauauauaauuuuuuucuuuuugagauggagucucacuguguugcccaggcuggagugcaguggugugaucuuggcucacuucaggcuuccaucuccuggauucaagugauucuccugccucagccucccgaguagcugggauuacaggcacacaccacuacgcccagcuaauuuuuguauuuuuaguagagacgaagugucagcauguuggccaggauggccuugaucuccuguccucaaaugauccacccgccucagccucccaaagugcugggauuauaggcgugagccaccgugccccacccgacuuaguuauuuuuaacuucacuaacaaagcagacauaugcuuugugacaugaugcaauaaaauaaucaggaagauuuaaacauggccuaguuauuagcugauauuaagaaauuaguauugauuuugugaacgugguauaguauggugguuauauacuuuugucgguuacagauauaugcuguugaagauacacauuugugggugaaaugauuugaugaccacaauuugcuuuaaaguacucaaguucuuuuuguuuuguuugaaaauacccccaaaagggaaagggagacaccagugaaacaaaauaaccaaccuuuugccaguuauugaaacugagugaugguuauauggugauuuacuauauuuucucuuuaccuuguguauuugcuugaaauuuucugugauaaaaaaagaaaaaugaauguucucauauaacaguauguaguaacgcuauuaaaugaugaaagcaggauauaaaguugcauauauagcuacaguuaugaagaaaagcaguugaacugaagaauacuaauugugauuguguuaucacagauuuuuuccaauacagaacuucuaauuuaguuauaauuuaguuauuuaauuaguuauauauuauauguuuuuuuguuuguuuguuuugugacagagucucgcuuuguugcccagguuggagugcagugguaugaucucggcccauggcaagcugugccuccuggguucaagcgauucugccucagcguccaaaguagauggaacuacaggcacccacuaccaugccuaacuaauuuuuuuuuuuugagacggagucuuucugucgcccaggcuggagugcaguggcgugaucucggcucacugcaaccucugccucccggguucaggcaauucuccugccucagccucccaaguagcugggacuccaggucugugccaccaugccuggcuauuuuuuugcauuuuuaguagugacaggguuucaccuuuuuagccaggauggucucgaucuccugaccucgugauccaccugccucggccucccaaagugcugggauuacaggcgugagccaccacaucuggcccuaauuuuuguguuuuaaguagagacagaguuucaccauguuggccaggcuagucucaaacucuugagcucaagugauccaccugcuucaguuauauguuuuuauagggaguuuuuuuuaaaaacaucuguauauuauagcagcuguaugcuaaaaauuucuauaaggccaugcaugguggcucaugccuguaaucccagcacuucgggaagccaaggcaagaggauugcuugagcccaggaguucgagaccagccugggcaauacaggaaaaccccaucucuacaaaaaaguaaaaaauuagccagaugugguggugcaugccugcacucccagcuacuuaggaggcugaggugggaggaucaccugagcccacgagguugaggcugcagugagccaugaucaugccacggcacucaagccugggugauagagcaagacccugucugaaaaaauuaauaaguaaauaaaaauugcucuauuuaugcacucugguuacauguacucuuuuugcagcgcauuuauguaaggcaguaacuaccuugaaaagugaagaugauaccguuuuuagguuucgugaaauuauauauauguauguggaauucagcaagacaguauaaugauaaugaaaggcaaugcaaauaaauaauuauuuguaucucuucagugucuaaauauuuuauaacggugaaaacaucauuaccuggaauucucauaguuuuaugacauuuuacuuugaaagagccaucugucuguuaaauugugaagacaguucuuagaagagaaaaaacugaguuuauauuaaagauuuggacuuauuuuucuggagaucaguuauuuucuuuuaucaugccuucuaaugauaagggguuuugucuuuuuuuaggaagguggaguguuuacuuuuggagcuggaggguauggucaguugggccauaauucuaccagucaugaaauaaacccaaggaaaguuuuugaacuuaugggaagcauugucacugagauugcuuguggacgguaagguguuauguaaaagagcauuuuggucucuaaacugcaguuguuuagggauugcuuauugaauuguuucagagauccuaauaaucugaggaaacacauucugcccccaaauaccuauuuugccacugaggagucauaguaacaggagaaacaucuuuuuuacuguuauuuuauuuauuuuuacuugaacagauuuagcugaggcaagauguuaauaguguauauguaauauuauauuuauuguaguugauaucacacucgaaaggcuucuuucuuucucuuuuccaccuuuuuuucuuuucuuuucuuuccuuuuuggggugauagagucuugcucugucacccagucuggaguaccacaauuauggcuuauugcagccucaaucuccugggcucaagugauccucuugccucaggcuuuugaguagcugggacugcaggcaugcacuaccaugcccagcuaauuuuauuuuuuuaauuuuuaguagcaacaaggucucauuauguugcccaggcuuaccuuuuuuccuuaaagggugaagagaucgaccaguuaauuaagacagaauuaaugugaugaaaguuugauuggcauaauuaaaccaauaaucuccuaauucuccuuauucugaguucuugggaguaaacagaagagucuuugacauugagcuucaucuguugauucuuaggucuugggaauaaauagaagagucuuugaguugagcuucaucuuugggggaauuaaauugagcagacucccaaguagcaaaauguaccuuuuuugaccacauaacuuaauuuugaucaccuugcuuaauguuuuucuaccuuguauguauagcuauacaauaguuuaguuuuaucaacuauuagcuucaaaugcauguaaucacacuguaaguauucuuuggugauucuuuuuuuccucuuaacaucagacuuuuaugauuuuuauguaguuaugguucuccaucauuaggccucauuaauguuuuuuauucaauuuuauacauauauaauauacucauucuauugcugauggacauuugcauguugccaguuuuggcaauuaugaauaauguugcuuugcacuuuuauuauaugguauauguuaaccuucauauauacccagaauggaauuacuggguuauagaggacacuuaauuugaauuuuguagguuaaaccauauuucccaugugguuuuaccaguuuguauucccauuagcaguguaugagaauuccugaugcucuuguacuuaucaccaguuaguauugucagacuuuuugcuaauuucuuggauauuuauuguuauuucauaauuugaauauacauuuccaugacuuacuugaguaccuuuucauauguuuauuggccacuuacauuuccucaggauauaaaaauugauucauaguaguuauuuauauaguguagauacaaguucauaauguuucucaauacagggauaaaaguucuuuauugggcauauguuuuacagaugucuuuccauguuuugccuuaccuugucauuuucauucuguugucuuucaaugaacagaaguuuuagauauuaauguagaugaauuuauuaauauuuuacuuaauagugccauuuauuuucuaagaaauauuuuccuaccugaaggcauaaaaguaaucaucucuguuaucuucaaaaacauaguguugccuuuuacauggaggucuguaaguuaucugaaguugauuuauuuuguggaggacaguauaauguucaaguaaggaaucaacuuuuuaaaaauauaaauagucaauuacccuagcaccauuaaaaguuuuugugggaaauacauacaacaaaauuuaccaccuuaacuauuuuuaaguauacaguccaugguauuaaguacauuaauauuguugugaaaccaucaucaccauucaucucuagaauucuuuuuaucuugcaaaacugaagcucuauacccauuaaacaaugacucccuauucuccauacucucuuguggcaaccaccauucuacuuccugucucugugaauuuaacuccuguagguaucucauauagguagacucuuacaguguuugucuuuuggugacugacuuaucucacucagcguagugucaucaagguucacccauguuguagaauuuccuucuauauaugucagaauuuccucccuuuaaaaggcugaacagcauuccauuguguguauaugcuaauuuugcuugugcauucaucuuuugauggacacuuggguuacuuuuguguuuuaucuuauugugaauauuguugcuaugaacaugaauauaaaaacaucccuucaggaccccacuuucaguucuuuugggcauauacccagaaguggaauuggugguucauauggcaauucuguuuuuaauuuuuguaggaacugccauacuguuucucauaguaacugcccuguuuuauauuuccaccaaaaguguacaggguuucaguuucucuacauccucaccaacacuguuauuuucucauuuugccuuuuucuuuuuuuuuuuauaauaccuauuuuaauacguguaacauguuaucuccugugguuuugauuugcauuuucccaaugauuagugagcugagcauauuuuuauauacuuguugaccauuuguacaucuuuaggagaaaugucaauuaaaguguuuuucccauuuuugaaucuggcuguuuuguuguuguugaguuuucagaguucucuauauauucuagauacuaaucccuuaucagauauuugcagauauuuucuuucauucuguggguuguauucuauagauagugucuuuugaugcaugaagcuuuaaaauuguauaaaguccaguuuguuuauuuuuucuuuuguuggcuaugcauuuggugucauaucuaagaaaucauugccaaauccaaugucaugaagcauuucccuguuugcuucuuagaguuuuauaguuuuaccuuuuacauuuaggucuuugaucuauuugaauuuuauuuauuuauuuauuuauuuauuuauuuauuuauuuauuuugagauggaguuuugcucuuguugcucaggcuggaaugcaauggcaugaucuuggcucacugcaaccucugccucccgggaccaagcgauucuccugccucaguuucccaagugacugggauuacaggcaugcgccaccuugcccgacuaauuuuguguuuuuaguagagaugggguuucuccauguuggucaggcuggucucgaacucccgaccucaguugauccgcccaccucggccucccaaaguguugggauuacaggcgugagcccccacaccuggccgagucuguacauucuuuuggguagcauugacaucuuaacaauuugucuuccaguccaugaccaugcuguuucuuuccauuuauuugucucuaaugucuuuccaccaguauuuuuuaguuuuauuuuacaaaucuuuugccuucuuguuaauuccuaagaauuuuauucuuuaugauagguuuuaaauaaaauuuuauuuccuuccaaauuguucauuguuaauguauagaaauucagcuaauuuuuguguguagauuuuguauccuccugcuuugcaaaguuuauuaguuuuaacaauuuuuguguggaaucuuuaguguguucuacauauaugaucauaucaucugcauacagagauuuuuuuuuucuuuccaauuugaaugaaugccuuuuauuuauuuauuuauuugagguggaguuuugcucuuguugcccaggcuggagugcaauggcgugaucucggcucaccgcaaccucugccuccuggguucaggcgauucuccugccucagccucccaaguagcugggauuacaggcaugugccaccacacccgacuaauuuuguauuuuuaguagagaugggguuucuacauguuggucaggcuggucuugaacuccugaccacuggugaucugcccaccuuggccucccaaagugcugggauuacaggcaugagccacugcacgcagcauuuuauuucuuauucuugcaaaauugcucuggcuagaacuuccaagauuauguugaauagaaguggugaaagcaggcauccuuauuccugaucuuacaggaaaagcaagugcuuuuucugcaucaauucagaugauugugugugucuuuuccuccuucaaucuguuaauuugauauauuacauugauuacauauauuaauuuucauauguugaaccagguuugcauucuaggaauaacucucacuuggucguggucauaguauguaacccuuuuagugugcugcugaauucaguucuuaaguauuuuauugagaauccuuuguguaugacaaccugcuucuuucaugcugcuuucaagauucuuugucuuucagcauuuugauugaacugugugucucuggucucugaguuuauccugcguagaauucauuggggcuuauggauguuuagauucaugucuuuccccauauuugggaguuuuuggcuauuacuucuucaaauagucucucucuugcucuauucuucugagaauucuacagugcuuauguuggucugcuuaaugguauccuaugguuccccuaggcucucugcacuuuuuuuaagauuuucuguuccacagacucaauaauugcaacuguccuaucuuuacguuugcugauuuuucuucugcuugcugaaaucugccuucaaaucucucuaguguauuuuuuauuucagguauuguacuuuccaacuccaaacuuuuuuuuuuuuuuuuugagacggagucucgcucugucgcccaggcuggagugcaguggcgcgaucucagcucauugcaagcuccgccucccggguucacgccauucuccugccucagccucccaaguagcugggacuacaggcgcccgccacuacgcccggcuaauuuuuuguauuuuuaguagagacgggguuucaccguuuuuuuagccgggguggucucgaucuccugaccucgugaucugcccgccucggccucccaaagugcugggauuacaggcgugagccaccgcgcccggcccaaacuuuuuuuuuaguuuuucuuuuugauugauauuuccguuuuguucauacauuuuuuuuuucuuuuuacacgucuuacucuaguucuuugagcaucuuuaggauguuugauuuagucuuugucuuuuaggucugccauuugaccuuucucagggauaguuucuauuguuggcuuauauuuucuuugaaugggccacccuuuccuacuacuuuguaugucuugugauguuuuuugaaaacuggacauuuaauaauaugguaacuggaaaucagauucucccccuuugccagaguuugcugauuuuugguuuuugaucauuguagguuuuaucugugucaggagucacccugagguauaaaaaugaggucuuuucuuagccuauaccuuucccugcuaaugcacagugacauucuaaauucacccauaaaugugguugcuuuuuaauguuguagaccuuaaaugccuggcuccccaaagaaacaaggaaaaaaugaaagguggggguggaaggagaguagaagaaaaaaagagaaaggcaucagcccuuugaauuccuuggaagucucuuuagccagaaugggagaguauacaacagugauugccugccuuucugcaccuuggugaucagaagcaccaaucauugaucagggcaccaguuccuaaaacagacaaagucguuauugcccacccuggcuucuacaaguugcauacaggcugcuccuggaagcuguucauggcugcauuacacaggaguaaggaguggguaacugcuaccaugcuaagauccgaaguugaaauuaaccagaauuugccauccaacucuucucuuggaaauaacaaaccgugcauagacuccagaguugcagaaugguucucucagacagauucugucaguguaauuguugucuaggugggaaacagauucucggugcuucuuauuccacgauuuuccaagaaucccccugucuagcuccauuuuugaaaauucuucacccuccuacuguauggugucacuguugccauaagcuguuguauguacauggaucucuuucugugaucucuaauuuuucaaucuauaugccugccccugugccacuaaacacuauauagacaccauaauaacuucuucuauuugggguaaagugacuccuuguuauucuucuguucuuuaagaaugcuuuggcuggaccgggcgcaguggcucacgccuguaaucucagcacuuugggaggccgaggcggguggaucaccugaggucgggaguuugagaccagccugaccaacauggugaaacccugucucuacuaaaaauacaaaauuagucgggcgugguggcacaugccuguaaucccagcuacuugggaggcugaggcaggagaauugcuugaacccaggaggcggagguugcagugagccgagaucgcaccauugcacuccagccugggcaacaagagugaaacuccaucucaaaaaaaaaaaaaaaaaaaagaaagaaugcuuuggcugaugaugaccuuuauuacuuucauauaaauuuuagcauagguugugaaguucucucaaaaaaaaaaaaaaaaaaaagccuugugggguuuugauugguagugcauugaaucucuagguuaauuuggggaaaaguuguuaucuuuguaauauuaacuuuucuaauaaucaacauccagacuucuuuaaugucuuauaauaaaauguuuuaaaauuuucaucauagaggucaugcauaucucuucguaguuccauuccuaggugcgucuuuaaugguauuauauuuuuauuuccacuuucugaggaaucacuggcauguagaaauaguugauauuuacauauugauuuuaaauacaaccaccuugcuaaacucuuauuaauaacuuacucauguacguagucauaccaucugugagucaauucaguuuuguuauuucuauuauuuauacuuaacguguuuauauaauuguuuuaaugugcuguuuaggacaccauuauaauguuuacuguaacauaauguuuccuuucugugggaaaacuuucaguauuucauaguuaaguaucauguuugcuguuaagauuuuuauagauaaccucuaucagacuaaguaauuucccuuuaauuccuaguuuuuuuuauugugaauggauguuaaguuuuuaauguuguuuuuucuguauuuauugaaaugauuuaugauuuuuuuuuccuuuaaucuguuaacauggcauauugauggauuuuuuuuuucuaguuaacagcuuuguguuucuggaauaacuucaguuuggucaaguauuauccuuuuuguuuggugcuggguuugauuugugaauauucuguugacucuuacuuauauuucuguuuaucagugaacuugaucuauaauuuuuuucuuauuauucuuuucaccagguuuuauuaugaagguuuucuagucugauaaaauaacauugaggaauguaccuuuguuuucuaauuuuuggaaauagaacagcuugaaauguuggcacaacuugucauuaaaaccauuugugccuggcauuuuauuuuuuggaauuuaaaaaacauucuucaauuucuuuaguggcuaugagauagcuuuuauuauuucuugagucaguuaugugaauguuaauuuuuuucuaauaauuuuuucauuuugccuaauuuuagacuuauugacauaggccgggcgugguggcucaugccuguaaucccagcacuuugggaggccgaggcagacugaucaccugaggucagggguucaugaccagccuggccaacauggcaaaaaaacccaucucuacuaaaaauacaaaaauuagcuaggugugguggcaugcaccuguaaucccagcuucuggggaggcugaugagacaggagaaucacuugaucccaggaggcagagguugcagugagcugagauugcaccacugcacuccagccugggcaacagagcgaaaacucugucucaaaaaaauaaauaaauaaacuuauuuacauaaaauuuauaaugucuguauuggucucuugugcacaaacaacaugucagugacauauaauaguaaauguuuauuuguuucucugugguucaguaaagccaggccuuuggcuaucuggagcagcuuuuauuuaggcuagagauugacuggggcaguucuguuucaggcugccuauucacuggggugacuuugcucaggcuguguuucagcuaggguggcuuuguuacauaucucguucuugggacuauaccagaggagcagugggcugccucuggguauucuucugauggagacaaauacacaagaaggcaaacucaacuguacauuccauuucaagccuucugcuugcaucacauucacugaaaucucguugaccaaaagcaaacuauauggccaaaccuaaaguuaagguauggggaauauaauauacagcccaaccaccaucaggcuaugaugggaauaugcaugcuuaauacuacaggguggugaauuuaaaucauuuugggugacauacucuauuaguccuuugugaaguaucacaaaugauuuaauguuauccaguuuuguaauucuuaguagccaaaauguacaugauuugaaugguuauucuuagcucuguaauacaugauuugaauaguuauucuuagcucuguaaaccaguucuuuucagcaguuuuauucauguaacuguuggaucggggguaaaauuucgacuauugagugagaucuaaggacuuaaccuaaacaggaaguguaaguagguaucugguauuuugaucaguuugacuuccagguagucaguacuauaagacaucuuauugggccgggugcaguggcucaagccuguaaucccagcacuuugggaggccagggcgggcagaucacaaggucaagagaucaagaccauccugaccaacauggugaaaccccaucucuacuaaaaauacaaaaauuagcugggcaugguggcacaugccuguagucccagccacuugggaggcugaggcaggagacucgcuugaauccgggaggcggagguugcagugagccaagaucacgccacugcacuccagccuggcaacagagugagacuccaucucaaaaauaauaaaauuuuuaaaaaagaaauauguauuauuauuuccuuauucaauaauugucaaaaaccuccugaaugaagcagucaggauuaccaaaaugucaguucaucaauagacgauccaaaagaaaaagguuuacauuccaguaguauaaugaagugcuuucgagcucuuacaucaaaucuagagcuuaagguaguucuguucaugcaguggcucugaaccccacuuuauacuauaaucacacacacauauauacauauauuuuugagacugagucuugcucuguugcccaggcuggagugugguggcagaaucuuggcucacugcaaccucugccuuccagguucaagugauccuccugccucagccuccugaguagcugggacuacaggcgcaugccaccgugcccagcuaauuuuuguauuuuuaauagagacaggguuuugccauguuugccaugcuggucucgaacuccugaccucaagugauccaccugccucggucucccaaagugcuggaauuauaggccugagccaccaugccuggccaaaauauauauuuuuaccuagauucaccccaagaugauucaaauaugcagccaggguuaagaaccagugcuuuauuaguccagugugaggaggaguuuuaauaaaauaguauugcaguaauuuucaaacuauuaauacauuccuuugagauggcugcuuccugagggaggguaguaaucuagcagacuagcuaacuugaaaacucuugaaucaaaaccccuuuaaaauagcaugugugaguuugccagguuguaaagagaacuccaccuggcaaaaacaaaagaaauuugaaaaccaaagguguuaguuugaauugacuuuggagcuacccugaaagaauuugccaaucuggguaauguauuaguuagcuuaugucgcuaaacagaacgacuccaaaaccuagugaccuaaaauaauuauuuagcuaauaguucuuuguuuuaguaauuuuggccgggcuuaacugggcugcucucaucuuagcugacuuagaugaucaguugaugaucuggcuaggagcuggaagucuaggauggccucagcugggacaguuugucuguuccagauuguagaucauccuuuagcugcuaaccuugguuuauucuuacgaugguagagcagaauuccuaaagauaguuagggaaagaguguauaaagccacuugugaggcaaaggcucggaacugagacacuguuguuucugcuggccaaagcaagcuauagauuaggacuuggauuuaagacauggagaaagagauuuccagucuugcugggaacaacuguaauagucauauugcauaagauauggguaugguuagagggauaauuucagccacuuuuauaaacaauaugccacaaauggcaaagagguuuagggcaagagacaagaucuaagaccugauagaaacaagggugagaccuggagaugccauguccccucaguaaaaccaucucauggauaggguacacaaugaaauacuucccugcuugccuaaggagacuuuuucugaggaguuggauagguuuacugagaguggauuggugggucauccuuagcuucagaucugugguuucuuagguuugcuuucacuguaguaccuccagaggaguuuuggugcguacauauagagauuacuuuccucagaagaaaggaaacauuguuucugucaugcauaaguguauauaacaaucuucugauugguacuagauuacuucccauuucuuagccuaaaacuucucggugauacccaaguggaggacuuucauagaccacagcucuggacuagaacuugacaaggggaguaguggggacuuccuugaacagcauagguagaugcuacucuggugcugaaucguuuauuguaagggauuucaguauagacccaggcuguuuaaaauuuaaacauuaguggaaauuuucuggaccaugcucgugcagccugucuaugugaugcagaauucauucuauagauuaagucuguuaaugaauauuuguacagaagcuuuggaacuacaauugguuuuauuaauuuuuugaaaagaaaaauuaccucuuuugauauuuucucugcuuuugucauuguaaauuguuggaagguaacauuaagucugaaguuuucuaucauuuuacucuaggcagcacacuucugcuuuuguuccuucaucaggacgaauuuacucuuuugggcuuggugguaaugggcagcugggaaccgguucaacaagcaacaggaaaagccccuuuacuguaaaaggaaauugguaccccuauaaugggcagugucuaccagauauugguaaguucugucauauuaaagcuuuccuucauauauugaaguucuuguuaaaauguugcucuuaaaucaugaagauuucugcgaaagaauuccaagauacauuguuaagugaaaacagcaaaauauagaacaauguauaugguuguuugauuugcuuauauuuacuuguaaaugcauaaggaaauucuggauaaguaaaaguuacuuacagagagugggucauaugggaacuagaagauggcuacauaccagugggagggagguuuuuuguuuucuauuuuaaauugugguaaaauauacacaacauaaaauuuacagacguaaccauuuuuuaaguagcauuaagcauauucacguuauuauguaaccaaucuccagaacucuuuucaucuugaggauacuaaaacucuaugcauuaaacagcaacucuucauucccuccucuuccuagugccuggcaacugcuauucuacuuuaugucuuuaugaauuugacuuaacacuaggcuagguaccucaaagaaguggaaucauauaguaguguuucuuuuugugacucacuuauuucacuaagcauaacguccucaagguucaucuguguuguagcacauguuagaauuuccuuccuuuuuaagcuauauaauucaggcauaccuuggagauauugugggcucaguuccagaccacugcaaugaagcaaauagugcaauaaagcaaauaucguaauaaagcaaaucacaaaauuuuugguauccuagugcauauaaaaguuauauuuauacuauauuguagucuacuaagugugcaaugaugacauuaugucuuaaaagacuguguauauguuaguuuauaaauaugcuuuauugcuuaauaaugcugacacagagaugagcacaugcuguuggaaaaauggugcugauagacuuguucuaugcaggguugccccaaaccuucaauuuguaaaaaucacaguaucugagaagcacaguaaagcaaagcacaauaaaaugcggcaugccuguguucuuauuauauggaugugguuuguggcauccaaacaauugcaauaguaacaucaaagaucacugaucaugucaugcauugucuuauaucgcuaaauuagugauaugagaucaccauaaaagauaaaauaauaaugaaaaauauugaaauauugcgagaauuacuaaagcuuauaagcuuuacucaauuuuugauacugaauuuuuacaaauugaagguuuuuugacaacacugcauugagcaagucaguuggcaccauuuuuccaacagcauauaugcucacuuugugucuuuaugucacauuuugguaauucuuaacaguauuucaaaacuucuguguuguuacuauaucuguaauggugaucugugaucaguggucauugauguaauuguuuuggggugccaugaaccuuaccuauauaagacaacaaaccuaauugauaaauguuuauguucugacugcuccaccagcuggccaguccuaucucucuccucuccucgggccuuccuauuccuugaggcacaacaguguugaaauuaggccaguuaauaacccuacaguggccucuaaguacauaagugaaaagaaaaucucucacuuuaaaucacauuucucacuuuaaaucaaaagcuagaaaggauuaugcuuagugaagaaggcauaucaaaagcccagacaggcugaaagcaaggcuucuugugccaguuauccaaguuguuaaugcaacuuaaaggaauuaaaagugcuacucuggugaauacaugaaugguaagaaagugaaaaacagccuuauugcugauacggagagaauuuuaguaguccgaauagaaaaucacaccagccacaacauuaggauuagccaaagucuaauccagaccaagauucuaacucucuucaagucucugaaggcugagagagauaaggaagcugcagaagaaaagcuugaagcuagcaaauauuaguucgugaaguuuaaggaaagaagccaucuccauaauguaaaaguacugauguauaugcuacagcaaguugucuagcaugucuagcugagguaauugacgaagguggguauacuaaacaacagauuuucaauguugacaaaacagccuucuauuggaagaaaauguccucuacaacuuucuuuuauagcugagagaaguagucaaugccuaacuucaaaggacaggcugacucucuuuuagggucuaaugcaucuggugacuuuagguugaagccagugcuuguuuaccauucugaaaaugccagggcccucaggaauuaugcuaaaucuacucugccuguauucuauaaauggaacaacaaagccuggaugacagcucaucuguuuacagcaugguguacugaauauauuaauaugggcuuaagcccacuguugagacccaccgcucaguaaaaagauuucuuucaaaauacugcugcuuauugacagugcaccuggucacaucagagcucagauggagauauacauggagauuaauguuuucaugccugcuaauacaacauccauucugcugcuguaggaacaaggaguaauuuuuacuuucaaguuuuauuauuuaagaaauacauuucguaaggcuguaguuaccacauauagugauuccucugauaguucugggcaaaguaaauugaaaaccuucaaagaauucaccauuccaguuacuguuaagaacauuugugaagugagaggauugcuugaagccaggaguuugagaccaaccugggcaauguagugagacacugucucuacaaaaaauaauuuuaaaaagccaggugugguggcacaugcuacuugggagguuuaggcaagaggauugcuugagcuuaggaguugaagguuuacagugagcuaugaucauacuagugcacuccagccugggcgacagagcaagacccugucuuugauucaugggaggaagucaaaauaccaacaauaagaguuuggaagaauuuuauuccaaccuucauggaugacugaggggcucaagacuucauucgaagaacuuaacuauagauaugguggaaauaacaagagaacuagaacuaaagccugaaaaugugacugaauugcugcaaucuuaggauaaaaaauacccuucauccagucccaggacaucucaaagcucugcagaaagaacuugagcaauuugccaagcuccugaagcagaagaggaucacccugggauaugcacaggcugauguggggcuuacccuggggguucuauuugggaauauguucagccaaacgaccaucugccucuuugaggcucaacagcuuagcuucaagaacauguguaagcggcgcggcccuugcugcagaaguggguggaggaagccgacaacaaugaaaauauucaggagauaugcaaagccgaaacccucgugcaggccugaaagagaaagcgaaccaguauugagaaccuggagaauguguuccugcagcgccugaagcccacacugcagcagaucagucacauugcccagcagcuugggcucuagaaggaugugauccgagugugguucuguaauuggcgccagaagggcaagcaaucaagcagugauuaugcaccaugagaggauuuugaggcugcugggucuccuuucucaggggcaccaguguccuuuccuauggccucagggccccauuuuggugccccaggcucccauuuugguaccccaggcuaugggagcccucauugcacugcacugcacuguguuccuuagugccuuucccccuguuucugucgccacucugggcucucccaugcauucaaacugaggugccugcccuucuaggaaugggauacagggagagggcggaagcuagggaaagagaacccggaguuugugccagggcuuuugggauuaaguucuucauucaguaaggaaggaauugggaacacaaagggugggggcaggggaguuuggggcaacugguuggagggaaggugaaguucggugaugcucuugauuuuaauccccauaucauguaucacuuuuuucucaaaugaagaagacugggacacaguagguagagagaaaaaaaagaaaaauacuccucauccauuuauauuuuauggaugagcaaagaaaguguuuucuugagauggaaccuacugcuggugaagaugcuaugaacauuauagaaaugacaacaaaguauuuagaauauuccauaaacuuaguugacagagcagcagcagggguuaagaggcuugacucuacuuuugaaagcaguuccguggguaaaaugcuaucaugcagcaucuccugguauagagaaaucuuuuaugaaaagaagagucaaucaguguagcaaacuuuguugcugucuuauuuuaagaaauugccacagcuaccccagccuucagcaauuaccacccugaucagucaguagccaucaauguugacaaugaggcgagacucuccaucaacaaaaaguuuaagacuugcaaagccucaauugaucguuagcauuuuuuagcaauaaagugauuuuaaauuaagguauauggauuuuuuuuuuaagauacaaugcuauugcacacuuaauagacuacaguauauuggccuggcacaguggcucaugccuguaaucccagugcuuuggaaagccaaggcaagagaaucacuugaggccaggaguuugggaccagcuggggccacauuaacucucaucucuauaaaagaaaaaaaagaaaaaccaacucuugucaauggacuacaguaucguauaaacauccuuuuuuuuuuuuaaugagacagagucuugcucugucacccacgcuggaagugcagcggugcaaucucgguuuacugcaaccuucaccucauggguucaagugauucuuguggcuuagucacccuaguagcuaggauuucaggugcgcaccaccacaccuggcuaauuuuuuuaguauuuuuauuggagacaggguuucaacauguuggccagucuggucucagacuucuggccuuauuugaucugcccaccuuggccucuuaaagugcugggauuacaggagugaaccacugcgcccaggcuaguauaaacauacuuuuaugugcacuaugaaaccaaaaauuugugugacuugcauuauugcgauauuugcuuuauugcaguugucuggaaccaaacccuaaauaucuuugagguaugcuuauaccacauuuuguuuaucuauucauauaucaguggacgauuggguuguuucuaccuuuuggcuauugugaauaaugcugcuauggauguagguguacagguaucucuuugagauccugcuuucaguucuuuuggguauauacaggaguguuaauuauuuucuauuuuuuaagaauuugaauucuuugaaucuauugcuuauuaaaaauauuuaaaaauuuugacccagaaguggauucagcacauaaggacguuuuccacauccauaugauuacauccccaaccggucagcagcacccauucuccugccugccaaacuauccuugaaaaacccuagccuucaaauuucuggggagacugauuugaguaauaaaauucaagucucccauauaaaaacaacaaaaaauuuuuugacuagaagggaagcugcugcccugaagauaaaagaccccaggccugacaggauuuaucacuugcugacuaaagagcccuugggcuuugaauaaacaucaacaauagacaggaauuagucucuacaugcuuugggugagacccaguacugucaggugugaucuagcacagucuuagcagugguggccaugggagugcuugcaucaccucuaccccaacuauuaagaaucucagcacagagagagagagugagagggaaacuucauuuguuugggggagaguaagggagaagaacaagagacucugccuaguaauccagggaauucucccagaucuuacccaaguucaccaaggcaguaccucuaugaguuggcaagagucacaguuuugcugggcgugguggugugugcauguagucccaccuacuuaggaagcugaggcaggaggaucgcuugggcucaggagcucugggcuguaaugugcucugcugauugggugucugcacuaaguucgacaucaauauggugacuuccugggaguggggggccaccagguugccuaaggaggggugaacuggcucagguuggaaauggagcaggucagaacuccugugcugaucaguagugggaucgugccuuugaauagccacugcacuccagcuugggcaaccauagugagacucugucucuuaaaaaaaaaaaaaaguguuacugggcuuggaguguccacuaaugcagauggcugcagugacugaagaauugagaucauuacacucaauuccuuuugaauacuuggaaugccuucccaagaaguucagguacaaacaaguacggacugcaaaggauagaauaaauaccuaacucuucagcgcuuagacauugcugaaaauuuagaagcaucaagacgauccaggaaaacaugaccucaccaaaccaaugaaauaaggcacuagugaccaaacaugaagagacaaagccaugugacuuuucagaaauucaaaacagcuguuuugagaaaucucaacuaaacugaagauaaacagaggaaguucagaauccuaucagauaaauuuaacaaagagauuaaaacaauggugaaauaucaaagagaaauucuggaguuagaaauguaauugacaaccuggagaaugcaucagaggcucucaacagcagaauugaucaagcagaagaaagaauuagcaugaagacaugauauaugaaaauauacagaguugacaaaagaaaaaagagugaaauacucccacaggaucuagaaaauagcuucaaaagggcaaaucuaaggguuacuggccuuaaagaggagguagaaggagagagagggauagaaaguuuauuuaaagagcuaauaauagagaccuuuucaauccuaaagaaaaauaucaguauucaagugcaagguuauagaacaccaagcagauuuaacccaaauaagacuaccucaagacauuugauaaucaaacucccaaaggucagggauaaagaaaggaucucaaaagcagcaagagaaaagaaacaguauacaauggggcuccaguacaucuggcagcagacuucucaguggaaaccuuacagauuaggagagaauggcaugacauauuuaaagugcuaaaggaaaauaacauuuaucccagaauauuauauccacugaaaauauccuucagaugugaaggagaaauaaagacuucccagacaaacaaaaacugagggguggccgggcgugguggcucaugcuuauaaucccaccacuuugggaggcugaggcgggcagaucaccugaggucaggaguuugagacuagccuggccaacguggcaaaaccccaucucuacuaaaaauaaaaauuaaaaaauuagcugggcaugguggcuggcgccuguaaucccagcuacucaggaggcugagacaggagaauugcuugaacccgggagguggagguugcagugagcugagaucgcaccauugcacuccagcccggacagcaagaggaaacugucucaaaaaaaaaaaaaaaacaaaaacaaaaacaaaaacgcugaggcguuucaucaacagcagaccuguacuauaagaaaugcuaaagggaguuuuucauucugaaggaaagggacauuaaugaacaauaacaaaucaacuaaagguacaaaacucacgauaauaguaaguacacagacauuguggugugcgcacuacucaucuugaguaagaagacuaaaacggaucaaagauaauaauaacuacagcaacuuguaaagacauauacaauauaauaagauauaaauagauguaauaaaauuaaagagcaggggaaaagaugauaaaguguaaaguuuuuaucauuuuucucuuugcuuauuuguuuuuguaaugagaguaaacuugucaucaguuaagauguuguuugcaagccugguaaccucagaucagaucagaaaacaggaggcaagaggauugcuugagcccaggaguuugagaucagccuaggcaacauagugauaccccauuuauauaaaaaauaaaaauuagccuggcaucauggcacaugcccauagucccaguuauuugggaggcugagguaggaggauuguuugaccaggagguugaggcugcagugagccaugauugugccacugcacuucagugugggcaguagagcaagaccaugucucaaaaaaacaaacaaaauuaauagaugcacagaaaauuaaaaaaaaaaaggaaauuaaaacauaccaccagagaaagucacauucacaaaaaggaagauaggaaggaaggaaagaaggaagagaagaccauaaaacaagaaagcaaauuuuaaaaugucaggaguaaguccuuauuaauaauaacauuuaguaaacggacuaaacugcccagucaaaagacacugaguggcuggcuggaugaaaaaacaagacccagugaucugcucccugcaaagaaacacacuucaccuauaaagacacacauacacugaaaauaaagggauggaaaaagauauuccaugcaaauggaaaccaaaaagagcaggaguagcuauacuuauaucagacaaaauagauuucaagacaaaaaguauaagaagauauagaaggucauuguauaaugauaaaaggauuaguacaacaagaggauauaacaguuguaaauauauaugcacccaacacuagaaaacccagauauacaaagcggauauuguuagagcuaacaagagacagaccccaauaaaauuacagcauaauauuggcauaaaaacagacacauggaccaauggaacagaacagagaacucagaaauaaauucauauauguacaguaaauucauuuuggacaagggcgccaaggacauacauuggaaaaaggauauucuuuucaauaaaugguacugggaaaacuggauauccauaugcagaagaaugaaacuagaccccucauaugguuaggcuuugugcccccacccaaaucucaucuugaaucguaauccucauaauccccaugugucaacggagagacccgguggagguaauggaaucauggaaucgguuuccugcaugcuguucuuguaauaaugagugaguucucacaagaucugauuguuuuauaaggggcucuaccccacuuugcucgacacuucuuccugccaccuugugaagaaggugcuuugcuuccucuucgccuucugccaugauuauaagucuccugaggccaccccagcuaugcugaacugugagucaguuaaaccucuuuccuuuauaaauuacccagucucaggcaauuuuuuauagcagcaugaaaacagacgaauacaccccuaucucucacuguauacaaaaagcauguacaaauggaauaaaaacuuaaaucuaagaccugaaacuaugacaagaaagcugaggaaacucuccaggacauuggucugggcaaaaauuucuugagugauaccccacaagcacaggcaaccaaagcaaaaguggacaaaugggaucacaucaaauuaaaaagcuucuacacagcaaaggaaacaagaaagugaagaaacaacucacagaaugggagaaaauauuugcaaacuacccgucugauaaggaauuaauaaccagaauauauaaagacaacucuguuguuucaacucaguuguugaacucuguugaacucaacaacucgguuguuccugaaacaacucuauaggaaaaaucuaauaaucucauuaaaaaaugggcaaaagaucuaaauaugcauuucucaaaagaagguauacaaauggcuaacagguauaugaaagguacucaacaucaucagagaaaugcaaaucaaaacuaaaaugagguauuaucucacucugguuaaaauggcuuuuaucugaaagagggcaauaacaugcuggcaaggauauggagaaaagggaacgcuuguauacaguuggugggauuguaaauuaguauagccacuguggagaacaguauggagauuccuuaaaaaaacugaaaauagaacuaucagaugauccauugcuggguauacacccaaaagaaaggaaaucuguacaucacagagguaucugcacucucauguuuauugcagcacuauucauaauagccaguauuuggaaucaauuuaaguguucaucaacagacauggauaaagaaaaugugguguauauauacacaauggaauacuauucagccauaaaaaagaaugggauccugucauuugcaacaauaugagaacuggaggacauuauguuaagugaaauagccagcacagaaagacagucacauguucucacuuguugguggaagcuagaaauugaaacaguuguacucacagagauagagaauagaaugauaguuaccagaggcugggaaggguagugggguaaggggaggaagugaggauaguuaauaaguacaaaaauggcaggggugggguggcucaccccuguaaucccagcacuuugggaggcugaggcgggcagaucaugaggucaggagaucaagaccauccuggcuaacacagugaaaccccaucucuacuaaaaauacaaaaaaaaaaaaaaaaaauuagucaggcaugguggcaggcgccugcaggccuguagucccagcuacucgggaggcugugcaagagaauggcaugaacccgggaggcggagcuugcagugagccaagugagccacugcacucgagccuaggugacagagcaagacuccgucucaaaaaaaaaaaaguauaaaaauauaguuaauagaaugaauaaggucuaguauuucauagcacaacagagugacuacagucgagaauaauuuauuguacauuuaaaaauaaauauauuauuggaacauuuguaacacgaagaaaugauaagugcuugaggggauggauacuccauuuauucucaugugauuuuuauacacuguaugccuguaucacaaugucucauguaucccauaaauauauauaccuacuguguacucauaaaaauuaaaauaaggcuaggcacgguggcucaggcuuguaaucccagcacuuugggaggccaagguaugcacaucacuugagaucaggaguuugagaccagccuggccaacuuggugaaacuccgucugaacuaaaaauacaaaaaauuagcugggugugguggcagacaccuguaguccaagcuacucaggaggcugagacaggagaauugcuugaacccaggaggcagagguugcagugagcugagauugcaccacugcacuccagccuuggcgacagagugagaauccaucucaaaaaaaaaaaaaaaaaguaaaaauuuaaaaaauuaaacauuuuaaauuugccuuuuauauccaugcagcuuuagccaaacuuguauauaccuauuuuuuaucuauuauucuugcagagcugauuauuuuuucauugauguuaauuuacuacuuaguuggaaauauuugaaugcuguuuucucauucauuuuuuugacaaccugaaaccaaaauguccuucuuuucauauauauuuuuuacuaucccaaacuuccucagaauugucuucuuguuuaucuauugauggaaaccagaauucugauuuucuuuaaagugaugcaaaaguugagucacguguguguuaauagauuuuaucuauucacagugacgaggauacuaugaagguugacauuuguaaagguccagugcuuuuuauuguaaauaaacuugauguuuuuuuuauaauuaaaaggcuuuuucaguuaagcucauauuuaacaaaggucaccauuacuuaggaaugcauuuuggcaccuucgaaacuguagaccuugagauuauuugcauuagaauggggaaggaguugguguuuuaaaaucagucguuuuugcugcaauuuaguuucaucaaaaaauugugauacauuauagccaaaagguggaaacaacccacguccaucagcagaugaaugagugaaaaaaaauauuguauaccucuauaguggaauaguauucagccauagaaaguaaugaaauucucauacauuaugcaacuuguaugaaucuggagaacauuauguggggugaaagacacaaaaggacaaauaucauaugagucuacugauaagagguaccuagaacaaccaaauucauagagacagaaauagugguuacuaguuccuagagggaggaggguacggagaguuuccauuuaauggguuucuguuuuagaagaugaaguucuagaaaugauuaguggugauaguugcacaacauugugaauauacuugcuaccacuaaauugugcaguuaaaauuguaaauuuuauguauauuuuaugauaaaaaauuguguaaaaauugauaaucuuuuugcacuguacucaagcuguauaggauaaaaacuaguuacaugugaauuuaauuuaccaauucuagcccauccagagguuaaacccauggcccccagcaugaauuaacauuuuaaucauaaacuaucuguguggccagugccauggguaaacaagaggaauuuuuuuuuuuuuuaaauacaaggucucacucuguugcccaggcuagagugcugugacaugaucacagcucacugcaaccucagccucccaggcucaagcaguccuuucaccucagccuccuaaguagcuggaacuacagguguuugcuaccacacucagcuaauuuuuaaauuuuuuuguagagacggggucucacuauguugcccaggcuaguguugaacuccuggauucaagugauccuccugccuugacgucccaaagugcugggauuacgcauaugagccacugcacccggcugacaaaaggacauucuuaacagccagaauauuccuuugguuuagugauuauuaucucccuggagccaggcaaggggcacaccuuucuuuaaaauguguaaaguugaaacaacuauauuaguuugcuagaguugcuuguaacaaccuaccacaaacucgguggcuugaacaauacaaauuuauuggcucacuauucugcagacuagaaguccgaauuuagaguugcuuccuucugaaggcuguaagaagaaucuguuacauauuucuuuccuaguuucuggugguuugcugucaaucuuuggcauuccuucgcuuguagaccuuggccuucucucuguacgugucugcauccaaauucccccuuuuauaaggacacaaaacauuggguuauggaccuacccuacuccauuaugaccuuaacuaauuauaucugcagugaccuuauuuccaaauaagaucauauucugagauauuggggauuaggauuucaacacacaauuuuuuuuuuuuuuugagacagucuggcucugucgccuaggcuggagugcaguggcaugaccuuggcucacugcagccuccaccucccagacucaagcgauccucccaccucagccuccugaguagcugggacuacaggugcaugccaccacacccaguuaacuuuuuguauuuuuuguagaguugggguuuuaccauguugcccaggguguucuccaauuucugagcucaagcaaugugccuaccugggccuucaaagugcugggauuacaggcaugagccaccgugccuugcccaauauacaaaguuuuaggagacccaguucaauccauaggaauaccccaaaccugcugagcuaaucuuuacugcacagaggguauccucagcaucgccccuguuaguacaggcaaacuuuguuccuucagaugacuuauuggcuggugugauggcuuccaccuguaaucccagcacuuugagagguugaggcgggaggauugcuugaggauaggaguccaagaccagccugagcaacauagcaagacccugucucuacaaaagaaaaaaaagugacuugucauaccggauuaaguaaccguuguucucaaauauaacacuucagauaagucuuugguugcauaauagauuuuuuucaauuauauuguaguaggaaaggggacauauucuuauugaaccuuuauaaauauauuacuaaugaagggagacuuaguaagagauggaauucugggcaucagugagaaucagguagcauuuuuaaauaauuccuuuuaguuuacucaagcagaguuuuaugaaauuguggauaacuuuagaaaggaaaaaugagcacaaaaucaaaauuaaacauuacucaaacauguaaccauaauaaauuuuucuucaucaguucauucuuucuuaugucauaaugaauucuuauucugcuggaccuuggguuagcaguuucaugaaaugucuguuucucaccuaacaaaaaagaauaugaggaauccuaauguacuucacugcuacguuuugaaaguuauguaagagagaucucuucagaacccuauacccaagugucuuuucuuugauguauacauuguuucacauaccuguuggaauccuuuuaauagggcucugagacuccuuuguugaaaacacaaacuggccuguagcuuguaggagagucuucaggcaagcaucagagcagacaaaaacugcucugguuaauagguuacacaggccuaaaauaacuguggcuaguuuauuacugauaauuaucaaaugauaugaucugaugaagauucagaguaagaauaauaauguuuccaaagaugaugauuaggccuauuuucaaggaacucagugacucuuaugucugauauguaaauauagcugagcauaaccauuuauagacaaaaacgaaaucuugagauacaacuuaauaaucuugagaucuaacauaccagguauacacaagaauaucaaaagaaccagcaaguguaggaucaagccuagacauauuuuuauuuuuuauuuuauuuuuauaaaacuccaugggagccaggcacaguggcucaugccuguaaucccagcauuuugggaggccgagauggguguaucaccugaggucaggaguuugagaccaacauggugaaaccccguuucuacuaaaaauauaaaaauuagccaggcaugguggugcacaccuguagucccagcugcucguuggggcugaggcaggagaaucgcuugaacccaggaggaggagguugcagugagcugagauugcaccauugcacuuaagccugggcaacaagagcaaaacuccaucaugaaaaaaacaacuacauggguaagccugaagaacauccccuuuugagaacuacuggcauagaauauguggauuagaaacaauaagguuagagaaccacuggcauaagugagaauuagagcaguaagguugugccagaaaacauuuuaaauaauaacugaaauuagaacuggauaguacuguaccccccccccuuuuuuuuuuuucaauugagguggagugucacucuuuugcacaggcuguaaugcaguggcaggaucucggcucacugcagccuccgccuccuggauucaagcaauucuccugccucagccuccugaguagcuggaauuacaagcagugcuaccacacccagcuaauuuuuguauuuuuaguagagaugggguuucaccauuuuggccaggcuguucucaaacuccugaccucaggugaucugccugccucggccucccaaaaugcugggauuacaggcaugagccaccaugccuggccuguaugauuuuuaauuguauuauuauuauuuauugagaacuuuugggguuucuuaaaaaaauauuuuccagccggguacacuggcucacaccuguaaucccagcacuuugggaggccgaggcagguggaucacaaggucaagagaucaagaccauccuggccaacaugguggaacccccucucuacuaaaaauacaaaaauuagcuaggcgugguggcacgcaccuauagucccagcuacuccagaggcugaggcaggagaaucgcuugaacccgggaggcgguugcagugagccaagaucacaccacugcacuccagccuggcgacagagcgagacuuugucucaaaaacaaaugaacaaagaaaaauauguucuauccaugcaugguugauugaaucugcaaauauggaaccuauggauacagagggccgacuauguuucuuccaccucguacaagagcacaggucaugguggauuagggccuaauuuccaaaaagaggaaauuuauguuacuaagaaacaugcaaaaauuauuacccucuuuaguaucaaagaaaugcaaauuugaaaagcaagaggauacuaaaaaaauaaagccuaauuuuaauaaucaccucuuuaaugcccuuaucuccaaauacagucacauucugagguacucaggguuaaagcuucaaacagaucuauuugggugggggauacaguucagcucaucacaggaaggcaaaaaucaaauaaguaugagaggaaauguggauacuucauuaagauauaaucauaagugcuugagaaauaauacuuaguuaccuauuuuacuacggugacaauaaauaaaaauaaauacagaugaugauaugauugaaaagaacuuuagcucuuuuguaagucaggagccuuuguucuuuuuuccucuuaaauuuaaaggacaauaaagacaacauaaagcauagaauauuauuuuaauaaaacagauuauuugcuaucuagcagauuacacaaaaaguaaagaauagcauuuuauauuauagguauuuaucaguaaaccaagggagcagguccuucuaaauugaguuaacuuugcuaagauguuaaccauuuuauagcuucuuucagacucagguauaaacugaggaaaauaaaauucauuuccccaguuguaucuuuaguuaugcucuuuaauauucugcaacaaagugacauuuugcuugaguucaguauuucuaucucagaggguucuugaagucauaaugauuuucuuuuuuuuucuuuuuuuuuucgagacggagucuugcucugucacccaggcuagaguguaguggagcggucucagcucacuacaagcucugccucccggguucuugccauucuccugccucagccucccaaguagccgggacuacaggcaccugccgccacgcccagcuaauuuuuauuuuauuuuauuuuuuuauuuuuaguagagacgggguuucacuguaugucucaaucuucugaccucaugauccacccaccuuggccucccaaagugcugagauuacaagugugagccaccgcgccuggccagucaaaaugauuuucauauuaauacuaagauguuuucuaugcuaaauguaaugcacucaauauugcucaucuucaaauaaaaaacuauuuuuuaaguuucucaauuuuaaguucuaauacguuaaguauuaaugauuuuaacccauguaaacaaagcccuuuggaguccugaauaagugcuaagaguggaaagggacuuagagaccaucaaaacuacucauuuuccauguuaaacaaaagcacauacacaguuguagcucuaucacuguuuugcuucuaaguagaauuacaauuuacagaauugugaauagcucaaagacagugaaagguggagauaauccuaaacagugcacuaaucaagacuguuucuuguggggcagggggggugucuauuucaaggucuucaaaauuuucccugacaauauauuuuguaaagaagaagaagaaggcugcccaggcuggauugcaguggcgugaucacagcucacuccacccucgaccucuugggcucagacuacaggcaugcgccaccacgcuuaaccaauuuuuaauuuuuuuuguagaggcgaggucuugccauguuguccaggcuggucuugaacuccugggcucaagugauccuccuaccuuggcuucccaaagugcugggauuacagguaugagcuacugugcccagcggagaggaauuuuaaggacacuuucagauagagaaagaguggcaaaaguauguauuacagguggaagauaugaugucuguucauacacauugaaacaaggcaucacuguucuuuagauaagggggggaaaauuacuugacacaugaaaauuggggacaaaaaggucaguuuagauccuaaugucacaauaugcacuaagauaaacuauaaaugaauuaaagaguaaauacuucuuaagacaagaagauaugaguugaggaugggaaaagccuuucucagcauauaugcuaugaaaguuauaaagaauuagauaaauuuguuuaaauggaaaaguaaauguucugugagucaaaauuaagcaaauaauuauuuggaaaaaauauuuguagcaauuacaaccuaagguuaauauccugaauaucuaaaguguccauacauauuaaugaaaaaaaaaaaagacagcuaauagauaaauaagacaaacaauaaauaaaggaaauuaauggaaguuccuaaaagaagaaauuuauauuacuaggaaacaugcaaaaauuauuacccucuuuaguaucaaagaaaugcaaauuugaaaagcaagaggacaguaaauaauuguaauagaucaagcauuaauccucucuuuccuguuauaagauaacuauauaauagggagaaacuaaugcuucagcuacaauaugaaguaaugcuaacacuuaauuuuucaaccuacagugaaugagcaucaaugccuacuaccaccacaaaaaagaacucagugaaaauucuucucaaaggaauuauguguuuccugauggaacuacucuccugccuccauguaguaguuuuacugaaauaaccaaauggugauugaaaccugucuagauucaaccaccaauuuacagaacagaagaccaagccaaauguuaggagaaaccacaaagauaaagucagcaaaauccagucugcauaaaguuguacaggacaaaugacuagguuucucaaacuuuuucgaguagugauuaaaaggaaauuaaggauaggaugcaguggcucacaccuguaaucccagcacuuugggaggcugaggugggcagaucacuugaggucaggaguucgagaccagccugaccaaaauggugaaaccccaucuguacuaaauacaaaaauuagaugugguggugggcgccuguaaucucaguuacucgggaggcugagguugcaguaagccgagaucaugccacugcacuccaacccgggcgacagagugagaccugucucaaaaaauaaaaauaaggccaggugcaguggcucacaccuguaauucugacacuuugggaggcugaggugggcggaucaccugagguugggaguucgagaccagccugaccaacauggagaaaccccgucucuacuaaaaauaaaaaauuaaucaggagugguggcccaugccuguaaucccagcuaauugggaggcugaggugggacaaucgcuugaacuugggagauggagguugcggugaaccaagaucgcgccacugcacuccagccugggcaacaagagugaaacuccgucucaaaaaagaaauaaauaaaaauaaaaaaaggaaauuaaggaaacuuaacuuuugguaccuaacucauagccuccagaaacccauucauguacuguagauuagucaaccaucuuguagggaauuguuuauagagggcacaaucacauuuuaagaguaaauaaauaacauccugcuaaaucuuuugaggaaaugagcaauuccauauagauuugugagaauuauuuagaaaaaagauuuuagguugaauaauuggcuuauuuaauaaagauuuacccuuuuauucuauucuuaaaacuuguuuuuggccuuaggguauucuugugacuuacggaaaauuugauaguaauuaucaaauuauuguucuaaacucugaagcucauuuuugguauaaccuagauaacaauugcauauuuguauggacagguauuuacugauuucuuuuacaaauaaaacauugugcuugcuuguaaggaauaaucaaggaaauuaacauguggucauuuccuugaaaagaauggauaauucuauagcagccauggucacaaauaauacaaggugaagaauuagucaacuaaggaaugggaauaggauaacagggauagacuauggacuagccaagcaauauuuuugguaauagauacucuuuccaguuuggggagcagaagaaaagaaaaaaaagaggcccggaauaucuuuuucaaaagaaacuuuguugcccuuucuuuauuccuaauaaauuugcuuauuaauguauucacuuuggggccuaauuuggcuuuuacugacaaauagcugccaacaaagagcuguauguauuaucuuguacaccuauauugaaaaaaaaaauucugcauuaugaaauauuuacuccagaaguuuuaauuuuuguuugcuguuucuuuuuaagaauaauuuuuuuuuuuuuuagagaugggucuugcuauguugcuugcuggagugcaguggcuagucacagaugcagucauagcauacugcagcuuugaacugggcucacgccauccuccugccucacucucccaaguagcugggacuacagacaugugccacuguagcccaguucaauucuuucuuuuuuuuuuuuuuuugagguggagucuuaugcucuggcccaggcuggagugcaguggggugaucucggcucacugcaaccuccgccuccuggguucaagcgauucuccugucucagccucccaaguagcugggauuacaggcacacaccaccacgccuggcuaauuuuuguauuuuuaguagagaugggguuucacuauauuggccaggcuggcgucgaacuccuaacaucaaaugauccucccaccucagccucccaaagugcugggauuacaggcaugagccacugugccucgccaagaauaaauacucuugauuuuuauuuccuucuagcuaucuuuuguagcuuuuguucuauuuuuuuuaaaucaucuuugguuuaaacugaaauauacugagaugcagauuagaaaaagcuuuuuuucuuggugcagggcagaagaaaggcuuguaaacuucaccaaaugcugcuuaugcuugugggaucguuuaauguucaucauuuggucagucucauccccauagcagucagaauauuucaagucacuuuauaccaugaaguccaugaaugggaggccuuauuaaauaagaugauuaugugaaaaucuaauggcauauugaugcucugaaauauguuauguaaaucuuggcuuuuaauuuuuuacauuuuuauuacagauucugaagaauauuucuguguaaaaagaauuuucucagggggagaucaaagcuuuucacauuacucuaguccccagguaauaauauagucauguaaauaauuaaauagcuccaauaauuuugacaaauuuuaaaaacccauuauuaauguucuuuauauguuacaaaguaauugccuuaguuuuuuuccccuuaagucuacagaauaaguuuuuucugaucuauuugauagguuuuuguuucagguguucaggagagauuuaauucuguuuaaagaacaaauauauggugggaauuucuugguuuuugaguuauauauaauaucucuucccucugacuaaucuuauuugaaaauuuagaacugugggccaccagaugacuucagaugucccaauccgacaaagcagaucuggacagugaaugaagcucuaauucagaaauggcugagcuauccuucuggaagguuuccuguggagauagccaaguaagaaaagcauuuugggccaggcacaguggcucaugccuguaaucccagcaccaggcagauugccugagcccaggaauuggagaccagccugggcaacauggcaaaacccugucucuacaaaaaaauacaauuagcugggcgugguggugcacaccuguggucucagcuacuugggaggcugaggugggaggaucagcugagcccaggaggucgaggcugcagugagcugagauuaacaccauugcacuguagccugggcaacaaagugagaacuugucuccaaaaaaaaauauccauggauauuuuuaaagaucuuaauuaaauauguauaaguuguaguucuuucaugugcauagagauauguuaaaugauaacauaaaauauuuaauguagccauuuuaggauuggccuugaaauguguuccuucugguuuuauaauggucacuaucuuaacuuuuauacuuuguggaagacuugaguauuauuucuuucuugaauauuuuguuaacuugccuaguagcacuuaagauguuauuuguuuuuuguugguauuugggaugauggguuguauuugaaaagcuguuuuguuucucuagcuuguuuuccaaaacuauaauuuuucugaaaaucccaaaggcaucccagauuaggcucacugccaauauaaaauguuuaaaauuuuuuuaaauuaaaaaacuuuuuacaugaacauacacacuuaauuuuuaaaauaccauguuuuaaagcagauaacauuggauaaauggaugaaaguaauauuuaagaaagucuagaauaaacaguaauaccuucaucaaguauuauuuuaucagucuuuagcaauuuauguaauucugauucaucuaauuggguguuagaggagugcucuguagcauuaaacauuagauuaauuauucauuuuaauucuuuuuuaagaaaggguaaacaauuaaauuucugauucuaugauuaaaaaaacuuuuuuaaauuuuuuagugagauagauggaacguuuucuuccucugguugccuaaauggaaguuuuuuagcuguuagguaaguggcaauucuuuaauaugcugaaauuuucaaauuuauugucuuaaauaguauaucaaauuaaaaaaugaaauaauuuuaaauuuuuauucuauuuuuuuuuuucuuuucuguuuuuuagcaaugaugaucacuauagaacagguaccagauuuucagggguugauaugaaugcugcuaggcuuuuauuccacaaacuuauacaaccugaucauccgcagauaucucagcaggucuguuuuuaaaguauuauguuuacaguauuaucuguugauuuuguuuucuuuuguuuuauacguuuauagccuaauuuacuuugcaguuucacagacucuuacgaugugcuuuuaaaauaagauuuuauuuuaaagcauuuguaauuuagcugucaaagaucuauaaaucuuuucagauguuugaagcagacccugaauuacuuaacauuaccacguugcuuaaguuuguguaugguuauagagguagagaguuuaaauugagacuuguacacgugauuuuuuaaauucuccaaguaaugcuuaggcauuaauuuucauugugcuccaaaguauauucauuguaagacauugucuuucuuuuuucuucuucaccauuucauauuugcuguagugcaaaauuuuccuuuucuuucuuuucuuccugccuuccuuuuuuuuuuuuuucuuugaaaguguauucauuuuaaaugaaguagguuuuacuuuuugucaaaauauagguggcagcuaguuuggaaaagaaucuuauuccuaaacugacuagcuccuuaccugauguugaagcauugagguuuuaucuuacucuaccagaauguccccugaugagugauuccaacaauuucacaacaauagcaauucccuuugguacagcucuugugaaccuagaaaaggcaccacugaaaguacuugguaagaauucuaauauuuuuucuuuugaaaccuuuucucuuuaaaugaaaaugcuucauaaguucuuuugccauuugcaguucugcugcccugcuuauuugacacugucuuaggcaaaaaugaaccuguuuuuccuuuucuugcuuuugucuagucuuuugauucuaguuguuggaguuguugaaagaaaaacauguuagauauagaaguucaauuaaacauaacagcagagacaguauuaggaaaguuaaaaacugucacccguauuccuuucccucaucgccuuuaguauaaucuugcuauuaaagaaguaaaggaggaggaacaauuaaaacugaacaaacaugggcuuuaaaucuucuuggaacccugauauaagcccuuuaucuuguguuuccuucacuugcuaauuucaugauauuugauuuuauuuuucugccuauagacuagauuuuauugcucaucugaucuugcacuucuaucucuuacuguucugguuuuuuggcauaaaguuuucucacuuuaauuuuucuaauugucuagauuuuaucucuauuuccuggccuuuauacuuuuuuugcuacauuuaacccagugcuuuucuuucuaaugguauuuguuagauauguggagcugagauauauagaaguaauaaugucaguacaagaacuuuaaggcugaggguaaauggaggaagcaacaagcaagggguagaauaugggaaucugagggaaaaagagucaagcagggacugaaaagaguauugcuuuccuguugucagaaguuuuuguauucuuucugccugcuucauaggauugaaguguuuguacuuaguaacuacaaauagugaauguggggaaggacccauauguuacacuuuacauuguucagcuucuguauuugaucuucaggaguaccuugcauuuuaaagguagugguucacaauauuucaaccauauauuaaauugaaagauaaaaguuagaaagauccuuuaguauuagagcaauacaauuuaaaggauguuuuguuuaaaaauugaaacuguaauuuucaaaacauuuuuuaaaaacugguuuuaauauuagguauaguggugaguuuuuuauauaacuuaggaaaccaagaauauaaauucaacaagacuuucacacuuuauuuuugcuuuugagagcuuuucggacaauauuguuuaacuuggucggggggagguuuauaaaccuuacaaauguuacauaagauauuguguuauaugcaucuuucugggguuuucucagguuuaacaacuacuguuucagaaaaaaagucaguaugauuuugaaaauugugauuuuuuaaaaaauucauuuuauuugcauguucacuuuuuaauaacagaaaacugguggucaguacuugaaccuccacuauuccucaagauaguagaacuuuuuaaggaaguugugguacaucuuuugaaacucuacaagaucgguauucccccuucugaaagaagaauuuucaacaguuuucuucauacugcauuaaagguuuuagaaauacuacauaggguauguccaaucauuccuuuauuuuccucuuuccccauuccuauuaacagauugauacuguucauuuuaacauuaaucuauuaaagauuuagauuggcaaaaacaaugcauauuauagaaauuuggaaaaguuaucuauacuuucucuuaaaagaaguaauaaaccuguccuuuggagcucuggucuuaccugacuuuguuaggcauguauagauaacuuauccauaguugggcagaacaauaacauacuaaugaguuagaauucuccuuauauuuccuuaugaagaauauaauuuguuaguuugcauuauaugguuuuuguuagcuguaagugguuaucuugugaaagagauuggguccuaguuguaauuaugaacauuaaaacuuguguucuuuugcuguaggguacuaauggccucaaaguagaacauuucauuugaaacaaaugacuaauuuaaaauuggaaccguauguaauucauuaauuugccuauuguucuucccugcccuucuucccaguguaacaaauaguacccuuuacacuuguagcaguucaaaguuauaugaagaaguagacucugagcuguuucauuaaagauggauuuucaucccugacaguugguagguauaccucuguuaugccauuugguuuucucaaguugcuauuuagaugagacaugaccuaagggagaagcguauguuucuaaccuauggaaugacuaaaaaacccacaugaaccuuuaaucuuuaguuucuucuccuuaacagcuucuuugcauuuucagacccucuugccuagugcuaagguaaauaauaaagggauaaaggagauaauccaucuguucuuugucuaagaacaaaccuuuaccggccauuuauuuuccuauuuuagugaagcuccuggguauuuuucucaacuacuuaacuuucuggacuuacuuuuuucuuugguauuuaguauguccaagauuccuagaaaaacaacucauuucucuucauuuugauugaugaaaucauagccauguauuuccuagggaaacaggucauucuuauguuugccuuuacccagaacagggcuuucuuuuagcauaucaggguccaggucugcaguaaacaguuacuaagaagauucucuaacuacaugagaugggucucuaccuuucuguguacuguuugccgaggauucaagagauuaauuagauuguuucuuuucucuggacuucauccuacugcuuuggugaacaaucccuuuucagcuggacccuauuaccaaauaauuacucauucugugcuuucauuaucugcuuaucuuuauuccccccuuuaagaaauacuuuuuuuucuuagcugugucuuuuaccucgagaaaauggaaggggcagagaagcgggggaaauugaacauuuuuucuuucaaacuauaggcagaacuuaagcaaguaaguuaaauuaccugccuagcucaguaacuucagucucaacuaaggaagaacuugauagaguuucaucuucaaagaccuuuuugauggacucauucuaaauacuagaaucuucacaucuugauaguugaaggggaagggaaaauuuauugcuugcuaaccacuagaaccuccuuugucuguaguucaugugaauacucuagauauauuuaacuuuaaaacccuauauagucgguauuuugccccuuuucauagacuggaaaaaugaauguccacauuuauaucagcagauauaguaguauaaucucuuuagaagggggcuugauuuuauuuuaugccccuagaucuagaaguucauauucuagaucacauauaguauuauauuauaggcgcuggacuaggaaucaaaaagaucauauuucuaaccccucuguguugcuuccuaccacugugauuuugaagaagucuuuuucuuuaucccauaugcaaaugaagaauuaucuauaaggauugaaauaccagcccugauaguuuuccaagauuuauguauuguuuacauuauacaguaugggcugggcgugauggcucaugcuuguaaucccagcaguuuggguggugaggcgagcggaucacuugaggucaggaguuugagaccaaccuggccaacauggugaaaccccgucuccacuaaaaauacaaaaaaaaauuagcuggguaugguggugcaugccuguaauuccaacuacccaggaggcuaaggcaagagaaucgcuugaacccaggaggcagagguugcagugagcugagaucauaccacugcacuccagccugggcaaaagagugagacuccgucucaaaaaaauaaauaauacaauauauguaaguuauuauauauucauaagacagugauuuuguuaccaccaccacuugaauggaaaaccacuacuuuugacuugaagaaauuauuggguuaugaggaaacuggguucuuguuugcaguaguuacaaaagucaaaagcaggaugauacugguaugacuuucuuaaacaucucuuuuugggaggcuuuagagcagugaauuaucuuucuucuaugccuuagaggaaacuuucuucauccugcucugccauaaauagguaucuguagauaugaacuacgagggacgauuuauuuguaucauucaagaaaccuauuacuaucaaaacuuguuuauucaaagacaccuuguaucugacagcugccuaaauuccuucccucugcucuaugguuaagaauuaaggggaauuuccucaguuuucuucuuucucuaacucuggaggaugauuaugaaccagagaacuggacuuuguguucccuauucauuucaggauuuauggaugcacuuguuccucccauaugucauguccuuuggaaaguuuuugaauuaaaaauuguuuucagugcuccaaauggcaucauaagaaaauaccuuugguaccugcugucaggaauggauguauuaucagcuaaaugaguuuacuggcaaauaauuggguuauuuaguaguuuccgaguuccacguaguacauuauagacaugcugguaugccaaaagagaagccuuacuuggucugucuagccuagucgcuacauauuugugcugaucuaaaucagugauuuucaaacuauuuuauguagaacccuuaaauaaaaccaaacagauaaaacauacucaccauaaccacccuugaacugagguuuuuaagcaagaauacuaaacuuuaauuaaaaugugaaauaaaaguguuauaaucaaacuuauauagguuuuauuuuguacauuuaggcaauaauccuaaacacauaaguuguuuugaacuucuaccgugugacuucuuuuuaaaauucauuuugcaaauagagugccuacuaugugcuuauuauuauauuagauauuagugauguagugauaaaagacaugauuucugcccuuguugagcuuacaauauugagagauugucuaaacuuuuuggucuuuauguuacagcaugguaaguacuagauuagggaaaaugcagagugcuaugagaacacuugggagggcauguaacuaugaaggacuaaggaagacuuccuggagaaaaugauggcugauugaaccuuaucuacuaugcgaauauauuauuuuuauucuaacauuaacauuucuuuucaaaaacguauauaucauaucagcaagauauacaaacugcaaacacugguugcguuucuuuaauuuuuuuuaauucuuaauuuuugugaguacauaguagguauaucuuuaugggguacaugagaugugcuaugaaauacuagguuuggccgggugcggugguucacuccaguaauguaaccccagcacuuugcgaggcugaggccgguggaucacuugaggucaggaguucaagaccagccuggccaacauggugaaaccccaucucuacuaaaaauuacaaaaauuaauugagcgugguggcacgugucuguaauaccaacuauucagaaggcugaggcaggagaauugcuugaacccaggagguggagguugcagugagucgaaaucgugccauugcacuccagccugggcaacagagugagacucugucucaaaaaaagaaaaaccuaggucuuacucauuuuuuuuuuaauauuuuuauuuuuaucuauuagccaucccaaccucacccaugccccugccuccccacuacccuucccagcuucugguaaccauucuucuacucugugucuccauuagauaaauuguuuugauuuuuagauccuacaaauaagugagaacaugcgauauuugucucugugccuggcuuauuucacuuaaauaauguccuccaguuuuguccauguuguugcacaugacacaggaaugucacucuuuuuuuuuuuuuuuuugagauggagucucacucugucguccaggguggaguacaguggcgugaucuuggcucacugcagccucuaccucuuagguucaagcaauucucugccucagccucccgaguagcugggacuacaggcaucugccaccacaacuggcuaauuuuuuguauuuuuaguagagaugggguuucaccacguuggccaggcuggucucgaacuccuggccucaaaugauccaccugccucagccucccaaacuguugggauuacgggcgugagccaccaagccuggccagaauaguacuucauuguguauaaauaccacauuuucuguauucguucuuuuuuuuugagauggaaucuugcucuauugccagggcuggagugcaguggcacagucucagcucacugcaaccuccgucucccggguucaagcgauucugcugcuucagccuccugaguagcugggauugcaggcguacaccaccacacccaguuaauuuuuguauuuuuuuuuuuuuuuuuuugagacagagucuuccucuguugcccaggcuggagugcaguggugcgaucuuggcucacugcaagcuccgccuccuggguucaugcuguucuccugccucagccucccgagcagcugggaccacaggcgccugccaucacaccuggcuaauuuuuuuuuauuuuguauuuuuaguagagacgggguuucaccguguuagccaggauggucucuaucuccugaccuugugauccgcccaccucagcaucccaaagugcugggauuacaggcacaagccacugcacccggccuuauucauucaccuacugauggacacuuagauugcuuccaaaucuuggcaauugugaacaguguagcaguagaccugguagugcaaauaccuguaugauauacugcuuucguuucuuuuggguagcuccucagcagugggauugcuagaucaugugguagcucuauuguuaguuuuuugaggaaccuccaaauuguucuccauaaugguuguacuaauuuacauucucaccaacaauguacgaagguucccuuuaguccacauccuugccagcauuuguuauugccugucuuuugaauaaaagccauuuuaacuggggugagauaucuuacuguaguuuugauuugcauuucacugguguucggugguauugagcgccuuuucauaugcccguuuguuuuuguuuuguuuuuuuuuuuuuuugcucagugcaaccuccgcuuccuggguucaagcaauucuccugccucagccucccaauuaacugggacuacaggcccacgccaccaugcccagcuaauuuuuuguauuuuauuagagacgggguuucaccguguugcccaggcuggucuugaacuccugagcucaggcgauccacccgucucagccucccaaaaugcugggauuacaggcaugagccaccgcacccugccgccuguuugguauuuuuaugucuucuuuugaggaaugucuauucagcucuuuugcccacuuuuuaaauuggauuauugcauuuuuuucuauagaauuguuucagcuccuuauauauucugguuauuaaucccuugucagaugauuaguuugcaaauauuuccucccauucuguuuguugacuguuuccuuugcuguguagaaguuuuuuaauuuaauguaaucccguuuguccacuuuugcuuugguugcaugugcuuguggggcauuaggaaauuuuugcccagaccaauguccuggagaguuuccccuaauguuuucuuaaguaguuucauaguuugaggucuuagauuuaaucauuaaucauuuugauuugauuuuuauauauaguaagagauaggggucuaguuugauucuucuucauacagauauucaguuuucccaguaccauuuauugaagagacugucuuuuguccaguguauguucuugguucuuuugucaaaaaugaguucauuuuagguguguagauuuguuucuagguucucuagaaacaaauuuguucuguuccauugguuuaugugucuguuuucaugccaguaccaugcucuuuugauuacuauaccgcugcacuauaauuugaagucagguaauaugauuccucgcaguuuuguucuuuuugcuuaagauagcuuugacuauucugggucuuuugugguucuguguaaauuuuaggauuguguuuccuauuucugugaucaaugucauugguauuuugauaaggauugcaaugaaucuguagauugcuauaggugguauggacauuuuaacaauauugaacauggaauaucuuccauuuuuuguguccucuucaauuucuuugauaguuuuucuuuuuuucuuuugagauggaguuucacuguguugucuaggcuggaguaaguacaguggccugaucucggcucacugcaaccuccacccccccgauucaagugauucucaugucucagccucccaagaagcugggauuacaggccacuccaggcuauuuuuuaguagagaugggguuucgucauguugacugggcugguuuugaacuccuggccucaaguaauccacccgccuuggccucccaaagugcugggauuacccggugugaaccaccaugccuggccuauuucaguuuuuuugaaugguuuaagacuuguuuuaugacauaacauauggugugucuuugagagugauccaugugcuaaggagaacaauguuuauucugcagccauuggaugaaauguucuguaaauauguguuugguccauuuggucuauagugcagauuaagucucauguuucuuuguugguuuucugucuguacaucucuguccagugccaaaaguggaguguugaaggcuucaucuauuacuguacugaggucuauuucucucuuuaacucuaauaauauuugcuuuguaugucuaggugcuccaauguugggugcauauauguuuacaaugauuauauccacuugcuaauuugaccacuuuaucauuauauagugaccuucuuugucucuucuuacacuuuuguaaucuauuuucucugauaugguagcuacuccugcccuuuuggcuaacacuggcaugggauaucuuuuuccaucccuuuauuuugagucuguuugucuuuauaagugaaguguguuucuuguaggcaacaggucauuuggucuuauuuuucuauucaugcagcuuuaugucuuuugauucaugaguuuaguucauuuacauccaauguuauugauaaguaaggacacacuccuccuauuuuguuacucauuucuggugguuuugcaguuuucucuuccuuuuuuuucuugcuguuuuguuuuuagugaaggugauuuucucuggugauaugauuuaguuuuugcuuuuuauuuuuuguguauucauuauaugcuuuugguuucagguuaccauggggcuugcagauacuaucuuauaacccauuauuuuaaauugauaacaacuuaacacuguuuguauaaacaaauaagcaaaaagaagaguaaugaaaacucuacaccuuaacuuuguacuccugcuuuuuaacuuuuuguuguuucuauuuauaucuuauacucuguuuugaaaaguuguuguaguuguuauuuuugauugguuaauuguuuauagucucucuacuuaagaguaguuuacacaccauaauuacaguguuguaauauucuguauuuuucuguauacuauugaguuuuauaccuuuagaugauuuguuauugcccauuaauguuuuuuucuuucagauugaagaccuccauuuagcauuucuuguuccacaggucuaguguugauaaaauuccucagcuuuuguuugucuaggaaaauauuugucuuucaggguggggugcgguggcucauggcuguaaucccagcacuuugggagacugacgcggguguaucaccugaggucgggaguucgagaccagccugaccaacauggagaaaccccuucucuacuaaaaauacaaaauuagccaggcaugguggcgcaugucuguaaucccagcuacuugggaggcugagacaggagaaucaugccaguaccgugcuguuuugaugacuaucuggaaggcgaagguuguggugagccgagaucgcgccauugcacuccagccuaggcaacaagagcgaaacucuaucucaaaaaaaaguauuuaucuuucauguuugaaggauauuuucacuggauaaauuuucccuucaauacuuuaaaugucaugccauucucuccuggccuguaaaguuugcccugagaagucugcugccagcauauuggcacaccauuguauguuauuuguuuuuuucucagacagguuuuuuuuucuuuuuuuuuugagauggagucuugcucugucgcccaggcuggaaugcaguggcacuaucucggcucaccgcaagcuccaccucucagguucacgccauucuccugccucagccuccugaguagcugggacuacaggugcccgccgccacacccggcuaauuuuuuuguauuuuuaguagagacgagguuucaccguguuagcugggauuauaggugugagcuacugcgcccagcucuuguuuuuuucucuuucuguuuucaggauccuugguuuaucauugaccuuuggaaguuugauuauuaaaugucuucaaagagucuuauuuggauuaagucugcuugguguucuacagucuucuacuuggauauugauaucuuuuucuauguuugggaaguucucugucauuaucucuuugaauuaauuuucugccccaucuaucuccucuuuaaggccaguaacuuagauuugcccuuuugggccuuuuuucuagauucuguaggcaugccuuauuguuuuuuauucuuuuuucuuuugucuccucagcucacuaauucuuucuucugcuugaucaauucuccuauuaaaagacucugagacauucuucgguaugucaauuacauuuuuucagcuccagaauuauugcuucauucuuuuaaaugauuucagucucuuuguuaaauuuaucugguauucuuucucuguauuaucuugaauuucuuugaguuucuucaaaauagcuauuuagaauucccugucugaaaggucauguguuucuuuuucuccaagauuugucuuuggugccuuauuuuguucauuuggugaggucauguuuuccuggauggucuugauaacuuaacagauguuccucucugucugggcauuaaagaguuagaguuacguauuuauuguagucuucgcgguuuggacuugugugucuucgugcuucuuggaaaggcuuuccagauauucagaaggacuuggauguugucaucgcuuagaagcuguaucugcuuuaguuggcaccccacacccaguagugcugugguucuggcagacucauaaagguacugccuugauggucuuagacaaggucuggaagaauucucugaauuaccaggcagagacucuuguucuuucucuuuccuuacuuuuuccaaaacaaacuuugucuguucugaggcaccuggagcuggggguggagugacacaagcaccccuguggcgaugcuaccaccacugggacuacacuggaucagaccugaagccagcacagcacugggucucacccaaggccuguuauaacaacuuccuggcuacugacuaucuucacucaaggugcuggcgcucuacaaucaccagguggcaaagccagccuggccuguguccuucccuucggggcagcuaguuuccccaggcccuuggugacuccagaggugcugucugggagccagggacuagagugaaaaaccuuagacgucuaccugguguucuguuguacugcagcugagcuggcccucaaaccacaaaauaguccuuaccacucaucccuccccuuugcaaaggcagaggaacaccccagaccuccccuuggccacugucaccaggggccuguggggaguacugccagaauacugccaguguuuccuugaggcccaagggguuuuuuuguuuguuuguguuuggagacggagucuccugucgcccaggcuggagugcagugacgcaaucucagcuccuccaucuccuggguucaagcgauucuccugucucagccuccugaguagcugggacuacaggccugcaccacuaugccuggcuaauuuuuguauuuuuaguagagaugggguuucaccauguuggccaggcuggucucaaacuccugaccucaaggaucugccugccuuggccucccaaacuugcugggauuacaagugugagccaccaugcccagcccaagggcuuuuuugagacaaggucuggcucuauugcccaggcuggagugcaguggcacaaucucggcucacuauacucucuaccucccaggcucaagcaguccucccaccucagccucccaaguagcugggacuacaggcaugugacauugugcuggcuaauuuuuguauuuuuuguggagauaguguuucuccauguuggccaggcuggucuugaacuccugaccucaaguaauuugccagccucggccucccaaagugcugggauuagaggcgugagccaccaugccugguccuuaagggcucuuuagucagcuuguggugaaugcugccuggcaugggacuuacccucuggcccagcacagguccagaaaugccaucuaagaaccaaguccuggaauuuguucacccuccuacguuggagcugguacccaagguacaagacaaaguccccuuuacuuuuccuccacuuuucucaagcaggagucuugccccauagcugccaugguagggaaugugcugagucucaccugaagccaggaaguuucaggcucacucaaggccuuuguaccuaguacauggauauugcugcugauuauucagggacccaagggcucuucaguuaacagauaaugaaagcugucaggacugggucuuucuuuucgaggcaguggguucccuucuggccacuguguaucuagaaauguuguucaggagcuacagucuggaaagcagucuucacaacuuugacuggugcccuauccagcuguggcugagcugguauccaagaugcaagacaaaguucuccccacucuucccuccagucuucucuccgcaaguggaaggagaagaucucuuuuggagccacaagcugugcagccuuggguuaaaggagggguagugccagcagucccuaaacagccccagcuggugucucaguaggucacaugccucuccagcucacuggcucugggcccaguucugcacuuggacucaccuaguaguugcgguccuuguggccugcacuauguuugaaguuuauugagggccccagagcacuuuagcccaccauggugaggcuugcaggaacucacauuuugacaacugggacccacaguuccccucuggcuagggcuggguuuuaaugcucccucuguggacaggagucagcuaaguuugauccaguuuuacuuuuugcuguaacagggcagugcugagcucaaugccuaacaauugcugcauucuuucucuccccggugcacagaaaugcucucugcaccacaaugccucugccaggggcugggagaggggugauguuggugauucaagacuuuuuuguaucucuuuuuuucagcaauaugaaguugaaaccaggugcuaugagugcucaccugauuuuugguucucaggaagaugcuuuuuuuguguagauaguuguuaaauugguguccaugcagcugggacaaucaguggagcuuuccauuuugcccuauugcuucaccucuuccaccuguuugcuuuuagggauggaaacugugguuucacuuuuaaauuuuaaguaagauaaacaaaaauauauaucagaggucagugggaugugaaucauauucugcaagagucacuaaauuuuagaauccaaugugauuaaaaauuaguuuguauauguauaaacauaaauauuggagaggggaaagccauuguguuuuuuguauaacuauucuguauauuucuuuuuuuaguagaaagaguuuggcuaauuauuucaguugauuaaagcacaauacuaaagacuccaggguaggaccugcaaacuuuuucuguaaaggaccagauaguaaguauuuuaugcuuugugagccauacaguuuuuguugcaacuagucaacucucaacuccacuguggacagcauguaaauggaugggaguggcugcuuuccagcaaaauuuacuuaaaaaaaaaaaaaacaguggguagcauuugaccuggguagcauuugacccacagguuguaguuugccgaccccuucuuuuaggaugaaaauuuuggucuccauauguaaacuuggugucuuuguuuuguuugaaagcuaguaauagcaguauaacucuggucaguuucucccaaaugaguauccuggccacagauauaaagcaaucaaaacagugggagaaaaaaagaacugaaagugcuuuugucaauaauuagaggagauaaaaguaucaacugugaaaauaaaagcaguauuauuaaaugugugcuuuuuaaauuggauuauuuguacaaugcuaagccacaagaucaagcaaauuggacagucauauagugaguuaagaaugcaugugucggcugagcaugguggcucacgccuguaaucccagcacuuugggaggccgagguggguggaucaccugagaucaggaauuugagaccagccuggccaauauggugaaaucccaucucuacaaaaauacaaaaaauuagcugggcaugguggugggcaccuguaaucccagcuacuuaggaggcugaggcaggagaauuguuugaaccugggaggugucaacagagcaagacucuguccaaaaaaaaauagaaugcaugaguuauauuucuggcucuguuacuuacgugaccuugguuacuuucuuaaaugcuaagccuuaguauacucaucuuuaugaucauaauaauaguauacauuucauaagacuguuuaaaugagacaauguacaugaaguccacuuuaaugauagguuuuauuuuauuauuggagcauaaaauuugagugaauuuuuuuuuuuuuaaagacagaguuuggcucuugucacccaggcuggagugcaauggcacgaucucggcucaccacaaccucugccucccggguucaagcgauucuccugccucagccucccaaguagcugggacuacaggcgugcgccaccaugccuggcuaauuguuguauuuuuaguagagacgggguuucaccaucuuggccaggcuggucucgaacuccugaccucaugauccaaccaccucagccucccaagguucugggauuacaggcaugagccacugcgcccagccaaauuugagugaauuuuaagguagagucugcauuguagugaaaauuuuagcuucccuucucgauaugcauacugaagccugacaguccccuaugccccuccauggaaugaggcaggguaaugguguuauauauguguuuguucucuuucucuauuaggaauacuucagggcaaaaguucagaaaacaugaaaauuauauaaacaauucuuuuuacgaaaaauuaacaauaagcauacauuauaauacaucucacugaaaaugcaacagauauagaccgauccuuuuaaagugccauuagaaguaagaacuauaggcaauaucucuuaaguuuuaucuguccauccauucgucucauauuuauugagcaccuguuuggacaccagcauugucugguuagauuuauauauuuacugagugauucauuuuguucccuuucagauauuccuuaguuuuaguguauaugugauuauucacaaauuauaauacuuuuguuauucuucaaaggaaaguuagcuaguuuuguuuaguuuguauguuagaucaacuuuauuuguuucuuuggugguuuuucuucucuuaagugcaacaucucuauagggucugcauuuggcuccuuuuguuuuacuuucuaccucucccuuaccuacugccacagcuuauaguugucuccuuuaaggaaaaugacugucaguuaugucucugaggcaaacguuucucgaguaacuugacaguccugccauuacuuucaacuaagaaagguugucuuguuuuccugacccuguguguauguguguguguguguguguguguguguguguguguguguguguguguacaguaauuuuuuuuuuuuuuuuuuuuugagacagagucucucucuguugccaggcuagagugcaguggcgugaucucggcucacugcaaccucugccucccggguucaagugauucuucugccucagccucccgaguagcugggucuacaggcacgugccaccgcacccagcuaauuuuucuauuuuuaguagagaugggguuucaccauguugaauggucucgaucucuugcccuugugaucugcccaccuuggccucccaaaguucugggauuacaggcaugagccaccgugcccaaccuauguacaguaauuuuuaaaauuacucuuacccaggguugaaauauugaaguugucuuugacucuucucguuuuccauauccguuagcugccaugaccucugaauucuuaucuagagacuuuaaaucuucuagcaauauccuaauccuauugccagccucucuacuuauucuugacuauaccucacucucucagccgaauaauauucauaaaauacaacugguucuguuacuuuuuaaaucuaaaaccuuauuuccccauguaucaacuuuugccauaguaauauucuguaacaaaacaugccagaacucauuggcauacaaugaugaacacuuauucuaauuccuacgggauugggccuuguuuuagccuaagccuuggcugaggauggcuaaccuagagacgguugaggucagcuuauuucccaacugcauguugaauccaguuuugcuccaugugccgcucauucucuuuagcaguuuaggugggggcaauuacauacagauugugucucuuuagcuggugcuguucucucugccuagaauguucuccuucaaaccuuuuuuuuuuaaauguuuuccauucacuuuccuuuuugauuuuuauuugcaguaucuucaaaccuacagaaacauugaaaacaaauauaauuaaaaccugugugcccuccauucuagauucagcaguuguuaacaugcugucacauuugcuuuauauauguguguguauauucuuuuuucaugaaucauuugaaaguaaaauguagauaucauccuuuaauacuuaaucuuucaucucuuaagaauacaggcauuuuucuguguaacagcaguagcauuauuucucuuaaggaaguuaacuauaauucuauaauaucaucuaucugugcaugcauauuucaaauuuccucauuuauagcaaaaauguuguuuauauuacugcuuuuuaaauaacuagaguccagucaaauuuugguuuuugcaauuguuuguugagucuugcuacucuccuuucugauucaugaacauggugaaugacucuucaguuucucucagcagugcuugguaguuuucaaggaucuugcauauucuuuuaaaaauuuuauuccuucucuuucucaaagauuuauuccuaaauguuuuauguuuuugaugcuauuguaaaugauuuuuaaaauuuuuauuuuccaauuauuuguugcuaguacagagaaauucuuuuuuuuuuuuuuuuuuuuuuuuuuccucuuuuuugagacagaguuugacucuuuuugcccaggcuggagugcaggcacgaucucagcucaccgcaaccuccgccucccggauucaagcgauucuucugucucagccucccgaguagcugggauuacaggcaugcaccaccaugcccggcuaauuuuguauuauuaguagagaugggguuucuccauguuggucaggcuggucuugaacucccgaccucaggugaucugcccaccucggccucccaaagugcugggauuaccggugugagccaccgugccuggccuuuuuuuuuuuuuuuuuuuuccuuugagacagagcuucacuccugucacccagacuggagugcaauggugagaccuuggcccacugcaaccucugccucccagguucaaaugauucuccugccucagccucccaaguagcugggauuacagguguccaccaccacacucagcuaauucuuacauuuguaguaaagaugggguuucaccauauuggccaggcuggucucaaacuccugaacuguagugaucugccugccucagccucccaaagugcugagauuacaggcaugagccacuguaccuggccuagagaaaaucaauugaguuuugaguguuggccuuuuacccuaugaucuugauaaauucuuaguucugguaauucucuuauagauugauucauuuggcuuuuuuauauacacaaucauguuauuuucuuggcauauuuuauuaacuaagaauuucaguacaauguugaauauaagugguuaugguggucauucuugccuaguuccuaaucuuagaaagaaagcauucaauaucuuaauaguaaguauaauguuaaaugucgguggggggugggggugguuagauggguuuuaucuguuugaagaaauuuucuuccauuucucauuugcugagaguguuuauuauaaauggauuugaauuuuaucagauauuguuuccaucuguugagaugaacagaugauuuuuuucuccuuuuuuuagaaauauugugaaauucauugauaguuggauguuaaaccaaccuugcauucuugagaugaacuuuacuuggcauuauauuuguauuauacuuuauauauauuauuggauuuaauuugcuaauauuuuauugaugguuuauaucuguguucaugagggauauugaucuguaauuuuuauuucucauauugcuguuagcuuuugguaucaaguuuauucuggcuucauaaaaugaauuaagaaaugauccuucuuuauuuucugaaaaaguuugauuaagauugguauuauuucuuuauuaaauguuugauauaauucaucagugaaaccauuuuggcccuggaguuuucuuuugggaaaauuuuaaauuuccuauuaaauuuaaaaaauaaauauagacauuucagguuuucuguuucuuccugagucaguuuuaccaagauaucuauguaaucauguuucuucuuuaauuccugauagugguaaauugugucaucucuuuuucuuggucagucugacuguagguuuauucauuauuaucuuuucagaaaacucauuugcuuuuaauuucuucucuaguguuuuucuguuuucucuuucauugauuucuuuguuuccuucugcuugauuugugcuuaauaugaucuuuuuuuuucuagauucuuaaagcagaaacauugaucauugauuuuagacccuuuauuucuaauaugaucauuuaaugcuauagauuuucuuuuaugccuggauuuauuagcaucccacaaauuuuuauguguuuuuacuuuuaaguucaaaauauuuuccuaaagccccuguuuccuagcuccaacauuugggucuucucugaaucugacucuguugauugcuuugucucuagacacuuuuuuguuuuguuuuguuuguugauuuuuuuuuuuuuuugagacagagucucgcucugucacccaggguggagugcaguggugcaaucucagcucacugcaaccuccaccaccuagguucaagcaauucucgugcuuuagccucccaaguugcugggauuacaggcaugugccaccacggccagcuaguuuuuguauuuucaguagggacaggguuucaccacauuggccaggguggucuugaacuccugacuucaggugauccaccugccuucuccuccccgagugcugggauuacaggcaugagccaccaugcccagccuguucaguugauuuuugauaugucucauaauuuuggguuaucuauaaaauaguaagaaacugaaaucaauagguuuaaagcuuauaaauugguacaccucuacuaucugguauuaguguaaggauuugaguuuagucaggaguuaagcuggaauugaauuuuuaauuugcuauaaauaccuucauuacacuacaggccuguaaugcuagaggaauuugaggccucuaacauuggaggaauuugaggccuguaguacaauguuuaggguggaaguggggugucaaaugguuuuugugaauguuugugccccacuuugcaugccuacuccuuagagggauuuuguucucauucuuuccucuugucaguuguaaacugguauugcuuguuacucagugcuuucaagauugguagaggagagggaacagaaaugguucuugguuguugugguauagccuugguuuuagguagauuaugugugccuggaccuuugucagaguucccuccccucuuccuguggcaaccaaacucugcuuccgauuuuuuuguguggcaguuucugcucccucccccagcaauugcagaccucuaguccuacugauauaagauucugagccuaggacuguucuugucaccuuuccucccaggaauugaagguuuuucccucccucagcaacaagacauggguuugcguccccuuccucaguggcugaaggcuuuugcucugugugaaagaaggaucugggcagggugacgggccuuuguuccuuucucauguggcagcuaauuccuuguaccauugagagaggcucuugauauucugccuuguuuccuuuuuucccccccucugccuuguuuccaguuguuucaugggcacccaguggcaucuauggacaagaggcugugagugagugccaacugccugggacucugcgggguuucauacuaucaagcuaccccacacucagcuuuaagugauccuuaaaauuuuaguguauuacuucugcuuauaugacaguaguaguuuccucuuucucucugccacaaaugagccaauucugguacccuguuaccuuuuguaaggauuuguugauccuuggauucaggcuacuugguugucuuguaacuuuagcucucucacagguucaagaaaaguuuucaguaauuagaaguguuuuguuuaauugccaguauucuaggauuuuccaaaucucuuucuguuacugauuuuaguuuaauuccauuguggacagagaacauauguuguauacuuuggauucuuuuaaauguaugaagacuuauuguaugguccaggauuuggucuaucuuagugaacauuucauguacaauuauuaggugaaguguuaugacagugagugcaaguugguuuaaauuguuauucagaucaucuauacuugcugguuuugucuauuuuuuucuaucaguuaaugagagcaguguuaaaaaucuccaaauauaaucaugguucuguugauuucucuuucauauauuuucaagcucugcuguuuuuggauuguugugacuucuuggugaauuaauccuuuuauuauuaugaaauaugccccuuuuccucuggaaaugcuuguuuugaacucuuacuguaagaguagccucucuggccaggcgcgguggcucacaccuguaaucccagcacuuugggaggccaaggugggcagaucacgaggucaggagauugagaccauccuggcuaacauggugaaaccccaucucuacuaaaaauacaaaaaaaaauuagccagaggugguggugggcgccuguagucccagcuacucaggaggcuguggcaggagaauggcaugaaccugagaggcggagcuugcagugagccgagaucacaccacuguauuccagccugggcaagagagcgagacuuugucucaaaaaaaaaaaaaggaguagccucucagcugugcuuucuguugguuuauuggguuugaguuuuauuuauuuauuuauuuauuuuuagcaggucuuacuuugugccuugugcauucaugguuuagaguuagccaaggauguggggggaauuugcacauagauuuuggggcuucguccucuggauuccuuucuuugauuuuuuuauuccucacugucuggcugugcuggcagcuucagucugucuauuaagacugcugcuuucugcuugagcucuauccucuacuuguguccauuccuguuucugccuacuuuugguggaucuccaguguuuuuaaguacaguaguuguucuuuaauguauugucuagaguuuauaauuguuagugccaggaagaguagucugauacaaaguauucugccauauuuaguaccagaauuccucuagucucuuuuaauuuagaauagcuccuuuuuuuuucaaucccugcuaccuugacuuuuugaagauucuuggccaguuuucuuauaaaaguuucauaaucaggauuugucugauuguuuccucauugugauguuuauuuaacuuguuccucuaucccuuguauuuccuauaaacuaaaauuuagauuaggagacuugauuggauuuggguuaaacuauuuuuacuucauagaucauuuguaugcuucuuguugagcuauaucaccaagaacauaauauuucauuguuccaguauuggugaugauuaguuagaucacuugaugaagauggugcucuccacuguaaagauuuguuuuuaucuuuguaauuaauagguaaucucuagggugguaauuugcauccucuucauuuuucacaucguguccagauaucaccuucuaaaguuuauucuaaucagaugccagcacagagcaacacuuaacaagcauuagcugcuauuauuauuaaggucccauuucccaaccauaagucuuuauaguaucuaguuuauauauaccguauacaguuuaaucauuacauaucucauacuguguuguaguuauaaagacaugucuuuucuagauuuugggguacugaaugcagauaucacaucuuacaaaucuuugugucucccauagcacuuaacuagcauuuugcauauaguaggcacucaguaauuauuuuuuguaggaagaaaaaaauagcuaagaaaauccccaaagcauuuuuuucuuuagauauuuuaaauuucucugucuuggccaggcgugguggcucacgccuguaaucccaacacuuugggaggccaagguggacagaucacaaggucaggagaucgagaccauccuggcuaacacgaugaaacuccgucucuacuaaaaauacaaaaaauuagccggucaugauggcgggugcuuguagucccagcuacucaggaggcugaggcaggagaauggcgugaacccgggaggcagagcuugcagugagcugagauugugccacugcacuccagccugguugacagagugagacuccgucucaaaaaauaaaaaaaauuugucugucuugaguacugguuaaauuuaaugucaauuacauuuucuuuuguagguaaaugagaaaaugggacagauuauacaguaugauaaauuuuauauacaugaaguacaagaauugauagacauaagaaaugauuauaucaacuggguccaacagcaggccuauggaaugguagguuuucugugcaauuugugauuucauuuuuauguauauguaucuaauaaaaaaagaaacaauugcuugguuuugaaaugagaaaguuuuuucagaacuuuuauccagaacuuacuuuuuaaauaauaacacauugcaaaggagugcuauauauuuuacaauauuuauaugcaaacauucuacucuuuuaccaaagccaaaccaaagaaauggauuacacuguaaaacaaaacaaaacaagacaaaaaaaaccuacaagugugaaauggauuuuuaacucuuuuauuuuccaugagguugccucuuauuucuccaguguugaaaauacuggcauucuucauacuggaacuccuaagaaugcauuauuguugugaaauuggugcuucaagacuaccaaaagaggacugggugugguggcucaugccuguaaucuuagcacuuuggagccugaggcagguggauucccugagcucgggauuucaagaccagccucggcaacaugacgaaaucccaucucuacuaaaaauacaaaaaauuagccaagugugguggcacaugccuguaaucccagcuacucagaaggcugaggcaugagaaucacuugaaccugggagauggagguugcagugagccgauuauguguuuacuuuuauuucagauuuuuaauauaaaugugggugcguacaucuuuuuaugcagcuaagucuuuaauaacuagacacuaucccauuaaaauaguaccauggucuuauaaaacuugaauuaggcacauaaaauuuuaaugcagaaauggguaagcaguuagauacaaaauauuuagguuuacuacucuuauuugcuagccauuuguguauacuugaggcccacuuuucuguacccagguaauuuaauaugugugcagcaguuauauaauagaagggugaguaacuuuucauugcuugcuaggcaccagcuguaagcuccuuguggaugggugcucuugucagucaaccagcaccucugacagugucuagaauaugucuaguaagcacuaaaaaaguacaguaguuuuugaauggcaaucugguuagugcacgcuguuuuuaggauacucccaccuuccggaaucagguugcuucuagacaucuuuuccuucccuaguguacuugggucuggacugggagagacucauugacuuuucuccugagucacuuugaggcugggucagguuuauagccauucuauagauuuaggucuauucauuugcuuauucaacaaacaaugagaaucuguuauauaacaggcacugauuuagguauuggaaauacaguggugaaccagacagagccuuguuucucauggaauucguaaucuacugggcaagauuggcaauagucaaacaaagcaaaaaauaccagcuaauaauauguauuauuaaaaugaggggacuuaguaaagauagguuucagaaaagacuuaucuaaugaaguaugaguacuaaucugaaugacaaggagcagcccuuuaagaucagggcagagagaauuucaagaacaacgaacauuugguaaaauaccugaggugaaaacaagcuugacaugauugaaggacagaaaaaagccagcauuaggccaggugugguggcucacgccuggaaucccugcauuuugggaggccgaggugggcagaucacgaggucaggaguucaagaccagccugaccaacauagugaaaccccgucucuacuaaaaauacaaaaacuuagccaggcaugguggugggcgccuguaaucccagcuacuuggaaggcugaggcaggagaauugcuugaacccaggagguggagguugcagugagcuuagauugcaccauugcacuccagcaugggcgacagugugagacuccuuucaaaaaaaaaaaagaaagaaagaaagaaaggaaaacagccagcauggcuuaugggagugaggagggaacagagaaaugggcaggggccagaucauagagaguuuaguaaacuaggauuaggaauuuggauuuuaucuaaaguguuaaugauaaacaggggaaacuuaaucugaucuuuuugaaugaucacuuuguuggcuguguagggaacgggacagaaaugaaagacggaaauccaugagaaagcuauauuuuaguagauuaggggagaggaaaugauggguuugacuaggaugaugguuauuuagauggaagaaggaaauggaauaugucuuggagauaaaagggaaucuuggagacaaaaggaaaauaaaaaucacugauggauuggauaugaagugaggaaaggagagaaauccacaaagauuaaaaagcaggugugguagagggaaaacuaggagagucuuggaaaccaaaauuuaaaagugaaagagagacuguugaaugcugcagaggaggaggaugaaaccuuagaauugacagugaauuugguuacaugaagguaauugguaaccuugauaauaccauucuuggguugggauguuguaaagagaaauuuagagguaaggaagcaguaacaaccauuggcaauacuuugacgaaguucugcauugaagaggagcaaaaaaaaaaaaaaaaaauggagugguagcuggaaucaagggauaauuuuuuaagaaagaaaauaauugaccucagcaguuuugaauaaauauuuccuuuuuucuucaucucugaccuagguaaagcuucucaaacucuuccuuuagagaaccugugauggcaggagaaauaacauauuucuuaaggauuuaaccuucccucagcaagacuugaacugaggcuaauuuucuaucuuuaaaugcaaauuuugcauuaugggcauaauagauauugcaguauaaaagagauuuaauuuauuugucauugaggaaaauugauucuucaggaaaugaaccuuguucauaccaagacuuugcauauaaacccucacacaccaaccaggguacccuaggucuuuuagcaguguuuuugaaaggauucagaacauuuggagggauauguggacccuuuuaaagaagaacaauuucuuaagaagcccaguguucacuuacauauuauauaaauauauacacacauuaaacuaguucuaaacucuugguguuuagcucuuaaaagaacucuaagaccacagcaaauuuauaauuauaaauaacauuacaguccaggugcggaggcucacgucccagcacuuugggaggccgaggugggcagaucaccugaggucagaaguucuagaccagucuggccaauauggcgaaaccccgucucuacuaaaaauacaaaaauuagccaagcaucguggcgggcaccuguaaucccagcuacuuaggaggcugaggcaggagaauggcuugaacccgggagguggagguugcaaugaguugagaucacgccacugcacuccagccugggcaacagagugagacuccaucucaaaaaauaaauaaauaguaaauaacauuacaaauuggcaaauuaaguuaauuuauuauggagaauguuguaaugaugaagaauucuaacucacaacauaaauauguaugaugagaaagcagaguaacuuuuaugagagugccuggauucaaaucccaccucagcauauauucaguucuguccuugggaaaauuacuuaauuucucugagauuucauuuuguuuucuguaaauuaggauauuaguaccuaccuuaaaaaguuuugagaagauuaauuuauaugaucccugugaaggacuuagaguaauuucuggcacacaguuaagucuuuauaaaauggugauuauuguugcuggcuaccuugacacaggcuacaaauuuggcaguagcuuuuauucugacgugucuaauaacucuguucucuugcugccuuucucuaugugcacuauaaugaaacauuuucuaagagcauuuucuagguacuauucucaguuuccuuauccuccuuuaacuuugcuuuuaaauuguuuguaaaaauaccuuauugguuacuaccaaacucuuugcuauuuuuucuucccuuucugauacuuuuaguuaauuaucuuuaucugguuuucccuuuggugccucucucucuuagaaaaaugauuauaccuaaugucuaaucaucucucuuuuucugaaguuuuucacguccuauuauuuuucauauucuugccaguucacaucuuucugucccaauuuuuaguguaaccaaauuauauucugcuuaguauggguuagucgcacuauaaauucuaacauuaucuuacugacuuccccaguguauaaugauauguauaacaucuauaucuacuuacauguaguaguaaaaaagauaaugcauacauacuaauauuucauuguuuagcuaaggagaaaaucgaucucccauacuauaaacucccuugguauauaguauaguuaucaagcaggccauagauaaauuuuuauaggcuuuuuuuuuuuugcuuauuuaaacuuucuuaguaguaauaacacuuuuuaaauguccuacaagaggaauauuggugauaugaaggcugugcauaugugaggauaaggguauauuggaagucucugcaccuuacuuucaauuuugcugugaaucuaaagcugcuuuaaaauaauaaaguucuuuuuucaaaaaaagucccacaagguauacuauaaaaggauuucagauguuccuuuuauauugccuucuagcuaaacagaguguaaucugaaagguuuuuuugcagaacagucucuaaagacuuucaucuuguuuacacugccaguuggagcauuuaugugguaauaacuugguacugugaauuuuuuuaaagaaauucuugucaauaauauucuuccucugaauaggguuugcauagagugauguuuugcuuaugcuuacacugcuuuggcuuuacuuaauauagugagagaacccaaagucuuugcuaauaucuuaaauccuccaauaauaucgcuggugacacgugggaacucagucaacuacaaaguuaaagagaacaguuuacacaagacugcccucacuucugauaccaauugugaguuuggggagggucccccaaacuacccuuagguuugauaauuugcuacgaggccucccagaacucacugaaaauuguuacacugaugauuaggguuuauuacagggaaaggauaauagguuaaaaucagccaagggucuuuuugacucucugagcagcaccaugacauuuggcaagaacaagcaccuuaugaaaggugacaaauagggagcaaagaagugguuaaucuacuuucuaaaaaagauagauaugauaugaaagcacgugcuguguucaguauaagaaauauuggagagaaacacuagucaccaggacucaaggaaccaaaauuauaucugauggccucaaguguuguguauauuugaagugaaccuuucugaucugcagaaugaugaaauugcauuuuaaaaauucaagcugacuacugaggauguugaggcgcuaaacgaccuaacuuccauugcauggaucuuaccugugacaaaaugaguuccauggccaaaaacugguagaucaugaaagaagcucauguuaaugucaagaccacuaaugguuauuugcuucaucuguucuguguugguuuuacuaagaaacgcaauggucagguacagaagaccucuuacucucagcaccaacagguccgccaaauccgcaagaaagugaugaaaaucaugauccaagagguucagacaagugacuugaaagaaguggucaauaaacauuggaaaagauaaagaaaaggcuugccagucuauuuauccucuccaugcuuguccuuguuagaaaaguaaaaaugcugaagaugcccaaguuugaacugggaaaaccagggagcuucauggugaagguaguaguucuagaaaggcuacuggggaugugacaggugcuaagguuauaugagcugauggauguggaccacaaauccaagaauguguuuaaaauuuacgcuuuuggcugggugcgguggcugacgccuguaaucccagcacuuugggaggcugaggugggcagaucacgaggucaggaguucgaaaccagccuaaccaacauggagaaaccccaucucuacuaaaaauacaaaauuagcuaggcgugguggcacaugccuauaaucccagcuacucgggaggcugaggcaggagaaucgcuugaacccaggaggcagagguugcggugagacgagauugcaccauugcacuccagccugggcaacaagaucgaagcuccgucucaaaaaaaaaaauuuuaggcuuuuaauagugacaaauagaaaguuccaucugagaacaaaaaucagccaagggaagaaacacacagggcagagucugggaaagauaaccagaggcagagcuucuguuguccuuuccauguagagucauggaugaauuacuuuccuggcauagauguguaacaauacagaguauuucuagccaaagaagcucaccagaacccuggugcccagaguuuuuacugggguucaaucacauccugcucccguagugaccucuaguucccagcucuucuggaagcagaacugacagcacauggcccaagccccuaucauaagucacauuguccaguggcuaaagcgccaggcaaacaaagacacuccuaucaggcaugauauugcacaggucuauaggucaccuccuaguaacccagggcaaugcccucucuucugggguaaaauuaauuccucacaacacaaggcaccguccacaaauuuaguaacauauuucugaagauucuggugcuuuacacgagucugugcucugagcauauguggaaacuuucuacaagaaaauguacauuucuguucaauaaagugguaagcuuucauuauaauuuccacuauuacugccuuaauaaauauaucuuucucucuucauuucuuuuugcuuaccaacccuuuuucccuguccuguacuuucuauuuuaaauuaauucaguuuuaaagaaugcuuaauguaagauaccuuauguuuuacuguuuuuuuuucugucaaauaaaaacaauuuauggcuuauuuuuucuuacuuuguguccauauggcauuuuaaucuacuaaacacugucagacauuuugcugagauuuuaaagucuuaaagucugaggaauguuuuuuccauuuuuuuuaaguagaaaaacugagccauaaauuuuuuuuuuuaagaccaagccaggcauaggauuaguuuucuuauucugccuaaauucugcaaauggggguguuuaauugcugaaaacaaauuucauuauguucaagccucaaucauuuuaugaucacaagguaccugaaacaaagaucuuacauuaguagauauauaagaugcuuguguaggggguguauuugauuguagauguauuuucuaccucauuacuucaauauucugcuguagcaaaauauaugaaaugcuaccuugaauagaaauaguuaaauuuggacacuaauauugcucuuuccucguuauuguuauauucugcacugcugucuuaggaugucaaccauggauuaacugagguaaguuugguguaauaaagcucauguuuagaguaaaauauacuccauuuucuccugaguaauagaagagccaaagauucguuuuuuuggugugguuaaaaaauguaaauaaauagauauauauguaucauuuuuuaaaauacagucuguagagauuaucuuguauaacauuucagaaguuuucugaagaaaaugaaauucuguuaacauuacaccuauaugaugccucaacaauauuugcuuuagaauaguuucuguccuccucaagucuuccaguauaaaauguaauguguccucagaauauaaaaaagcaaacuuuuauuuuaaaauuuagcaaaugccuaccuaauguggcugaaaacauuuuauauuagagaaguaaaacaaacuucauuuuuaaaauugauuaauugauacucagaauggucacaaaguuaaacuuuuuguaugauuaucuuucucacuucuaauauauaaaguucuagcacuuugguuuaaguaaucaacaacccuagacuacccuuuuaacacuugggaacauuauaauacuuucuuuauccguuauagaugucagguuuugcuuugauuugcauuuuguugguugcuauguuuuucccagcacuugaaccaaugaagcauuuugaguuagcuuuaaauuauagcucuaauauuguuugcuuccucauugucaaauagaauuagcacauaaaauuaugaaaacauagaguuuugaagccaaagggugcuuuggagauaucuaaaucuuuuugaauuucagagaaguaaaauuaguuuuuaugaucauuagcuaggcagugccacaaauauaggauggagguaaaccuugucacaugaaaaauacugaagagugaauguuuagaauguaauaaaauacaauuuagggagagcaugauuaggacuuaaaauauuuaaacuacguacacuucccagcaggggcaaagcaaagacuaaaugaugcauagugauauauagaaaugcagauucaggcugggcacaguggcucacgccuguaaucccagcacuuugggaggccgaggugggcggaucaugaggucaggaguucaagacuagccuggccaaccuagugaaaccccaucucuacuaaaaauacaaaaaauuagccggguguggugacaggcaccuguaaucccagcuacucgggaggcugaggcaggagaaucgcuugaaccccagaggcgaagguugccgugagccuagaucgcaccauugcacuccagccccggcaucagugcaagacucuguaugggggaaaaaaaaaugcagauucagacuauaaagaacugucuaaucacuaagaaguggauuguuuuaggguguauuaauucuucauuagaagucucauagcaggggcucugagucagggcaggcacaaagauauuguuuuacuggguagaugguagaaguaggucguccuccaacuacaagaaugugugacuggcaauucauaacucuuuauauuuuacugcacuauuaaaauacuuagcaaucaauauauuaccugccaggauaaguaauugucuauaaagugucuaaugucuaauaaugauaauaauagaucaguucucguaacuuuaaaggcuaacagaauaguaauacuaaugguacuuuuuuguauauuaaguaaaugaagagauuauuggacucauaauaauuuugauacccuaaugacauuauacucaauaucuguuaaaugaaggaauagacagauuacuuaucauuagccucaguugcugcaguugcccuaacauguaagaauuggcuaucgcauuuaacauaggagcccccaauuuuagaacaaauuugcaaccucauucacugagauuugcaauuaacauaugcuaagcaaaagauacuugcaguauaugauuguauagacucucaaguauacagucgcccccuaaaauugggaauuggguucauuccaaugccucauuuaauuuuuaauaauucuguaagcagcauguuuuauuuguaauuccagaaccacaugagugaauaaacaaagaauguaguccacuuuauaagaaaugucagcauccacaguaaguauaucacaaaucaacuuguacuaauaaguuaauuuuuuauuuccaguuggcagauaucccuguuacaaucuguacauauccauuuguauuugaugcccaagcaaaaacuacucuguuacagaccgaugcagucuuacagaugcagguaaaauauuauuugagaggguuuuuuuuuuuaauuguuucuuugauguuucuggacaguaaauauuugaaauuuuccuaggaucaguaaugaagguacacaaaguacuuuggguagcuauaaagaagacugcugcaugugauauguauauucuuaugagaacauuuauaaaaaaagguugcagugaaaauggaauaacuuaaccuauaaucauuuuauauauuaaaaauuguauaagccucuuucauuacagaaauauucaaucuuuauaaaccguuuuacuaguuuacuugauaagauguugguuuguuucaaaaucuuguuucauuauauguccccuuuuuauaugcuugguaagagauggaagucacuagaggugagagauguuaaaaguaggaagcauuugaucucguuaggaagaagaugugaaauuuccuugaagaaaguuucaauaauaagguauuaaacauguuccugggguuggucaccauuaucuccuauuccucuuucuuuuccccuuccuaucacccuuucccauccauuuuauguugagaguucuuucauuuauagagaggauuuuuuaaacuaauucauauuaugacuuuaaaggguuacaguaaguuugcuuuaucauuugauccuguaaauaaaaaagauuuugagcugcuuccucugguauagaauaucugacuauaccaacuaaggauuaaggaaaggaugaaaagaaagcuugaauauuuaauagucuaaaaauauuuuaaaaaauuaaaaaccuucaaaucuugguaaccauuuuuauucuguucaaauaaaugcauuugguauucuaaauauuuuuguaguguucuauacuaacagcuaguaagccaauuuuuuggaggucuuuguuaaaacgauaaguuaauaacuuggugauuuuaccaugggauauuccauuuuagaacaagaacucagggagaaccauaauaaaagaacaaaaguuuuaaaugguaaaagucaaauccuugguucgugagcacauaccaugaucacuuaguuaagugaauuuguguaaugcuuccuuagccagaucauuccuuauucuuuguuuuuuauuuuuuauuuuugagacggaguuucgcucuugucgcccaggcuguagugcagugguacagucucagcucacuggaaccucugccuuccagguucaagugauucuccugccucagccuccugaguagcugggauuacaggcacacaccaccacgcccugcuaauuuugcauuuuuaguagagacaggauuucaccauguuggccaggcuggucuugaacuccugaccucaaguaaucugcccucauuggccucccgaagugcugggauuacaggcgugagccacugcgcccagccuguuccuuauacucuuuaaagguuuguuuuugcuccucccucuuuacccuccccuccagugaauguuuuuuagaaaaaccaaugcucagauuuaucaguauuacuaccguucuguacuggcuuacucuaaugguguuaugaguuauacauuauacauuaguauaaaaacauucaaaaggguacucuuuaugcucaguuuauuaaguuuuaugcuguacgggauacuguuaggugcuauguuaauucaguagcauaggaauuauagaauaccuguaacuaauagguagagguuagcuuguuucagucacaguagcuuuauuguagcauugcuguuaaaauguuaaucuuuuguuuuccagauggcuauugaucaggcccacaggcagaaugucuccucucuuuuucucccagugauugaaucugugaaucccugcuuaauucuaguggugcguagagaaaauauuguaggagaugcaauggaaguccuuaggaaaacaaagaacauagauuacaagaagccacucaagguaauuugacauuuucugugguauaauugggacuuuuauucagaagcuauguuuaaaauuuuccuauuuguuuuuagugaaucuuuuaaacuuaauaaauaaaauuauauuuauuuuaaacuauuaauuguagaguauuaguaauaaauaacauguucuagggucuccagaauguacuuucauuucuuuacagucuauuugguguuugcauugugcuauuuuagguuauauuuguuggagaagaugcuguggaugcaggaggggugcgcaaagaauuuuucuugcucaucaugagggaauuauuggauccuaaauacggcauguuuagguauuaugaagauuccaggcucauuugguuuucugauaagguaaaauguccaaccaucuaaauuacuucuguguauauacccauguauuuauaccuguauguaucaaguuaauucaguaaauaaggaauuacuacuggaucccuaacauauaagaucugcuuuauuacaauuugagaaauuauaaacuuuggacuuggaguugucaaaauacauuugaugcuuaccacacauuuuaaauuaacaaaauaaauuaagagaugguuagccagaaaauaauguugacuauuccuucugcugauuucaauuugaggauugaauaauaaucaccagauuaacuuuucuguugggaaaaauuaauuuaucauuagggaucauugauuuaucuaccuugucauuuagagcaggucagcagacuauagcccauuaaucucaaagaaaaaaaaagucacacccacucuuuuaccuauuguccaaggcuacuuucaugcuacaauagcagcggcagaguuuaaguaauuacaacagugaccuuauguccaggaaaccccaaaauauuugccaucugguucuuuauagaaaguuugcugacccaauuuagugaucauaagugaaaaggauggaucaguuuaguagaacuccugacuugaaagaaauuuagauagaauagcuauugguuguaaaaaccucaauguaauauuuaaucauucugccuggagguuggcugucuuguguaauguuagcagcuuagugccuagacucuaauucaucagggguugcaaaauggugugcuacucuaauauuucuuuuucauuuauuagcuuggauacuucuguauagagaaauuuccucacguuuucugauuccuuaguagugcaauucauaggaaaggauucuauuuaguuaccaauuuuucaaaagaaugaauugguucauuagcauaguccacugguaauaauucauuuuuuguguuuugcuuucaaguaucauuagguauucauagguuuaaacauacuugauguuuuucaauucacugcaguuauugucuucauugaugcucauauugucccaucuuuguucaaggagagcucuuaagguuggugcccaaguccuuuugaaacaaccuauauacuuuuugguaccuuccuugcuaccuuguguacuuacuaugacagaauguuccagacuuaucuuacacauuuacugccuaacaguaccaacauuaccaccaauauuaugauuacuaaaauguuuuaaauuguuuuucaguucuuuuuguacaaagaguauacccuaauauagauagacagccagauaauauaguuuugauauaauuuaaaauuguuauacucuauuguuauaccaccaagugaauacucauuuaagcuaacuuauuuuuagggauugcuuguucaaauucaauuuaguuuuacaauaauauaaaaugccuacauaguuccaaagucaaaucuacaaaauaagauguguuaaaagaagucaagcuccaccuuguuuucccccucuuccuaugggugaucuuuugaaaauguaugggcuauccuccuuuaaauauauauauauauguagauagcaauauauuacauaccaaaguaauuuuccugguuuugaccauggcuauguaagcuguuaccacuggagaaaacugagugaaggguacaugggaguucuuuauauuauuugugcaauuuaggugucuuuuuuuuuuucuuuuuuuuugagacugagucucccucugucgcccaggcuggaguacaguggcgcacucucggcucacugcaagcucugccucccagguucaugccauucuccugccucagccucccgaguagcugggacuacaggcgccugccaccaugcccggcuaauuuuuuuuauauuuuuaguagagacgggguuucaccguguuagccaggauugucucgaucuccugaccuugugauccaccugccuuggccuuccaaagugcugggauuacaggugugagccaccgcgcccggccuccaauuuaugagucuuuaagauauuuuaaaauaaguauuuuuuuggccgggcccaguggcucacaccucuaaucccagcucuuugggaggccaagguggaggucaggaguccaagaccagucuagccaacaugaugaaacccugucucuacuaaaaauacaaaaauuagcugggcguggugguacaugccuguaaucccagcuacucggaaagcugaggcaggagaaucgcuugaacccaauagacggagguugcagugagccaaggucgcgccacugcacuccagccuggugacaaaacgagacucucuuuagucauguuuagcuguuuggauagagguaaggauaagagcaacaguugauuuuaaucacguuuugguuuuaacaagugaauguaacacagaagggaguaaaaggcaagggaguuauuauagugagggauuauggaauuucagcuuuguguggacuugguuuggacaaauaaauaaauugugacgguggaauuguauugaggggcugagauaagaagucagagguaaugguuaguuauggaaugcuugaaauugagauuuggaggguuguaguugaauguaagauauaaccauggguaugggcauugaggugugguggagaacaagauuguuggaaacagacagguccagaaacugagaggcuaguguguuguaugcauuuuuuuuugucuggauauugaaguugccaaaaacgauggcagaaauagugguagagaaagaaagcauaagauagugccaaaguuugugaaugaaggaauuguggaagguuuuuuauacaacugcccaaggaacaguugcagggaauauggucaguuggcccguguuucagaggaguuggaaauuuuaggauggcaaauggaaagaagucuagaaacacagaagagcaagagcaaggagaccuaccuuagcucuagacgcaaucauaugaaggauugaaaagugacaccauuugugagagcugcagaggaaaugguguccucaggagacagucuuguuuccuuagacaaaaaggggaaaaaauuuggaguuuaggauacaagcaguuuuccaaaugguagauugugaguuccagaacaaacagugaaaggguuugguggagcaaggacagucauaaaauugugucagacuugagggcaucccacaaugccauauggauguggguuuagggauaaccuaugaguuucgaggcuuuguauuuguucuguaaacaggcauauaagacaugauggaguuaguccuaauggccucugagguaaguggacaaucugcucaaauccuagccuccuuccuggcacuggucucuuuauaaauagggaaguuuguagugguguagcagguagaauuugagagggcauaugagguugggggcugugcugcuagaaacacagaguucugucugcccuuuagucaguuuuaaagagauaauguuuugagacaaagggaggggcaguuguaauaagcuuuaucaugaaucucuuugggaccuuucaaguucuaucucaccuuggcuggugagagccccuuggagccggcucuacucuuugguguacuucugacauauccccauuauucuucaagcauuuccuuacauuugguacgguaaacauuccagguuuaucuuguguuuucuccaccccagccauggcauuagcauuuuucuuaagagccgugucuucuuuaaguggaaaaugguauuuagaaaucaagcucugggugcuaaguguaguacuucuugcuuccggagagucaguaguucuacuggguucuuucagcugauagaaauaggaucuguauguguguauacacacaugcauccauagacuuaucuauauuuagagcuguauauauguugaagaccgugaaaucaaacugauacuucuaauucuauccaaacaccaaagaauuuacucuagccuucuuccuuuccauauuauguauauaacuuucaucaucaaugagaaaccuuacugccauaaucuuuaagauauuuacuuaaaucuccccuguagggcugggugugguggcucaugccuguaaucccagcacuuugggaggccgaggugguuggaucaccugaggucaggaguucaaaaccagccuggccaacauggugaaacccugucucuacuaaaaauacaaaaauuagcugggcaugguggaaugcaucuguaauccuagcuacuuaggaggcugaggcaggagaaucacuugaaccuggauggcggagguugcagugagccgagaucaugccacugcacuccagccuggggacagagcaagacugugucucaaaaaaaaaaaaaucuccccuguauguauccauggagucuucaggcugcacuggucaaaagcucaaccucagacauacuggaccacccucucagagaagguauaauaguaggauguuaccuguggauuuuucccaaauucccuuuaugguguuaaggaaauucccuucugucccuaguuuguucagcauuuuuaucauaaaagaauauuggagauacucuuuuguguaaugguuuuccuuuuuuuuuguuuuuuguuuuguuuuuuguuuuuuugauugauggagucuugcucuauccuccaggcuggagugcaguggcacaaucucagcuuacugcaaacuccaccuuccagguucaagcgauucucuugccucagccucccaaguagcugagauuacaggugugcgccaccauaccuggcuaguuuuuuauauuguugguagagacgagguuucaccauguuggccaggcuggucucaaacuacugaccucaagugauccaccugccucagccacucaaagugcuggcgugagccaccgcgcccagcuaugugaugcuuuuuuacauuaguagagauuaccaugugguuuguuucauucuguuaauaugguacauuaugcugguugauuuucuuauguugaaucacccuugcauuccugggguaaaucccacuugguaauaguguauaauccuuuuaauaggcuacuugauugagguugcuauuauuuuguugacaauuuucacaucuauagucauaagggauauugguuuguaggguuggauuuuuguuuguuacuguuuuuuuguuuuggggugcgugugcaagguccuuuucugguauuuugauagugaugaucucauagaaugauuuaggaaauauucccucugcugugaucuuuuggaagaguuugagaauugguguuaauucuccuuuaaauguuugguagaaucugauccuuggcuuuucuuuguuggaagauuuuuauuauuuuuauuuuuuauuuuuuuugagacagagucucacuuugucaccccagcuggagugcaguggcacgaucucagcucacugcaaccuccgccuccuggguucaagcgauucuccugccucagccucccaaguagcugggacuacaggugcaugccaccaugccuggcuuaguuuuuguauuuuuuguauuuuuauuuuauuuuauuuuauuuuuuaguagaaacgggguuucacuguguuagccaggaugaucucgauuuccugaccuugugauccauccuccucggccucccaaagugcugggauuacaggcgugagccaccgcgccuggccaacuuuuaauucuuuuuaaaaauuguauuuauuuauuuauuuugagggugugagauagagucuugcucugucacccaggcuggaaugcaguggcacagucucggcucacugcaaccucugccucccauguucaagccauucuugugccucagccucccaaguagcugggacuauaggugcaccucaccaugcccagcuaguuuuuguauuuuuaguaaagacaguguuuuggcauguuggccaggcuggucuugaacuccugaccucagguuauuccccuaccucagccucccaaagugcugggauuacaggugugagccaccaugccuggccuacuuuuaguucuuuagggaaucuccacacuguuuuccauagugguuguacuaguuuaccuucccaccaacaguguagaguguucccuuuucaccacauccacgccaacaucuacuguuuuuuuauuuuuuuauuauggcuauccuugugggaguaaggugguauugcauugugguuuugauuugcauuucccugaucauuagugauauugagcaguuuuucuuuuuuuuucuuuuugccauuuguauaucuacuuuugagaauugucuauucauguccuuagcccacuuuuugaugggauuguuuuuuucuugcugaauaauuaucugaguuccuuguagauucuggauuguguauuauuuuucuauucucuaauacauuuaucacugcuuuaauauuuaguuuucuccaucugcuagcuuuggguauaguuuguucuuaguuccuuaggauauaaacuuagguuauugacuugagaucauucccuuuuuuuuaguuuaaguguuuacaacuauuaguuucccucugaacacuauuuuugcauccuauaaguuguaguaugcuguguuuucauuagucucuuaaguauuuucuaauuucccuugugauuucuucuuugaucuuuugguuguuuaagaguguauuguuuagacugggcaugguggcucaugccuguaaucccaccacuuugggaggccaaggugggcagaucaccaggucaggaauucgagaccagccuggccaacauggugaaaccccgucucugcuaaaaauacaaaaaaaaaaaaaaaaaaaaaaagaguguauuguuuaauuuccauauguuugugaauuuuccagauuuccuuuuguuauuucuaguuucauuccauuaugauaugagaagauaauuuuuuaugauuuuagucuuuuuaaaauuuauugaaaguuuugugaccuaacauauggucuauccuagaagauguuccauguacacuuaaaaagaauguuuauucuacuuuuauuggauagaguauucuauauaugucugauaggucuuauugguuuauaauguaguucagguucucuauuuccuuauugaucuuuggauuguuguauacauuaaugauagugggauauuaaagcuaccaguuauuaucuuagaacugucuauaccucgcuuugauucugucagcuuuugccuuauauauuuuggagcuguguuguuagguucauaacuauuuguaauuguuguaucuucuugaugaauugacccuguuaucaauauuugucucauaucaauuuugcaucauauuagucuguuuugucuuaguauaguuucucuagcucucuuuuguuacuauuuacauggaauaacuguuuuccaccuauuucugucuuuggaccuaaagcaagacuuguauuuuuuuaaagacuuguuuuguggccuaacauauaugguccauccguauguuguagagaacaauguguauucuucagcugcuggaugaaauguccuauaaauaucuguuaaauccauuuggucuguagugcagauuaaguccaauguuucuucauugauuuucuguuagaaugaucuguccagugcuguaaguggaguguugaagucuccagcuauuauuguauuggggucucucucucucucuuuagcgguaauaauauuugcuucauauaucugggcaguccaguaugggugcauauuuauauuuguaauuuuguuuuguuuuguuuugagacagagucucgccuugucacccaggcuggagugcaguggcucaaucuugacucaaugcaacaucuaccucccagguucauacuauucucuugccucagccucccgaguagcugggacuacaggugugugccaccaugcccaguuaauuuuuguauuuuuaguagagaugagguuucaccauguuggccaggauggucucgaucucuugaccucaugauccgcccaccucggccucccaaaguguugggauuacaggugugagccacugcgucuggccuauauuuguaauuguuauaucuucuugcuuaauugaccccuuuaucauuauauaaugaccuucuuugucuucuucuauaguuuuugucuugcaucuguuuugucuaauaccuuguauuagacaaaauaguuaacauuugcauggaauaucuuuuuccaucucuuuauuuucaguauaugugucuugacaagugaaguguguuucuucuaggcagcagaucauugggucuuguguguguguguguguguguguguguguguguguguguguguguguguuuguguuuuauccauuuaccuagucugugucuuuugauuggagaguuuaguccauuuauauugauugauaaggaguuacucuugcaucuuuuuuuuuuuuggacauagggucuugcucugucacccaggcuagaaugcaguggugugaucacaacucacugaagccucuccuggauuccagugauccucccacuucagccaccaagcagcuaggacuauaggcacgugccaccaugccuggccaauuuuuauauuuuguauagagauggaguuucaccauguugcccaggcuggucucaaauuccugggcucaagugaucugccuaccuccgccucacuaagugcuauguaagccagcaguguccagcuauuccugccauuuuuaaauguguucugguuguuuuuugcccuuccuuccuccuucuuccuuccuuccuuccuuccuauuccauuccuuuuugugaaagugacuuuucucuggugguauguuuugauuucuuuuuuuuuauuuuucguguaucugucguauguuuuuugauuugaguuuaccaugaggcuugcaaauagcuuauaacccaauauuguaaacaccaauuacauaaacuaacaugcaaagagaaaacuaauaaaaacuuuaugcuuuaacuguguuccccugguuuuuaacuuuguguuguuucuguuuauuuuacuacacuaugucuuguagcuguaguuauuauuuuuuauugguucauguuuuagucuuuauacucaagauauggguaguuuauacaccacaauuagagugucauaauauucuguuuuucuguguauuuacuauuaccagugaguuuugcuccuucacaugauauugcucauuaaaguucuuuucuuucagacugaagaacucaauuuaguuuuucuucuugaacaggucucauguugauaaaaucccucagcuuuuauuuuucugggaagaucuuuauuuguccuucauguuugaaggauaucuucacuggauauacauacuauucuaggauaaaaguuuuuuccuucagcacuguaaauaugucaugccauucuccuggccuguaagguuuccauugaaaagucuacugcuagauguacuggagcuccacuguauguuguuucuuuucucuugcugcuuucaggauccuuucuuuauccuugaccuuugggaguuugauuauuaaauaucuugaaguagucuuauuugggcuaaauuugcucuguauucuguaaccuucuuguacuugaguauugauaccuuucccuagguuugggauguucacuguuauuaucucuuugaacaaacuuuccaucccauuucuuucucuacccccucuuuaaggccaauaacucuuagauuugcccuuuugaggcgauucucuagaucuuguaggagugcuucauucuuucuuguuuuuucuuuuggcuccucugauuguguacuuugaaauagccugucuucaagcucacuaaucacuucuuuuucuuggucaguuccacuguugacagacacugaugcauuauucuucagcaugucaguugcauuuuucaacucuagaauuucugcuucuuuuuauuuuacucuguuaaauuuaucugauaggauucugaguaccuuuucuguguuaucuuggauuucuuuuuccucaaaacagcuauuuugaauucucugucugacugaaaggucauauaucucagucucuccaugauuggucacuggugccuuauuuaguucguuuggugaggucauguuuuccugggugguugugauguuuguggauguucauuggugucugggcacugaagaguuagguauuuauuguagucuucacagucugguuuuauuuguacucauccuucuuaggaaggccuuccagguauuuagagggacuuggguguuguaaucuaaguuuuuggucauugcagccauaucugcauuagggggcaccccaagcccaauaucacugugucucuugcaaacuaagagguacuguccuggucuuggauaagauuuggaagaauccucuggauuaucaggcagagacucuuauucucuuuccucacuuuuucccagagucuuucuaugcugagcucucuggagcugggggaggggugacaccagccagcaccuuuguagacaccacuacugggacugcacugggucagaccugaagccagcacagcacugggucucaccuaaggcucaugguaaccacugccuggcuacugccuuuguuugcuuaaggcccuagggcucugcagucagcagguggugaagccagcgaagcuuguguucuucccuucagugcagagaguuccccucagucccaguuggguccagaaaugcugucugagagccagggcuuggagucagaaaccuuaaggaaccuaccuggugcucuguucuacuguggccgugcuggcauccaagccacaaggcaaaauuguucccacucuacaggccccauccauagaauaauuagguggggaccugucaaaggagaauccucaaaugucagcauauguugguuuuuuuauccuuuggguuuucaagaaagguuguaacccugggugucuguguuuuaguaguguucuggacccuggaaagggaagcuaggauucuccuuguucacuguacagaccuucauuugaucccuuuguuuucagugcagcacccuaacuaucagcugucucagauuccagacccucugguucaggcucuccaaaaaggcaaaggacuuuccaccaagcauccuaguuucaaccccacucuaauaccuccgccuuuuagagucuuuauguuuaccagcugagcuaacugggcuaccucugauauugcggguauugguacguccaguuccugagccuguagcacaaauuagcuguaaguuacuauuucaauuuuuucugcuuuaccaauucaguuaccagccauuugucuacuuuucauauuuugaaauguuauuaacaucucuuuauugcucuuaccucccuuauucucuuuuuuccuguggacuuauaccauuuuuccuccuucucuuuuagaggguuuuaggagggggaaagauuuaacacauuaaucagucugcucuauuuaagaacuuuauaaacuuaaacagaauuaagacauaacagcacagaaagauuaauuugaccacugaaaacuguuacauuuaugcauagcagaaaacauaaaauugaaaagcauguaacaggcuggguuguauguaacaaauaugacacagaguaauacuccuaauauaugaagaauucaaauacaaauacuuaagaaaaacauuaucccccaaaagauaagugggcaaaguaccuggagagauauuucaugagcacauauguaucucugauuuucaguaucacaaauagucagaaauguguacuaaagcaaguugucauuuuaaacucaaaagaaaaauguguuugugugugcauagaguauauauacagaugaaaacgugaagaguagagcauuuuccuggacugcaaauggcaguuuaaacuggaacaggagcuggcgcaguaucucacgccuguaaucucagcacuuugggaggccgaggcggguggaucaccugaggucagggguucgagaccagccugaccaacauggagaaaccccauuucuacugaaaauacaaaauuagccaggcaugguggcucaugccuguaaucccagcuacccgggaggcugagccaggagaaucacuugaaccgaggagguggagguugccgugagccaagaucgcgucauugcacuccagccugggcaacaagagugaaacuccaucucaaaaacaaacaaacaaacaaacuggaacggggguagaggaaaacagauuagcaauaugcuugacugucuuuugacuuaugaauucuuccuuaggaaguagaauuucuccuagggaaauauuucaaacuauggacaaaaauaugcaaaaagauguccaucuuauuuuuaauacuacuagcuaggaagaauaacugacauuuauugaaccuuuaguguguguuucaagaacugugcuaaaaguguuuaacguauauuaucccauguaauccucacaacaaccauaugagauaaauacuauauuuaccuucuuugaaaacacagaggcuagacugcuaaaccaggcuggagcccacgucuuauuuaaaacauuuauucuuuaaccaucaugcucacaauuuucuguaaauacauauuacuuuuauaaagaugagggaaaaaaauaaacauuuucagugugucaguaguguaaguauguuucaguuaucuaagcauccaaggagaguaaaacagcuaaauuuagcaacucauuguacuuuuaugauacaauaugcagccauuaaaaagucauguuuuggccaggcacgguggcucacgccuguaaucccagcacuuugggaggcugacgugagcagaucaccugaggucaggaguuugagaucagccugaccaauauggugaaacccagucucuacuaaaaauacaaaaauuagccuggcugugguggugugugccugaggcaggagaaucucuugaacccaggaggcauacguugcagugagcagagaucacaccacugcacuccauccugggugacagagggagacuuuaucucaaaaaaaaaaaaaaaaaaaaaaaaaaaguuguguuuuagaagaacauuuagugacauaauacucauguaauuagaaaaugagauaaaaucuuaaauacgguguauuaaaaauauuuuucugagcuuauuauagguggaaauacacaaaauauuuuuaaucauuauuccugagugauugguuuacagguguuuauucauuuucuuuucuauguuuuuucuuuguuuuccaaauuucgaauguguauuacuuuuuaaaucagaaaaaaaguuauaguaauuauuucaccuauuaacuuaaugucgaaugacaugaauaugcuuaugucugggagaaaacaguuguaaagucguauguauaguacgauuucagcuagauauauuuuuuuuaagucugagaaaauaugcuacauggaaauguacaaaaauacuaacagugauguuaucccagggagacaguaaugaggaugaacuuuuguuauuuauuacuuuuuucucuaucuucaaaauuguauaugagcauauuuauguaaucuuagaaaauuuaauauuuuaacuuggaggacauguguuuacuuuuucuuauauuuuuagacauuugaagacagugauuuguuccauuugauugguguuaucuguggcuuagcaauuuauaauuguaccauuguggaccuccauuuuccuuuggcuuuauauaagaaacuacugaaaaagaagccauccuuggaugauuugaaagaacuaaugccugauguugggagguuaguuggaaaaaaaagucaaaaaguaguaggguuugggagguaaaaaguggggaagguacagaaagcuuuccuucuaugaaaaaauauauuuuguucuucuuguuaaauuucugaaguaaacaaaugcccuucuaauaaaggaaaauccauuauguuucucagaucaaaauuuucuauugaaagacuaaauuuggcuggcccaguggcccacaccuguaauccuagcauuuugggagaccgaggcagguggaucaccugaggucaggaguuugagaccagcguggaggucaggaguucgagacuaguaugaccaacauggcgaaaccccaucuauacuaaaauacaaaaauuagccaggcgugguggcccacgccuguagucccagcuauucaggaggcugaggcaggagaauugcuugaacccaggaggcggagguugcagugagcccagauugcgccauuucacuccagccugggugacagagcaagacuccaucucaaaaaaaaaagaaagacuaaauuuuuaguuguuugacaauaccuugcaaauaucagauaaucaccuuaggaaaguaaauuuuuuuucugagagugguuaaaugauuuauuuggacuuuuacuucugauaaccuucauuccuaguuugaauaugugaaauuuauuuuuauuaaauaaaaugcauuaaaaauuuuauauaaguuaggacaaaugggccaggugcgguggcucacgccuguaauccuagcacuuugggaggccaaggugggcagaucacgaggucaggaguucgagaccagccuggccaacauggugaaaccuggucucuacuaaaaauacaaaaauuagccgggcaugguggcggucgccuguaaucccagcugcucuggcugaggcaggagaauugcuuuuaaaaacccagggggcagagguugcagugagccaaaaucaugccacugcacuucagccugggcgacagagcaagacuccaucucgggaaaaauaaaauaaaauaaaauaaggaaaaauguugaaaauaguuggauacauggccuuuguauucagaaaagugauaagaaccuuuuacuaauuuuuuuccuuaagcaucauuuauaaguuugccauuguguauucacuauucugaaacaaauauaaaauuacaaauugacaaaaggauuuuaccaagagggaaugagaaguauauauauauauauauauccauaaguaaaauagucaaaauauccaauaauuuuuuccucucagaaacauauauauuauuuugcagaagcaugcaacaguuacuggauuauccagaagaugacauagaggaaacauuuugucuuaauuuuacgguaagauggaaggacauagguuagccugauuauuuaucaucucuuuuauuuaacagccgugucuuaggguuuuucuuuauuuugauggauggaauucuuaaagaacccuuuagcuaacauuuauugagcauuuacuacaugcuagcuagucauaguacaugcauuucauuuaauccucagcaauccagugagguugggauuaucccugguuuacagaugaagaacacugaaaacagucauuaccuuggggagucaguaugcauaccagccucugugacuuaaaccuguguacuuuaucauuaugcuaaagauauugacaaauacaagacauccucuuuacccaaguguucauuuuugagucugcaauuacagaagugcuuuagagaagcaaaagguuauuguaauaugagaauauuacuacuaaacuuaaaaacauuaauuuccacugguacauuccuuucuauuucauacuaacauucauccuugcccaucuugucuuauucacuguuggaugauguagauaaaacaaaugcaaaugcauugcaauauuauuuggaaaaugaaauugcaaaucuuguaaaagaugcacaauuucauuaaggcagcaaagggaugugguuuuuuuuguuuuguuuuguuuuuuugagacagagucuugcucuguuacccaggcuggggugcagugacgugaucucaacucacugcaaccuuugccucccagguucaagcgauucuccugccucagccuccugaguagcugggauuacaggugccugccaccacacccagcuaauuuuuguauuuuuaguagagacgggguuucaccaccuuggccaggcuggucucgaacuccugaccucaugauccacccgccucggccucccgaagugcuggcauuacaggcaugagccacugcaccuggccaaaagggauguuaaauaacugauccagucacaugcaaagccauugauagaugaggauauggcagaaguagacuaguugguaauuaaauaagagaaaauccauaaguauuacgguaaggcacuccagaagggaacaauuugaauauuauaaauuagacucuuggagaaauuguaaaaccuucaguuuucuuuucccuuuucuuuucuuuuuuuuuuucuuuuuuuuugagacagaaucuugcucugcccagucuggagugcaguugugcaaucucggcucauugcaaccuccgccucccagguucaagcaauucuccugccucagccucccgaguagcugggacuacaggugcacaccaccauacccagcuaauuuuuguauuuuuaguagagaugagguuucaccauguuggccaggauggucccaaucucuugaccucgugaucugcccgcguuagccucccaaagugcugggauuacaggcgugagccacagcaccuggccucuuuuuuauuuuuuaaauuuuuugcuuguauauuuguuugccacccugccacacacacaacauucucuuuaugguuuugucaaagcugacaaaagaugccauauucugcugucauaaaauuugccaaaaaaaauugcauguucauaauuuuuucaagaaaauuuuaagacuguuuucuguccgggcacaguggcucacgucuguaaucccagcacuuuuggagcccaaggcgggcagaucacuggaggucaggaguuagagacaagccuggccaacauggugaaaccccgucucuacuaaagauacaaaaaugagccaggcaugguggcacguaccuguaguaccagcuacucggggaggcugaggcaggagaaucacuugaaccugagagguggagguugcagugagcugagaucacgccauuguacugcagccugggugacacagugagacuccaucucaaaaaaaaaaaaaaaaaguugcucuccacaaauccagauaacaacagaaaagcauuuuccaaaguguguuccuguuagaauaaggugaccauaaaauuaaaaaaaacaaaaacaaaaacgauuuucuaugaaauuuugguucuuuuuuauuugauucacucauacccuuguuaguuucuugaauuuuuauugaucaucucaguugacuaaaaaauuaaguuucaagcuguuuaauuucuaauuuaucagucaccaaauuugugaauucuuacuauauucaaagaacuaugguaauucaaacauuucuucccacugccauuucuuucucagagauuuuucaguggcucuuuauugcuuguagaauaauagcuuuagaaugggugucaaagacauuuuuaaacuggcccucuccuuucauuguaucccucccuucauaccaaguuuugucauaucacacaguauuuuuuuuaauauaccuuaccuuccucuuuuucagagccacuugccauacauuuucagaaacuugguauuuauuguaauaucuaauuuuuuguucaauugauauucucugucugaaaucucacucucuucuuaaucuuucaaaauacuaccccuacuuguaggugcuuuucagauggcauuucuuccucaaguucuuucacacuuccucuaguuuagaauucuguuugcauuccucuaugaucugauaacauuuuauucaucucugucuuauaaaugcauuauuuuauuauaauuaguucuucauauguuacauuucucuuccuuuacuagauaguaaacaucacagcaggaauauacucaucuaacaucccacucccaucauaguauuuuauaaauagcagguuuucauaaaagaggauaauauuccaaaaagaaggaguagcaaaagaaaagaugcauaagugggaaugguaauauuuuuagaaaaauuccagaaguaaaagaaauaaaagguuucaaaauaacugccuaucuuuauaaaccaaauuaguacauaacuggaaaaacugucugugauaaaguuuacaacaagggugauagaggaacccuggaguagcaguugucaugugggaagaaugcaugguuuucuaagcugaauagcauucucauacuuggauuuuaucacucgucuaaggaaaacauccugucuaauauuuuauaguaacaauucuaaaguuuuaugcacaacaaaugcuuaguuuccuuauuaacuuaccaaacuugguaauuuguaauuaaucaugguaggauuucaaacuagagaguaccaaauuucuaguucuggcuuuaaguagaauucucagauaagcuauaugguagcagaauuuuaucucaaauuuaguaguuuuuuuuaauuaaaugagagaaagguagaauauaauaauagauuauuauaaguuuugagucugacauugacuuuuuuuaaaaauuuaaauuaauagaucacaguugaaaacuuuggugcaacagaagugaaagagcugguucuaaauggugcagacacagcuguuaacaaacaaaaucgguaagugaauuuuagcagcaacagugggaguaauaagauucaguagacauuuucuucuguacguagaaaacgugucacaacccuaagcuuuuacuccaauaaaacuuuaauuuugagugguuagugaggaaauaaucugccuuuuccuccugaaaucccuugaagacauuaaaacaaagagaagggagaagugacagcagcaaacauuuuuggaagccaggaaacaguaguaacuaacuuaagcaaaccagagaaagcuacaacaugagauggaaaagaggagucacgaagccagcuggaucacuucacaaaacaaaaguuugggugcugagaauaaaacauaccuuuagaaaaugcaugguguuuggggaaaugcuagaacucuuauaagaagcaguuagaaacuaguuucccaugcuaacauuggauuuaaaacaacaacagaagaaauuaguuucccuuagcacaccaggaaucuggcaacugccccucucuggccugggcaggagauuggaaauuuaccuucuggagaaauugaacuaaagagacuguggguuugaggacaccuggacacugccacagguaaggagcugaacugaaaacagggagauuaagugcugaaagucuauagcucccuccuucuugguaccguauagugaaagauccuuuucuggggaaacugccuaacauuuaaaauguaaauccauaggccccgcacagugacucacaccugcaaucccagcacucugggaggccgaggcgggcggaucacgaggucacgacaacgagaccauccuggcuaaugcagugaaaccccaucucuacuaaaaauacagaaaauuagccaggugugguggaaugugccuguaguuccagcuacucgggaggcugaggcagaagagucucuugaacccaggaugcagaguuugcagugagccgagauugugccacugcgcuccagccugggcgacagagcgagacuccgucucaaaaaaaaaaaaaaaauguaaaucgauagccaaaggucaacagacauuuaaggaaaggccaaaacagucaaaaagaauggcaagaaaccaggaaccaugcagguugaaggacaaaacuucagaggaaaccgaaaucaguauccucagaaugaugcgugacauccagaugcauacaauuaaaaauggaaaaaaaaaaaacucauuugaaagaauuggaaugaaugaaaucugucaaagaaaauauuaaaaaaaaaaaaacuucccagaaacgaaugacaucuuuucaagauugaaagcacgagaaguggaaaaaagaucaauaccaagacaagauacaugaaauuucaaaauuuucagucaaagggacccuaaaacuguccagaaaacccacagaccuaagaaucaguaacaucagacacuggaaucaaggaacacuggaagcuagaagaccaaaauuuugggagaaaauuacuuuuaacuuagaauucuguauccaaauuaucaaauguguguguuuaaaaacauuuuuauacaugcacagucucagagaguuuacuucugaugccuuuuucucaggaaguuacuggaggauguguucugucuaccaaaacaaggaauuaaaccaagaaagaggaagacacaggauuaaaaaaacaaccaccaccaccaccaggauucaaacaagcaaagauucuuucugaaggaucaauaacugugucgauuuagaaauaacaacuuggguuagaucaagaggauggagggcucaaggagagaaauaaauaucuaguauuuugaaugaaucuagaggaaauggauauuucuuuuggagaaguuggcgaugaauuagcaaacuaaagaaaacagaaguucuuuuuaagagaaaaaggguaaccauagaauacagcuuaacugugaauaauauagaaauguuaacaaauauugaaccaaaaauuguuauauaaauauaauagauguacaggggaguagaaagugaaugggacaauuacauuaaagauuaauccaaagcaaauugaaauuuaaggaauaacaauagaacuguguuguuagaagcuugaauauaaauaucagaaggaauagcaaaaagaguuaaauaguugccuuuuaauagcgggaauuucuggcagagaagugcaggacagaguugcuuuguucucuucuauuuuguuacaauucuuuaauaguggcuguugccagggaguugguccaaaggauuauaauccuaauuccgcuacuuagaugcuuuauaacuuuaaauaaauuaguugaugucucaaugccucaguguccuucucuguuaaauggaaugacaaauuauacuuacuucaugggguugagaacuagaugagacaauauuuuaagauacuuagaauaagaacuagcacauguagugcucaguaaauguuggcuauuaggauuguuacuauuugauguuuuaaacucuugauaugucuuacuuugauaaaaauaaagcuguuuuuaaaaugaugugaaaaaauuuuagguccuucuagauauccuuguuuuaaaaaaaaacuugguucugaaaggcaacuuaccauuauuccuauugcagaaucauccuuuauuacuuggaagacaaagauauaaaauagugaaaucuucuaguauccauucucauuauuugaccagauagcaucauaaaauguuguggcuagcaaaacaaaacagauugaauaagauugugguucaaauucagggguuaaaggggcuucuuuuuuucuuuacaguuucguuuuguaucauaagagauagaagagaaucagaagugauuguauauguauucacacguacauuugaaaagaaacuacacuuguacucuuuaaugauuauccuaaaagaaugcuuaguacccucucuuaggcauuuguuaaaguaaauuuuguucagauuccuuggaacccaaggaaaagaaggcuauaguuggucaaaugaucugaauccaaagcucucauuuuuuugucaccuauuguuuguaacagacauuccuuuuagggaugcaugugacaugauauauauaaauucucaauaacuuguaaauauuuuaaaauuauuuucauagccauuugcaucauucugcccauuaggaaaugacauuuuuuccauuaggaauagccuaagaauaacugaaugccucauggauacagcugauuuuuauauagaaagaauaauagcuuuuuccauagugacuuugguuuuguccuguuugaacgcuacucauacauucucaguuucguagauauguagcagaaauuguaggagcacuugaaguuuuaaugacuacauuauggauucuucauacaugauuuuuauaaucuguacaugugugcuuuuucauuucuaggcaagaguuugucgaugcuuauguggauuacauauucaauaaaucaguggcuuccuuauuugaugcuuuucaugcgggcuuucauaaggucuguggaggaaaaguccuucugcucuuucagccuaaugaacuacaagcaauggucauuggaaauacaaauuaugauuggaaggaacuggaaaagguaggggaaaacuaaucucugauauuguuaaauggaaagauuuauauauggaaaucuugccuuuuuauguauuauuuuuuauuuuauacacuuuauuacuaccauuuuacaggaaagcacucuacccuucaaacuccacaaugaauggauuugaacgguauaugaauuagacacuauuauaauuggugguauugauauagaaaacucaucuggccaggcacaguggcucucaccuauaaccccagcacuuuggggugcuuaggcgggaggaucacuugaggccaggaguucaacagcagccuggggagcacagcaagaccugaucucuaaaaauaacuuaggccaggcgugguggcuuacaccuguaaccccaggacuuugggaggccaagguggauggaucacgugaggucagguguucaagaccagccuggccaacauggugaaaccugucucuacuaaaaauacaaaaauuagcugggugugguggcacgugccuguaaucccagcuacucaggaggcugaggcaggagagucucuugaaccugggaggcggagguugcagugagcugagauugugccacugcauuccacccugggcagcagagcaaggcucugucucaaaaacaaaaaauaaguaaauaaaaguagauaaaaauaauuuuaaaaauuagccagaugugguagcaaacaccugugguccuaccugugggaggcugcagugggagaaucucuugaucccaggugguugaggcuguagugagccaugauuauaccacugcacuugacccuggaugacagagcaggagccugucugucucaaaagaaaacaaaaaugucaucugugacacagcuagauagaagcccuaaccaagccaggcgcgauggcucaugccuguaaucccagcacuuugggaggccaaggugggcggaucaccugaggucaggaguuccaggccagccuugccaacauggugaaaccucgucucuacuaaaaauacaaaaauuaaucgggugugguggcacacaccuguaaucccagcuacuugggaggcugagacaggagaauugcuugaaccugggaagcggagguugcagugagccaagaucgcgccacugcacucuccaaaaaaaagcccuagccaaagcugaauggguuuucguucugccucagucuuaggaaaaccaucaugaaaugcaguuaugauuuuuaaaaaucuuuguuuccuuuuuuucugauuagucucaguguuacauuuuuuagcagaguaauuaucaaauauugauucugauaaacauuuaauagaaagugcuggcccugugugguggcucaugccuguaaugccagcacuuugggacaccgaggcgggcggaucacgagguuaagagaucgagaccauccuggccaaccaacauagugaaaccccgucucuacuaaauauacaaaaauuugggcauagugucgcacgccuauagucccaacuaucgagaggcugaggcaggagaaucgcuugaacccgggaagcggaggguucaagucagugagauugcgccacugcacuccagcccaggcaacagagcaagacuccaucucaaaaagaaagaaagugcuagguuaagccaggcauggugucucaugccuguaaucccagcacuuggggaggcugaggcaggcagaucacuugaggccaggaguuggagaccagccuggccaacauggugaaaccccaucccuacuaaaaauacaaaaauuagccaggugugguggcacacuccuguaauaccagcuacuugggaggcugagacacaagaaucacuugaaccugggaggcagagugacagaaagugcaagguuagaucagcuuugaggaagauauaugugaaauuaaucugcugauuuucuaucuuucuaauauaccauccucugauuuaugcauuuauaauuaguuagauacuguauaccuauuaagaugacuaacauaaaaaaacagagcagcacuuaccacucuacuuuuuaugucagucauauuaauaggugcaaagcaucaggaacauuuauauguugccgauggggauacaaagugguauagucacuuuggaaacaguggcuguuucuuaaaaaguuaaacauacauuugcuauaugaccuagcaguccuacucccagguauuaaauuauauucacacaaaaaucuguaaaccaaggggacagaguuucaguuuuacuagaugaaaugaauucuggagaugguuggugguacaaccaugugaauguaguuaaugcuacugaaguguacacuuaaaaugguuaagauacaaacuuuaugguauguguguuuugccuuaauuuuuaaagacuuuuuuuuuuaauuugcaaaugagugaaaaacuggaaacaacuuagaugugcuucagugggugaauggguaaaccuacuacaguauaccuauucagcagaauaacuacuaaguguuaaaaggaaaugcacagcugggccgggcgcgguggcucacgccuguaaucccagcacuuugggaggccgaggcgggcagaucaccugagguugggaguucaagaccacccugaccaacauggagaaaccccaucucuacuaaaaauacaaaauuagcuggguguggugccuguaaucccagcugcucgggaggcugaggcaggagaaucgcuugaaccuaggaggcagagguugcagugagccggagaucgugccguugcacuccagccugggcaacaagagugaaacuccaucucaaaaaaaaaaugcacagcuggguguggugucucacaccucuaauccuggcacuuugggaggcugagguuggcagauaguuugaacccaggaguucaagaccagccuggacaacaugauaaaacccugucucuacaaaaaauacaaaaauuggcccuuuaugguggcgugcaccaguagucccagcuacucgggaggcugaggugggaggaucccuugagcccgggagguagaggcugcagugagcccugacugcacucugucauaggcagcaaagcaagacccugucucaaaaaagaaaaaaaagcacuauugauacaugcaacaacuggaugaaucugaggcuuuaugcugagugaaagaagccaguuucaaaugguugcauacuguauggcuccauuuaugugacauucuugaaaagacaaaaaauuauagugaauagagacaagggguugagugggagggugugacuucagaggagguagcacaagaggcaucuaagagcauaacagugaugggacugcucaguauccuaauuguggcagugguuacacagaucugcacaugugcuuagaacuuacagaacuguauacaccccagaauauagccaguuuuacuguguaguaauuuaaggaauaagauuuuaagaauaauuaggacuucuaguuaaacauuauggaauaaacaugucugcucccucccaaaaauaucacuagaaugacagaaauggaauaaaaauagaaauauaaaauaaaaauaccaaaaaauaaaaaugcaaugaacaagagaagaaauaguuuuggaagacagaaaguaaggagauaaauugaugagugacuuagagcagaggaaaauugaauucuaagccuccagagggacaggauugucaggaggcaacucuuuuuuuuuuugagauggagucuugcucugucgcccaggcuggagugcaguggcucaaucuuggcucacugcagccuccgccucccaaguucaagcgauucuucugccucagccucccgaguagcuggaacuacagacaugccacuauucccggcugauuuuuuuauuuuuuuaguagagaugggguuucgccauauugggcaggcuggucuugaacuccugaccucaugauccacucgccucggccucccaaagugcugggauuacaggugugagccaccgcuccuggcccgaggcaacucauuuuauauccuagaaucugaaaggcucaagaauugguauaccauguuacccuuaauggcagggaugaagguuggacuaagggcaacagaauuacuuuaaagccauuuuaaagaauaauuggaccaugcauguccccucuccuacccagcaaaagacagcuugggagagaggcuuuacaauuugggaaacaagguaacacugaggaugcuacacagcugguagccagguguaaauccuucaggaaggagauugaagguucuuguguaguaguaaauugaucuucucaaaagaagaagccuguagauacuaacucuaaggggucccccaguggaaauggacuccaccucuaaucaccuuaaaaugaaaaugauauaacagcuucucaucacccuuuagauccuacacaauuuuucccuccuugccucaucuccugucauuguuccucucacucugccucagccuuauuaaccucugcugagccuagaacccuccaggcacacuccagucuuagggcguuuguuuccuuuuccaagugccuggaauucucuuccccugauaaucacaaaagauucuugcucucaccuccuuuguguguuuauaccuucucagagaccuucccuggauaacugaucuaaaauugcaaaccucucuccugcacacguauccugucuccccucgcuguuuuauuuugcuucuuuggauuugacauaauuuuacuuagguugcuccuuccccccaccacaauguaagcaccaugagggcagaauuuuugccucuuuguucacugcuguauucccagcaccuaggagagcacucaguaaguacuugaaaccuugccugaagugauaauugauuuaaguguucauucaguuaagacaggacaucuuaaaaaguauauuguagcggccgggcgcaguggcucaugccuguaaucccagcacuuugggaggcugaggcaggcggaucacgaggucagaagaucaagaccauccuggccaacauagugaaacccccgucucuacuaaaaauacgaaaauuagcuggguguggugguguaggccuguaaucccagcuacucgggaggcugaggcaggagaaucgcuugaaccugggaggcagagguugcagugagccaagaucgugccacuguauuccagccuggugacagagcaagacucuaucuaaaaaaaaaaaaaaauauauauauauauauauauauauauauauauauauauauauauauauauaugguguauuuauucuuaacacuuugauuucuucuguuguauaucugauucauuacaauuuuagugauuaugauuuggagcuuuaaauguucuuucuuaaucaggacaugugugcacauuucuaccaaaccauuuagagauuuaaaagaaaaaaaaacuuuagccauccucuuuucauuccccacuaacaugcucacagacuuuaauucaaacaguugaauaaauuccauaaauuccaugcuagaauucaagcuguuuucuucaaacuugugugcaacuaacagcaaauauuuugcauauuugaauuauugagaguucagugauuaagauaaaucauggcuacaaauaaggaaaguccaaaauucaagaagcccauuagcaaguauuuauugagccucuacugugugccggauaauguacagcugaaaccaugcaagagauugaagagagggcaggaaauaagauagagacauggucuuugcccuaauaagagagcuagaaauuaaauguuuaauacacaguuuuaauuaauacagugaaaaagaguuuagugaauggugcguaaggaggagccugaucuaggcuagaugaaucugggaacgccucuuacuagacggugagcuccacaagguaagugaggauucuguucacugagguuuucccagggcccaaaacauugacuaaaacucauuauauauuuguuggaugaaucaaugaaugaauuagauggcauuuaaucugagcccuaaaaggguaaaaauuagccugaugaccaaagaagaaaggaugugucugagugguguaggcugagggaacaguauguccaaaggaccugacgcaucugaagaacugaaaguuaaagccaacugcggcuggauaagaacaguucacaguauaaacuauuuccucucuacuuccuaccugcuucucuuuuaguacuaauuuuuuuguuuuuuuuuuuuuuuauuuuuuauuuuuuuuauugagauggaguuucgcucuuguugaccaggcuggagugcaauggcacagucuuggcucacuacaaccuccgucucccaaguucaagcgauucuccugccuuagccucccccaaguagccgggauuacaggcgccugccaccaugcccagcuaauuuuuguauuuucaguagagaugggguuucaccauguuggccaggcuggucuggaacuccugaccucaagugaucugcccggcuuggacacccaaagugcugggauuauaggcgugagccaccgcgcccggccaguacuaauauuuuugacaggggagauauuuuaguccuauugcagcaaauuaccccaaaacuuauuggcuucaaaauaacaaugaaacucuuguuucauaguuucugugggucaggaauucaggaguggcuuagcugaguaguuugggcucaggguucccucaugaaguugcagucagaauauuggcuggugcuauaggcaucuaaaagcaugauuaaggauagagauucacuuccaagguggcuuacucacaugacuguuggcaggaggccucaguauagcaccaugaguacuucucuccauauagggauguuugaauauccucaugaaaugacaacugguuucccccagagugagugauccagaagaagggcugaagccauagagguuuuuuuuuuuaugauuuagucucagaagucauacauuccucauauucacaguauccuuauacacacgggcaugaauaccaggaggcagugcucacugguggccaucuuggaaacuaccucagaaaauuuuuaguguugcuuaguaccauauuuuuaaaaggagagauaaauuguaaugguuugacuucuguucaugaauacagagaaagggaauuuucugauuaucacagauaauuccaugucagacuuuugaugguccuauaacauuauuuuaucuaguuucucuuuauuuacuuuugaagaugauaguaugauccuaucauguucuuugaagugcuaggaaagauuucuggugauucuuacguauuucuucuuuuucuccuggaacuaauagcuucaaauuguaaauguccagaaaacagugggcaauccauugaauugcacaaguugcaaacuacuggaccauguuagcuuuaugugcuaauauauuagccagugugucccuuaauacuaauaaaagauuauguuguuuuuagaauacagaauacaaaggggaauauugggcagaacauccuacgauaaaaauuuuuugggaaguauuucacgaauuaccauuggaaaagaagaaacaguuucuguguaaguauuucuaacuaguuguauacuuuaugagacuggaaucuaauuauaguauuauuccaaagcccuguuuuaaucuucaaguaauuuuuuugaaacagaacuaucugcacucuucaguacauguauuuucuuauuucaaaggcuaaauucaguuugccuucaaaauagcauugauucauucuaugaaguaaaauggaagcuaacuuggaaaugaaagcaaacuauagcuauguuauaguuacaauaaacugugguuacaauaaacuaggauuguagaauuccuuuuagauuucuaaaaagaucucuggaguauagucauccuuuggcauacaugggggauugauuccaagaccucccugccaaggauacccaaauccaguagaugcucaaguuucuuguauaaauuggcauaguauuugcauauaaccuacacauauccuuauacuuuaaaucuucucuagauuacagucaugugccacauaaugacuuuucagugaaugacagaccauauauacgauagugguccuguaagauuauaauacagcuacuguaccuuuucuauguuuagauacacaaauaccuacuguuauguuacaguuaccuacagaauucaguacaguaacaugcuguacagguuuguagccuaggagcaauagggcuauaucauguagccuagguguguaguagacuauauacugucuagguuguguaaauauaugauguuuacagaaugaaaucaccuaaugaugcauuucucagaacauaucaucaucguuaagugacacaugaauguacauguuauuaauaccucauacaauguaaaugcuauguaaauaguuguuauacuguauuguugagggaccaaugucaagaaaaacaguugacacauucaguacagucacaagcauccauuuuuugaaaauauuuucgauuugcagucgguucaauccauggauacagagcucacagauacggagggccaacuguauugcucuuuucucuguuuggucuucauuuucuuuuucuuuuucuuuuugcuucaagacuaaaacuuuggcaauuucuauauaaaauaaagcuuuuucaggccuuaguucccucauuuauaacugaugccuguguaucuuucuucuguuaaagucuguauucuaauugaaauuugacuuauuuuuaaaguugucagaauuuauguguccaaaucggugacauuuccuuugauacuccugcuuuugccaggaaugauuuggcaaccuccgagaaucuuggucaaauucuucugugugucauaaggaugagaaaucauuacucuuuaagagugauuugagccugggcaacauggcaaaaccucaucucuauaaaaauuagcccugggcuuggugacugugcucccagcuacuccagaagcugagguagagaggauugcuugagcccaggaggucgaggcugcugugacugugaccgcacacugcacuccagccugggcaacugagcaagacucgucucaaaaaaaaaagaaugauuugaauuuuggcugcccauuauaaauuucugauuuaaaaaaaauaacagaaacgaagcaaauagaaaaagaaaucauaaucaaaacugcauuuuguauuugguuugucaacuaguucugaauggcuuuuccaaaaaagggcucucaaaauguuuuggcaauggcaaaauacucacuuaucaaacauuuauuaagcacuuccuuugugccaguauuaagauuauacuuuuaaagaaaaaauauuguguggaugagcaauuagaaugugucucaaaaaacuugucuuccacaaauuaggaaguaagauaacacguuagagcagauguuaaagugaagcucugcuguagcgacuguaccaaauauuacuugcuacuguaucuuuuuguuuugaagugguugacugaaugauuucuuucuuggcaguauuuuugacagguagugaucgcauuccuauucuugguaugaagagucugaaacuagucauccaguccacaggagguggugaggaguaucucccaguuucccauacuuguuuuaaucuucuggaucuuccaaaauauacagaaaaagaaacucuacgcucuaaacugauccaagcuauugaucacaaugaaggcuucaguuuaauauaacuuuggaguuauaacuauucaguuuagugcaaaagcauuaaacuauuuguguuuuucuuguggugaugaauucagcaaggugacagagguacuauuauaauucuuacuugcagaauguucaaucuacgaguguucauggaagccaaaaaauauuaaaggaaaaugaacaaacuguuaauauuauuguacagaaccauggauuuuuuuugaccaucuucuaauaaacauagcaaguauuaugaauacauuaaaguuuuacuaacaugaauuuuaagaguuugcauauuucagaaaugaucuggugugagugcauggaaauauugcuuaauuuuucuucaaucauugagugaaaaaccuuuaacuuuggccugcaauagucauuugauuauuuuuucauuuuguaaauaauguuaaguuuuguaauaaaauaguuauguucugauaccaguacaguuucuaugguuguaauugaacuugaacagacuuuuaaagguuaaaaauuaugauuuaaaucuuacucugagacucuauaaaaagaaaaaaaagguagcaugguggaaacacuaucuuuucuuuuuugcuagaauaagugucuuugugcaaaccuaaaucacagauagggaauauacuacauaaccugcaguucuuuucuuugugaauccugacacacugauagaugggggauugucgaucagagaacuuauuaauauuuaguacuggaagaacucugucuccacaguugccaguaauaaaaagaaacauuggcuacuaugagcaccaaucacuggguuauagcuuucaaaauuauugaugcugcagugcuuuagagcuauuuccuugaauuuaagaaacaaaucuuaacaguuuuauggugcugaugcuuaguugucucaugccauuaaauuguaaaagugaguugaugcaauacaugugacuuucugcuauaaugcaaauauuuauuuuuuaaauuuauuuuaaaaugccgugaaaacuguuuaauaaagauuuauuguuuuaauauuuaaacuuuca

SEQ ID NO: 192147 - RNA, 103761 nt, Homo sapiens
gggggaccgaccucugcgcagcccaggccgccgcgcgcacacaccgggcccggcuccugagggcgccagcgcggccccggggagcgcgaggagccggcgaagcgcgcggccugccguuggcggccugguccgcagcgcccugcgcccacccgccccggacguggggcccaagcccccgugaagaugguguccuggaugaucuccagagccgugguguaagugccucucacugcgcccugcagccggcgcgaggcccaggggagcugugggaaggggaaggagccgagaggaaagggaaggccugggccugggcggggacgggguagcccggccucgggccugccgagggucugggggagcccucggcuuccucaccuugguccacgucgcugcggagcucccugcgacggccgagggccuagcugcggcgacugcggcugcgacggcggcggcggcuguggcgcugcucggcugcgugcggugcggcgcggcgccccugcuccggcggcgcugggugggcaggcgcucagggcaggcggcgcgcgcuccccgcuccugcuccccgcgcagcgcggcaccgcccugcgggcccgggagcggcgcgccucgcagcugcucccugcgcaggcuccgcagacgccgagcgcgggaggcuccgcgauccucccgaggaugcgacggcagugccgagccuuuguaucccgcggcugaugcguugcggugucucucuuggcggcugauugccauucggucacgugugguaggaggagagauuugucuaaaaaccggagaccgcucccagcccaggaucccugggaaggguccuaguuuucccaagauuugcagcuuaccgagaaaggugacaccggcugcucgcccagauccccgaauucggcccugucucggcggaaauauuugcuaagugauugaaaggcugcaggugccuguugccuuuguucaaauuauggguucauuucauuguucuccuaccaacaagugcuacaggucuguaagaaaaagaaauuccuugaguuggugguguuaaucguguaaauguauuugaauacaguuuaaacugauuuucucucaucuccauuuuaccccucuccccgauuaaaaaaaaagucaccaaguaaacaaugacguaguuacagcuagggccuaugaauucauuauucaccucuguaguaguguuaucucagaagguuucauaaagguauaugaaaaaauguuuaugugagggggcaggcuucucugauaagcuuuagaauuuaggaaaaauaacauuaccagacuuuuuguuaaaaggagcuagauuuucugaguuugggguuuauuuuguuuggaagugaauuacuagcccuauuuaaucagauuugcagcacagcauucaaaauuuuucauuugauuaaaucgcaaaguuucuaguuuuaaagccucagagcuuccuguguuccccuguacgaaacuaaaaaucaagauauaaacaaaaggauaccacagaugccuucagauuguuuuucagccuuuuccuggccucucuuuugagucugucauuuaucuaauucaggcauaccuuucuugaccuaguagaugucuaucaacuguuguguccacaccuagaaaaucaagugcccuauuaagaagcuguacuuuacaaaaaaaaaaaaaaaagccucuggauuucuuugaccaguucuucagcugacagaaaauugugaagcacuuuuagacuuuuguuuuucauaauugccaaugaauaugaaugucuguucuaggugcuaccuauaacacaaaggucaguaacacguaguugaucaugggaauugacaguuugggugcacagauaucugcaguacagguccaaaugucaacucuuguaaaaguuacacccacucuaauacccaguguuggacaaggaagggauaucugguuggagaaucagaaaaggcaagggagauuacguuucagaugggccuuaaagaauaggcccaguagaguggcucacaccuguaauccuagcacuuugggaggccaaggagggaagauuguuugaucacaagaguuagagaccagccugggcaacauagcgagaccuugucuccacaaaaaaagaaaaauuuaauuagcuagucacaguagcucacaccuguaaucccagcuacucagggacugagguaggaggaucgcucaaauucaggaggucaaggcugcagugagccgugaucgugccacugcacuccagccugggccacagagugagacugugccucagaaaaaaaacaaaaaagaauggacagaaucuaggcagccaaagaugaaaaaggaaaggauuccagauauagggaccggcgugagccaaagcccagaggaggaaaagcccagauuaguuacagugggcgugagggacucggguggggaaaaagcaagcuggaaagguagccuggggccuguuuucaagaaagaagggguaaauguuauaaggcagcaacagcuuugcuuuggaagauucucugcccuucugugaaaugauuggcaauggagaccuggaagacaaggagacuccuuaggaggcucccuaacuggagagaggggauuaaagccucucuccaguuaaaguacuugagcuacagaauguaagguuugaggcuaacgacagggagcaauaaugugaggaagaaaaugucaugaaaagaaauguauuucucaagugucaggaacuguuauuuugugagccgugaacacauuagcacauuagaaagcacacuuguagagaauauaaacaucauucuauuuuuccucuuuacucaguuucucucucuaaacaugaaagagcaaucacaggaucuacacaaacuuggaaaccuuuuucacaccaggagguagaauuuacuugauucuuucuaacccacugagacaaccaccuccuccugagcaagaucagacccuucucucaacaugaaccucugguagcaugggcagggaaccuccauaaccaaagcacccuguauguagaagcacuuugucccaagauccugcacuuuaacaccagagaaauuagcccuggacaccacucuuuuuuuuuucuuuuuugagacagagucucucucugucgcccacgcuggagugcgguggugugaucucaacucacugcaaccuccaccucccaauucaagcaauucucaugucucaugacucaaccucccaaguagcugggacuauaggugcacgccaccacacccggcuaauuuuuuuguauuuuuaguagagacaggguuucaccauauuggccaggcuggccuugaacuccuagccucaagugauccgcccaccuuccucgcuaagugcuagaauuacagccaugagccaccgcaccuggcccuggauaccacuguuuacagcugcguggucuugggcagcaugcuaaacccuucugagcuucagucuucuugccuuuaagucauuauaauaaauaccacaugaaaccguuguaaagaaaauuagccgggcgugauggcgcacaccuguaguccuggcuacuagggaagcugaggcacuagaaucacuugaacccuggaggcaaagguugcagugagcugagaucgugccacugcacuccagccugggcaacagagcaagacucugucucaaaaaaaaaaaaaagacuguuguaaagauuaaauuaguuuaacuaaaacguggaaguguggugcuuggcauugagugugcacuuaaaacguaauagauauauagauagcuuuuuuaugagggaagugaguaaaaugguguaggaagaaauaucacuggauuguuaccaagaaacuuggaauucagaacuggcuuugguuaccuuaaccagcugaaugacccugaggcagucucuugcugauuauagaccuugguucuauuucuuagaagaggcaaagggaccugauaaccgccaagcucuuuuguccagccuuagcauucugugaugauaugaaaguauuuuuccauuacuuacagucuguucaaucucagcuuacuuuaacaucacaggcaagauugacagauuaguuacuuuuuuuuuuuuugagacggaguuuuucucuugguguacaggcuagagugcaguggcacaaucuuggcuuacugcaauuuccgccucccggguucaagcaguucuccugccucagccucccaaguggcugggauuacagacaugugcuaccaugcccagcuaauuuuuguauuuuuaguagagacgggguuucaccacguuggccaggcuggacuugaacuccugaccucaggugauccucccaccucagccucccaaagugcugggauuacaggcaugaauaguuaccaauuuuuaagggauaguaguuugagauuaccaaugauguuccauucauauaugauauccacaccucaccuuuugaaacaugacucucauaaguugagggaaauuccauuuuuuucccuaacuuuucuuaauuuguuuuuaugaucuagcauugugauuaagaucaagauaaaagccagauugccaaauucaacuauuaacucugccauuuaugcgucauaaccuaccccaugggauuaaauacauuacuauauguaauguccauaguccagcaucuggcacauaguaagcauucaguaaaugcuaguaguaguuaucagaaaaaggaaaaacaugcucuccuaaaaucccagcaugcugaauguuugaaguaucuucaauauacauuuuuuguuugaaucacuuuguguguagguaacauaauuuuaauuagaguauaguaaaaauguuauacuagucuuuauuauauuguaagcaucuucuauguugcucugaaaucuuauaagcaucuucuauguugcucugaaauccuauuuaguaucuucuguuugaucaggccaguauuauuuucuuagccauucaucuauuuguauuuaauuuuacauuuagauaauuuuuaauauuucauuauuauaaguaaugcugaaaugcaauuauaaugcuauaauggacauuauauauacuucuuuugaaguacauacuucuuugggauaaaaauacaagaggaauauuucugagucaaacacugaauauuuuuaugaucauugauaugaauugccagauugcuuuccaaaagaauauuaauauuuuacaugcuagcagcaaugugugaguacuuucuuuaucacaauguagccagaaucggaaguuuuaauuuuuuaauacuuuaccaauaaauauaacauaucucauuguuuucuuuuguauuuuauuuaucagcacaguugaaugcuuguccagauuuuuauuaauuauauauauuaugcauacaguauguauauacuuugcccauuuaucucuugguuacuugauaauuuacuuguuuugucugagcuuuuuacauaauaaaggaauuaaccuuaugugauauuucaugcaaauguguuucucaaucuaauuucaguuuucuuuuagauauuuuauucuugguugcauagagaguuuauaguuuuaauauaguucgccuucuuuguuuuuuauuuugugauuucuugaucauuucuaaauguaaaauuagauacuacagauauuugauaaguacuacuuuccuauguagaaguggauuaauuuggagacuuccuuuucaauucuauauaucgauauuucccuuuuuuacaaugauaauacauuuuuguuuuaccuuaguuuaauugucuggcaguacucuuaaaacccgcaauuauuuuucucugauucucuucauuuauauugggugcuauaauggaugucuucaaaggcuaaauuauacaccuuaaaaaccauacuucagcagcuuucccccuucuuuucagcuucaucucuuuuuucuucucuacuagaucuuucucgacagcauaccaacaugcuauuacuucucccaucuuaaaaaaaaaaacucuuuuaaucuacuauacuuuucaucuuaucaccccauuucccucugucucuuuagagcaaaaauuccucagaagaauaguccaagccgggcacaguggcucuugcuuguaaucccaacacuuugggaggcugaugcguauagauuaccucagcucaggaguuccagaccaauccaggcaaccuggugaaaccccaucucuacaaaaaauacaaaaaacaaaaaaauuagcugggcguggugguacaugccuguaaucccggcuacuguggaugcugaagugggagaaucacuugagccugggauguugaggcugcagugagccaugagcaugccacugcacuccagccugggcaacagagugagaccuugucucaaaaaaaaaagaaaaauaauuuuuuuaaaaaaaggauagucuauacaccaucuucacuuucuuuccuucaggguacucuggaacccauacguuuguuuagacuuuucucuccuuccacuccacugaaauugcccuucucagaucaauagugaccgccacuuggccaaacuguuugauccucaucugacuuaucagcagcuuuugauacaauugcucacuuucuccuugaaguauuuucuucacuugguuuccaagaaaccuugcuuuuuuuuguuuuuuuuuuuuuuguuuuuguaacucaacggccacucccuucucagccuaccuggcacauuucuccauguuccuugacuucuuaaaguuguuaaaguuggcaugucauggggaucaguccuuagaccauuuucucuuuucuauuuguaguccuuuaaggauucccauuaauuuacaucuccaacccagaucucucugcugaacucugugaucauauuuucagcugcguucuuugcuccacguggaaacaucugaaagucagacugaacuuaagacauccaaaacuaggcucuugagcuuccuuccccaucuggcuccucuggcagcuuucccccacucuguuaaugccagcuccaccuacuagcagcucaggccaaagaccuugggaucauaccauccuugauuccucucuuucucuaguucccuacauugaauccgcaaaucuuguugacucugcuuucaaaauacauccuguacucaccaccuuuacauacaccauucuaguccaagccagcaucaucucugaaauguguuguaguggcauaguguccugugucugcccuugucccuccucaacagcagccaaaauaguccuguugaaacccaagucaagucaugugacucgucugcucacaacccucagaugacuuccugccucacucaggaaagccagguccuuaugauggucuacaaacaggacaugaucuggacuuuuuuccaucucaaaccuuugucucuaccugcccgcugccauuauaacuccagccacagugaucuccaacacaguggagaucugugaucuccagguaagaccugagagccugggcacuugauggccccugccucagugcacuucccacagauacccuccugccucauucccucgcuuccuucagguguucacuuucucagugaccccagcacuccugcuuuccuuccccgcuccguugucuguaguauuugguacuucacuucuuuaaccuaucaucuguccucuccaacuagaaaauagucuccaugagagaagucuuuucucuaauauguucauugcacacaaaagaagcucaauaaauauuuuccgcaguaagagaaugaaaaaaaugaaugugaacuauaaaucacagaacuauugauaguaaauauuaugccucaugaauuuggggacugccuuuuuuucccuccuccagagcuuauuucacaauuaauuuuucucaugaaagcugcagugaaugaauuauuuggaaagagagacugaaaggaucucagcauugaauaaaguuuuuuucacuaaugagccucuuuccagacacacuuauuccagauagggaaaagagaaaaggcucugcauuuguacuguuacuaaaaacaaucucuuuaaaccuugguaaccuagcuaaaauuguucuggagauagauagggaaguaggauuggauaccuuaacaaauauaggaaagaaaacagaauaauaugacuggaagugaaugucauucuuuuauuuauuuuauuuauuuauuuauuuuagagacaggguuucacucugucauccaggcuggaguacagugcagugacaugauccugguucacuggagccucaaacuccugagcucaagcaauccuccuaccucagccucccagguagccaggacuagaggcaugcacuaccacacccagcuaauuuuuuuauuuuacuuuuguagagaugagggucuugccauauugcccaggcuggucuccaacuccuggccucaagcauuccuaccaccuuggccucccaaagugcugggauuacagcugugagccacugccccggccaugaaugugauucuuuuuuuuuuuuugagacugaggaguuuugcucuuguugcccaggcuggagugcaauggcgcaaucucggcucaaugcaaccuccaccuccuggguucaagcaauucuccuaccucagccucccgaguagcugggauuacagguggccaccaccaugcccugcuaauuucuguauuuuuaguagagacagcguuucaccauguuggccaggcuggucuucaacuccugaccucaggugauccaccugccuuggccuccucaagugcugggauuacuagcaugagccacugcgcccugaugaaugucauuuuuauauucaucuuugcuauaauauagcaagagaauguaccauuuguuaggguauauguuuguuaaguuuaugauaggauuaaugaaaaaauccucauuuuuaaauccuuauggaaguuugaaggcagucacaauuauaugagugauauuuuucuuccuuuauaugugcuuuaaauuuuuuaacugguuguaaaaucucaaugauagcuaaaauauuuucuuucaauuagguuaagguagauuuugucuuuauuuaccauuuuuuaugagauccauugugaauagcuuacauguucaugaguuguaucuaagaauaagauacauugcuauuagacaaugagaaaucagguaaauaggaacaaugauguuuucaagaaaauuaaaagguugacauuuuaaaaauauauguaggaaaugcccuguaagaggucaucuuuucugucuucuuucauuaagaaagaaaacacauucuaaacuauugggucuuguuuucacugcaugggcuagaacuuccaacaagauuccuuuauuagccugcauuucaaaaacaauuugcuuuuguccauuuuuuguuacuguugcucuguuagcuauuucuuuuuccacuauauuuuaaacccuuuuaggauggagauuuuuauauuauguacuuuaaguauagaugaaacuguucaaauaaaugguacauuacaacaauaguggcauaaauggguauuuuaaauaucuuaaaagauguuauuguuuugaucauuucauggaaaaagguuacuguugauucauaacaacaugaacuuauuuuuaugucauugauuacacauuugcacuaaacuaauccuuucauacaacuuuugagguaaaugagagguuaaagauaaaaauuuuuguuauaaaauuguucauguuuacaaaacuaacuguuaaggguuuaugcauacuuaccccuauuacugaaguaaauuuaccaguuucguucauguuguuauauuuacagaggccacuaugacugaaaaucaggcgagauggcauacucacuaaaacacugugaacagggaaaacaguagcaaucaggauggaauuauccaacagugguuagagauuauuuuauguaaugagcagaccagcuaacguuagaauguuauauagccauucauaauuauuuucaaaguacuuuucauuucauuugaagauguuuuaauauaucacaguuucuuaaccucagcauuauucauauuuuuaaguggauaauucucuguugugggagacucuccugugcauugugggauguuuagcagcauccaccaguugugacagccaaaaauggcuccagauauggaauugacauaugucaccuagugggcaaaacugccacugguugggaaccacuguguuaaguaaaaagggaagaaaaauauauauggagagggcaugaggcuaaaaacugugcuaucucauaugguuauguguggcuauuuaaauguaaauuaauuaaaaauuaaauuucucaauacacuagccacauuucaagugcucaguagcuaugugaaugcuuaucuuauucugugcuaccuuacugggcagcauaaaaauagaacauuuuuaucaucgcagaguucuguugaagugauccuuuacgagauauaguccgcucagcaucuccaccugaaaauggcugugcuauuuucuauuugcugcuucuauguauuuuaugagagaaauucuauaaugauauuuggaaauucacaaguaucuuaggauagcucuggcuuaagaauauucuauauaaaaauacuguugcuacuuguagaaaagaaauuacuguugcugaucaaucugucacaaucuuuauuauuucaaaauuccuauguuuacagagaauuucuaaaaauugaugaaaaauacugauauaguacacuuugcaaauauuuuuauacucacguauucugcacaucagguguuauaauccauauuuuuuagccuguaaaugaaguaugacuuacaaguuauaguuuuuccuggucuuagaauugauuaagacauuaggauuagaauacagagcugaagguuaucacuauguugcuuuuccuaacuauuaacagugucauugacucugcagaaucaaaacuaucaaggaaaucauaaaaguaaaagucauaggacaaaucuaaacaaaauagguuuaugcuaaccaauaauucaaaacauaaucuuaggaaauauucagauauauuaauaccgagagcauuaacacuuucaaguaaugauguguucauuuuaggaaagaauuauucucaccuauaaauaaagaaauaaagugcuguaaucccagcacuuugggaggccgagguggguggaucaugaggccaggagaucaagaccacccuggcuaacacggugaaacccugucucuacuaaaaauacaaaaaauuauccgggcguguuggcgggcgccuguaaucccagcuacucgaagggaggcagaauggcgugaacccaggaggcggagcucgcagugagccaagaucgcgccacugcacuccagccugggcgauagagcgagacuccgucaaaaaaaaaaaaagaaaaggagaaaaaaaaauucaggaguuccacaccagccugggcaacauggugaaacccugucucuacaaaaaguacaaaaauuagccgggcaugauggcaugcgccugcagucccagcuacucaguacucagaaggcugagguggaaggaucccuugagcccaggagguaaaggcugcagugagcuaggaucgugccacuguacuccagccugggcgacagagcgagacccugucucauaaaaaagaagaggagaaaaaaugucgaacaaacuaacugucuuagagucaucacauggggaagggggacagauuuuucuguuauugugaauccaagguuaaagguaggucuuauaaggaagccaguuuuauuccauauauugaggaaaacuuuauaacgucuaaaauuguucaacuuugaaacugccaacaucaugagugcaguguguauaccaucacuagaggcauaaaggcaggguagaacccuaguugaagaucuuaaacuauacugcuuguaugcuuccuguggaggaucagauagaaaauguggaaugcacuuucaccaaaacugugaagugggcaaacugacucuuggagaggcccacaggaacaacaagccuagucguucuugaguguugacaugaagaaagugcagauauggaaauaaaauagaauauuuggugauauuugccuaauggauaccguuauugucaugaucaguucuucacugguuuguggcuguggucuuuauuuucugcuuaggaagcugaucaaucucacuauugcugaacacacuuccaaguuguucauucaguccuuuuuauuugcauuauauuuuugguuauuaauuuucaucaaccguaguuuuuuucugguuuucugaaauauagggacuuucuguuuuaacuuuguauaccuaaguuaauuuuguaaauagaaaugauaaugguuuuaggauguuuaauggaucgugagugaaugaaaguacucuuuaaagauauaccuauauaaguccacaugaaagagccuuggaaguauguaaaucuuuuuuuuuuuuuuugagacggagucucgcucugucucccaggcuggagugcaguggcgcgaucucagcucacugcaagcuccgccucccggguucaagcaauucuccuaccucagccucccagguagaugggguuacaggcgcccaccaccaugccagcuaauuuuugguauuauugguagagacaagguuucaccauguuggccgggcuggucucaaaguccugaccucaggugaucugcccaccucggccucucaaagugcugggauugcagacaugacccaccgcgcuugcccuggaaguauguaaaucuuaaagaaccugaaaauauuaaggugugaaauaaaguuauaugagaaaaauagucagaaaguucuguguagagauauucuaaaaaaaaccugaucuuuccuugcuaaguaaaaaugagaaauuuaaauuggaaauaaacuuuuuuguccacaaagauuaugcuuauuaugaugaaauaauucuuaagaauuucuagauguuauaucuugaaguauuauuauuuuuuauuuuuuuuuuguuuuuuagagacagggucucccucuguugcucaggcuagagugcaguggcacagucauaguucacuguaaccucaaaucccugggcuccagcgaucuuccugcuuccaccuccuaaguagcuagaacuauaagcacacaccaccacauccagcuaauuuuuuauauuuuguagagauagggccuuguuauguugcccagacuguucuuaaacuucuggccucaagugauccuccuuccuuggucucccaaagugauggaauuacaggcgugagccacuacaaccaguuuugaauauuuuaugugguaaauaggaugcaaauacugccuuguuucaauugguuuccuauaaguuuaagauacagauguauugucucuguguaaaucuguacccaauugccucagauuuuugcuggugacaaagucuuacagugcuuuaacuaaaauagcucaccuaaaacuaggaucagaaaaauauaggauaguaagccauuuuaaaaguaaugguuacaauagagaccuugaguuccugaaugacugauaaauauaaaggaaauacugaaaaugaaaugaccuauaacccuacaagugacacugccuagacacacuuuuuaaguguaugaugagggcaggaacuguaugagaaaggaaagcagucaguuuuuccuuugaggucuaaaauuaugcucucccacugcaaaguaugccaucacugucacuuggcuucucuuuuauucuuuccucaccuuuaucucuggguuuuucuuuuuccuucauucucaauaaaaguaggaagagaaugguauggucucugucaugugaagagaaauaauaauuuuuaaagauuagaaauauaaucuauuguuucaaaacuaacagaagagaggaaaggaggcuaaagagauacagaaggccaaaauaaaggggucaaguaggugagagagacauaaggggaaaaaaagaugguagaaauggguucaaauauaucaauaauaacaauaaauaucaacaaauuuuaucuuccuguuaaaagacagacuaaaauacuggaaggaaaagaacuauaaaguauaaaacaugauugaaagauaaaaggauaucugaauaaauguauaguuuauguuaaugggucaauauuaauuaaugauuaucaguucaucuccuaaaaagucuauaaauuuaauggaauuccaacaggauuuuuauuguuguuuucauggaaccugauaggcuaauuaccuauaaaguucauaugaaagagcaaaagccccagaaucaagaagacaacugugaagaaaaaggaauaaaaacuuucacuauuacaugucaugauuuauuauaauguaggaauuacaaccuuguaguauuguugcugugauugacaguagacuuaauagaacauguaacaaauccagaaauuaacccaagcuugcaaagaaucugauaugacagugguagaauucaaaaucaaugggaaaguauaccuaacuuaauaaauaguguugugauaauugguuaucucucagaaaaaaaaauuaaaaaauaaagaucuuuacuacacagcagacucaaaaauaaaucguaaauguauuaucugcccaaguguaaaaaguacagcacuuaaacuuuuggaagaaaagguaggagaauaucacaauuugguagagaagaauuuuucagacccuacaacaaaccauagaggaagcaacagauaacauuugucuacauguuuuauagccuaccauguaucugaugcucauucugcaucaggcauuauucuaagcaguuucaaacuaauuuguuucuguuucacaaccaucuucaugacacagguacugcuguuauguucauuucaccaaugagaaaccucaggcuuagaaaugugaaauaacuucccaaaguggucacacagcugccaaguagcaaagcuauauggcaguugagcuccggacauagaccuuaaugugcuauaauuuacaccuguuauuuuaaauccuccuuguugagauagaauuuauauauaauaauuucuauguguuucaucagauguguacacucacauaucaucacccuaucaagauucaguuauuauccacaguggugguugaauguccauuucuauuacauucaccauuccugauaauaauuuuaucucucucuaugugaaaaguaucuaaauuauuuaaaauauccucaggauauagaauuuuaaaagcuaauuagaaacucauauugcuguuuucucaauuccuuucuaacuuggggcaaggaaggagggugcaaugggagaagccagcacuaggauuguugcccagugagaguaaaaaacgucaacaguuacauugcuuagauaacuaauaaaguauaauaaucagaagauaaaaagaauucuuuaaaaucaguaagaaaaaaaauuaaccuaaaaagaaaaguggacaaaugaacugguaucucauagaagaggaaaccaauggcaacuagacauauaaaaagauagacaaaacucauuaguuuucaagaaaauguaaauuacaaccacauugaaauuccauuucacacuuacuagauugcaaaaauuaagaagucugaaaauaccaaguguuggcaaagauguguacagcaacaggauccuuuucaugaugccaguaggagaguaagaugcuggaacugcuuuggaaaacaauuuggcccuaacuuauaguguuaaucacucacauacccuauaacccagcaaucccacaacuagcuauguaccaucaaagaaauuuggcauaugcaucaaaagacauuugcaaggauauuuauaggaaaauccuuaaagcaaaagucuaugaaaaauaauaguuuacguggacagaagaauugguaaguaaacauugguuuauguacaaaauggaauauuauacaacaggaacuacuacuuagaagccucaacuuggaugaccguuaggaaaguuauaguguuuguguuuuguuuuuuuuaaagcaagccagauaugauuaccuaugguaugauagcauuuuaaaggcccuaccauaggcaaaacugaacaauguauaguuuaguaauguauacauacacacauauauauauuuagcaagucuauuuuucagaaaagacaauaaugauaaauuauaggauagggguuagcucugagagucugggagaggagagggaucuggaacaaugauauuugauauucugcuucuuaaguuggaugccggauucacugggcucauuuuacugugugugcuucauaacuuagaagugugugucauauauucuuuuccuuuaaucaaugauuacauuaaaaacauguuuaacacuugcagugagucaggaccaagauaucuacaguaacuaaaggggcgagcuuagagaagcagggagcagguagcaacggaaaggagaggcugauccugucccagcccauaugcuucuuccugguguagaggccaguuucagugcugagccaggccacagauggaggcagggaaggggcugcaccugucaugaugaguaugugaacagaaggccagaaccucuaugaaaucgccaggcaggcugucucuuguccuuucuuuuucucaaagcugguaugaauccaaagaagaauguccaauuucuuauuuacccaagggauuuuugagguucuggagguacauacauagauagccacuuaaaagcuuucuuccccccccgacccccauugauuucuugucuauucagauaacaguuguuuucuugucuauucauuugauacaugggauauugcuauaaaaagaaaaugucuaaaaaauguguaaauuaaugugccugcacuauagcuccuuccaguuuaagacaggccuaagagauaguguugauauugaaauguagaauaauauucuucacuccacagcuucugcuucuuauuuuucaugauauuucuugccuauuuuguuaguuuagccuaucaaaaaugucacauugcuugaaacucccuaauaccuacauaagaguaauuuaaauuuuugagugauauuucacagcaauuccccauaauuaguaagaaaauaacauuagcccagaaucuggaugguucuaaaccuaucagugggagauaacaucuaauauuaacauuuuauacuugaugugcagcucugauucuugaugcacacagagugucauuuauauaagacgaggaaaacgggccgggugcgguggcucacauguauaauccuggcacuuugggaggccaaggcgggcggaucaccugaugucaggaguucaagaucagccuggccaacauggcaaaacccugucucuacuaaaaauacaaaaauuagcuggaugugguggcacgugccuguaaucccagauacucgggaggcugaggcaggagaaucgcuugaacccaggaagcagagguugccgugagccaagaucaagccacuacacuccagccugggcgacagagcgagacuccaucucaaaaaaauaaauaaauaaauaaagaugaggaaaaugaacauuauuaaauggugaauuuuccauguguguuuuccauguggucaacauugcugugggggugaucuggcuaagacaucugucaccuacugauagccaggauuuauuuggccugugagacuauccccuugcuuccuugucauuccaugugcugugcucacuugaucaguagaggacauucacagccucacugccccucaagaacauaaccgugagacauuagcuaguagauuugcagaucuguucacaaagauuucuaguuaaagaaugcaaaguaacuaaauuuacuagauuucacuucaaaaguuaucuauaccuauacugcacuccuacaguugcccgaaauaccaacagauugccaacuuuagguuaaauaacacuuuuuuuuuuuguaugaagaaugcuagucuacagaugggcccugaaaucaguggccauuuacuucuuuuacuccuaaccagauucuuguuuaacuauagguuuauuagggucuuauguuuugguaacauuuaaucugucaaaccaauccuaaaacuuucugauaaacaggcaaaauuuucuaaccauacugacccuuugaauuuuguaagaugggguaauuuaaaauuauagcuuugagccagaagagcaguuuuauagcuuuaccaauguuggaaauugaugcugucauuuaauuugagaaacaugguugauagaccauauauuuuucauguaacuuuaagcucuuagaaaaucuuaagaauccagguacagugguguguaccuauggucacagcuacucaggaggcugaggugggaguauuucuugagccuagcaguucgagaucagccugggcaacauagcaagaccccaucucuuuaaaaaaauguuaaaauuauguucacuguuacugaacacaugauaaauuaagauuauccauugucauagagacgcuuuggguucuucauuuagaauuagagcuuacaaaguauuauaccauauuuaaaagcuuuaaaaacccuuucucagacuucauugccaaagauucugauuuaacugauuugggauggcaccuggacauacuuuuuuucuuaaaaaaacucuccaggugauuggguuugaaaaacauuacacuagaggauaugagagaaaaccuggugaugauuuuuugagaaauaguaguguagugucaggaaacggucacagagcugagcugccaaauacuguuaccauuuuaaaacgcaacaaaaauuguaaaauauucucaguucgauuuucagugacuuuaugauauuaaaacaagaaaauuugaguaucuaaaaauuaucugaagcuuaacaguaagcaacauuaguggccuauaaggaagugauuuuucuagacaaacuugauuggucuuuuaagauugaauuacagaaguauuaggagaaaagaauguaauagagggacugucuggauuuuauuacaacauucucuacaguaccucaugaaauucaacuuggaaaugcaauuuauauuuccaguuaguaugagaacaaagucuagcaaacagcaaaauaacauauuugugagauggcuguacagcacauuuguagcaauacacauuuaagcugccuugaaaagaucauuuguaaaauuugucaguguggagcuuuauguuuguuuuuaauuaaaaucauuucaugccuuuuaauguauccacaguauuaagacuguaaacuagaauguguucuacaucuugguuaaaaaauaauauguaauaaaaaucugaaaaggauggggaagggagaagggaggaaggaagcuugagggcaaauuuuaucuaccauagcagaaagacagaugcuuuuuagaauuggaacaccagccuuucauaauccuuuucuuaaaagauuauguuggacccugacauuucuaccgguuaaguacaauuuauuuauuccuucaguuuuacuuaucaccuguuaaauuuaagcaaaauguaauuuaaagguuuuuuguuuuguuuuguuuuuuuaaauagacaaggucucacucugucuccuaggcugauggcaaacuccugguuucuagccauccucccaccucagccucccaaagugcugagacaacaggcauacaccaccaugcccagcuuaaggauuuuuauuuuaagugacauauauuuuuaagaucccauuucuauguagucuaucaaucuucuuucucuacuaauaauaugaaauuagauaaucaaauguuaucauugauuauuucugggcaguggaucuaggggagaguuuuagauuucuuuauucuuucuggcaguguuucuauaauaaauaugaaucaucucuacuaaaagcauuuauuuuaagccauaaaacauguuacuuuuuaaacaaauaaaauaauuuaaauugaagacuaguucuaauucaucuucccucagaauuaucaauaccuuuauuuuauagucucaauuuuucauaucaaccaugauuaaaaucuuuaagugcuggccguagaauggcguaugucuacaaaacaagcugaaauauuagcaugugucuaaccguaugaccuuaaccuuuaaaaguuauuucuaggaggauaggggugugauugacucuuuucagaugguucauauaguucuagauuuuccauagaacccuagaauuugcuuacuagguacaauucauuuuucuuaaauaaucagaugaaaaugagacaguacaaaaggauaaaguuuccaucuauucuauauuaggacaaaaacaaagugguagcauuuaaacccaaauaagcaguguauauuagcuacagaaguauaaccaucuaccaguauacaauuugcugaacagaaauugaugaccuuuguucuaacauacuuauucuauccagagaaguuuuuuuuuugaagguuaauaaacucuccaguuauauuaacgaaagaacugaguacuuaguuuguuauuuaaaggucaaccaguagcauuuuacgugcaguuuaaauucuucaaaaucugauaauaaagauaucucaacaaaggauaggcaauauuucuuuuuuccauuuaaaguggcccugcccguagcaaugggauaaaagcaauauuaaauuccuucuuccagccaacuuugaaauuguuuuuaugaaauuauaacaacuuuuagaauucacauuuuuccauuuuuaugcauaagguaaaacuuacuaauauuucuaugucauauuacuucuaguuuacagaauugagagcuucauaaaaugcaaaacacaucauuauccuaauucauuauccuaauuagaguugguauaagugacaucacuacuucuuuuuguuuuuguuuuuguuuuuuuuuuuugagacagagucucacucuguugcccaggcuggggugcaguggcaugauuucagcucacugcaaccuccaccucccagguucaagcgauccuccugcuucagccccacuaguagcugggauuacaggcaugcacaccaugccuggcuaauuuuuguauuuuuaauagagacaggguucccaugcuggccaguuggucucgaacuccugaccucaggugauccacccgccucugucucccaaagugcugggauuacaggcgugagccaccacacccacccaacaucacuaauucuaaguaguuguaugacuuuacugcaucucuaaaaugaggacacaucuguucuucauuaacucacagacauugcugaaaggcacaaaugugauauucuguauaaauauccuuuauauccuuaugauacaaagaacuauauuaucuacaaagaaguauauuaucuauauaaauuuuguaucaacuauacaaauacagcacuauauuaccacuccuuguuccuuuaaaacaauccauuugcauuacagcaaggcacuaaucaguauuucagacucgcaacccuuuuguaagaacauuauuagaauuauaaagaaaugaaagaugaugaaaaauaagcuucuggaauuuuuauauuuuggaguuuuuucacaucuuaauaucauguagaugccaauuuguggaccuuaaguaaggugacuuuaacaguuugaccguaagucuaauagauuaauaauucuaacaugucuaacuuagguacgaccucagcucuuuacuaugucucucugggcacguucaagguacaggaugccacagguaucaucagaguagcaucgugcagcccugcaguucucuccucuagcuauuccucaugccauauugcugccacguuucucuauguuuuauuauaccccagugcuccuccccagccauucauccagcaguaaugauucaccccuggcuuucugugaccucaggagucuguguucacugccaccaaggccaccuggaguuucuugcugcuuucaguuaucuaauacuguguaacaaaccacccaauaacuuagugacuuaaaauaauaaucauuuuauuauuucccacaaaucuguucacaugaaaauucuguucuacauugguuuucuuuaaucuuucucauguuuuaauaacauggaaaacuuguauuguuuggaauuauuuauuuauuuucugacacagggucucgcuguguugcccaggcuaaaguacaguggcacagucaugacucacuacagccaccaucuccugggcucaagccauccuucugacucaaacugccaaguagcugggauuacagacuugcaccaccaugccccauuaaguuuuuuuuuuuuuuuuuuagagacaaggucuaacuauuguguuuuaaaaccauaaaagcaagucaaagaacugucagaauauuuagcaguuuguccauuucuuuugucacauuuucauuuucuagucucaacuuacguaaauuguguguacagaagauucaguucugccuuccuauccacaguaaagaaagggauuuuuuucuuuuauucuuucugcaaguauuuauugaauaccuacuacguaucaggccuggggaugcagagcuaagcaugacacaguuuccguuuuaaagcaauacccaacacagagaccacaaacgggaaagucagugaacauaauaucgucugaugacaguaauacuaguaauacuuacaaaauguguaccgugugccuggcauuauuauaugguuuaacucauuuaauguucacagcaagauguguacuauuauuguuacguuuuuagagaaaagcaaacagacacagaaagguuaacaacuugcccaaagucacacugcuacuucaaguauguacaaaauguuaugagaacauggagaaaggguuccucaccuagaggaggcaaagauauuuucccagagaaaaugaacuuucaauuucaucuuugaaauuaucuuccuuguaaaaaggccccagucagagagaacaaaauaugccaaggcagaaaaaaauaauaugacucucuucagaaaucaagcaguucaauaucaguggggcacagagaugcaaaagauaaaacuggagaagucaaaggaguuagaucaauuuggucuaaccugcauagccuaugaggggauuuuucuuuaaugagaaagcaaggaaagguuguugaaauauuuuaagugaugauugauauuaacaggggguguaaggaaagugaaugagggcagacaguucccaugaaaaauaagaaaggucagaauuaaggcugaagugaguauuugggacaugggaacagauaugaaagagauuuaggggaggugggagaauuugacaaaacuugacgauugggugugaggaggaggaaggaauuucagauuucuggcuuggauccuugagugggaggugucaaacaugagaggaagaaaagguuuagagaaggaaugaugagcuuaaacaacagcaaguguguuguuggggaaagggugaacagagcacuuuagauaaggaagguacacagaagcagaugggauguuagggcaaugcuuucauuuuaauuuggauacuggguuugcauguguucauuuuguuguuagacuucauaacuugcacauauuacauauauuuucuaguauggauaauauguaguaaguuuuuaaaguaacauuugguaaaacugcuauuggaaaaaaauacccuauguuaagauuuugagaagacgacccaauucuccccguauguauaugcauuagggauuaguuaaaugucaccaaagcaaagacuauuugauuuauauagcucuucuucauauguuaaaaaugcaaaauacaaaggaacagugauuucuaugaccagcagaaaaaguuaucaucugcaacucugggguauuuauugugauuagauuaauuucuguggcuaucuuauuuuuuaauaaauacaaagaagacagaauuagcuauuugaagcaaaugaaaaacuuugcuuuuuaaauuguuuguggugauuauggguacuuguuucuuuguuuuaaauuuaauuuuuaaaauuuacauaauauauuuagacauacauauaacauacagugaacagauuaauguaauuagcauacccaucaucucaaauguuuaccauuuauuugugcugggaauauucaauauucugguucuaccuauuugaaacuguguauuacuguuaacuauagccauccuacagcguuauagaacauuugaacuucuuuuuauuuauuuauuuuuuuugauggagucucgcucuguugccaggcuggagugcaguggugcggucucggcucacugcaaccuccgccucccaaguucaagugauucuucugccuccgccucccaaauagcugggacuacaggcacccgccaccaugcccagcuaauuuuugcauuuuuaguagagacaggguuucaccacguuggccaggauggucucgaucucuugaccucgugauccacccaccucggccucccaaagugcuaggauuauaggcaugagccacugcgccuggccaacuucuguuuuuuuuuuuuuuuuuuuuuuuuugagauggagucuugcucuguugcccacgcuggagugcaguggcacgaucucagcucacugcaaccucugccuccgggguucgagugauucuuacaggcguaagccacugcgcccagccucaucuucuuuaugguguuacauuucuguugaagguaaaacauuuuguuuggaaucaaauuuucauuuagucucgggguaacuugcaauuuuaaauaagguaguuggggaaagccucugagaaguggauauuugaacagaguuaaaggugaaggcauuagccacacagauucuggggaagagugucccaggaaggaagccaaccggguguaaacccuaagucaggucuguacucaucacauggaggucaauguggcuggagcagaguagugugaccagagguguaggccauuguuaaagacacuggaacuggcucugagugaggugggaagcuguuggaggguucugagcagagaagugauauuaucagauuuuguguuuuaaaagcucuacuacagagaacagccuguaucgaagcaaagauggaagcuuggaaacgaguuaagaggcuguauuaauaaaccagcgaguaguggugaguaguggguggugacuuggaccaggcugguagcaguggucagaugcuagauucauuuuaaagauagaacccauaggauuguuugacagauuggcugugaauauucaaagugaagaaaccucaugaguucaugaaguagggaguaaguauaccuagagaagagaagaaaauggacaaguuauuuauaaaauguauauggaaaugcagagggccaagaauagucaagacaaucuugaaguagaagagcaaagaacaaaauacugggaugccguauagauauuaguaguggaauaaguuacuuauaucaagauugauuauaaagcuacaguaauuacaacaacaugguauugggucaaagauggacacauagaucaauaaaaaacacagagucuagaaagugacccauacauauauaggcauuugucuuaucacaaagguagcacuacacagcauuggggaaagauggcuauucgcaauuaugauuguaugccaauuggauauccaucacuugcagaaucauagucaccuaucucagaccaaacacaaaaaauaaauuccaguuggaucacagauaaaaauaaaacaguaaagcuucucaaagauaauauagaaaacuucuucgugacuuuuuuuuuuuuugagacagaguuucacucuuucacccaggcuggagugcaguggugcaaucucagcucacuacaaccuccgccucucaguuucaagcaauucuccugccucagccucccaaguagcugggauuacaggcgcccgccaccaugcccagcuaauuuuuguauuuuuaguagaggcgggguuucaccauguuggccaggcugaucucaaacuccugaccucgugaucugccugccucagccucccaaagugcugggauuacaggcgugagccaccaugccuggccaauucuucacgacuuuaagauaaccaaaaacaaccuuaaacaugauacagaaaagcauuaaucaugaaagaaaaggcugauaaugacaaaugggaaaacacuaaaauuaagcacuucucuucaucaaagacaccauugagagugaaaaaagaagccaaaaugggagaaaaucacauguaaaugcaaaaaauggcucauauucaaaauauacaaagaaaaauggacaagauacuucacaccaaaaaagggguggggugcaugcaaguagccaagaaacauaggaaaaggugcucucacuucuuuuccuggagugguggcaacauuauguaaugcuggaccacauuucuauccucuuuuuauaucuuuggggaaaaaacuagagauuccugggccuuuauuuguaccaucacaccuuuaggauugcauaggaaucaagauuguucaaauuuagccuaaaaugugaaugguuguacauuuaaagagaauaaaaauguauucuugaagaugagauuacuauuuuaagaaaagcucuucuaccauuugcaucagauaauauugggcacacucacacucaugcauaaccucuuuauuaagaguuggaugccucagccuugcagcuaaaaccuguggaauggagaaugaggucagaaaaauaccacuacaaacacuaacaacucauauuuuaaaagaaauaucaccagggaaggagaacacugagacaauucuguacaaagaaugccuauuuucuucuaaugcuucaaaaucuauuuugacguuuuucccaaggauguaaccuaaagguagaggcugcccugagugucacuuauugauugucauaagaagauuuucaugagauggcacugggauccaagguaaccagccuguguucagcggggacuggaagugauaaggauagaaaagcaucuguguuuagaaugcuccaaugagcaaucagcacucuccugagaugacccuuuacuguugcuaggcacucauuucuguuucuggaguggguggcaacauuauguaaugcuguaccacauuuccauucucuuuauauaucuuuggggaaagaauuagagcuuccugaguuuuuauuuugugcuauuaaaucuuuagaauugaauagaaauugagauuguucaaauuuggccuaaaaauugaaugaugguacauuuaaagaaaaaaaaaucuauucuugaacaugcaauuaccauuuaaagaagagcuuuuuuaccauaagcaucaaagaacauuagacacuccccugcauaagcaguaguuuaggugcuuaauuuacauaauucacaucaaguauagggaacuccuauaccucuguuuuauuuaucuauucccagaagugccuaaugagaaacugauuuucuuuuauggauauuucugauuguccuuuuuuagaacaaagcugcugaaaauuuaaagaucagguuuuaggguuuuauuuucagcaaaaugaacaaaaauguaacugcgaugggcccucccauugaaaaaaaaaaugcuagcuaaaauauuuauuuaauuacgcuuucucaaugcaccagucagggaagccauucagaccacgaguuuuuguauaaacaaaaugauaaucaaauacuacuugauaacauggucaaccaaaaacuuuagaaccaaugaauauuguauaaagaauauacuacuguuacauguaaguucucagaacuggaaauguuugauggugaucucuuguaagagucaaaauaagugcccuuugaguuuuuuuuuuuuaaaugcaccauugaguuuauuaaaaaguacagcuuacucagaggccagaggccaagaaagguaaagagagaacuaaagccaccuuucaccuaaggacauuuccugaaaccugauaaccuugacauuuugguuuucauguucucauggggcauguugggcaaaaagcaacaccaaggacugaccuaguguagguagucuaauagcauaaagcuagaaaccaaagaaauaaagaacuaugucucauuuauuccauagaaggcagagguguggaguggggagagagauaaagaaagaacagccaggugugguggcucaugccuguaaucccaacacuuucggaggccacggcugguggaugacuugagcccaggaguuggagaccagccuggauaacauagugagaccccaucuuuacaaaaaauuugaaaguuagcuagccaugguggcccucgccugucauccuaguuguucaggaggcugaggcaggaggaucccuugagcccagauuuugaggcugcaauaagcugugaugacaccacuguacuccaguuugggugacguugucgaagggaauagagagaaaagcugcugaucuaaguaacuuuggaaaugauuggaaucaguaagacugaacucaaaaagacucguacaugauacuacuguaguugauaaaguuguauaccaugaauguguaugguuagcaauucugaaaccaccauauauguuuacuggaauuaaacaguuaaguaaauguuucucauuguuggaauguuaggguacagauaagaaaggggaggaagcuagaaugauccacguggggaagaggaaagaugaggagggaaggaggcauuccagcuaagaaucauaacccaggauugaaguugaaauacaagaggcauauugaggaaaccaugcuggaacagaugguuuauauagggcagugcuuuucaaauuauguucugaugcacucccacagaggcuggccagcaaggggugaggaggccugcuagugaagucuuuaagugaggcagugcugcagguguauuagaaagauuuaucugacaguggacacagaggaauguguugggaagcuguucaguaaauccgaugagauggcgugagcccaaauguguuauuggccacgaguuugaaaauaaaacaagaggauggaugcauguauucucaccaagggagaaccaccaggacuggguuacagaugggagaaauauuauaccaugggaaggagguaucaaagccccauccagugauagaagugaagaaucucauguuggauguaaaucugaugguacuagauuguuugggaauauggaaguuaauacuuugauuguauccaaguucuaaagggaauuacaaagugaauuacaauaauuagcuugaauauaucaaauauaacuagauggcuuacuaugggauuauaucuagugucagcaguguggaugaacacacagcagaccugggaauucuuauuuacagcucaguucuuaagguuaauuuucuuagaagucucuaaauuucugaguuuagguagggguggggauaaguuaaauugaaaagccccaaguacuaaaaaucccauauccagagucuaggaguuggcacuucugguaagguagcauucacaggguaguauuguuaaggauggcagagauuugguaaggauggaauccccaacagaggaagaguuggcauuccuccuugggcccaauaagccacaaaccuagagcuccagguuaaggaaggauaaggaugucaaggcuaaggaccucagguaguaucuacuauccucuccaucaaaagaaaauaaauaagcuauaaaugaacuaaaaauauauagagauacagguauuugcuugcuuucaauguaggaaagucuuaaugcaaaguuauuuaauacaaggguucacagauauacaauauauacacuucagcaaaauucauaaaaucaaaagguaacaauaaucuauaaaaauaacaacauauaaaacagacaauuaacauauaaaacuaacacuagaaucaacaacacuccaguaguacaagaauagcuaguguccagaucuugguuucaaauaccauuuuccaauaaaaggaauaaaggcuccuuagagacauguugauucuaggaaugggcaggaaauauacaugaugagccugcagcaucuuguagugccagaaaguaaagaaagugcucaaacaaaaacaauguagguaugucguagggacacaggacauugagaaagaucccagugacccaaggagaucuggaacaauuuaagcagcaaaauaaaguaguauuggauuauaccauccaaagcauaaaauaaauaucaugaguccauacucauauaaauaaaugaauacaggagaauagguaaaucucuccuggagaagaauccauauaauuuauguagauacucugcccucaaggaaauggagcaucacuccccacuccuuaaggcuguacauagugacuuucugccaaaaaacgugguauguaaaucuggggaggggcgccaguaacuuuaccuaacauauacuaccucagccacaucaucuuugugauauuacucccaaaaacccaugaccugagucuaaucuugagaaaaauuucagacaaaugucccuaauugagggacauucuaaaaaauacuuaaguagcacuccucaaaacuaucaaggcuaucaaaacucaggcuugagaaacuuagugaggagcuugggaaaacaugaugaguaaacaugauaugguaaauggaugggaucccagaugggauccuggaaaagaaaugagaccuuaggaaaaaccaggaaaauuugaauaaaguauggacuucaauuaauaacgauauauuauuauuaguuucuuaauuguggcaaaugugucauaccaauguaaaauuuuaagaauaagagaaaucaguuguggaguuuaugggaacuaucuguacuaucuucacacuuuuucugcaaaacuguucuaaaauuaaaauuuuauuuuaaaagaguaaguggccaacauuauggcauuucugucuuaauuauuauaucuccuaaauaaggcauuaucuuauauagucacaagacaaauaucacuuaagaaauacagcacuggggccgggcacaguggcucacgccuguaaucccagcacuuugggaggccgaggcagguggaucacgaggucaggagaucaagaccauccuggcuaacacggugaaacccugucuuuacuaaaaauacaaaaaaaaaaaaauuagcugggugugguggcacauaccuguaguuccagcuacucgggaggcugaagcaggagaauggcaugaauucaggaggcggagccugcagugagccgagauuuugccccugcacuccagccuggaccacagagcaagacuccgucucaaaaaaaaaagaaagaaauauaacauugaugaacuauuaauaccuaaaguaguucauauccaaaauacccaaguugcccaaguagugccuuauguagcuaccugguuauuguuuuuaauacagaauccaaucaaauagcauugcaucuuauugucauuucucuuuuuucucccuagcagaacagugcccucaugaugaggaauuuuaacaccccuucuuuucaguugauagauggacugcccuucauuuaaucacuuguauauguuucuuuagggaggaaaaaaguaguaaaguuaggauugguggagauuauaccauuucucaaguaggaucaucccagacugccuuugagugacguuucauuagacacagggggcuugcuagugccaagcagccagucugcugguuuugugcuguaauuacugaugucagaauuaaauuaggugguaguguaguucuuguggcacauguuuguuucuuuuucugucagguugucccagauagaaauaaaguucccaccucucugauuuucuuguaguaagaaaguacuuagacauugucuuugucaguugaccaucucaagagaacauggagaauacucacaaaugcuuuuacaaugacuuaauuuuuauguucugguuguuacuucuguaauguaacuucuguuauuguucacuuacuuuacaaaauaagaagaccaaaccuuuuuuuaaagccccguuaaugaaagacaguaaacaggcaguguggcucugagaggagggagagcucacaacaugaagagcgagauuguucuagcuacagggaguggcaugggaaaaaauuacuguguuggagaugcuggagguauuagagugauuugaauaaauggaaugaaggaagugguuuaagaaauaugaaaauagaauguuuugguuuccaaaucaucacaaauuuaauuuucauuaaaaagcgauagcaaguucacugauguaucccuagugauagaaaaacacagugccuugacauguaguaugccgucagugauaccuguuauuguuuaauggagacuuaaaagauuguuugaaagcaaaauauuaaauuaaccuggugaagcguuuucaugcucauuggugaagugccuguaggugacuguagcuuagacuguacauuagguaugaauguucuaugggagggcuuggccagaauuuuauaucugaguucaguuuagagaaguucacuuuguggucaugugauacugaaugaauugcacagaauaggguagaauuuguguuuauggcuuuccuuacucauccuccuuuaauuuguagagacggauguauuucaggagaggaaauuuuuugcaauguuuucacaauuguuuguacauguuuuuucuucaccagaagcuuuuuaaaacuuagauuggccgggggcgguggcucacgccuauuuguaaucccagcacuuugggaggccgaggcgguuggaucacaaggucaggagaucgagaccauccuggcuaacacgguaaaaccacgucucuacuaaaaauacaaaaaauuagcugggcgugguggcaggcgccuguagucccagcuacucaggaggcugaggcaggagaauggcgugaacccgggaggcagagcuugcagugaguggagaucgcaccacugcccuccagccugggugacagagcaagacuccgucucaaaaaaaaaaaaaaaccuuagauugcaauugaacuuucacguuaucuuuaagucagugggccuaaugguaaguucaaauuuuacacauccugugcuuaaggggcuaaauaaaguaaacaacuccucugagucaagaguuacucaggaaucaggaauuggucagaucaugaguaaucauuugauaggaauuaaagggugugaugauuguugauuaaagacaugcauauuccuuuauguagacuuaguauacaaucagaaaaugggucucagauauuuuuuuuauaugacaguaguaugccuguggaauuacaauuguuuagagaacuucggaauauugacaucaucgaacuguuaauauuggggaucugcuaugagcuauacauuguaugaaauacagguuuucuuugggggacaguuuuuugguauagaggaaagagcacaggucuucaaauuagaaguucuauguuuuggcuuuaacacuugcuaugugcuuaauucauaagaucauuaaucucucuaagccuuacuuuuaucaucuguagaacuagaacaauagcaccuaccucgccuaugaauuuucuguguguaaugacaaucaggauggaaaaauugcagcuggaaaacuguggagugcuguagauuguagggaccauugucuucuuucagcccuaugagccauucugugguacucuacccacaggaugcugaguuacuggagugcuucaaggguuuguagcccuugauucuacaguguacucuguuccaaguucagcauucuucuaaacauuuuuuuguuggggucuaccacaugguaggcccuugugguuguaguggggcguggcuaguggggagagagugaggagaugaggaaguuugagucugaguugcuguagcuugauuuuuuuuccccucuaguuucaucuuuaccuuuccuuuuagaauagaaauuauaggcucuggaguaaaauuagaaauguagcuccaauuuagcuaaguuuagcucuaacaugaaaauuccaaguuucauagcuuuugaugaguauuaugaaaaacauaaagucuuucaaaggaauuuccacugucuuuuucucuccuucaugguuuuaaacauggggaccuuugguuauagaauucaggauuuggggcuguuguuguuuuuuuccccauggguuugacucuuucuccuuguauggaauuuucauauuuuucuuuaagguuuagucacuuaaccauuguuuuacuaaaugggaauucucuacugacagagauuuuuagcaacaaauguauuuuucuuaaaauuuguguaagacaaaaauuacauauuauuuuggcagugaucaugcaugaccuuugcuaccugauggcugccauggcagaaaaacucauguaggaaguuuaucacagggagaauauacacagguaccuugguuaucaguagacuuugcacuacuuguaaccauuuagucuacucuuuguaacucucucuucuuuuaucaugaugucuuacauuuauuuuugcaucuaagugaaggauagagcguggcaaaaguccagauaaccuauaaugacuuucacauuacuuuaaaaaauccaguuaaccaacguacuguacugacaacauauugcuuaaucauaaucaguuuuaauccaacaccaaacuaagcauaauauugucacacauugguuuguugaagaugcagaauuuagaaauucagauccuugagcccuacugccaaaaauccuccuucccaguugauuauuuuacauagacagguuugggagcuacugaaccauuuguaaggggcacuuuucaaauaauugucaaggguuuaaaauucaucagaggauucuacaaucagugaaaauaaguugucuuaggaaccuguuaacugcauuuaucucuuuauuuaugaaguuccuaagaaacauuuccucugggggaaaaaugcuaccuugaaaaaaaaccagaaaaccauucuuauaaacuauuucugggauuccucauugagauuaagauucugauuuuauuuuauuauuuauuuauuuauuugagacagagucgcucugucacccacugcaacagagcucacugcaaccuccgcuucccagguuuaagcgauucuccugccucagccucccaaguagcugggauuacaggcgcgggccaccaugcccgacuaauuuuuuuuuuuguaucuuuaguagagacaggguuucaccauguuggucaggcuggucucgaacuccugaccucaaaugauccgcccaccuuggccucccaaagugcugggauuacaggcgugagccaccaugccuggccuaugauucuauuuuuuaaauucauuacagucuauauuaauauuagagaacuaauacucaaacagaauuugagugaacuauuauaaaugacagaaaaauuugcccucucucuuaauuuuacaugaaaucauuuuuaaaauuggugggguuuuuguuuuguuuuguuuuguuuuguuuuguuuucuguuugcuuguuuuuuuuuuuguuguuuuguuuuuuuuuuuuuuuuuuugagacggagucucgcucugucgcccaggcuggagugcaguggcgggaucucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggccuuugcuuguuuuuugaucccagggucaagccaggaaacuugguuguuauaaugggcugccuuuuugauuucacuaaauucugugaauucucccuauguauaguguuccauuguccucccaauaaaaacauacuauaguuucccuuggcuaaaacccauguaggcaguggugugccgguaaugcuugacaacugagggaaagaggacugauucauacaauuugcuaauuucugugauguaaaguacugccuacaauagccuaguucaagcucgcagcgugaccucacugaauguggagcuggaaagaaaugcacacagcacacuuaguauuucuaguauuuccaccauacagauagaauagaaguauauaacuugaagagcauaguaaaauguaaaauaauuaggaauaaauauaauuagaaaauaaugaguuuuugacuauuucccuuugucuuuaauaaauguuauauguauaacuuaucuuacuguuuggauaccaaauaaacuguuuccaugcuuaucuuugggaaaugccacuguuucaaaaugggagguuuuugcuuagcguuuucuuccuuauucuauuguuuaaauuaauuaccuacguuaaauuuaucaacaacaaagaagaagcucuccaggugauuuugacguguugcaggguuggggaccagucuuuucuugguuugccuggcaccuuagagcugcauuuugugcuuaauuacacugacuacuacauuuuaacuguuuaugcucuguuauguucuuucaaaugauuugagaauuuuuuuuccaaauugauauguuaaauuauaaagaaaaauaacagaauugagacuagaaaauagcaaucaaagaaaauaaaaauuuggugaguacaaauauaaauaugccaguucugaggaccacaaguguugauauaguagaacaacagauuugauucugaguuuccuggcaacccauggagggaagcaaggaauaauauaauucuuuucagauggaaggaaggcaucaauuucucaaagaaagcuaagcauugcauuguacugaauuucagaguaaaucucucauaugaaauuucauauguagggauacugacuaauaaaauagugccguauuucucuacuucuuauggauuuuauagagcagauuauuauaauauacuucaaaaaaaucaagaauguaguaugacuuuccccccaaaggagacagguguaauaauuuaggaauauaaccuaguaaucaaguuagaauaacaucaccuagaggaauaaagauuuacaacaauguuggcaaaagaugacagauagguuuaccuagcuccuguccuugguuagcgugagguuauggugcuguguugacaagaauucugagaccagggucagcagaaacaaauguagggaaugccuagcaaucucugacuugaucacaagaaggaggaguagcacaguuaccucugcaucuuugccauccuuacuucacaucuuauguaaauuucauggguuuuagaugguaucucuaguauaaacuggauuacuaauggaguuuauacucuucgauaagaggcuggaggccaggcacagugguucacaccugcaaucccagcacuuugggaggccgaggcagacagauugcuugagaccaggaguuugagcccagccuggccaacauggcaagaccccccucucuacaaaaaaauacaaaaauuagccaggcaugguggcacuugaacccaggaggcggagguugcagugagccaagaucaugccacugcguuccagccugggcaacagagcaagacucugugucaaaaaaaauaaaaaauaguuuuaaaaaagaggcuggaguguuguauuuuguauugauuuuugagaguguauauagugugugugugugugaauugugacuaauuuauucuaaugagcuugggacaugucuuccaucauuccaauuuuugauccucuaguuuauuuuguuuguuuaauauuagcuauccuauuuuaguuuaccucuagucucauugaguuguuuuuagucccuuagucuaauaguacacuguaauuaauuuuuuuguuguuguuuagaagcaugauucugaaagccaugaaauaaggggaauuuggcuaacuaauucuugcauaaguguggucauauuacauuuaaguaauauguagauuaucagcaauaaauuauuuguuauauuuauuuuuaacaagcuacaauuuaaauuauuuugucauauuagagagggaauuuguaaucuaaagaaaauuucaggggaaaguauagcuaguucagaaauuaauuauuaacacuacuaacuaugauauuuauggauuuuucuccauuuuaguagugauuuauacacugcauaauuguucuaauccauaccuuauuaccuuagaaauacaauucauuuuucaaacagaaugucuguuagcuacucuuuuacuuuacuuaauucaucuguugacuuuuuucuuauuuuuuuaaauaguccugaaauggauauuuucauacauucuugguaguaauauguauagguguuacccuucuaaagagcacguuggcagaggaccuucaaaauugacccaguuauuucacuucuaggaaaauaucauuaggaaguagagauuuuaagugugaauucuggaguaagagugccuggcuuugaaugcagccgacagacuuacaaauuauaugaccuuggguuaguuucuuaccuuuuuaagccucagucuuugcaucuguaaaauugguuuuaaaauaacacccaucucuaguuguuguugugaaaaucaagugauauaaguaaagugcuuaacauuguggcucuuaugaaaugucaauaaauaauugcuguuguuaauaaucauagaaagauuguucguagcauuaguuaaaauagaaaacagguaggaaaggauuugaaugauuuucauuuauauaagggaauacuauaccauguaguuguuaaauaauauuuuuaaagaauauuuaaagacauaagaaaaugcugauaauguagcauugagugaaacagaaggauaaaaaucucuauaugcucuaagguguuaauuauguuuuaaauuaucuucuaaugauguuauaaaauauuguuuuuaaaauguuaauuauguuuacaaguaaugauucuuaaaaauauagaaaaaaucuggaaaagggggcucacuguuaauaauucuuaaaacuagguaauagguaauggagauuuauuauauucauacuauucuauuucuacauauuuuuguuuuucauaauacuuuuuaaaaagaaugacaagaagaauagauuaaaaacagauuaaauccuugauauuagugcuuuguaaccuguuuaaauguaaauuaacucuugaccaguuuuguuauuaaaccauuauuuauacuuuuuaaugguuucuuaaagcauuugagagauguauaucagacuuguuugguuaaggaugaauugugucugaauaucugucuagaaaauagcuguuuuaaguauuuuccguaucugaaaaugauaugaggaccaucucccacuacugcauucccauaagugguuuuauuuuucaucuuuuaaaauggugcagauuuuucaacauagccagcguucguacauuuccaaagucaacuuuacauuagucggggugaacaguaucuuauuuugacaaaauuuccccucuuuagacggaaaugaggcaaagaggaaagguguaacuauuucuucuugucucuauaacugaaacaauauucaauguaagugaauuuuacuuguagcaaauauucccuuuauaagcccuccauuuaucuuguagguggcccuguaaaauauacuuuauuugauuuuacacacugugcucaugcuuuggcuuuaugcccaaccucccaggcugcagacaucuacaguagaccccaguguuaaagaaaacaagccccucaaaacccuagaaaauauuacaguuauuaauaauaaauucucaguaauauucacauuggagcaguaauaaauuauauuaauaguagcaguccuuaaaaauggucccacucuucacuaaaacauucaaucuuacccauguuccaaaugaaaugauuauuguuuucuacuuucuacucuuacaagaaagagguguuaaggguauucuguuuauuuguuugacuuauucucuuuaauacagaaguuaaaaaauaaaggcaaagcacauauauguauaguaucaacuagcaccaaauccuucguaugugagagaaaaugaucugcuuuggaagccaguuacauacauuuaagaaauaugucaagcaaucuaaaaugaauauguuaaauggaaaaugacuaguccugacaaauucuucuaaaaugcaaaauagcgguaauuuagaaguuuauggaggaaggguagaucuugaagaaaaauauguguuuuaauuaaggaagaaaauaaagaccgggaagaaagaagaggaagaaagauagggagggaggcaauccaggcaugaagcagacgcuccuggauugaaguagaaauacaagaggcauauugaggaaaccauguuggaacagaugguuuauauaaggcagugcuuuucaaauuauguucugaugccacccccagaggggcuagccagcaaggggugaagaggcccgcuagugaagucuuuaagugaggcagugcugcagguauauuagaaaaacugaucugacagugggcacagaggaauguguugggaagcuauucaguaaguccgaugagauggcaugagcccagauguauuacuggccacgaguuugaaaauaaaacaagagaauggaugcauguacucucaccaagggagaaccaccaggaguagguuacagaugggaagaauguuguacugggggaaggagguaucaaagccccaucagugaaagaagugaagaaucccacauugaauguaaaucugaugauacuagauuguaugagaauacagaagauaauacuuugauuguauccaaguucuaaagggaaauauaaagugaauuaaaauaauuagcuugaauauguaaaacauaacuuugggauuauaucuagugucagcgguguggaugaacacacagcagaucugggaauuguguucuuguuuacacucuaguuaguuuuuccuuagaugucucuaaacugaaaagcuccugugcgguggaggaguggugggggugcuaaguuaaauugaaaagccccaagcuuuguggcacagcuaaaaauccuguauccagagccuggggguuggcaguucagugaagucgcuuucacagguaauauuguuaaauaaggcagaguuuuuuuuuuuuuuuuuuagagacggagucuuacucugucgcccaggcuggagugccaguggcacgaucucggcucauugcagccuccaccucccagguuccagcgauucuccuaccucagccuccuggguagcugggauuacaggcaugcaucaccaugccugcuaauuuuuguauuuuuaguagagacaggguuuccccacguuggccaagcuggucucgaacuccugaccucagguaauccaucccccucaaccucccaaggugcuaggauuacaggcaugagccacugcuccuagccuuaaggcagagauuguuaaugauguggcuucuaguugguaaguauaaaauccccagcaagagaagcguauucuuccugugacuuguugacauaagccccaaaccaauggauaaggaagccaccaggcauguacugcccucugcagcaaucaaucaauugguaaacaaacuaacuauaaaugaacuaaaaauauggagagauguaaauauuugcuccaguguaagaaagacuuauguaaaugcaaacacuuauuuacucuaaagguucacaaauauauauguguuaugggcugaauucugucuccccaaacuucauauauugaaguccuaacccccugcgcaucagaaugugacuacguuuggaguuaaguuauuuaaaggugugauuaaguucaaguacggucuuuagagagggccuuaauccaguaugauuggcuuccuucuaagaagagauuaggccacacacacaaacugaggggccauuaugugaggacacagcuagaaggcuacaagccaaggaaagaggccucagaagacaccaaaucugccaacguuuuggucuugggcuucuagccuccaggacugugagaaagcaaauuucuguaguugaagccacccagucugugguauuuugucaggguagcccuagcaaacuaauacaguaugcaugcauuucuguaaaauuuguaaauuaaaacaaaagauaauaaccuacaaaaauauugauuaacauauaaaauagacaaggaaggaccuagaaucaacaacauuccaguagcaaugagcacacuuagcucccagaucuuggcuucaaauacuguucuccaauaaaaggaacuggggcuccuuggagaaauagcugauucuaggaauggggcaggagauacaguagucccccuuuaucagaggggaauauguuccaagauuccugguggaugccugaaaccacggauaacaccaaagccuauauauacuauauuuuuuuaaucugauaaccaaaacagcugcuaagaauaagcgacuacagggcagguaauguguacagcauggauacacugaacaaagggaugauuuguuauuuguagagaauaacuccccacucaagcaugggcugugcauggugacuucuuuccaaauaauauaguacuaaaaaguggacaaaaaagaguaacagcaaaaucugacaaaguccuacuucagcaugguggucaagauuaacagcagugauaagucacguugauagacuguguccuugauauaaugugauaagaauugcauuugaccucugugguuuuccucccgaaaacccauaucucacucuaaucaugauuagagugaauagagaagcaucguacaacauacuuaaccagcacuccugaaaacugucaaggugauaaaaaacaaagucugagaaauuuacagccaaaaaagcuaagagaguagcugaguguaaugugcuauccuagaauagagaaaggagacuagguaaaaacuaaggaaaccuaaauaaaguauaaaguuuaauugauaaacaaaaaucagcacugguacauuaauuguaauaaguguaccaugccaauauaagauguuaauaauaggggaaacuggguauguaguauaugggaacuaucuguacuaucuuuccaacuuuucuguaaaauauucucaaaaaauggccauugaaaacaacagaaaacaaauagacaaaguuaucguauacucaucaaaaggccaguaagcacuugaaaaaauuucaaauuugcugguauucagaaacacacauuaggccagaugcuguggcuugugccuguaaucccagcacuuugggaggcugaggcaggcagauugcuugaggucaggaguucgagaccagccugggcaacauggcgaaaucccaucucuacuaaaaauacaaaaauuggcgagacaugguagcacaugccuguaaucccagguacucaggaggcugaggcaugagaaucgcuugaaccugggagacggaggcugcagugagccgaugucacaccacugcacuccagucugggcgacggcgagacccugucucagaaaaaaaaaaagaaaugcgcauuaaaauagcuauaagguuauuguuuuucuucuguuuagcuugcaauuuuuuuuuuuccuaacgaugauaccuaugaucagcaauguauaggaauguaaaauggaucagccuuucuggagggcauuuugguuaauagauaaaaauguguguaccccuugaagcagcaacaucacaaccaagaagugaacaucagugaugacaaaguuuuucacaguguuguguagaauaguaaaaccucagaaauuaaucaaaagguuguaagcauggaauuguuuacauaaaguaaaggaacgucaaugugugaugcaaugcagacauugagaauaauacuggcagggcaugguggcucaugccuauaaucccagcacuuugggaggccaaggcagguggaucacuugagguaaggaguuugagaccagccuggccaacauggcgaacccugucucuacuaaaaauacaaaaaaaauuagccgggcauaguggcacacaccuguaaucccagcuacucaggagccugaggcaggagaauugcuuguccccaggagacagaggcugcagugagcugagaucgcaccacuacacucuggccuugguggcagagcaacacuccaugucaaucaauuggucaaucaauaaauaaaaauacuguaggauaacauuugaggacaaaaaacuucugugccauauuaugugaaaauauccauuguaaacuguguauacugugucgugagauuucugugucuaucuuuucauuauucauuuguacauaugucuuggaccugggauuuggugaucuuuacaaauggcauuagauuaaguccuauucgugauuuaaagucaauuuguaaaugcuuaaaguuauuuuaaugcauauuauaguuaauguaucaagaauugccuuacaacucugucauaauuagaacccagugauucuaacuaguggagugaaggaccaaguuuucauuaccacaaauuguguacguguauguuuaugucuuagguauacuacacguggauaaauagugggauuugugugcaauaagauauugccugugauuaucucugacuggcaggguuggagcaauuuuuauuuuauuauuggugauuuccuacauuuucuaaauguuguucaaggaaccacagaauauuuuuugcaaugagauaaaaaguuuuagaagucaauuuuuucaaaaaauaaaguuuuuauuuucaugaaacugcuaucuaaauauuuaaaucaucuuuuuuuuuuuuuuuugagacagagucuugcucugucacccaggcuggagugcaguggcacgaucuuggcucacugcaagcuccguccccuggguucacgccauucuccugccucagccuccccagcagcugggacuacaggcacacccgccacgcccggcuaauuuuuuuguauuuuuaguagagaugggguuucacuguguuagccuggauggucuugaucuccugaccucgugauccaccugccucgaccucccaaagugcugggauuacaggcgugagccacugcgccuggcuaaauuaucuuuuuauuaaaaauauauuuuuacuuuuucugagcggauuuaauuuacacacaaauuuacaguuauuuguuuauuagguuaaauuuuuaugagcuguuuaaaacauuguuguguuugaacaguauucucauuuuuuuuacuuuuaggcugguguuuggaaugcuuuauccugcauauuauucauacaaagcugugaaaacaaaaaacgugaaggaauauguaaguauaguuuuaugagugauuaaucugaguuuaauauuuuaaugauacacacugaaaaacugcuauucucuuagaaacggcuggaguaguguuuuggguuaaaagguguuaugaaugugaaguaacaaaacuaaucuuuuuuaaaaucuuugaagauaaccccaaaguggaguuucaauaaaaauaaguguaugguucccaagaugaguaauugaauaggucuugauuuagucuauaaauuccaguguaauaagggguuggagaacuuuuguuuguuugacuuggggaggggaguuguggggcuuuuugccuuauaaauuuauagguacauugagaauaucucucuggccucaaagcuuuuuuccucuucuguagguguuucaucacuuucuaaucuauauaaauaugcagauacuccaucaccacugacaacugcagucuuuuuuccuucuugaaucagacuccauuuguaauuauuuugcuuugauuugcgaugaguccucaauauuucuuuguuuuuaguuuccucuucccuauucccuaauuuucuuuuucugucacuaacauuuauuuuuuaggauuucugaaguucuccucauuucucauuuuauucauacuguguaauaguaaauggccuuccccaccuauaaauccugauauaguuuaguauaugugauggagugaauuuuuagagaauagcaaaagcauauuguauuggugguguuaaucaacaggauaagcagucaauacugagauaacagcacaucaauaacuaugccucuuuuuuuuaaauugaggugacauucacauaacauaaaauuauccauuucagaggcauuugaugcauucacaauauuauacauauauauaauacaauauaauacaacucuuucuaguuccaaaauauuuucgucaccccaaauaaaacccugugcccaaguugcugacaaccaccaaccugcugucuguauguauuuaccuauccuggauauuucauauaaauagaaucauauaauaugugaccuuuugugucuggcuccuuucacucagcauaauguuuuuaagguucauacguaucuuaguauguauuucauuuugaauguguuacauuccuuuuuauggcugaguaacauucuacuguauggauauaugacauuuugcuuauccauucaucuguugacagacauaugaauuguucugucuuuuggcuauuaugaauaguacugcuacaaacauucacauacaaggauuuguuugagcaccugcguuugauucuuugggauauauagcugugguucuuuguaaggaaucuuggaugauagucuugucauccaauuggucaaaugaacagagauuagaucauuauucuuuauauuuucaggguuuuuggggggugggaggaagggacagacucugaaacuuuuauaacuaacucauuuuauuaaacuuuuacggucauuuuuuucucuuguauauaaaacuaacuucugaagugaaguauauauuaauauaagucaaaaugguggaauacaucuggcagagguaaauaaguuacauaguugggcucucaaauuuuucuauccuuuuauuauaugugucuuuuggaccuaggauuggugaaauuaaucuuaagagauggaaccauauuaaguccugguaauuuaaauucauuuuauacauggcuugaagguucauauucuaauauaaguuggaguaaauacuuugcguauuguuuuauagugcuggcauacauuaguuucuagaugccagcgugucuguuaacagugcuucucaagcugccugugguacaggaccacuuuuguuuuucgaguaagucauagacuaauccuuguuuguuuuuuuuuuuuuuugagacggagucuugcucugucacccaggccggagugcacuggcgcgaucuuggcucacuggaagcucuaccucccggguucacgccauucuccugccucagccucccaaguagcugggacuacaggcgcccgccaccacgcccugcuaauuuuuuuguauuuuuaauacagaugggguuucaccguauuagccaggacggucucgaucucccaaccucgugauccacccgccucggccucccaaagugcugggauuacaggcgugagccacugugcccugccgacuaauacuuuuauaaaaugaaauacuaaucacuagaaauaaagaaaugaaaaaagccccuaaaccugaaauacaacccagaauuuuuuuuuuuuuuuuuuuuuugagacagggucuugcuguuaucacccaagcuggagugcaguggcaccaucauaguucacuguagccuggaccucaugggcucaagcgauccuccuaccucagccuucucaguagcugggacuacagccgugcaccaccaugcccagcuaauuuuuuuuuuuauuauuuuuuauagagacagagucuuacuauguuguccagguugaucuuggacuccuggccucagguuauccaccuacuucagccucucaaaguacugggauuauaggcaugagccacagugcccaacucccaaauuuuuuauugcuauauucaguaacaugaaauuacugucaaauaauguacuuuugccuauuguuuucauuauuguauuauuaauauacuuacaguaacacaguagugcuuuuacagccuuguacaauuccauagacaacacucugcccuacuguguaauauuuuaauuggaauucucuuuugaaagauaaaauuaagaguuggccaucauuuccaaacaccaugaaaauaugaguugaagaaucugcuucuggccagugcuuaauaaaugggaaccauuucccuauuuggaauguuuuuuauauuguuauuaaauuagaucuuuuuuugagucuaauucaauguacaguugaaguacaggguauuaugucucucaacauugggcccauuucaccuagaaagcauucaagaagcccgggauauauaauaauuuggugugcugcugugugugugugugcauuguauauauauuugugcuuacgguauucuccaaucuuuucucccaaaucugcuuuuuuuuuuuuaggaaaagaaagcuaaguacaaauuuuaaauguuuagaugagaagcucuaauaacuugagaauauuaucaguaagcacagaaauaccaucccuaaaauaaacgucaaagguaaagggauagcauaagaaauauaaaaauaguuaauaaacuguaauaaaaaauaggcuuggccacgugcaguggcucacaacuguaaucucaacacuuugggaggccaaggcagguggaucacuugaggccaggaguuugagaccagccuggccaacauggugaaaccccgucucuacaaaaaauauaaaaauuagccggguaugguggcauaugccuguaguccuagcuacuggaaaggcugaggugggagaaucaccugagccugggagucgagacuacagugagacaugaucccgccacugcacuccaaccuggacaacagaaugaaacccugucucaaaaaaaauacuaacaauaauaauaaaauaaaaaucagaaagauuaaugcauuuauaaaugaugugcaucaauucaauuuuguuaauauuaauuuuuagagacuuaaaaacaacaacaaaaaaagacuuaaaaaaaagaauuuguguguuuuauuaccccugauacaacacucagauuuucauuacuagauuaaaaauuggggauugauaaggauggucuaacccugaaauuuuuauucaacuuuauaaagauaauugcuucuuggcauuuuggcuaagaucaagugugaagauaauuuaggcuauggaagauaauccaucagcauucaaacugaugagaaaacuauaaacaugauauguauugagauauauguauauguguguauuuaguuacauagugagcauacauacagcuuugcacaguuguuuucagagaauacucauuaauaaagcuggaauuaucuguacauaauuuugcaguaauaccaugucucuggaaagcauuucuuuuuauuuaacuuugauuguaaguuuaggguuugugcagguuuguuagguaaauuugugucaugggggugugugguacagacucuuucaucacccagguauuaagccuaguacccggaaaaaagauuuucuuaaccauccauuugagaagaccagaauaaugaguaauugaggagaaauuagggaagguaaaaggcagguggcuggagcugguuugauaauuacaugguaaucaacucuacuucacaaauaaaaugagaacuaaaagcaaaauaaauggccaggcacugaaauaaggacaaggcaucugccuuugacagggaaaugugucaucucugaagacccucccagcaaccauauugccuuccaucaaggcugcuagagaggccuggugcaguggcucacaccuguaaucccagcacuuugggaggcugaagcaggcugaucucuugagcccaggaguuugacaccaaccugggcaacaugguaaaaccccaucucuacaaaaaacacaaaaauuagcagggcaugguggugugugccuguaguuccagccacucaggaggcugaggugggaggaucaccugagccugggaggucgaggcugcaguaaguccugauugcaccacugcacuccagccuggaugacagacagagugagaccaucgggugggguagugggaucagggggaggcugcuagagagacuaaguugagaugucaccuuggaauaguaauauuuuccauuuauaugauuuccuacgaguuucaaaguacuuuuguuuauuauuguuuuaauuugcuacccuggauaauuuuuugaaacaaauuaucacacucuuauuggcuuagaacaacguaaauuuauucucuuacaguccuagaggucagaaaccuaaaaugaguucacaggccucaccccuucuggaggguuuaggggaaagucuguuucccugucuacuccagcuucuacaggcugcccgcauuccuugguuuauggcuuuauucuuccauccucaaacccagcaauguugggcugagaccucuucaugcugccaucucucugguucucucucuucugccuccucuuccacuuauaaggacucuugugauuacauugggcccaccugauuaauccaggauaaacuucccauuucaaggucagcugauuagcaacccuaauuucaucugcaaccuuauuucuccuuuacgguguaaccuaacauacucaguuuccagagauuaagacacagacaucuuuaggggagagagggcauuuuucugccuacuccaauaauaucucaguuguucuaacugcagucuuaugaaguaggcauagaaaauauuccaguauuacaggcuuagagaagugaauuuaccuggagucacauggauuguaaagacagaauugguaccagaucagagaucuucuguuucuaguauuuuauucauucuauucuaccaugcuaccuuuagaaacacaggugaagauucuagcuucacguaaaaguugaaacagccuucacaaccagccagugaauaugcaucugauuaauucaaagcuggacguucgggggccacggccauauagauauuuuccaagaaggacaaucaggcagcuuaccagggcgggacccaccagcauugaaaucacaugugaacaaagagguucaaaaugaaauagaagguuuugaaaauucuguaaaguuccuccuuuaaaaaaaaauaaaaucccuuaaaucuugacaaucuucuaaguauuuccaaucuaauuucacucugacaaaaauuuugaacauuauuugcuugcacccagugcaaggcuaaguccuaaacuuagccaucuaauuuaaaccgacuuuuuuuuuuuaauuauacuuuaaguucucggauacaugugcggaacguguagguuuguuacauagauauacaugugugacauggugguuugcacccaucaaccugucaccuagguuuuaagccccgcaugcauuagguauuuguccuaaugcucucccucuccuugccccugacccuccaacaggccccaguaugugauguuccccucccuguguccacguguucucauuguuaaacugacuguuaacaguuuuaucagaacucuguccucauaaaguuuuccuauacaguaauccuauccaaauuuucuuuguuuuauacaugguauuuucuuaguaaaauuaaccuuuuuauauugcccuguuauguuuuuaauagcaccuuauaguaucugauguuauauucuuuauuugaauauguuuauguuccccaccagaauaagcuccauggggaauguuuuguuguuuuauuaauugcuauauuccuguaccuagaacaguaccugcugcauaauagguacucaauauuucuugaauaaauaaaugagaaaaguugacuuuuaaguaaauaucaaauauugugcuuaauagcuuguacauuucuuaaguggauugaucuaguuuaccagcuuugauucugcuggguuagggagaauacaguccagucuuaacauuuaucccaaaacccaguuucuuugugguauuugguuaugaccuaaauuucacugcuaucuacuucaaaauuauuuucagaaagcaaacauuuucgguuaauuuacuucuucccacccccaacuacuaccauuccccuuaagccugcaaaugguagauugcaccugauaaaacagaugcugugcucaaaucaaaacaaauggaaaguacuguguauuuuggcaaccuuccuuucuuccuuugccuauuuuuaaaacagagcuuuccuaggauauaauuuccugcauaguguggcugauauggccuacuuaaagacuuucagucuugcaguaauugaaauguaaacuuacugaagaauuaguaugguuuugcaaauuuuuucaggcucauuccaucucaugacuugaaaauagaguguuuacuuccaagucguguguaauugcuguagcuuuucuaggaaaccaguguucuuauucuaagaauguuggagaaagcagcaaugaaaagauuggcuaacagcacuuacaaaucaaaaucagacauuugguucugagauuuacugugagcaagaacaaagaacaggaaaagcugggagauuacucucuaaaaggccuagaaauggcccucuaaaagucugcugacuugguuuuugaaagugaccuaauuuucgacugacuauuuaggugauaugaaaaugaacaaauauaccacaugccaguucuacagaucuuauugauaaugaaaucugaaguugucugcuaacuuuagaguggaaauagaaggggaaaaacauacuaaagaacuuuucuuuguucucaagaaguguuuccuagguaucuuuugauaauuuugauaaaaaguauucauuucauuuaaagguuuuaauaauuuagaaaguuuaaagauuagccuacugauuaugaugggauuuuuacugaaaauuaguuuugucaggcugcuugcuugucuguguauuuucuauucuaauuuaguuuuuauuuuuaucaaagcuguauuuacuuauaauguaaaaagucaauuaguuuuccaaggcuuauuauggaaaacaguaguuccccaggcucccaucccuaugucuaacucucuagaggcaacuaguucaaacucuuuuaucugaaucuuuuagcauuuauugccauauuccaaauaacauacuuauugugcuauuucuuaauuuuucagauggacgucaugaguuaacuuccuucuacgaaagaugauuuagcaguuacccaaugccacuauacacuugcauauuucucuguucuuauagcuucccagaaucauugcaguauaauuuguuuagcucaauauucaauauuuauauuauuuagacaaaauuagaagcaauagaauauagagguaaagugcacaaugucuggaaacaggcuuccuagguuucauccuagcccuacccauuacuagcucuaccuuuggacaaguuauuuaaccuuucugugccucaguuuucuaaucaguaaguaguaguaaauaaugaacauauuauuuaauuauaugaaugcacauaaagcauuuaaaucaguaccuuaaacauaacaguaccugucauauaaucauuuucauuauguaaacacuauucacagcugaucuccacaguauccugccauuaccauucuuuacucugguguuauucacuaucuuguuguuucauuugugugguguucucuguguucuuacucuguauccagacccaaacuuuccuagaguugugugcauuucuucucagugaugguucuuguuuuggauucucugauuucuuaauuacuuaauuucuucauuuugauaaaaugcauccuuccugagaaggcuauaaugagaggucaauuucuuuuuuuuuuuuuuuuuuuuuuuuuuuugagacagagucucgcucugucgcccaggcuggagugcaguggcacgacuuggcucacggcaaccucugccucccggauucaagcaauucuccugccucagucucccaaguagcugagauuauaggcaugcgccaccaugccuggcuaauuuuguauuuuuagaagagaugggguuucaccauauuggccaagcuggucucgaacuccugaccucaugaucugccugccacggccucccaaagugcugagauaacaggcauuagccaccgcacccagaccccaagaggucaguuucuugagaugcuagguuggaaaucauuuucuuucagaauuuugagagcaauucuucauugucuuuaacuucugguguugcuguugagaaggcugaagccauuaugauucuuaccuguuuuucuccccauucaggaagcuugugggauauuuucuauuuuccuguuguuuuaaaauuucaugaugauguacuuuguugcaugaguccguuauagucaauuuugcuaaacccucaggagucccuuuuaaucugggaauccuuuuuccuucagcucugagaaauuuaguuaaaauuaucucuuuaauacuguucuguacuccauuuucacuguuguucugucuggaauucuuuuuauucauuuguauuuguaaggcacuuggacugguuuuccaauuuuuuuuuuaaucuuuucccuucucuuucccaucucuuuuuguucuacuuucugauugaguuucucaguuuuaucuucuaacccuucaauggaucuuuuaauuucugcaccuaugugcuuaguuccugagaauaugacugacaguuuuuuggacacuuuuuuaauuuauucuauuuuauuuuauuuuuugaggcgguguuuugcucuugcugcccaggcuggagugcaguggugcaaucucggcucaccgcaaccucugccucccagguucaagcaauucuccugucucagccuccugaguagcugggauuacaggcaugugccaccaggcccagcuaauuuuguauuuuuaguagagaaaggguuucuccauguuggucaggcuggucuugaacuaccgaccucaggugauccgccugccuuggccucccaaagugcugggauuacaggugugagccacugugccuggccggacauuuucuucuuucuacauagucuuucguuugaauucuguuuuacauuuguuucagcuucuguuuuucauguauaauuuccucaaauguuggaugaucucggguucucugcucauuuuuuaggauaauaaugaaaagcugccuggagcucugugcccaugaaagggcuuauugaacgugaucuucacuguagagugaucugacuagacuauagaauauuuuccuguggcugccauaaggacguaccacaagcaguguggauuaaaacaacagaaauguauugucucacaauuucuggaggcuugaaguccuuaauuucauaaucaagauguugacugggccacacucccucagaaaccuguugaggagaaucauuccuugugaauuccuagcugcugauuguugccagcacuucagucuaccuccacacucuaccuccauugucacauaggacucgccccucaugucucugugugucuauuuugccucuucaucuuaaaaagacaccagucacauaacuucauuuaacuacaucuucaaugacccuguuuccaaauaaggucacguucugagggauugggguuuaggacuguguguuagucagcuuguguugccauaacaaaaaccauggacugauugacuugaacaacaggaauuauuuuuucacaguucuggagacuggaaguccaaaaucaaguugcugccaggguugguuuccugugagggcucuuuuccuggcuuguaaggcagccacccucccauaugucaucacauggucuuucugaugugugcacauggagagaaauauuccucuuuuuccuuuucauauaaagacaccagcccuauaguagggcuucacccugugaccucauuuaaccuuaauuaccaccauaaaggcccuaacuccaaauauagacacauuugaaguuagaacuucaaccugugaauuuugggaaaaccuaauucagucuagagcagaucuuaacacaucuguuuugggaacaccauucaacccauaacaaccauuucuuggaaaguuaucaaugucuauaucuuuagguauuuucucuugugccagucagauucuucagagaagacucuuccauucugaaagguacuuguuuaccagcauccuacuaggagaauaaggcuugggggcgcucaacauucaguuuauaaacuuuuacucgaucccuauuagccccacucucaguugugcuggagauuugcaaauccagaaacccucugauucaccccuuuccagagaauaaacauaaggguuucccuggggaaggagggacauugacaggcuucuggaaugagaagguaucuuggagucucucuccuccuuaagcagauguacagccauccuuccuaacuuuagcaccccuguccuuuuuguuuuguuagacagggucuugcuguguugcccaggauggagugcaguggugccaucauagcucacugcaagcuccaccuccuggguucaugcgauccucccuccuuggccuccccaguagcugcgacuacaggcacauggcaccacaucuggcuauuuuucuuuucuuuuuucuuuuuuucuuuuuuuuccuuuuaaguaggaaaaaaaagcuguucuugagcucccggguccaagcuauccauccaccugggccucagaaauugccaggauuguuaggcaugaaccacugcacccagccucuguaacccuuuugaccaggaauuuugccaccauuucuuuuggcgagcucugcaguguagaguuaaguugcuucucaguuuuucccccugccagcuugcuguucaguuuucucaggucuccuaacucaguuacuacucauccauuuccuuccugguuccaaaauucuuauguucucuucuauauucuucugagcuuaugcugucuuuaaaaaucacuuuacuguuguuuuaauauuuguagagggaguggaacugaauauguauauucaguuuaccaucuuuacccaaauuuccaaauugacuuugugagugggauacuugcaguugaguuacucugugguauguauguauguauguauuuauguauguauuuauuuauuuaaagucggagucuugcucugucacccaggcuagagugcaauggugugaucucagcucagugcaaccuccaccucgcagguucaagcgauucucuugccucagccucccgaguagcugggauuacaggcaccugccaccacacccagcuaauuuuuguauuuuuaguagagacgggguuucaccauguuggccaggcuggucucaaacuccugaccucgugauccgccugccucagccucccaaagugcugggauuacaggcgugggccacagcgcccacccgauuuacucuauaauauuaaguaagacuuauuauacccuuaacauugguuuuuaaauguguucacuuaggaaauagauuuaaaguaauauauggccgggcaugguagcucacaccuauaucucagcacuuugggaggccgagguggauggaucaaucgcuugaguccaggaguuugagaccagccagggcaacuugguaaaaccccgucucuaccaaaaaaauacaaaaauuauccaggugugaugguacacgccuguagucccagccacuugagagguugaugugggaggaucgcucaagcauagcaguucaaggcuucagugagccaagaucaugccacugcacuccaccaugggcaagagagcaagacccugucucgaaacauaaaaauaaaaauaaaguaauacauacugucguuuuuucaaugcuugaaaauaacuuuaacauuuaauuguagcugacauacacugaauucaugugugcuuacuuaaauuagguuauuauuucuuuauaaaccuaauuuuucauaugucauguuuacuauuuuauauguaauauauacagcauaucacuucacugguaaaguaacugguacuguuauaaucaucaaguguuuuauauucuucacuauguguuuuuuuuuggggggggggagauggagucucucucugucacccaggcuagagugcaauggcgcaucucagcucacugcaaccucugucucccugguucaagcaguucuccugccucagccucccgaguagcuagguuuacggucacccaccaccacgcccagauaauuuuguauucuuaguagagaugggguuucaccauguuagccaggcugaucucaaacuccucaccucaagugaucuccccacuucaaccucccaaaguacugggauuacaguccugagccaccacaccgggcccuucauuguguuuucuaaaaacaauuucugaucaccuggggauuauuacaacagaucuaacuuuaggaaaguaaguauuaaauuugaauaagauuauauaauagggggauuuaaauuaaaugccuaacagaguuucauccaaaauuuuagaaugugaauucaaggaacucuugacccuucugaaguaaauugaaagcauuuccacaguguucacacuaggauguagcuagccaacucacagcugccuguccucuuuuagcuuccaaugaaaaugcuuuggaaaacauacacauagaaaaagaaauucucacaguaauacuuaaaccuaagaggcuaagcaaucaggcuuuugcuaaaaucuaggaagaauguuaccaacuguagugccaauggaaauggauuuuuuaaaccauuuuaaaugggacugaaacaguuguuuccauuaaaggaaauguugcuaagaaguaaguuggagggaggccuagccacccccacccuaaucccuagugauggaauaguuuaaaaccauaaaagcuacaauaaccagaaaacucaacugcuaccacccucacugcagggagaccugaauucagaggcagccaguguuugccuucccuuuuucagaaaacauagccucacuacuuugaagaaaauaccaguaauuuccacacaggagaaauaaucauugacuauaagagaaaucaacaauguaguaauaaacuaauuauaaaaaauugaaaugauaguaauauauaucauaauuuauauucuugacuauaauagcugguuuucguuguuguuguuguuguuguuguuuugaggugggggggugguauugcucugucgcccaggcuggagugcagugguguggucaaacucaccacagccucaaccuccugggcuucagcuauccuccaacuucagccuccucaguagcugggacuccagaugugugccaccacgcccaucuaauuuuugaauuuuuucuagagacgggggucucacuauguugccuaggcuggucucaaacuccuagauucaagugaccuucccacuucagcuucucagagugcuggaauuacaggugugagccacugcauccagcuauaauagcuuuaaaagacuauuuugaaaaggaaggaagaaaaaucaaaagaaucuguaagaaauguagcaugaauaaagcaauauaagagcaaaaaauaaaaacaaaaucagguaaauuaguguaucuaggaguuucuuugaauaaguuuaauaagauaaacacuugaaauaacuaagguauaggguaagauagaaaaggacugaaaaaaaugaaaaacaagaaaagaguuuaagcaagcaguacuaaauuuaagugacauagaaaauauuaaacuaccuauaauuuuuauuaaaaaaugggccaggcacaauggcucaugcccguaaucccagcacuuugggaggccaaggcaggaggaucauuugagcccagcagaccagccuggguaacauagcaagacccuaccucuacaaaaaaaauaaaaauagccgggcauagagacaugugccuacagugccagcugcuugggagacuaaaacaagagaaucaccugagcccaggaggcugaggcugcagugagcugggauuaugcaacugcacuccagccugggggacagagugagacccugccucuaaacaaauuaaaaagaguauuuucuaauaauaucagauagaccuauuuuuuccuuuucagcuaaagauuauauuauuuaugcaaugacauuuccccuuucacacaauacugggaucugucuuuggaauacccagacauguacaucaucuuuccauuauguaauuuuaaaaauauagugcuuuaccaacuacagcuguaauaaucagauugucaaccagauugccaucacaccgugaaagguccuccuaaaaauauaaaagcuagagcuauuccugaagauuguagcuaaauacauaaaauaaaaucacucuccaaaacgucauaacuuuaaaagcacccaaaauguaauggaaauguaaaaugauaaaguuuuuuugaaaaacuauaaaaaaauuaaaaugcauugaaauguauuauacaaauauuuaccuuaaauuuugucucuuggcuacguguggcaacucacgccuguaaucccagcacuuugggaggcugagguaggaggauugcuugagcccaggaguuugagacuaaccugggcaacauagcaagacucugucucuacagaaaauaaggaaaaauuagcugggcgugguggcaugugccuauagucccagcuacucaggaggcugagggaggaagaucgcuugagcccaagaguuccaugcugcagugagcuaugauugugccacugcauucuagccugggugacagagcaagacccuguauuuaaaaaaaaaaaaaacucuugcuauuagaagagaguuuuuaaauuguauuuuuaaaaauucuuuuaucugcucaauuguuagcuaugaacagugccucugagaaguaugcuaaagguucagcuccuuuuuuuuuuuuuuagcuuuuugguauuuuucuuuuaaaugaugaugugcccaaacaguauuaugaaacuaaggguacauuuuaaauguuuacacugaacagauuaucucacaauaccaaguuugucuuuucucuaaacccaaggcucuuacauucucuucggaaauggcaccaccuuccucuaguugauauugucagaacaugcacagcacagccucucacugcagugcuucucaaaauuuaaugaucaugccaguccccugggauucugcuaaaaugcagauucugauuuaauaguucuggccugagcuucagauucugcauuuccaacaggcuuccaggugaugccagugcagcuagucuguagaccacaguucacaucacaaagauucugugcauguccucaacucugguuacauaucaaaaccacuggaggagcuugacuuuuaaacaucugucugcccucucucugcaccuugugauaaugaggccucagaaucuauauaacuguuuguaaucaccacaugauuccuauccacagccaaguugaaaaccacugauuaagcaguauauuauuuuauuguggcacucaggcaacccuucacuacaccuuuacuacacugugugcuuuuaaaaacauauauguugauguaaacgaauaguugauuuuagaaacaucuuauguaaauugauugauuaacaacuuggaauauauuauagaaaaauaauauuuuaguaaaauuaacuauaagauacaauuaggggaguaaggcuauugaguaggacuuccuccuaguuuccauuuuuuguggcuggcucuagaccaaaugucuccgucagugaagugucccuuuauaaucacccacccuucuuucauagcuuucugcagccucuguguaccuguuuccuuaggccuccacuguggcacucaggcagccccucuuuacccauguauccuguauucugugcuccguuacuugcugcccucccacuaucucccacucaccuaaaugugaacuuucucucugugugguugauugcacaugccuuugaagagaaguaauuugauaacacagguuuguucucggucaugauggagauuuugucuuccuggaguuuuuuuucuuuuuuguuuugagauggagucucgcucugccacccaggcuggagugcaguggcacgaucucagcucacugcaaccuccgccucccggguucacgccauucuccugccucagccucugccucccaaguagcugggacuacaggcgcccaccaccacacccagcuaauuuuuuguauuuuuaguagagacggaguuucacuguguuagccaggaugguguugaucaccugaccucaugauccgcccaccucagccucccaaagugcugggacuacaggcgucagccacggugccuggcccccggaguuuuuuuucuaucagucuuugcuuucucaggaagaccaugugguccuacuauuauaagggccaguucuugacauuuaaauacuuacuguauguuuaaaguaugcugucaaaccuacuauaaagcaacaguaguauauaggggcuguuauguucccuaaagaauggaauuuuucauuuacuaagucagccauagccuugccagacaccuagagaaugaagcaucucuuuugguggcucgguuaauguccuuuguggaaggagccagauggagucgacugugugaaguuagauaaggccuaggugccuaagaagugggaccaagaccaagagaaagaaggaaguaggaugacaguuugguaugggaacuaagauaaccaguaggauggcuguguaguccagucuauauuugaauagucuuuuuucccaugcuaaaaucccgagaaauucugugugguccuguuaaaagggaacugugucucuuacaaaugcuuauuaucccaaauaaaucaauagaacuuuaaauaauauaaaaagugaaguaugaauucucagccaguguugauggagagaguuauuuugggacugagaagucauuccuuccuaaauucugcuccugggaacaguucccuuaagcaguuccugauuuuugcaucuuuaacacuucuuuuaaauuaauuaucaucuaauuuuuuaacauaucuguacuuucccaucucucaaguuucuuagacucuacugaggucaggguugagauauauaaggcuucucugauucaagggcacuggggaagaccagugcaauguugcgacagagguauccauuucuauauacagucggccccauuuuaacucacuguaacaccagauacauuuauauaaugugaggcuuucuccuucagagcaacaggauauucugugagguauuuggcagugauaauuagaaacugcagguaaacaauguugcugccaguuccgcaucugaaaguagaacucccaagucauugguguacuggggaggugcugacaguuaaaaccugcuuagaugggcauggggggagaaguaccccaaaguugagggagcucacaucaauccuaagcuaacauauucacccccaacacaugccccaucuuuuuaaaaaaaaaaaaaaaaaaaacuauuuucagccacagucucuagucacuuuggauuuaacuucaaauagcuuuuuuucaaccaugccucuaacuuggcacagcucugagaaaaaaucccguaaccaagccaucuggguuggauaaaacagggagcuuuucuauuugauuucucacauuuuguuccucuuuguuuuuaaugauggaguggggggggaaucauuaugaaguaaccaaauuauuggauaaguuagugaaucgggaauagaucuuuucaacucuauacugucucuaaaaaaaucuguaucagaggaucucucuguugucucugaaaugugguguagaaugaauguuuugggugaauugacuugaguggguaacaaguaauggucagaaaauaaaguucucauuggguggucugaaauucagcaguguuuauuucuuuuuagacucagcagagauuuuuuuuuuccagugaagcauauuuuaacauguuaugcucuggauuuacuuaguaugguuuuaagugaaucauuaggcaugugugauuuuucauuuuuucuuaaagaccagcauuaauagcuucauaauucaaagagucuguaauuaagagaguuugaagaguuguuuaaacucuguuaacuuugaaaaaauaggcuauuuuauaugugauaaacugcugcuugcaguucagaguuacuuguugggauuguguaucaauucagaccuuaaaauguaagaguggaagccauccucugugcuugcuuuccaggcacagggugcuagguacugagaauaugaagaugaacaaggcacuuuugaucccuauuuguuguuacagucaaauggcaggggugguuguuacauaaaccaaccauauggauauguuacaaaggaaaaguacgguacacagagauuauauaugaucucuggaaggagucaggguaauuaggaaaggcuuucuuuuggaaguaaagaaauuuuauuuauacaaggcagugaauaauauguaauguaauaaaauacuaguaguuauauauuaaaucagacauugugcugguaaucaccuauucuuauccuucuauguuauacuaauccccccaugaaagcuuuguggguguaggaaaaccuugacaucaagguuuaugacuaucucaugucaaagguuuuguuuguaguaggcccuaaguaauguuuaucaaauuaauauaucacauuuuuucuuuuuauuauacaaguguaaauuauuacaauuauaacauuuaacuuuaucauugcuaucauaaugucucacuggucauagcauaacaaguuauauaaagguaucauuuaagaaaaauacuuugaaguuaauaugccauuacugcuauuaucuauggcucuuauaaaucuacagcaguguaccuccaaccauaccauauuuccuuguauacuuggggccuggguauuguucucaauuucugugauggaaauccugaggaucauuuuacaauugcagcuuacuuuuuguuugcuuuauuuguuuauccugggaucuaaaucaauuucauaaaaguuuucucuaagaauguaaaucauagaaucuuguuuuauugaaaauguuaagagaucaugaaaugaagcuaacucuucauuuggcauuaggguagguaaaugcauaccuauuaaaugaagcaugguuuucuugauaguaaauuuagccuaggaguauguucauuuuacaguauucacuccagcuuuaaauauccucuaauuccuuugagagagugaagcuaagaacucuaucacaugaccgucuggauuucugaaaugcuaagucuuuauaaaagccuuauggauuugaguaauaauaaagcaagugcuggcuuguuaaguaggcuaaucugauccaugcacuauauaaaucagaauguaauuuuaaauacuaugacuuuauaucgcagaugacuccauauucuucaaaagaacuugccuaauuauaagagcauauuuccuuggaaaaucaauuucuuuugauuuuuaaaugacuuuaagauuccauuugaggauuauuuuacuuauauauuuuuauuuuaaaugaaaauauucaucacauuucuuuagucacaaaaaauauaguagguaaagugcuccaguagugaaaaugauugccauuucauugugaccacuuucaagagaaguuuauuaccaaauaauuagaaaaaaaauggaaauuauaaucucacuuguuaaguuaacccaguucauucguucuuuuuuuaaaaaauuaauuuuuuaugguagggguagagauggggucuugcuguguugcccaggcuggucuggaacuccugugcucaagcaauccucccaccuaaaccucccaaagugcugggauuaaaagcaugagccacgacacccggcuuauuaauucuuuuaauaaguauuuuugagcuucuguuuugugccagguacuguacaaggcauuagauacacucuuggcaaagaaaacaaaguaagcaaaauaaaacaucaaacaucuuuguuuauagaguuuuccuacugacguuuaugcauguuuuuuuuuuuuuugcauuuuauucacuggccucccacucagaauauauuuacuugaaauauugugccuauuucuaacaaguucauuuaucugauuucuuggccuauugaaaguagaagaggauugcugcugaaaccauguagacugaaugcagaugauagcuaacaaauucacacagacuucacacuugccaagggaucacaauaauaauuuaaaaugguauuccucuagcucugccucugucugcugcaugagaacaucaauccuuccuacccuucauuucuuuccaaaauacuucccugaggauaucucaaccacaguugcuuaaaaugugguccccuucuccauuucucaaucauuguagcacugucacgaccaguccgggcauuagcccugccacagauggcagcuaauaguacuaugaccagugccuaacuaauucuggaaccacugcugcuguggccuugcucucucauuauuacagagauuaguguaaccucuuauacugcgguaggcuaagccgcuaugaucauaguauguaacaauaaugcaaugacugaagaacuauagaaaucuauuucuuuuucacauaaaaguccugguuaggugcucauuucaucaagaaguucuccccacacaacuauuaauauuugaaaacucagauucuacccaucuucaacacauagcuuccaagggugcucugcucccugccaucccagccaguaggaaggaagagcaaguggaagagacacccccacuucucaaaagccucaccucauauucuuuuggugagaacucaacagauuccucaucuaccugcaaagaggggcugaggaacccaggcccuggcucagccauuuucuagccacacucugucauucuaccuuuuauggacagcaguacaucauauccauacuucucuuguuucauuguccuagacuuuucauacuuguuucauuguccuagaccuuucauuauagcccuugcaccagcacccagaacuggugaaggcaccauuggucauagucuguuccaggucuucccuagacagcucccuuucccauccuuaaaaacaucuuuucuaaacauuuacugcuguugugaaauccacucaccuucccacucauguccagccuuaacagcuaauaugccgccuacugcagaguaaagguagagggccuaacccaugaacccuucaacucucuucuggacacagccacucuuuucuuccuuucuaucugucccagaggaagagguaucccugcuucuuucuugagcccacucuuuucccucuguguuccuaaucuuauucuugucuaucucauccaggaucuuguuccauuaaauauuccugcuuucucauaauuugaaucucauuaucucuccaguauaacguuaaauccuugagaacauaaacaugcuuucguguugcuucaugcuauuuuuuauuccuucuccuuaaaaaaaaaagauaucuuaaaagauuaauuuauauguacucaucauguuuuuaccuccuaucuacuuucuagccuuuugcaguucuuaccaaaaggaacacauuaagcuaugugcauucccacauucauucaccaauccaucaacauacauuuauuuacaccuuuuaugccaggcacagaugauucaucagugaucaaaauaaaagucuuugucaucaugggguuuacauucuacuagggaaaaagcagaggaagaggggaaagcaaauauuuguuagaugugcuuaugauaugugauacaugcuaaagagaaaaauaaagcagaauaaggaaguuaggauuuugauauuuuaaagaggguagucaggaaacgccucucugauaggagauauucgaacacagaccugaagcaagugagcaagcucuucacauggauaacugggggaaaugcauuuuagacaaggaaacagcaugcaaaaggccucgaggcaggagcauaucagcacauaccagggccaguaaaagagcagguguggcugaagcagaacagaacaggaggugcaguagcaggugagggcagagagauugcuggagccacguagauacacagggcuuuccaggcuauaguaagcaaugauugggaaccaugggagggguuugagcagaggaauggcaugauuuggcuucuguuuuaaguaggcacccugacuguuguaugcagaauagagucaaaaaaauggagugaccaguuaggaugccacugaaauaauccagacaggaggugauggucauuugagcugacgagguaaugaaaaaugauuucuauucuggguguuucaaagggcuaacagguuuaguagugcuggaaccuucuauuuuccccuccaguggagcuuuuccuccacucuccauacuucucugcccggcugcuuauggcccaggagacuggucuauacaggcuggaucaucucuggccuccuuuggguuuggcccaugagaggccccugcacaagaucagaagacaggaaaagcaugaggucacaauauuuguucuccuagcccccucacugccaccaccaguuagcugugaccguggcucucaccugcuuaccaucuuuggguuccaggaagccuuuuccuccccuaccuccuucucaccuagauauaauaccaguuccugcaguggcuugcucaggggcacgccacuauacuuuauugguguucuugaaccuugcacacagauuuauaaauaaucccuuuaguaagcuuuccuccaaauauugggauuuugacccauacugggagcuaggacgucuaauguacuaagaacagcagaacaucuuuuuuuuuuuuuuuuuuuuuuuuuuggaaacggagucuugcucuguugcccauguuggaguauagugucaugaucucaccucacugcagcuuccaccuccuggguucaagcgauucuccugccucagccucccaaguagcugggauuacagacacgcacuaccaugcccggcuaauuuuuguauuuuuaguagagaggggguuucaccauguuggccaggcuggucuggaacuccugaccucaagugauccgcccaccucagccucccaaagugccaagauuacaggcgugagccaccgcaccuggcccagaacaucuuuuuaaauuagggacgggaucucauuauauugcccaggcuggccucgaauuccugggccaaagcaguucuccaccucagcuucccauguagcuugaacuacaggugcacucacgcauuuuaaaaaucaugguuauuuacuuguuuuucugcccagugaaauguugaauccuugagaauggaacuaucauguuuauguuucuauucccaugccaugaggcagguaggauuugcuuacaguugaaucagugaguguuauuuuuaauguugccaccugaguccucaagaauugacuaaauuauguuuuacaugaaagauuaaugaaaaggaggguauaugugcauguguccccaucuuagugcuuauagguguaaacuucaccuuguuggauaauuaaguucucugggaucaaggaaauuuuuuuuuuuuccuugacuuguguauaguuaucgacuaggcuacauagaagggaggugcagaauauucaggcaauuccuauguuaugugagccuccuauaauacaagcccccuuucugaaaaugaacugucaucuggguugaaauugugcaccacugggaaugggggacuuguagauugacaagggccaaagggacuuuuaaggaaauauuggguauagcuuucucauuauucauuguucuugugaagauaucuaaacaacaguuuguugauuuuaccaauuguuuccgaacuggaaagaaauacgauuuguucucacuuccccgauaauauauuucuaucaauaaaguuaguaaccuuuuuucccaguagcuuaaaaggugauuugugauuuauuaaagucacuugauaaauuacugacuucuauuuacauauuuuaacagcaauucuuuauauuauauuugguuacauauguuuauaagauaguguauugguuuccuuucaauuuuuugguauuaauacuacauucuguuaucaauguuuuuuguugaucuaaagaauauuuccuuuaucuucacauacauuuagguuuuguguuuuuguuuuuguuuuuuuuuuuuuugaccuugacuucuuucugcuauuucuuuugagcaaaaccuuaaacagcaggcugaauggccuugagguguaguuuuaauaaaagcaucacugaguaaucauuugguauaaacucccaaccaaauacauuaauggaaaaaaagaaagcaauauauuuucaagguuaacuuucuuuaugguugcuuccaugaauaauacauggucauugaauuuauuuaauuuuugccuguauucaacuauauuuaagguucauauuucugaugagaacaaaaaaaaucauagguucaagagaccaaauugucaaagaauuuauuaauuaaagacaaauuaaagccaugggguuugcauauguagaacuguagucaauucaccaggaaaaugccuagaaauacccuauugauuagauaguuugcuguuggguauuuaacuaaaaguugaagccuuuucucucucuuuuauuuuugacacuauuaaauauucucacaaccuaaacagauaauuuuuacuuucuuaggaaaaaacauauauuuuaaagcacauauuuauuuugugaguuuuaaaauuaauuugaugacuucaucugaaaauugaauaagcacuuaacugaagcacagcuacuuuugaaaucuucagaaugugcagcagcucuaauucauuccacaauucgucauucagggaaugucagcaaauggcuaccgucuguacaguccuuuugccucuacucaacccuauuaacaaguaaauuaaaacaauuuguggagcauuacuuauaguuguuauccccuuggaagaucacaaccaucaacacaguuguaaaauaaugaaaacgugaaauaaugaaaaauagaaaguaguuacuuaaaugcuuuuauuuuucugugaauuuauuaaauuuucugugaagugagccauauuucacuuaagccuccacuuuccugggaaaggaggugauaauauguacacugaggucucugugcugaguacuggagagggagagagccaggaaauccuagagaacuggagagacuggucugauggcagccgcuuguuuaaaaagcugcauccuuugggcuucaagguggacuguuccuccuucagccauuuccuagugcagugaucuugagcaacuuauugauuuuggcccuuuguaaaaugagaggaguucaccauauuacuuauuuucaaacccuucucauagaacacaaggguuucuuagagucuccccaagagucuagggcaguauaaaugagagacucagccagaacaguuucucuuguaauguauuuacaggguuuuuuguuuuuuguuuucgguaaaggguuguuuaguuuaaaaaagcaugaugauuccccaaaucccugcuagcuuaacaaaaaagcacacgguucaguuuguagucauuuuuuccuucguuucuuuuuaggagggaggccuauagucaggauugacucuaaaagauaaccuuaugggccgggcgcgguggcucaugccuguaaucccagcacuuugggaggcugaggcaggcagauugucugaggucaggaguucgagaccagucuggccaacauggugaaaccccgucucuacuaaaaauacaaaaaaauuagccaggcaugguggcgugcgccuguaaucccagcuacucaggaggcugaggcaggagaauugcuugaacuagaaagguggaaguugcaguaagccgagauugcaccacugcacuccacccugggcgacagagcaagacucugucucaaaaaacaaaaacaaaaacaaaaaccuuaugaauacagcugagaagugaaaguacuaaauuaguguuuggauuuggaaggacugagggaaugaacucauacaagagcaucauuuccucuuuuagaaacagguagggaggggccgggcgcgguggcucacgccuguaaucccagcacuucgggaggccgaggcggguauucauauuucacauuacaauugcuucagaaguuauucauggcuauuuucuauuggguuguucauguaaauagacaauugaaaaagcuauuugaguuaucauuuuauauugccugcgaaauacccaaacaagcaucuguauuaaaacuaauaggucaauuucccaguuauauauaaggaccuaaauuuuuuugucacucaugaggugagaacaaggaaagugguagucauccuuggacccuacauugggcaguuucucacaucuucucucucugccugguauaauggguuaagcaauuccagagucaggcaaccuggacagaaauccuacccaaaugacuucucuuuuaccucucugugccacuguuuucuuaucgaugauggaauuaauuauauuuccuacuuuguaaagguuguuacagggauuaaaugaauuaauuuauguuauauguuuaucaacguaauuccucgcccccugguuggcauggcauuguguauuugcuguuauuacuacacagaaaagcagagauuuuaaucguacgugaaacuccagugcacuugagagacaagaaacucuguguacugaggucgaugaaaaaauauaaauuugggagaauuaacucagaaaacauuaaucuggcaugcuucuaugagaaggauaggucccaagagaaggcagagugccagggaccauucagcaugcccugacucagaagagauuaaaacguccugaacuaccauuguggaauuagaguggaagaaggagaaagaugugugagagauuacaggcuuacaucaggggaagaggaagaagauuaaccuuaugcuguccaccuggguaacuagcauuauggcugcaucauuaauagaaguaagaagcccaggauuguuguuugcuuucugaacaauuuauauauauugggaaauaaggaauauaaaauuuuaaagacuaauaaagauuaaauauagucuuauacuauauuauuuauguaacaauuaaauagcuaaggccaggcaugguggcucaugccugcaaucccagcauguugggaggccgagacggacagauagcuugagcccaaggaguccgauaccagcagggcaacauggcaaaaccucaucucuacaaaaaaaaaaaaaccaaaaaaaauuuagccaagugugguggugcacaccuguagucccagcuacucgggcagcugaggcaagaggaucacuugcacuggaaggucaaggcugcagugagucaugaucguaauuguaccacugcacuucagcguacccugucucuacaaaaaauaaaaauaaauaaauaacuuauagucuucauaaagaagcaaguagauaacgucuuuuaaagaacuuucuuccaauuaagaaaaauauuuccuguuuucccaauuccuugauuuagauuccuagauuauauuguaucaagucccagagauuuguuaaucuuugcuccugcuaucccaagacuguugauguaguaauguaaagaacucaaacauaaaaccuguugaaaauuaaaccaucacuuucugcguuugacccaacauacuauguauccagaaauacauacauaauaugaaauuauuaugaaauccagaaauacauacauacauacauauuauucagaguugcaaauaauuuucaucuguuguuucaugaguauuuuuauuauuuccagguucgauggaugauguacuggauuguuuuugcucucuauacugugauugaaacaguagccgaucaaacaguugcuugguaaguuuuacuauugagaaggggccagacuacagacucauaaucagguguccuaaguucuuauccugcucuugcuauuaacugagugauuuucaucagguuaccuaauuauccacccauuuguuuuugucaucugcuuucccauagaacacuacuuuccuuuuaguccccaucaaauaaaggcagcucauuuuccuccccauacgccgcucccugcucaccucccacacaccuucccccaguaucuuggaauagggaaaguugauugucaucauccuuuucugcacugaugacuucagaacauuuuccuguaucacuuccuaaaugacuccacuuuugaagcccacagcaucugguuuuagcaccccucccuauccuauccuuaaaacucucaucuacaaacauuugaacuggaaaacgucagcacccacguggacacccacucagcacuagcuuccuggcugcucuguuccaaauagacgaggcaaaauuaaaguguguuuauauccucagggauuugacauuuuaccaaggagcaguacuuaacuggacaacucaaaucucccugugguguauuucaguagugcauuuccaucuaaacccugcaaucacuuugagaacuucuccuuucaaaauauuuugguuuacuaccuugcugauaucuucaucugcccuugacgcacaaaccuucugucuaaauuagccuaacaauuacucgucuuuuuuuucuuuuuuuuuuuuauacaaggucuugcucuguugccuaggcuagagugcaguggcacgaucucggcucacugcaaccucuaccucccggguucaagcgauucuccugccucagccucccgaguagcugggauuacaggcacaugccaccauggccuggcuaauuuuuguauuuuuaauagagacgggguuucaccauguuagccaggcuggucucgaacucccaaccucaggugaucugccugccucggucucccgaagugcugggauugcaggcaucagccauugcacccagcuaaaaugacucuuuuuuacuucuuuaacugggcugcuaaauucagcugaaaaaauuaaucagcugcucacauagguaucagcuugaaccucauucuuuuuacuugcuccuggucagugucuacuuacauuuugucugggucuguuucaaaccuuuacuauucucuccuuaagcugucuuucccauuuugcucuucuccuguucauguggcacauuagguccuauuggauuugcaagaaaaaaaauagaagucuucauacuaaaauauuuuuaacaaccuucccuuauuugcaaacgucacuguaucugucuucugauuugaaauacuguaaaaauuucccuuccugugccccaaagcucauucauuuaucuguuauauuuuugguauagggguuugguuguggggggucucuuuguuuuuaagugacagagcacagauccccaaccgugcuacaucgaaguuuccaaguucucuuuuuaagacuucauuuuuuucugauugcaaauguagccuauauauguuauuuaaaaaugaacgauguagaaaauguuuaacaugaacaacugaauccagaaacuccuguaauugcaguguggcagagaccucuuuguugacuacauaguaagucauccucacugcucucuaccugcccaccuugacagaagaacucaaauuugcucagcuaucauuuauccuagugauaaauggacuacauuuaugugguucucacagacaacaagauacugagccucucauuauauauuagugaacuuuugcuguggcaaaaaaacaaccauaaaaguacaguggcuuagaaaagcaaacuuuuauuucuugcucaagcuacaugagggcaaaugguugacugcaucuuugcuggggucaggucacuuuugcuguuguuucuguuguuguuuuagagacagggucuugcuccauugcccaagcuggagugcaauggcaugaugauagcucaccgcacccuugaacuccugggcugaagcaauccucccaguuuggccucccaaagugcugggauuacaggcgugagcaccucaccuggcaccuuaaaccaaggcugaagaagcagcuguucucaugccagaaggcaaaagcuuaaagcaagaguuugaggguaauggguaauggagugagggagucgaaggguguucuaaagcuucugcuugcaugugacauguaucauguucuuuucugcuggccaaagcaagcaagucacaugguuaaagccacagucauugguugaggaaguauacugggccaacgggggaggcccacuguaacacuuuguauuuuccuuggaagugaacaguuuaggucugcagagugcugcaauucuggccaaaugaaauuggaagggauauuuuuucggaguucugaaaaagaugaagacguguguguaugggguagacauugugcacuuggagcauaugaagucauucucugauaggcacaacuaucauaugagauaggucauguacuuccaugccaguuuggcucugcagauaggguggccauaccuugugcacuggauaaaugguauuagugccuucucuuaacugcugcauucaguuuggcagcuuuccuaugcuuacuacaaaggaagauucuuguauuagaaugaggggggaaucucucaggucacacauucaugaacugaucuauaguugaaacaagauuauucaaacacaguugucuccugaucacugacuuuuacauucaaaaacuuagcauaggcugggugcuguggcucacgccuguaaucccaccacuuugggaggccgaggugggcggaucacaugaggucaggaguucaagaccaggccuggacaacauggugaaaccccgccucuacuaaaaauaugaaaauuagccaggaguggugacgugcaccuguaauccuaacuacuggggaggcugaggcaggagaaucacuugaacccaggaggcggagguugcaaugagccgagauggugccauugcacucagaugacaagagcaaaacuccaucucaaaaaaaaaaaaacaaaaaacagcauagugacugaacuuuuuaaaagguguuuuugugauuucuacagugguuuguuuuucacuggcaguuuauuuccaaauguuuuucuuauuagguuuccccuguacuaugagcugaagauugcuuuugucauauggcugcuuucucccuauaccaaaggagcaaguuuaauauauagaaaauuccuucauccacuucuuucuucaaaggaaaggguaagauauauaaauuacuuccguaaauaauuuuuuagaaaugccuaagcggaggccaggugugguggcucacaccuguaaucccagcacuuugggaggcugagguggguggaucacuggaggccaggaauaugagaccagccuggccaacauggugaaaccccaccucuacuaaaaauacaaaaaaaaauuaaccagguaugguggugcaugccuguaaccccgguuagucaggaggcugaggcaggagaaucgcuugaacccaggagacggagguugcagugagcugagaucucaccauugcacuccagccugagugacagaaugagacuccaucucaaaaaaaaaaaaaaaaaaaggccgggcacgguggcucacgccuguaaucccagcacuuugggacgccgagguggguagaucacuagguccggagaucgagaccauccuggcuaacacggugaaacccugucucuacuaaaaauacaaaaaauuagcugggcgugguggcgggcacccauagucccagcuacucgggaggcugaggcaggagaauggcgcgaacccgggagguggaguuugcagugagccgagauugcacaacugcacuccagccuggacaagagagcgagacuccaucucaaaaaaaaaaaaaaaagaagcgccugggcugggugcaguggcucaugccuguaaucccaacacuuugggaagccaaggugggaggauugcuugagcccaggaguuugagaccagccuaggcaauauagugagaccccgucucuacaaaaaaauuaaaaauuauuuggucauggugguacacacuuauugucccaugccacugcauuccagccuaggcaaaaggaagagacccucucucaaaaaaaagaaaagaaaagaaagaaaugccuaucaacacaugcuuaaugcuauaaaauuaaugaaacuauuauagggagaauguucuaguuuggggcuuauuaacacuauuuuuaaguaaaacuaacaucuguggcuuuuucccccaggagauugaugauuauauuguacaagcaaaggaacgaggcuaugaaaccaugguaaacuuuggacggcaagguuuaaaccuugcagcuacugcugcuguuacugcagcaguaaagguaauuguucauuuaccuuuuuaauccaaugucauauuaagucaacaaauaaagguggcuucuuauuucaaaccauuauaaaauuguggcauuuugcuauauuuauuuuucuaauacuggaaaacaaguaaauaauuuuaaagauauuuuaauuuuguguuuuccauacuugauauuuugaaucucuuaauucaucacaaaaugaggucguuaauaaauaauacauaccugaaaaugucauuuagucauaauuuucccacuuaaucaccuuaaaguaguuugaguaaaucaccugauguaaagaugaccauuguuuauuucucugucuuugguguucuuucucucucuuuuuuucugucucuuugucaauggcaauaucuugguaggauuucuggcuuacuucugcaccucuacuucaaucaauuugagguaaccgauuauucaaaauaaggcaugaaaaagucuguucuuaaaacuugguacuuagccaguuacuaaugucauuuguuguguuugcaagccaaguuaucaaaugaauguguucuguaaaaauuugcauuaugguuuuggauuucuuugcauguuguaauuugugugauuuauuuuaaauacuuuagcauaauugauuuugguguguuugguauggaaagaaaauagccuucuguguuccuuaguugcuucauguauaaaauggggguaauauaccugugagaauauuuaaaagcacagugcuugcuugcauauaguaggagcccaauaaacauaaauaucaugugucuaucuccauucaaaauucaagugaaaauuuaaguuuuuugcuauuaaauuaaauugagauugaauaguauucugcuuucaaguuagucuguuuuaguuaucuugaacuaaaacaacucuauggaaauaaauauuccaguugaguggugauuuuauauaacuaauagugaagggauaugaaaugagggcacuuucacuuuucagagaggucuuugacucaaguaucaaaaugaauguaaugaacaagaaggaaaauucaaauuauauaccuaauagcauuacauugaggguuaaauggaaguuuauuaacuaugcagcacuauacauguaagauaacuauauuauuaaugauuauuaauggucagcacuuuaauauagcauaguuuucuuguuauuuggcuuuuaaaggcuuuuucuuuuauuaggauagguuuauaaaugaauacagaaauagcaaaguuuucagcuuaaaggacuauguuuuauuuuagaaguucauuuuguuuuuuauuucuugcuuagugaaaaugcauuccugauuuccauaucugcuaaaaaagauuauccaggagauaauccagccacugggaauucuaaaaagagggaauagaugcaauuaucaaagaaauaauacaauaauauuucccagaacugaaggauaugaaucuucagauugaaaggacccaccaaguacuuagcacaaugaaugaaaagaaugacugacucuaagugaagucauuggguaucccaaaacaccagugauaaggaaagaauucauaaagauuccaaauauaaaaagcaugucacauuuggccaggcacaguggcucacacauguaaucccagcacuuugggaggccgaggcagauggaucacuuaaggucaggaauucagaccagccuggccaacauggugaaaccccgucucuacuaaaaauacaaagauuagcugggcguggugggggggcgccuguaaucccagcuacucgggaggcugaggcaggagaauugcuugaacccgggaggcggaggcugcacugagccaagaucacaccacuauacuccagccugggugacagagcgagacuccaucucaaaaaaaaagcaugucacauuuaaaugauguagaaucagaaugacauuaaauuucuaaacagugacagugaaagcuugaagacaguaauaccauccaugauaccaucaugauuuucacccucaagaacuauuaacagucaagcucucaauuguguuagcuuagaauuaagaaauuucuuaauucuaggcaugcagagucacaagauuuaccuacugguuaucuuuuguccaggcagauaugcuccccagagcuagggaaugguccacaaaaaagaaaacccaugggaucugggaaacaagucauucagcacagaaaggagaugacaaaaauucccaaagagaacaccacacagcaaguccaaagugcagccagccaaaacuggaugugguggaugaaaggugccaggagggaugucucugguagaccuacaaagccaagaggauuuuucgugcugcacagggaugauacuaaaaccagugagaggcugggcgugguggcucacaccuguaaucccagcacuuugggaggccgagguagguggaucaccugaggucaggaguucaagaccauccuggccaacguggugaaacccaguuucuacuaaaaauucaaaaaaauuagcuggacaugguggugggcaccuguagucccagcuacucaggaggccaagacaggagaaucgcuugaaccugggagauggagguugcagugagccaagaucacgccauugcacuccagccuaggugacaagagugaaacuccaucucaaaaaauacuaauaauaaaauaaauaaauaaauaauaaaaaauaaaagcagggacucugagggcaugcuucaaccagaugacacauuggcuguaggccacuggugcccauguagcugcacaugaucccugagcaccaugaaaaaauacauuggcggcaauguaaagaggaagaggguaagacaaugaaaaaggaaaaaaaaaggcauaaucauuaacucuggggaaaaaaguuacauaagaaaugaaauaauggaguaugacugcauuuacauuauaauaaugaacacagacuaaggauuuaacaacugugguuuugccauauugagaguaugggggaaagagaaggaaaguggaagagaacuaaaauccucauuuguuacaguaggaaaguagaggguuuaaaggaguugcaucggcagcggaugaagaggagaaggagacuaagagcuuguugcuuuuugcuauaaaauuuagcauuuuugauuuugcaaaucaagugcauguauuuauuuacacccaaugaagaugcuaucugaauuuuucauauuuaaaagcauccuucaacaugguucuauggagaaaaacugaaaauuaaauuucaaguugaaaaauuauuuagagaacacauuuuagaauauugucucaaaaaacaaagaagcauacaaaucccauuuuuccuccucacuuuuaacauuuguguauaauaaucuauuauucuccuauuuugugagacaccauuguacauauugugacuauuuugugcaguacuuguuuuauuuugacuuguguuuacuacucccacguagggcaucagcaguccccacucuauuaucuuauccucauucccuuccucauuuauuuuuaucuuacacuucgccuccauugguauuuagcauucuacauauuauuuauucagcaucuguuuauuuaaugccuacugcauaguagguacugggaauguagcaaugaacaagauagauauagcccucaccugcacaaucuacugucugucuggagcuaaugucuguauuagcuagggaauagcccacaaaaauuuuauuucuaacugaaaauuuuauuucaccucugguugauaagaccccacccauggcugggcgcaguggcucacaccuguaaucccagcacuuugggaggcugaggcgggcggaucacaaggucaggagauugagaccauccuggcuaacacagugaaaccccaucucuacuaaaaauacaaaaaauuaggugggcgugguggugggugccuguagucccagcaacucgggaggcugaggcaggagaauggugugaacccaggaggcggagcuugcagugagccgagaucgcgccacugcacuccagccugggugagagugcaagacucugucucaaaaaaaaaaaaaaaaaaaaaagaccccacccauuacccuucauuauuaaaauaagcauuaucucacaggaauacuuuucuguaaaaaugccacgaaaacaaaaaugugucuauuucauauaucuauuuuucuggcucucuugugauuuauucuuuuaauuuauacguuuaacaccuuaaaaucacguguuuuaauuuauacguuaacaccuuaaaaucacguguccaccccaaaggcaguaauauugauaaaaaucaucuaagucacuccugcaaaacaaguagaagcccauauccccuaaaugaaaucagauacuggauuuggaacuguucccauuuguuugcaauguugugauucuuuuauccauaacaucccuguauguaagguaaccuucauuauucucaugaguaccggaauguuggagaccccauccuggagucuauauuauucacuagcauauucauuaaauaugcugaacauagcguaauguuaacccuauuugccucaaguuauacugugcuuauuuuaaaguacaugaaauuaguuucaucucugcagaugucaaacaagggcauugucauagaagaaucacugaaccagacacuucauacugaagaguaaauugaaacugaaauaggaaauaggucagguuuaaggagaagcugcaagaaagccaacaguaagaucugaaaauuauuuaacauuuuuacaauauauaguuuguuuaaaguaucuuucaggcuuaaaauucuuggacucuuggugugaccuuugaagaacggguaauaacgcugacuagguuucccagguugaaccaccugagcauguuaaaggugaaaauaggaaucuaaucagaacauuuauuacaccguaaagcaauuuucugaaaauguuacucaguucuaugaccucauuaccaggcaucuguucgcaaggucacuguacaaguuuauuuuggcugagcaaagcauaaacauuugaaggaccuucaaggauuuugcugaggauguacagcauuccauagcuuuucacaugagaaacauaggugguuucgugcagaugagcaacacuacugccagaugaaggacagaugaagaaaaguacuguuaguuguauuaaccaugucuuugaauuucucuggcagccuuuuuuuggugaauuucuuuagcagauauaagaaaucaguuaccacagacuuuugagcuuuacagguaaaauuguugaaaucuaauuaacuuuaaaugaucccgauuaggucaaaaauccgaacaucuuacugucuaugacuuucuguuugugaauggcuuugaggauauacagcuuaguauuauacacuuaaaaaaaaagggaagaauguuuguccagacaauggaaaaagaagguuguacuauuuuuccuaaaaucuagggaagcagaaugguauaacaaacauugaaugcuacagcaauugaguuaaucuggauuuuuuuuagugcugauuccaccacaaauuagccacgagauuuugggcaaaucaucugcauugaucuaagcauuaauuuuucucacuuguaaaacgaagaggugaaacaugauuucuaaaaccccuuauaucucuaaaacagugguucucaacuagaggcaauuuugugccccuacccuuaccacgggacauuuuagguugucaccacugagagggggcugcuacugguaucuagucgguaaagaauggucagggaugcugcuuaauauucuacaaagcacaggacguuccccacaacaaaaaauuaucuaacaaaaaauagcaagaguguuaagguugagaaacugcucuaaaaguaugaugagucagaaaaaacuaaaagaauauauaaauauguauaaguaguuuuggugguagguuacaaauaauuuuuacuuccuuuuuaaaauuuuucuccauguuaucaauguucuucaguaaauacguauugcuuuaaacucacuaaaauauuuuauucaccuaaugcaaaugcagucaauuccauucugggcuugaucagauuaauuguuaaaugugcauggggaaaugagauuucccuaaaaacugggaacuaaccuuaucugcaauuauaauguaacaucagggaucaacaagaaauagagcuuaguggcuauucuuuacugaauaguauaauaagaauuauucuguaaaagaauguuuugugcuuguacgauuauaaagcauugcugguuauauguuuuuaaaucugugauuuaaaaugugaagaaaauaaagguuuuauacaaaggugcugauaaacaaaauaaguucuuauuuaaaacaaaauaacuaauguuaauguaguguuuaaccaggaaaugaaguauuuaaacaaagacagcauuauuugaguguaaagaaauuggaauuacucauacaugcagggccccuuuuuauggaugccaaccacgugcuuggauacuugaguagacauucagauguccuagugcccuuggauguaaaugagcucuguguggagccaguguggggagcugcuucucagcugaagaaucccuuccagagccugagugugcuagcucuggacccagcccuccugcccagucagccccugcaguauucucaguuucuuacagaggcauuugggcccaccuaaauccaaaaccugagaauuuagugccagcugaaguucagaugguucagaaacaguucugcucacgaugaucaguuucaauguguaaaauauucuacagaauacuuaauuaccuggacuuuuacauucucaucauaaucucuguuacuuugauuguuaggaucaauuuuaacauacacagaguacagacaauucugcagagaauaggaucuaaagugcugaaauauggaauuaucuugugaaugguaaucccgccuuuccucuuuauugacuaagaccgcuguuuccauacagcagacuagacuagaacuuuucuuuuucuuucuuucuuuuucuuucuuuccuuucuuucuuucucucucucugucucucucuuucucccucucuuuguuucuuucucucucucucuuucuuucuuugucuuucuuucuuucugucuuucuucuuuccuuuuuuagagacagggucucgcucuaucacccaggcuggagugcagaguugugaucacagcucacuaaggccucaaacuccuggccucaugugauccucccaccuuggccucccaaaguguuggaauugcaggcgugagccacugcaccagguccuuuucucauuuuucuuauacuuuugucuuaauauuauauaaauuaaauagaagaaaauagauacacaaagcauuauuaauuuaaacaaaaccaaucccuuuuagcauuguuauuuacaagugacuauaauguucuauuuguggccucaaaaauagacauuuuuauuuuauugaugggaauaaagcauuagauacaggacacaugagugagaaauggauuggaaauucuuauaguaugccacauauugacuaauuuuguaauauuaaagacaauauuuuaaaaaaggaaaaaagucacccaucccaucugccuaaacauuguacuguuguuaguuuugcauuuuuccaugccuacuuauagccauacugcauacuugcaaucauauuaugcaugugcuauagaauucugggguagagggaagauaucuccacuuaccguuaauauagcaaacauaguuccuuuauuacuggacuuuuugugcugaagauguaaaaacuggaaggaauaagguagucuucagaagugauuacuuuguaauuauacccauccuuuaaacugguuacauuggauacauguaauuuacguaauguuuucaaaguccacaauauugcaccaauuucucucuuauauuaguuuuauucuggauccauaaaaaauauacaguggaaaguccaauuuuccaagguaauaauggcuguuaaaguguuggagguucucaaagagggcucauauucccuuuuugcuuuucccuacagugccuggcuuuccugaaagccuugaagagguugauaauacuuggguauugauaauaguagcauugguuacucaagagcuaaauuuaaauccagccuuuagauagaucacccagauaccucaagguugggccuugccuugcucauguuuauucugaaccugaagcaaacccuugguaggugguguagucuauccauggagaaaccuguggccauaccuguaguuugcugcugaaccucugcaaaaaaccuacaguguuuacauuaaaacaugcugccaucuauggagaagucuuuaacagucaagaguaaugaaaaagaagggacauaaaaagaguauuuaguuuacuuauuacaugcucaauaucaguagcauaccaggcacaccaggagaauagaagaagccuaagauuugucccucuccucuagugucuuaaaagucuugcucuggaggcaaaauauaccuaucccaacaauagaaguaacaguaguacgugaguucauuugugagguauaucccaagagauuuguugauuaugcuuguuaaacauaccaaaguuuggggaugauauaauuauaaagcuagacugauuccauuguacuuugagucauuuguauccugaaauguaccuucuugagugggaggguuugggaauuauagccagccuuggaaaucgcaugugaauugaguaaaggguaucauggacaugcaugucauuugucaucuguguggcaguaaauaaagaaaucagaaauugcugagagaaggcacagaacuacgaagaugaaauaaagagaaugacauuucugagaaacaaggcauccguuucagaugaacacuggucacuuccucguaguaugucucuggagucuucugucaacuaucuguuugauaaguaaaugauaucuaauaaggaggaagcaaguauaauaaauuaauccaugccacaaauguuuuuuaaaugugugaaauccaauuauuuuuauugagaauaaaguccuuuaaugauuucguaucacaauucaaaaauaugguagaaauacgcagcucaagugggauauggaaauggcauuugguuuugacauaauauauuauuaacccaaaguaacugaaucaagacucauaaauuaagaccuuucucuugaguguaaaauauaaguuaacuguaaugcccaaauguuuguagcaccuuugacuuugaaauuuagagaugaagcauuauggauuaguuucucugguaacacuguaacuagaggaaaucauaaauucacaugugugaaacgaagaaauaauaaguauaaaaaaccccuuagaagaauauuuuuaaucuagcuauaaauaagaagugacucaucuauaugcuaugcaaauuuaaaguagguaaauuuagaauuuuuuuuucuuuuuuugcuuuuacaaagcuuuauacuuuaggaggggaaauguaguuauacaugaacaguucagaaaaugccucuuucagagcugcugugauggaaauguucugugucugcacuauccaauacaguagccacuagccacacacagcuauugaacauuugaaaaguggcuagugcaauuaaagaacugaauauuauauuuuauuuaacuuuacuuaauuucaacuuaaauacccaccugugccuagugucugccauauuguuaagggaaaggacuuaaagucaaauguagaguaguagauaugucuugccagauaguuaauucacuaauugacuaucauuuuguauucaagauucuuuggcucuuacauguuucuaacuuguucuaggaagagccguuaccaguccugacuuagcuuagcuuuaaaacaaugucaugucucuuuuacuuuaaaaaguugcccuuggccgggcacgguggcucacgucuguaaucccagcacuuugggaggccgaggcaggcggaucacgaguucaggagaucgagaccauccuggcuaacacagugaaaccccaucucuacuaaaaauacaaaaaauuagccaggcgugguggugggcgccuguagucccagcuacuggaggggcugaggcaggagaauggugugaaccugggaggcggagcuugcagugagccgagauugcgccacugcacuccagcuugggcgacaaagcgagacucugucucaaaaaaaaaaaaaaaaaguugcccuuggccgggcuuaguggcucacaucuaaaaucucagcacuuugggaaggccaaggcaggcagauccccugaggucuggagcucaagaccagccuggccaacauggcgaaaccccaucucuguuaaaaauacaaaaauuagcuggauaugguggcacaugccuguaaucccagcuacucgggagacugaggcaggagaaacguuugaaccugggagguagagguugcaguagccaagaucacgccacugcauuccagccugggcaacggagugagacucugucucuaaauaaauaaauaaauaaauauaaauaaauaaaacaaaaaauuaaaaguugcccuaaauauuaaaguuuaagccccaaagugcuaguuuuaggagacaucaacauuauggaugcuguuuacucugaggguaagcccaucauacaucuuuuacauuuuaaaauuaaauaugaugcugaaauguugagguugaaauauacugaugucuccaacuuacuuugaaaugcaugaaaaaauaaaaugaauucauggauagguagaugguagguaugugagaaagcagauaccgcaaaauguaaacaauauuggguguucauuguacaauucuuucagcuuuucugaaguuaucuuaauaaaauguucagggauaguuaaauguaagcauacuaaauauuuuuucuuggaccuaucacuucucuguuaaauagagccaaggagcaauaacugaacguuuaagaagcuucaguaugcaugauuuaacaacuauccaaggugaugagccugugggacaaagaccauaccaaccucuaccagaagcaaaaaagaaaaguaaaccagcccccagugaaucagcaggugugcuuguguguuuuaauauacgguucuuuuacauggaaacagggaggggaacaacauacacuggggccugucgggggguggggcacaaggagagggagagcauuaggacaaauaccuaaugcauacggggcuuaaaaccuagaugauggguugguagaugcagcaaaccaccauggcacauguauaccuguguaacaaaccugcgcauucugcacguguauccuggaacuuccaguaaaauuaaaauauauauauauacacguauauauaugauuauuucauaauugggcuuguggauaguaaaauaauacaugauacaugauaacuaucugaauuuagguagacaaaauuuacuucuaagcuuauauuuuuuacuuuuacauuuaaucauaguucuuuuucucugaauuuucucuaaauuaguacuugcuaggccaggcacagugacucaggcugggcacaguggcucacaccguuaaucccagcacuuugggaggccgaggugggcggaucacgagguuaggaguucacgaccagccuggcuaacauggugaaacuccgucucuacuaacaauacaaaaaaaauuagcugggcgugguggcacacgccuguaaucucagcuacuugggaggcugaggcaggagaauugcuugaaccuuggagguggagguugcagugagcugagauggugccacugcacuccagccugggcaacagagugagacuuuaucucaggaaaaaaaaaagauuaguacuugccuuuugcugauucuggagaucaucuagcuaacaaaguagccucuuuugcugccaugaauuuuagaagcuguaggugugguuaccaacaccuucucaccaccagcacuaguucuaaccuguaaucaauacucuuucuacucgaacugugcacugacaucuaagaaguuuuauaguugaacacucuuuacuguaagugcuguggacaaauaaggauauugacucacagauuaaaaguuuuaagcacgugauaaaagaugacucaauuugaaaauaagauuacucccauggaaaauguguuaaaauuacauauucuaguucaagagcuagcuuguaggcauauucuaguauaaauuaugaacaugucauaguuaauauauucuaaaacuuuaaaaaacuaucaugaucuuagaaacauacauauaaauuagacacgguuccuuagucauuuuaucacauauaauaagaaaguuuuaauucaaaggcaaggcugaaaacaaagauuuucaagacauuccuuauuaauguguuaaguccauaaggcacagggcuauuuuacuuuuuauuaaaaaaagaaguuuucuuuugagagagauugaaaaucaucuuuauaauuaaaaucaauuugaaaaauaaaaauuaaaaaaacuguuccuucuuaaaaaaggaaaaauaucucugcaaaaaaaaauuuuuuuuuuuuuuauuagcugaguauggugguauucaccgagcuacuugggaggcaggugggaaaaucacuugagcccaggaaguugaggcugcaaugagccaugaucacaccacugcacucuagccuaggugacagaggaacacccuuucucagaaaaaaaaaaagaaaaagaaaaagaaaaaauaaugagcuuucuuccaagaaugaauaccuuuacaaguugugacuauuaucuaagagguaaugaucaagcauuggccauugauuaagguagugaugccuuugagagagaggaaccaucagucuuaauaguacauuaauaauguaaaaguaguuccuaauguagacauuuccuuuuuuauuuuuauuuuuuuguuuguuuuuguuguuaauuuauuuauuuugagacagggucucacucugucacccaggcuggagugcggugguacgaucuuggcucacugcagcuuugaccucccaguuucaagugauucugugucagccuuccgagaagcugggacuacaggugugcaccaccaugcccugcuaauuuuuccauuuuuuguagagacggggcuucaccauguuacccagacuggccucaaacuccugggcucaagcagucugugugucuuggccucccagagugcugugugggauuacaggcaugugccacacugccuggccuuggcauuucuuaauaugcauuuaaaauuagguggucagucacaguggcucacaccuguaaucccagaacuuugggaggccgaggcaggcagauucccugagguuaggaguucgagaccagccuggccaacauggcgaaacccugucuccaccaaaaauacaaaaauuagccagguguggugguguaugccugcauucccagcuacccaggaggcugaggcaagagaaucacuugaacccaggaggcaaaggcugcagugagccgagauugcgccacuguaguccagccugggugacagagagagacuccaucucaaaaaaaaaaaaaauuagguauauugauuuugauuggagucugcuacauauauuauauuuugcugauuuagaccagcuaucuuagaccagaguccuuuauuagcaguuuauucauaaucauacccaaggauuggcuaagaauuauauucuaauuagguaaauaaaaacacguuuauaaauaugaaaauuuguaauacuauuuuuaugguacucaccuaucaauuuuuuuuuuucuuuuugagauggagucuaccucugucaccgaggcuggugugcaguggcacgaucucggcucacugcaaccuccgccucccaaguucaugcaguucuccugccuuagccuccugaguaucugggauuaaaggcgugcaccaccacgccuggcuaauuuuuauauuuuuaguagagacgggguuucaccauguuggucaggcuggucucgaccuccugaccuugugaucugcccacuucagcuucccaaagugcagggauuacaggcgugagccacugugccuggccaccuaccaaauuuuauaucuaugacugaaauaucuuaaaauauugaccugcuguuuaguucuuaaauuucaaaucaugaaauuaaauaaguuuuauaaaaauaugaaguaugugguagcaguauaagaaagauauuuguucaguuaugaaagguacuuguucagaguauaaauucugcccaguuuccaauuuuucuacagaaugguauguauucugagccuuucuucccuaaggaaaaacuuucaucaaaacuuucucucuugaccguauuuuuaacaaagcaguaugguucuaggaccggaauaggugaagagaaguuaaaaauagauugucuagauagacacaaacccagguguacauggaaauuuaucaaaugagaaagacugucuuucaaauugguggaggaaagacagauuauuuaauaagugaugcuaggauaacuguuagacugcuagaagguggaguagagaaugaaguuauaucucugccucaaaucuuagauuaaaauaaauucuuaaaagauuaagauuuaaguauaaaaaaauuaaacuauauaauaggaagucccugugaauauuuuuauaaucuucagauagauaaaauuucuuaagcaugauaucaaaaccagaaaacauaauggaauaguuuuugagauuuuccugcauaaaaaauacauaaaacucuaauacagggggaaaaaaacauaaaaaagacaaacuacaaacugucagaaauauucccauuauauguuauaggcaaaggguucagauucaacaauccaguaacccuuacaaaccaauuauugucaaugcuaucaaagaauacaacugucaagaaauauaugaaagagauucucaaccucagauaaucaaaaaauaguaauaauaauaauuuucguuugccagauuggccaaaaaaaaauguuuuuaauuaacagugcucuguguugggaacuguuucaguuaucuaguuaucuauugcugcauaauaagccaccccaaaacagcagcuugaaacaaucauggucauuuauuuugcucacagaucugggggugacuggacuuggcaaagcaguucuugcucagggucuccugcagcuguggucugacagcagcugggcuagagucauaaucucaaagagagcucacacaucugcugucugagcugaaaagagucaagcagcugcuggcuagaaugguuggagccucucagccaucucccucuauguucucuccauguggucucuaagggugguuggacuucuuaccuggcagcugaaggcucccaggccagugugccgagagaaacuugcagaaguccuagaagcagcaucacuuccaucacauauuuuguggcgauuuguugaggcaaguacaaaggccucugagauguuaagggaagggaagaggagugucagagaaucuguagacauguuuuaaaaccacacagcaagccuguugagaaauacucuuaggcacuuuuuaugaguuuaaaauggaauaauccuuuuggaugacaaucuggcaguaaucaucauaauuuauucccuuuagcucagcaagaaacuuuuaagaauaugucauaaggaaauaaucagacaaguguucaaagauguauuuacaagaauguucaucucguuguuuauaauaacaaauauuggaaugaaccaaaugccuaggagaaaugauuaagcaaaaggugguuuauuagcugugaaacauaacaaugucagucuauacuuaaugauaugaaaacauauccagauuguagggaaaaaaaauaauaaguagaugaugaaauggauuaauauaccuaauuuuuuaaauguauauacauaagagaaaguuuggaaggguauuacuaaaaugguaacaguguuuagcccugaguagugagcuuuuucguuuguuguuguuguuuaaauuaaccuauuaaucuuaaaaucagaaguaaaucagccauacucuucauuuugaaaaaauaagguauucauuuucggguuuuaaguuaaacagaaaauguuuuuuuuguuuuuguuuuuguuuuuguuuuuuaauauauuaauggagaugggauaucaguauguugcccaccucugcuucccaaagugcuaagauuacaggcaugagucaccaagcccagccagaaaauguauauuuuaaugaaaauauuugacuugauucuagugucucuucucucuuugauucaaggauugguuuaauaaauugcuaaauuaaacuuuuuuuuuuuuuuugagguggagucucacucugucgcccaggcuggagugcaguggcgcgaucucagcucacugcagccuccaccucccagguucaagcaauucucugccucagccucccgaguagcugggauuacaggcacgugccaccacacccagcuaaguuuuguauuuuuaaguagagaugggguuuugccauauuggccaggcuggucucaaacuacuggccucaugucauucacccacucagccucccaaagugcugggauuacaggcaugagccaccacacccagccuaaacuuguggauuucauuucccaauaaauucuaaauuuggcuccuugcucuguccucacucucuguggacucugucauuucugaccugcuauacuacaguaaccuccccacuuacgcucccuucccucagccuuauccauuucugauucauuuuccaaagcgcaagaagaauauuuuacaaaacccaacucuaaucauguuacucuucugcuuaaaacauuucaauacucuccccgagccuccagaggcuucauugcucucugacgaaguccaaacuagauagcaugguguauuaacuccccagccuuguucucccacuccaucaagugcuagccauacagaaucaugacucuuugaggauuuagcuuagccaccaccuccuacaaggccuucucucauaacccacccuuuccaacccaccccaugcugauuacauucucuuacuguaugcccucuggcaccuugucauuagcuuauaguauuuauuacaguaucauaaugcccauuaccgucuguuuccccuauuggacucuaaauuuuuugaggguagaaaaagacagcugugucuuuuucauccuuguauccucauaauucagcacacugccucauucauaauagaauuuuaaaaauacuuguggaguaaugaaucaauccaucacuuuuccugaagcuauaauuagauagcuaauaagauuuuuuuuagcuggaauuaggaaaaaagaaaagaauaagauguauaaucagcuuuugaaugaaauuccaauuccuaaucauacaaaaugagaggcaguuaaaauagcaaggacuggguuuguugaacugugcucuuaugcuacauuuguggccuuagagaaauuguuuaucacaguuacuuccuuucugacuuuuuccuugauuccucauucuguuuuaccauauuaggaucaggaauacuauauaagcaaacaucaauaggaaaaaaaaucuagaaaugacaaccuaaaccugaagccugguuuauuuuucucaauuauaaaauaaacauuuuuuaaaaauaagaauuuggcaaguaaaaaaagaaaaaaugaaaaaauuuaaaaucaccugaaagcucacuuccaugagauauaauccuuucauuuauguuuuuccuuuguuuguuucuauauguacauuuuuuuuuuccacacuuaauauugcuucaggagcuuuuuuccaggaccacugauccauccccuuccuugccacacuggccuccuugcaguucuuccaagcaauccccaagcccuagcuacucuccucacugccucugugcaugcuguuucuuccacccggaacacacacacuuccuuggaccacugcaagaaaacaaaggaucuuggccuaaauaaggacugauuccacuuccaaaucuccucugacuucuagccuagaagucuaagaacauaaaauuauaccugacuaauauacaaugcaaguugcuuauguuauuaugagaguaacaagcuuauuaacaacucuuuguaguuugcuuaguguuucucaaauuauucgugucuuagaagagcagaccaauaaacauguauucaauuuuuuuaauauguauauuuuuugaaacaggcuauaaugcaguggcaugaucacagcucacugcagccuugacuucccaggcucaggugauccuccuaccucagccuuuggaggagcugggacuacaggugcacaacaccauacccggcuaauuuuuguauuuuuuguagagaaaagguuuuaccauguugcccaggcugaucucaaacuccuaagcuuaagcgaaccaccugccuugaccucccaaagugcuggcauuacaggcaugagccaccaaagcccaccccaguuuuauuuuuuaucagcaugagccaccaaagcccaccccaguuuuauuuuuuaucacaugcacggaaucuaucccgugccuucuccuaagccuggaaauccuucuacucuuuuuuuuuuuuuuuuuuuuuuuuuuuaaagagauggagucuugcucugucacccaagcuggagugcaguggugcaaucucagcucacugcaaccuccaccuccuggguucaagcgauucuccugccucagccucccaaguagcugggauuacagacuccugccaccacgcccagcuaauuucuguguuuuuaguagagucggguguuucaccauguuggccaggcuggucucgaacuccugaccucaggugauccgcccaccuuggccucccgaagugcugggauuacaggugugagccacugcgccuggcuguaaguccuuccacuuucuccucaccugacaauuuaaguauuuaugcuccuuaugcuccuuauuuuuauuaaaggagaauuuauaacuucauggggauuucuuuccuucuucuuuuuuuuuuuuuuuuuuuuuuuuuugagauggagucucgcucugucacccaggcuggagugcaguggcgcgaucucagcucacugcaagcuccgccucccggauucaugccauucuccugccccagcuucccgaguagcugggacuacaggcgccugccuccaugcuuggcuaauuuuuuuuguauuuucaguagagacaggguuucaccauguuagccaggauggucuugaucuccugaccucaugauccacccgccugggccucccaaagugcugggauuacaggcgugagccaccaugcccggccucuucauggggauuucuaaucucaccccuuucuuuauaaccuacuuaguacucugguugucugagacuugggccccugucuugcugucuccagcauccucaggcagugguucucaaaguguggaccacagaccaugagcacaagcauuaccugggaacuugucagaaaugcagauucucagccccaccucaaaucugcugaaucagaaauucugggguugucagaacuuguauuaacagguucucaagguaacucugacgugcucaaguuugagaaccucagcuucaggguuggaagaguuuucguccuugaggccaagccucaagaugcucucagacuuccugacuguguggauguuugcauauuggcccguaguaagucuuuauagcuacacauaacagccuucuagcauacucgcgugaucucucacugaucugccugauucuauuuucuuugacuaguaucugucacacagucugugguacuucuaauuacugcagccuaccuggcuggguuuuaucucagcaacugcaauagcagcuaacauccccauccucaucaccugcccccagugaccuuauuuugcccaaaguucuagcccccuggggucuuccucaaugccuuaaguaaacccuaccauucccagucuugacaaaagauacgacacauagaacggaaaagccuuaauuccuaauucaaggcaaaagugcaaaugacagacuaaaacacaaaugcuuggguugaauucaugaagaggaggaaaggugggaagagacuuuuugcucuauaucuauuuauauucuugaauuuuuuaacaagaugguguguuaccuacucaaaaauaaauuauuuuauaauuauuuuuaaaaaugcauaguaaaaauaagaaugaucagggaaaauuuccuggaggaaaugaguuaugaguuucaccuggaauagugcgaggcaaagcuuaaugauaaagggcauggagcacauuccagaugcaaaaagaguaacugggggaaaugcaaaccauacaaagaacuguacacagaugggucaaagagccggcgcugacugguguccuuuuaccaaaacaugcuguuuuugacaacuuguuuagguuauggaauuccacugaaagacggagaugagaaaacagaugaagaagcagaggggccauauucagauaaugagauguuaacacacaaagggcuucgaagaucgcaaagcaugaaaucugugaaaaccaccaaaggccgcaaagagguugguuaaguguagagcuguuuuccuaaugauuagugaaggauuucccugcuguguuaucauuuaggauauuaaugauccauaaaugaaggauuggaaugguagaacagcaguuugauuuuuuuuuuuuuuuuuuuuuuuuuuaguuuuuggggauagagcuuuuuugcuuugucaaccaaauuggagugcaguguggcguaaucacaguucacucaaacuccugggcucaagcaguccucccaccucaaucucccaaguagcuggaacuacaggcacaugccaccgcaccuggcuaauuuuuucauuuuuuguagagacaggguuucaccauguugcccaggcuggucuugaacaccuggccucaagcaauccucucgccuccgccucucgaagugcugggauuccaggcgugagccaccucaccuggccagcaguuuauauuuaaaauucuuuauucagaucaauguaucaggauaucaggaaauuuugaaaaugguaaacucuuaaucuucugcuauacguagaaaauggcauucucauuuagcaaaucacauaguucaaauacccagucccagcccuaugcauaaacaaagaaagcaaugaauaaaauuaaccacacaguuuugcuuucaacuaaugcuacaugaagauuaaauaguaaacaguuaaccauaauaacauauugucuuuauacccagaaagcaguggaggacugugaauggccucugaucauuauaaucaauguucauugacauuguacuaagcaaaacauaaauaauaggauuaauguuuuuauguuauuaguaauaaucuguaacauauaucuaaauauuaccaacuacauuuuuuaugaguuuauaaguagugcugucuuauauacauuuauuaagagaauucauucuuuauaucaaaaagguaaaaaaauuacuaugauuaugaacuauuaaaucugauguaauuuuuuaaaguaaucaucuaauucuuaauaauaaaacauuucucucuucaggugcgguacgggucacuaaaauacaaagugaagaaacgaccacaaguguauuuuuagucaucuacacgucaaauaucccaagacagauuaugcuaaauacaucgacuucaucuucuaacaugauauauucaggauuuacacauuaaaaugauuauuuaaauuguggcagugaugggguuuacuuucaugaauuuaaauuguuuuuauuucuguaacaauugcuuccaaauauugacuacuaaaggcaguucugcaagauguacuaaauauguauauuagaaauuauagaaaaucauguuguccguuuucaaauucaucaacagccuagagugccugagauauaagaugaaacacaaauccacaguauacuugaaaggagccuuuuuacgguucaggauaaaucagccuuugugauguacuguguuuaccuccuuuuguguuguaucugguaauuaaauaggccucagauucagcagugacauaacaaggacauaauguaagauaauaaaguagguuuuauauauucuuuaaauuuuuacuuauauaauacuuucuaguuuuuccaccaucagcugaaaguuuuugaaacaaauauuugaaaaccagguauccacacauagcacuuuuauuccugacuaguuuugcacacuugaaaauuguuuacuuauuuuacaacuguuuuacugaugcuaucuuuauuguuuuugccguauucugacaugucaaaucuaugccuugaauuauaucaucucuuuuccuguggguuucauuuguuaaauucauuggauuuuaauaauauaaaaguauagcuaauuguucaguuuuaacuauuuuuaauuaucuucuuaacaaauaagaaguugcuuuaaacauuaaccaauuuucuauauuuagcuauacagaguaauugaacuuaacauguuuuugucaacaccaauuacauuuucagcuuuuaaaaaugguagcuuuugugaaauagaaucagugaccaguauagcacuuagaucccuucuaacucauauaauuuuucucagccaauccauucacaagcuuggcauugacaugugcugcuaguuuauaaacuggcauugacgaaaaucauuugaaucucuucuggcugagauaauuugccaaugcaaaauacaguugucauuaauccugcacauuagaaauuauuagaaacauauuacuuuuuaacuuuaaaucucaaagagauuuugaguuauugaauucuuaaggcuuucuuagcuugaacugauaacuaugcauuaugaacccuaagucaauauauuuuuggugguuuuagugaucaguaaucaaauuuguacuuauuaugcuuguucagguaauuuacuugacuguucuauuuguuuguccaaaagauaaaaugaugagagagauucgagaggucuuugaucugucucccuuuuaagaaaugaagccagcugguaauguauauucaggacuuccucagaguauuggccaagaacauaauguuuacacaggaguaccuugguauaaugcauacauugucucaugauacuagucauaaaauauuuuauggauuauuucacauucuucauauauaacaaguaaaauuaauucaguuuucuucucccaacguuuaauucugaauaacucuaucuacuuuacccuaauuuuuagccucuuaauuucuggaaggacucuaauuucuauuccaaauuucuaugaauucuaauuguaaauuaucggaacagaguuuuauuuauaugaccugguacuagacuucuuaauauaacuguuacacuguccuugucuuuccuacucaaagacaguaucaucugaaguugccuaauaaggucaugugagucaagaacuuuaucugugggagcugauuugcaccauuuuaccuuuuuuuuuuuuuuuuuuuugagacggagucuugcucugucaccaggcuggagugcaguggcgcgaucucggcucacuacaaccucugccucccggguucgagcgauucuccugccucggccucccgaguaacugggucuacaggcccgugcuaccacgcccagcuaauuuuugucuuuuuaguagagacaggguuuaaccauguugcccaggauggucuccaucucuugaccucgugauccgcccgccucggccucccaaacuucugggauuacaggcgugagccaccgcacccagccaccauuuuaucucucuaaagucuggucccaguauuaaaccuauucuuuaguaaacucauauuacuguucuaaauugaagaaauuauuuauuacucuguacuucuagacucaaaauucuuuaucaaagauagucucaaagagguaguacaaguccuguuuaacugcacuuuuucacauucacagugcuuccucugauaucuuuccuuacaucauuauacacuguugauaucauuuuacucuucuuucucuucuacauuucuuaaauuuugguucuuuuccuguacauguguuuuagcggggcccuuuucuuugaacuuugucuaauuagccuguacauuuuuguuucuuuuaagguagaacagaucuuuuuuuguuucuccuuuuaagucuacugguuuuaaaagagguaaauguauccauagaccacagugccuugcuuuuuccucugccagcacauggagcacgggauuagaugcacaaaccuauuuagggaacuauuuugguagauguuugaguuuauacagaaauugcagcugguauuuuauuuugcuguacauuuacucaacuuguccauuaguauuuaacuauuuccagaguuuguuuaggaguaagaauugacccauucguuaguuuaccauauuuuuuccugguauaaaaaggagccagaaauaagccuuauugcuaaauaauuaauuauguaagcccaccuagguccugcauaagaucccccucacauacuucacaauauauauguguguguguguguguguguguguguguguguguguguguguauuuggcuaaaaaauuauacugccaaaauuacugauuauaaauacuugacuacacugauugaugggacaaaaugauuaaaguauuuucagggaucuuauuccauaugucaccaccaaagauuucuacaguguuauaaaguauauaaauauuccaaauuucugugguuaaauauuuuuuucuuuuuuuuccuuuuuuagaauaacacagucugugcuuuccaaaaaugcuugaacuuuuauguuguuaagaaauauauaaugauaucuuacauuaagcaugagucuaauuuguauuaauugggauggacuaaauuuucauuugauuaucaggaaaauuaaggaguuauauauuuaaaagcaauuuucuguguuuucuucuuuguaaguugacucauuugugaagcaauuaggcaaauuuugagaagaucauuguuauugugguuugcaguauauauuucuuaguaaauaucacuuaagauuaaauuuuucagaaagaaaauuauagcuuuuuucccaaaauauuuuuaagauuuaaucuuuuuguaguaugcuacagauuuaauuauauuaacucuuuuuuaagacauugaccaugacuuaacauuuugccuucuaacaccuuuuaaaucuauguacuuuaauaguuaagagaaaauaaguuugcagauuuuuaauaaucuguuuguaaaaggcuaucucuaagccuaguauguggguaauuuuacagguguguuuuuugauaacuuuaauauaaaauaaacucauuuuauuuguggcaauucgcguuucuuuuuuuaugccagaguacauauguuggauuccaugaauugguauuacuuauuauuauguguugauuaaauauaugcacacacuuaggauuacagaucacagagcaaauuaugaaaaucauaaacauucugguauggucauccauaggauuaugaaaaagaaauacugaauuguuaaauuuggauguuagaaaggaaagauaggaaaaacaaugaguacagaaauccucaccaucaauuuggauggguuagcugucucaggcauaaaauguaacacaaaauucagauuuauguauccuggaaauguucugggguuccaucuguuuuaaaguuagacgucugucugccucacauuuaagcuuuagagagaaauccuauguuuuaagaaguuucuuuguguuacuucauuaugacacauaaugcguguuaaggucuuucuagauagcauuuuaaauggaauuauuuucauuuucauuaugagguauauacuuguaaugaucuaaagagguuagaaauauaaauaaaaauucaaaagaa

SEQ ID NO: 192148 - RNA, 8739 nt, Homo sapiens
ggaaaaagauaaagcagaaucuguaucccaguuuuuaagucaaaauaaaucuuaauacagaauuuaagacaaaaaaaguauguguggaagacaggacuuacuaaaacuaccagaaaaauacugacauguauuauucuaauacauucgaucuuugagugaggaagacuuaagcaagacauaaaagcagaaaguccaaaagucaugcaagauuguuaaagaacguauccuaacgaaaauauaggcgguuuauaauagcuaaauaugaaguguuaaauugucaugaaauauaaaauuaaaacaaucuuaauaugccuuuuucacauaguuaacagauugauaaaaccaaguuuuggcaaugauguacuaaaacaauaaguauuacacaccaugaguauuuaagaguaaauugcuacaaguuuuuuagggggcaaccggcaauaucuaucaaaauguaaauaaacaucuucaauccaucauucccauucuaaaaauuuauccuauaaaguugcauacgaagauaaauaucuauaaggacauucagugcaguacuguuaauaagagcaacaauaaccaaguuggaaaauaauuuaaauguucaucaauauggaagugguuuaauuauaucaaaaauguaaauagacauagguagaucuacgucuugauaauguuuuacacaaaaaagggaaaauauguauauauacauaugcaaauaaguccaccuuguguaaaaaaaaaaaucuuuauauacauacaaagugaacauacauacaaguguaagauuacaaauaaaacuaacagcgcuaccucugcagagugguuugguagaacuggugcaagaauaagacacuuuuauauacuucaguacuuaaaacuauacaauuuuauaauuuaccugaaauauaauaaaugucuacaauaaauugaccaaaacauguucaaaacuggaauaaaacaccuacaaccaccacucugcccuaggcuuucauuacuuuguuuuacauguaucugacagccaaagaaagaccagacuacccuagcuuccaacaauaccuaccaguucuauguuaucucaggcacuaauuuuuacuuacuagaaacacuaucugguaauaacauggguaucucuaaccuguauaaacuaaccaugagggagaaaaaugaaauacuuuuucuuauucuaacacuuuuuccaagcauauucccacaaaaugcagggacuucuauauauagucccuuuauauccacagugcauaaauauuaauaaaauuaguuaagcuuuuaccuuaacaagugaagaauccauguacugaccaggagggauagaauccaaguauuucuucagauccauggaaagaaacucaaagaugagauauaaccuggaauccugcauaagcacauccugaagacuggggaaaaaaaauauaugagagaagaauccagcaaacauuuuugaccucuguuucacaaaauaaaacuccuuccauaauuucaguugcuauaauaaaaacuggggaagacguaguagcuucccuaauggaagagacucaaaacucaaauuuaagaaaggaaucucagggcaacuauuuaaaauuaagccuuguacaggaggugcuuauuuauaaggagccuguauucaaaagaacauaucuagguuggcuacuaauugcugagagcuuauuuuuucacugaagugaauuauacaaauaaauuuuaaagugguaucugaccuuaaaagcuacuuccaaucucuagccccagccaaguacaauuagauuuuaacuuggacuguuaggaagacaggucuccaaaaacacccaaugcaaauacuuuaaggaaaaaaaaucuuuuucauuugaccuagcuacuuuucuuaagacucuaacuaaagggucuucaggaacuagagcuccccaaguaggagagaguugacaaagcucuaugaaaacggcuuuacucccauggccaauuuaccuugcuauucuaggcccaaauauuaaucuacaucacccagcuccuccaacucuguuccugcuuuaacagccuguucucuuuuacauaugugcggcauucucaacuaccaaaaauaggguucuaguccacucaguaaggcuagaccaagaaauugagcaaauguaaagauuuccaaguugaaauuuauauuugaaauagcaugcagaaaauggcuuacauucagauauuacaacauaccugacuauauuuggaugacgaaguuccuuuaauagagaaauuucccgaauugcaguacuaggaaccccuuccucuucacuuucuagucugauuuuuuucauggcuaccacuugaccuguaguuuugugucuacccuuauacacaacuccauagguaccugaaacaaaguaaauaauaugcugugugacacaccccacaaacuaaagaucuuuuuuucuuuuuuuuuuuccuuauggcagggucuuguuuucuuguccagguuggagugcagugggucaaucaaggcucacuacaaccuccuccuccugggcucaggggauccucccacggcagccucccaaguagcugggacuacaggcacaugccaccacacucggcuaauuuuugucuuuuugguagagaugggguuucaccauguugcccaggccagucuggaacucgugagcucaagcaaucuaccugccucgccgccccaaaaugcugagauuacaggcgugagccaccgcaccuggucaaacuaaaggauuucaagaucauugaaucccauaagggucacaugauagaaaugucugguguggccauaugggaaguaucuuacucauacccucauugcuuccaaaaagaaauugagaguaacuacaaucuguauggcuuaaaaauaaaauucauguagucaucacaaguuuucuauacaucuaaauuaccauuaauguuccagcauauuuuacagaacaaaauagaucauuugcaaauuaaaauuaaccuucugucaauauccuacccugcaacgaagugggcauaaaauauaguguaaaaauuugggcucaggaaauauuacugauaaaagucauuaugacacuuucagaaaauacuguagagugcuuuaugcuuuucaaaacacuuuuaucuguaucucaaaauacagucaacaguccucauucucaaaagaauggagaaaaaagaccagguguuuguguauuaaaccuaauaaagcacauuguauguacuacauauuaggaaagccucacacccauuugcaaguugaugaaaauacugauuuugauauaugggcuucagguaaugagcaacaauaucaauuauaagggauagcagggagggaggagguggauacagggaaugaaauggcaauaagggagaagacuagcuaaaaucugucauauacguggcugaauucccuagauaagucuuuuuaaacucgaguuggaguuuagggagguccugaaccccuuaaguacacacaaaauuuuguugaauagcuugcuuuccauggcauugguuuaacuucaaaagugauuagagugcacuguucuaggaagaaggccucuucuauagcuuuuaugaguuucucugaaaguagcaauauuuuaaaaaaggcuaacaaccaacaaauuaccaacugcuugguuaaaaaauuaagcaguuugagcaguagcaaauugaugcuacuuaagcuuaauuuuuuugacagaaccucuauacaaaagucuauguuuucuuaaauacuggugucauuuuaaaacuauaaacugacaugagucauuuuauacuauuuugauuaaauuguggauuaauguauaacuuuuugauaaccaaaauuacucuacauuaaaggagaauugacuauauuuaauccucacagccauccuuaaaaguaggcaaccuucauauacuuaaaaucuacauuuuuuuggauguaaauucagcucucauuaaacacaaaaaguagguaaaccaguagcacaaucaucuggcauacuguuuaagugaucucaggaaaauuagucacuugcauaauacagucacauaaacaguuaaugguaaguucagaacuaauuuuuuuucuagcauccuuucuucucccucaaguguacaaucucaucuaauccuaaauaauuuucagaauuaacaauuaaccaguggccaacacucaauguguugaauuuuagagauaauaucacuucucacugaacuacuggaagagggguuaaacaaagcagaacuuucuauugguuaaucauccaaaauuauuuuugaaauacauggcauauccuccaaaaugaacuaagaauucuaaagacagaaauacucuaggguauuuaacuaaguauaaauaacuaaggaggcaaaaaucauuaacacagguaagccuagaaggagaucagucuaagucuaauggaagauuuaucccaggaaacaaaaagaaacaaaagaaaaauauguaggauaugaucaaguuauggaggcccuuaagcagaaaaccuucauuaagcaaguauuuaucaaaugccuacuaaaugccaggcaagguuccaccaucauggauacugcuacucuaugauccaaaaagacauuuucuuaagacaggaaggauuucaaagauuaguaucacaacacucagauuucuguaauucagaagaaaccagagaacaauuuuuguaauauuuaaaauaguaaagucuggagguauuuaagaaaugaauuagguugucaagacucacugucaagugagagaaaaggcagagacuguucuaaaucagaauuaaugucaaugaaaaaaauaaaaaauaaugcuaacauacauacagauaauaaaguaaacaugacaaaacaccaacaucuugguaaaaauauuacaaguucauugcauaaaucuuucaauauagauuuggagauguucaaaaugaaaaguugaggggaaaaaauauaacuuuuaaaguaguauuuuaauacuagacuuuaaccagauaccuggcagaaccaaaagaaaauucugugugaaucauuuaggccuccauuuauuuccacaaguuccuuuuuccaaaacaauauccagcacauaauccaaaacaaucaggcauuggaguagaaaugacaauacaagccagaaaaagaaacaacaguguucagaagagcaaacaaggaaaacagauguuauuauuaucuauuuggcuaucuccuguggguugggcacuacugauaggcagugggcaaacaguugugaacaagacaaaaaccccagcccucaaggauccuaugguaugaugcaaagggaacuacaaaaugcucuuggacuagaggaggagauaaaaaaugaagccaguagaaacuggccuccagguagaaagaacagccauugccaaaacucauaggccaaaucacaggauacauuugaggacaucaaagaaauccaaauuaagaguuaaguggcauuagauggagcuggugaagagaugguuuuggagacaguguucauaguaauaauacaauguucaaaugauaaacauuugaagguuuucugaguuaaagcgcucauaacaaaugcuuuccauaauauuguucaauugaaucauaucuuucguguuaaguccaauuaucaccauuugcagaggcagaaacugagauccagaaaaguuaagaggguuuaccacugucacacugcuagaaauaaagaauggaagucuuaugacuuacauguauguaauggauuaaauuuaaaauuacauucuuuuaacugcuccuauuucuaguagcaauuaaaguacuuuucucagaagucaaaucugcagucuccuguauguuuggaguucuaucaucuuaaagaaaaauauauuuauacuuuaagaaggucucuuuuuaugccaaacuaaaaccaacacaaauucucugggaauuuaagaaacacacuacacagcauuagacauacuaaucacauauuuuuaauucagcagcaaaauuuguuuaguagaauggguaugagguauuuaagugauuuaaaaaaaaaauauauauauauauguauacacacacacaccuccaaucgaacaccacacuaacuugucacuccuauuccacuaaauucccuccaguauucccccuuguuuuucacuauuucuugucaaguggggucuuugaucacauuaaaaauauaguugggaauuuucuucuggcagaaccuauauaaacuggauucuauuagcaaauuauuuuguaccuggagaaucgagaauguucugcuggagucgaggaacaggcgaagggauauaccccucauuugugccauauauagaucuaaacauuccuucaaguaccacagaaagggaaggauuauauacauaaguuauaauuuuagaauagcuuaaacaugucuauaugacaggucauuuauacuuaggguaacuaaauagaaauuuuauuuaaauuagauuaagucaauuauuguaaccagucuauaaagucuggauaaaaauauuuaucauccuaaaaacaauugaaagagacuaaaacuaaaaauauauuaugaaguuagcauaauucugcagcccuaaccucugccccucaacacacaugcaaguuaucaauagugucuucaaaauacaaguacuacuauaaguguuuaguaucagaagacuguaagacuaugggggugaggcgaacggucauuagggauucgguaauuucaauucucuugaaaugugagcaaauuugcguuuauuaaguaaagaacauauguuaaugcacacugguacuacaagacaacuuaaugguugaauuuuaauaaauauuuaaauguguucauauuacagaaguuguagcauuguuaaaucauuccauaaaauuuauuuuacuaaaaccacucaccuucuccaauuuucucuauuuugguauaaucuuccauaguuagucaauggguaugguagauccuaaagugaaggaaaaacugacuuaauuacaugccacuaacucgaguaguuuuaagcauuaaugaaacacuauauguaaagcauuuuccacagugccuacugcagcauaaguauuccauaaauauuaauuacauucaaacaauauuuacaaggguaaggacuccuacaauaacuuuccauccuucuugacuccugagacauuggaaacguguauauucuauacuaguguaguauuuagcuucuuccaaucaaaauaacccucaaauucagguaucaacuugucuauucuuuccaaacaaaaaccagaauuauguucccuuuuugugacacuuuaaaguaguaccugcgugugccaaaguuauacccaaauauuucaacaaauuuauaccgcuuuaugauacuccuaauuuuauucaaaacauuauuuuuuaaaguuaugaggacagaacuaaaauguguucagacuguucauuaggaaaauuuuguuuaaaacgacaaaaacauuuuaaguguuuacaguugcccacgugacaauuuuaaucuuuuuccucugcuugcugaggucacagacaaacaugcucaagacuuucaagguacuuuuuccaagaguaggaaauaucacuuaagcaccguaaaacaaaagaaugaaaagugcaauuccacagauaaaauucuaauuauaaccuaaacaaugucaaggacuaagcagaaaaacgguauacuugaaucacaaugaauggguuaaaaaaaaaagcugacaaccagaaguucaagacuuccucugaaguuugccaaugaaacgucagaacuccaggcauaauuaccuagauuuuucuaacacccaucacugaugauaaaaucauuuauaaagcacacucagaauagaccuuuaaguucuauuucucacauucaucuucaaagaaaaaucaauccagaaagaagcagagauguaucuuuuuaaaugaaaaaaacugcacuacacugcucaugagaguuaagugccugggcugacuguucuuaacagcuccaggugggccggggccgugggcagagcaagcccaagaaggcccacgaguuccaggaucgguuucucagggcggccuggcucuagggacccgcgccuguaccuggcccaggugcggucccacuuucccacccccgaggcgggauggcagggcgcgcaggggccgggcccaggaaagagccugcuacuccgcaggcgcucagcgugggggagcggauuuugcuucaaucaagacccgaaagccucuucaggcaguuccugagaacagccgaccucgacucaugacugcagccccgaacccccacccccacgccgccuaaccccgccaggcugggcucccauagccucccucuaaagccagcccaguguggcucacacggccagacccaggcgaaggcccugcccaccgccccccgaggcccagccgggccccgcgcagaucccugaccuccaguccggccuucuuagaggaccccguuccucaauacucgcccuccgaggcccucggccguccccuagacacgacccugaccccagccacuguacccggcuuauuauuccgcggcggccgcagcggcagcuacaacaaccgcgucgcucuccgcucaauuuccaagagccagcuuugaagccaagugcgagcaguuucaaacucaccgcgcuaaagggccccggauucaccaaucggguagcccguagacuuucaaagcagccaaucagagcccagcuacgcugggcaggccuucccggguggcuagagcgcgaaagaaagaggaaagggcggcu

SEQ ID NO: 192149 - RNA, 3836 nt, Homo sapiens
gauugugggaaggcagcugaacucggcgccuggaaagauggaggcagcggagacagaggcggaagcugcagcccuagaguaaguguuugcggcuaaguggcagcuggggccgggccugggaggaccuugugggccccuauguguaaugauuggugcccucgacccuguacagcuguugagguucgacccugccgugaagugauccucaccgcagucccgucuuagguuccugaggugucuguugccugcuccaggaguacagccuuugggggaccguucgccgcuccccacauccacauaauccacaggaugugcucuaggagacgguuucacuucugucuucuugucccaacacgacacauucccagucacuucucauccccaucccugccccuucguagauugcuccagucccuaauaaugaaaaacccuagaguagaccgaggcauccagcccucugcccugaguccuuucucagcuauuccaagacucugccccaaggcuggugcucagcgccaggagggaucccaaggcccagcauucuuccccuuccuugcauaucucccuggcuuccuucacaucuugacucaaaugauuucucuucagugagacacucccuauuuaaaauuucagcucuuuucucaaacuccuuauccacuagcccugcugauuuuccuuuuggcacguauuaccaccgugugcccuccaugcacgccauuccugguugcaggcuguggacccuucaggcccuuguguaaacucuggucaaggcaagacucucaauacuauauauacugauauacacauccacauuuguuuguguacacacacgaacuguagaacuagcaccacaagaaacugcaauuuccuguguuuccuugccccuccaggguccuggcugagguggcaggcaucuuggaaccuguaggccugcaggaggaggcagaacugccagccaagauccugguugaguuuguggugguauguacaagaugagagcgagccuuucagaagccagggucugguccuggcuccucuuacugagauacagggcagcacuggcagagagcagacuuaaggaaaccuguaaggagguaaggauguucccugucucugcccucccucugagcaggacucucagaagaaagacaagcugcucugcagccagcuucagguagcggauuuccugcagaacauccuggcucaggaggacacugcuaagggucucgaccccuuggcuucugaagacacgagccgugaguaggcaggggauuguaguagcagcugaccugaguggggaaggaaggaggauuucaguuaggucucccauuuggcugaugggaaggaggcccaguguugcagggaggcaggcuagcaggccacccucacucauguacucauuccugguggcucaucucaggacagaaggcaauugcagcuaaggaacaauggaaagagcugaaggccaccuacagggagcacguagaggccaucaaaauuggccucaccaaggcccugacucagauggaggaagcccagaggaaacggacacaacuccgggaagccuuugagcagcuccaggccaagguacacccaggggucuugaguacagggagggaagggcaguuagaaaggaagagggaaagagugagcaagcugaguugugccagcuugcaaucucccaaaauucuagccagaaaaaauagacuucucuuggucuuucucccuugcuuaucuguagaaacaaauggccauggagaaacgcagagcaguccagaaccaguggcagcuacaacagguagguucgucccccuaggagaauaucccuucccaccaccaugccauuguaucggcuguguccccugucuagaaaaccguuuugcuuccuccuuugaggcacuauaauauaaauaccaacaugggcuugaaucucagugucaccacuuaccacugcaugaucuugggcaggucaccuaacuuucuguuucuuuauuuaaaaugaaggcaauaauaccaccuacucuagagaguuauuaagaugauuaaaugaucauuacagcaaggacuuuaaaauaguaccuggcacauagcaaguuaaauaaguguuaucaccuuugugccccuuccccgcaagaaugccucacccuagaacagcucauucugaucuuuccuuuucucuaggccccuacuccacccugaagugaauagagucccucuuuucaucauugagccugagcccugagcuggguguaggcuggagggguuggagggaguuucuaagacuucaacaucugaugcauaaugucugcaugcucacuccuggcaggagaagcaucugcagcaucuggcggagguuucugcagaggugagggagcguaagacagggacucagcaggagcuugacaggguguuucagaaacuuggaaaccugaagcagcaggcagaacaggagcgggacaagcugcagagguaaguucgggagcaugggcugcagauucaaaaugguccagcugagauuccuuuccuucacacuuaccuccucuuuguagguaucagaccuuccuccagcuucuguauacccugcaggguaagcuguuguucccugaggcugaggcugaggcagagaaucuuccagaugauaaaccccagcagccgacucgaccccaggagcagaguacaggagacaccauggggagagacccugguguguccuucaagguaaaugagagauggaacaggugggcaugggcuggcagguggagacagaagcugggagauuggccuuacccacugucuauacuguauuucuccaaggcuguuggucuacaaccugcuggagauguaaauuugccaugacuuccuggaggacagcagcauggagaaagauccuagaaaaggucagacccaacucaggccuuggugucccuggacugcaaguguggaaggagggaaagccugguuuaccucucucugcaucugagcucugcuacccauggagcagauggauggugggaacaggaaagagcuuauguuacaccucauucccaugcuuagcccacccagagcuaaccccugucuucuuccccaggccucugacuucccucaccucccaaccaucauuacaggaaagacugugaacuccugaguucagcuugauuucugacuacaucccagcaagcucuggcaucuguggauuaaaaucccuggaucucucucaguuguguauuuguucaucuucauaugcuggcaggaacaacuauuaauacagauacucagaagccaauaacaugacaggagcugggacugguuugaacacagggugugcagauggggaggggguacuggccuugggccuccuaugaugcagacauggugaauuuaauucaaggaggaggagaauguuuuaggcaggugguuauaugugggaagauaauuuuauucauggauccaaauguuuguugaguccuuucuuugugcuaagguucuugcggugaaccagaauuauaacagugagcucaucugacuguuuuaggauguacagccuaguguuaacauucuugguaucuuuuugugccuuaucuaaaacauuucucgaucacugguuucagauguucauuuauuauauucuuuucaaagauucagagauuggcuuuugucauccacuauuguauguuuuguuucauugaccucuagugauaccuugaucuuucccacuuucuguuuucggauuggagaagauguaccuuuuuugucaacucuuacuuuuaucagaugaucaacucacguauuuggaucuuuauuuguuuucucaaauaaauauuuaagguuauacauuu

SEQ ID NO: 192150 - RNA, 16892 nt, Homo sapiens
gggaaguccuggcccuuggcccaaccuccugcuguccccggucugagggcccaagccccgcgucuccgccuugccguccagccuguccuugguguggggugcuuggaagugugagcacccucucuggcucuuugccggccccaagggucguugcggcggcccccgggcccagucaucagcccucuuuuccggugccggaacuaucguacuggugcccuaguuucccagccggcaggcggagugaggaggaagcggaggcgagaccgcgcucaacacuggggaaaggaaggaggcgggcccugcgcgcagcauuuugggaaagaguggaauucuggguguuaggcccgccauucgcuugacucacgccuucgccguagcaucuuucgcagcggaccgaagagaagaaaaguaggccagagccggugaggcuggggacgggcgaggggaggucgaggcgccugugaggggccaggggcuggagaaagacuugcugcauggaacucugcggggcucggggagggaagaaagcgggaagcuugggccacccaaacaucagcgucgccucacuagcuccuggaaguaaguucauuagcuuuccccucaacgugcaugcuucucacauucuguaucucuccaggugaguguuuuucaaagcuuccaggcaguaaucucgaagucauuucugauugacuaucuccuucccccaaauccuaugaguuuuuuuuuguuuuuuuuuuuuuaaguagagacgggguuucaccauguugcccuggcuggucucgaacuccugggcucaagggauccaccggccucggccuuccaaagugcugggauuacaggcgugagccaccgcgcccagccggucauuuuuuaaaaaguucuuuguaucucugccccaguccccuuucaggcaaugguccccucaugcuuuccacacuguugcagcaguuuuaacuguugcagaaguuuuaacaaguuucucugcuucuaaaccuuacguucuauccauuuuguaaauaaaugcugcuaucuuuucauugcgucauucuuuacauauaauucugcagugguucuccacuaccuucagcauaaaaucuagacuccuaaggcugaaagccagggauccucaccaaaggagccuguccuuucaaccucauguucuccugucuuagguacgcuuaaguugaaacuuagaguuguugcucaucucaauaaaaaguucacugcuugaugcuuuugauuaggucaagucaggugcuuucccugauuuuccuccaugacaagcauuuccugcauauagcacguugucacuuugauauuuucucaauauccuugauaguaaaauaagugaaggguuaaagggcugaauuaaaaguacagccugcucuccuagaugugcaugguccuuuggucuguaucugcaccuuccauaggguagccacuagcuacauguggccguugaggacuuggaauauggccacugggauugagggacuggguuuuuuuauuuuaauucuauuguguuuuaguuaaguuuaauuuaaauagcuacguguguacaugagcugcuguauuggacagcucgggccuguauuauucucaaaacguaaucaucuacaauuaaggguuaacaaauaacagugcaacaaauuaacauuccagucccccuccccugacacacacaguauuggcuaaugguccuuuagcugaagauuaagggacauaggguagcggggacacaugacccaugggagaugcucucuuuucauuccuaguuuuacuucuguccaucccaucauuccuccucaccccacaucuugcacauauuugccagauaguuuccuccaaaccaggagcugagcuuuuuuuuuuuuccuugguagaaaaugcagcuuugguguuuuugcuaaguuuuauggagugccaggccuuaaaggaagcaugaugugugccacaugccuuuucagacucugaaagaugaacugacuguugucucucucauuguagaacucucuuccugccaagaugucuauuggugugccgauuaaaguacugcaugaggccgagggccacauugugacaugugagacgaacaccggugagguauaucgggggaagcucauugaagcagaggacaacaugaacugccagguauucugcuuugcaugugaggcugugugggaggaauggcccugugucuugaaggacagaaaaguguguguugagggucucuggaaauuguucucauucagcagugauuuccuaagugccuaaugcauaccagucaggugcuguuauaggcucugggggugugggcaugaacgagacacauaaucuugaggcagaaaagccauuuggagguuuggaauauuuuacuuuguccuuuuuguuuuuuccauccccaaauaugggggucuauuugggagaagugcuacuuccuucaguagaauccuucagauucagggccauuauccauuugccuccacuugcuuugcgauuagcagaaucuucucaccuacuguauuuguuucccuuuucucuuggaggaggagucucauuugauuauugcaacuaccuugugagguaagcagguuuggugauagucuugucauccauaaaauagggagaaugagauuaaagggcucaucacucugaugauaaauaauggaguaguuuccugauaugguguccuucucauggcacaacuuugccuuuugcauagucaucugaauuuuuauagcauuguuuuucaguuguaucuucacacuuucuuuguucuuuaaaccacugguuaagaacuuggacuugggagucagagagagauguggguuugaauccuaauuauaugacuuuagauguauuaaccacucaguuuucucaucuguaaaaugggggugguauuauguuggguucuuugauguagaugccaagacagaauuuugcaagguauuuauugggggaaaugacaauaaaggauaaaagagcaaggaagcaguaguaggcagggaaauuuucagucuauggugcuggucugacuggugaaaugagaggggaaaggaaggaggauugagcaggaagagccuuagacuacagcguaguuuugaggaaaucucagcaaggcagcgauugcucguuagaagagucuagcauggggcagaaaugggcggacuggcacccccgguguguucaggcuggcaacauggggagagaguagccucaaguugaaugccaugguggacugcaaagauggagauugucggcugccugcacuccucauagccuguucucuuuugaagggagaugugagcagcacacccuuaagacugccacagggguaauauccacacccccaggacuuuuacaaagaucagaugagcuguaugugugccauagcugcucagugccucacauacugugaguguucaacauaugauaccuauugcuuuuuuccagaugagaaggucagagagguaaagcaccuuacaccgcggucaggcauccugaccauccauugguuugcaggguucauuuauuugugauuuuucuguagcuuugagcgucugucaucuuccugcgagguugacaagcuuggucaguucccugaaugcagagaaguagaccucuggugacucagguuuauugcauuacugucaauagaucaguuuaucuauugaggguagauaaguuuaucaucucucauauauccaguccucuggcuuaaggcaugcucauccacuuuaagguucuuuaauuuggugaggagaaugcaagacuuggguuagugaagcuuaauggguuuguucaauuagcuguauguauuuggacaacuugcuggguuuccagggccuuugucaucccauccguaacgugaaggugucuaaccagauaaccuugguagccauucagagaugcagucaacaugacacaaagugcacagaccuugguguccgacagaccuggaaucagcuuguagccugcccccuagggugacuuggggcgagcuuagcuuuggaccuccuucauccucuggucccuccucuaaaucagggauaaaaauagcaccuuggccucagaaggaaccaugccugaccaauggugggggacagccaccugccucccugcuuguauuuguaugcuagugcuaccauaacaaaguuucacagacugggcagcuuagacaacacaaauuuauuuucucauaguucugaaggcuggaagucugagaucaagguguuggcaaggcugguuucuucugaggaaugugaaggaaggaucuguuucaggccucucuccuugcuuauauauggcucucuuccugugucuucacuuggucuucccucuguaguguuucuguccagauucuucuuauaaggauaccaugcauguaggauuagggcccacucuaaugacuucaucuuaacauaauuauguuuauaaagaauuuuuuuuuuuuuuuuuuugagauggagccuugcucugucacccaggcugcagucuugcucugucacccaggcuggagugcaguggcgcgaucuuggcucacugcaaccucugccuuccagguucaagcgauucuccugccucagccuccugaguagcugggacuacaggcaucugccaccaugcccagcuaauuuuuguauuuuuauauuuuuaguagagacagguuucaccauauuggccaggcuggucucgaacuccugaccuugugaucugcucgccucgaccucccaaagugcugggauuacagaugugagccaccaugcccagcuugcuugcuuuuuuuuuuuuuuuuuuuuuuuuuuuuuuuuuuuuuugagagucucacucugucgcccaggcuggagugcaguggcaugaucucagcucacugcaaccucugccuccuggguucaagcacuucucaugccucagccuccugaguagcugggacuaugcccagcuaguuuuucguauuuuuaguagagauaggguuuccccauguugcccaggcuggucucaaacuccugaguuugccucagccucccaagugcuaggauuacaggcgugagccacugcaccuggccuuuuuuuuuuuuuuuuuuuuuuuuuuuuuugagacagaaucuugcucuguuguccaggcuggaguacaguggcacaaucucagcucacugcaaaccuccgucuucccggguuuaagcaacucucuugccucagccuccugaguagcugggguuauaggcaugggccaccguaccccacuaauguuaauauuuuuuguauuuuuaauagagauggaggcucaucauguugcccaggcuggucucuaacuccugagcugaggcaaucugcccaccuuggccucccaaagugcuaggauuacaggcaugagccacugcacccagccuuuuuuuucuuuuccuuuuucuuuucuuuuuuuuuuuuuuuuuuuuuuuuugagauuaagcuuuggucuguugaccaggcuggggugcagugguuugaucauagcucaugggcagccuuggacuucugggcucaagagaucuuuucaccucagucuucuaaguauccaggacuaccagugugccccaccauaccuggcuaauuuuuaaauuuuuuuguagagacggagucuugauauguuuuucaggccaguuucaaacuccuggccacaagugauccugcugccucagucucucaaacuccuggaauuacaggcaugagccaccacaucuggccuguaaagauuuuuugucucuaaauaugaucacauucugaggugcuggguauuaggacuucaacaaugaauuuuuuugagggauacaauuuagccuguaacaggauguagaggccucacugggucuaucaaaaccuaggcacauugaauaagagccagcagacuguggcguagcuaaagcugguggugggugaacucugagcacaguuuaguuuguucagcacaucucaggcugugaggcuugccuguccuucccagauccagucauucugccuuuugggaaugagaacauccucuuagcacuuuuccuugcuuguucaauaacauuuucuguuauaaaaguggggugggacaaaaugugguggcuacuccuauaaucccaacacuuugagaggcugaggcaggaggaucacuugagcccagggguucaagaccaaccugggcaacaugacaagacuuugucuguaaaaaaaauaaaauagacggaugugguggcacaugccuguagucccagccauucagguggaggcugaguugggacgauuacuugagcccaggaagucaaggcugcagugagcuauggagugccacugcacuccagccugggcgacggagugagaccuagucucacacacacacaaaagcacaccacaacgauucggaaaagauaaauagaggaucucacucuguugcccaggcuagucuugcacuccuggacuuaagcgauccucccaccuuggccucccaaaguauuggaauuacaggccuaagccacaccugcccuguuuugggguuuuaguauuuacuuuuuauucuauccucuuucagaaauaguuagacccugucucuucugaaaagcaaaaaaguuuaaaaauuaucuggauguggggcugggcacuguggcucacgccuguaaucccagcacuuugggaggcugaggcgggcagaucacgaggucaggagauugagaccagccuggcuaacacggugaaacccugucucuacuaaaaaaaauacaaaaaauuagccaggugugguggcgggcgccuguagucccagcuacucgggaggcugaggcaggagaauggcgugaacccaggaggcagagcuugcaaugagccaagaucgcgccacugcacuccagccugggcgacagagcaagacuccaucuccaaaaauaaaaaauauauuaucuggaugugauggcuuaugccuguagucccagcuacuccauaggcugaggcaaaaaggaucacuugagcccacccagcaguucaggcugcauuaagcucuggucgcaccacugcacuccagccugggugacagagcaagacccuaucucuaaaauuaaaaaaauucuauggcaggauaaaaguagaugcauagaucauggugcagguaagcugggguagaauguaaaaugaagccaagcagucaguauccagaaauguaaaccugaaucucucuguacauugaauaaagguauauuccaguguaagauuaagcagggaagaucaucaguuccaaaaugcauaguguucuuaaguuaaaauagcaauuguguggauuucccuggcacucagauacaggagacacuauuagaugauauccucgacaacauccccauacaaaauacccuuuuauggucccucaaguaguuuuaaaguauccuguuaucuuagcacuguuuuugacauuugaaaaugcaaaauauggccaggcacauuggcucaugccuguaaucccagcacuuugggaggcugggccagggggaucacuugaucccaagaguuugggaccacccugggcaacacagugagacccugucucauauauguguguguguguguguguguguguguguguguguguauguguguauguauguauauauguauguauauauauguguguguguguguauauauauauauauuuuuuuuuuuaaaggaagaagaggaaauauguguaugugaaacucaggaugaggucccugaaauggugcuuaucgggucagagggugugcaucugagguuaagcugggaaggcagggagcuuuuguucuccuucucauuccgacagcugcaagccaagcacugguggccagugcugcaggauagggcaucagcugcaggauauggcauguuggucaaaaugcuguuggcauaagugagaaaaauaacaauacuccaaaauauguccccaguuuuauaaaaauggacccaaauuauaaaugauacaagcaaauacagagaguaauggucaaacccauuucacuacauucaaaaugacuuaauucuuagaaguuuuggugggagaaugugguguagagcucugcacaagcagacauugugcuuuuggggcuucaacaugaccacccaaucacugaugggacuguuugaaaucuguuuuguuggcuuuggcauauaauagccaucuuuggaaaacuggucucuguauggaauauggucuugugucacuguauaaaaaugagaacccaaaagaagcucucacaugauugggucagaaaauugcccauaacuauugcuaggaaaguuuuugaaaucucugaauucaauguaauugaauuucuuuagacaccuagcccucuagguugaaggaaaaccaguuuuuuaaacuuaucguauacuuuuuuuuuccuguacuguuuguguguggauugcauucaucaugcuccucuaccccauaauacuuuuguauuuccuaagaacaaagauagguagauggccuuaguugguauucguauuauagcaguggcauccaagcaccucugccuuuguguaugugugaaauuguccuaaagaaugcauuucugguguauugacaggccugagacaccccaacacaccuucacaguccuggagcuagcuuucuccaucuuggccccagguaucuaagaaagucccaccacuuugugcuacaaagauucucucucucccccucaggaugucauuucaguuggguaccuggcuuauaccauauguguuucauuguggcuguugaggaaaguugauuaaacuggguguuccugccuggaguugauuaggaucugguucacucaaaaguugcugccuugggcuugugauacaaacacaggucaggcuuauuagcaagcucuagcaggcaugugugcagugagacugugggguuuuguccacagcaagcuguucuuagccagugcuacagggaaagcgagagcaguagugagccugguuguuaggguuaaaauaggagucagaggacacuggacucuccugcuucagccaggacauaguucauuuauggaaaugccuagauuaagucuugucggacuuaugcaacagcuucugucaggaaaggagugagaugugccccugugcuggagggaguguggcuuagcaguggcacagcucccaaaacacauuuuagcugucaaucagauuuagcauguacugagucucuauuauguauuaggcaauagagacagcauuuagacauacuuugccuuguucauuuuuuuuuuuuuuuuuuugacagggucuuacucuguugcccaggcuggaaugcagugucauaaucauagcucacugcagccuugaacuccugggcuccagccauccucccaccucagccucccaaguagcugggaccacaggcaugcaccaccacaccuggcuaauuguuaaaaauuuuuguagagauaggaucuuguuacauuucccaggcuggucucaaacuccugaccucaagcaguccucccaccuuggccucccaaagugcugggauuacagacaugaaccacuguaccuggccugauuugcuuuuuaacaauuucaggaaaugugcagugguuaagagugugaguuagaaagaacuggguucaaacuccagccaggccauguaagcguggugugaccucaagcaggagaauagagggaaagggcauggguuucuggggacagaucugccucugaauggcuaugucacuucaucucuuuaccuuguaggauuuugugggguaacaugagcugccguggggaaaucaccugggccagcacuugaugucuaauaagugcucaguaacuguuggcuuuguugucuuguauuuucaaaacucagcuuuguaguugagggaacggaggcucagggaagccuggagauauaccuaggguuacacuucugacaaauggcagagcuggaucucaccuauaggucuuuaggccuauuuugugucuucuacagagucaugaguguggcacaguccccaaaacacguuuuuuguuuguuugguuuguuuuuuguuuuuugagacggcgucuugcucuguugcccaggcuggaauacaguggcgugauuuuggcucacugcaaccucuaccucccggguucaagugauucuccugccucagccucccgaguaggugggacuacaggcaccugccaccacacccggcuaauuuuuguauuuuuaguagagccaggguuucaccguguuugccagacuggucucaggugauccacccaccucggccucccaaagugcugggauuacaggcaugagccaccgcgcccagccccaaaacacauuuuaauugucagucagauucaggugagccugaguuguauccaguuucugucuuggguagucugaccauaaaccuggcguucauuuguggcacuagagguuaugguauucuucaggggaagaaaaggauugguaaggacuugggaacuggaugaaaauuuaauaacaggcugggagugaggagccuggagcagaagguuuaugagaaacuggagcccuguugccccugaagguagaacagggauaguggguagaagcucuagaaaccauuccucuagaaacugcucauauacaacaggggcggccccagagcauaguuuuguuuguuuuauuuuugagaggaucuugcucuguggcccaggcuagggugcaguggcuccaucacagcucccugcagccucgaccucccagaaccaagugauccuuucaccucagcuucccgaguagcuggacuacaggcacaugccaccacacccagcuaauuuuuguagagaugaggucucacuguguugcccaggcuggucucaaacuccugggcucaagugauccucccaccuugaccucccaaaguguugauauuacagacaugagccaccacaccuggcccauaguuguucuuuucugaguguucaagcagaggcuggguggccaguuagcacuugaggaaaagaaugaaugaguauaagauggcagcuagccagacagaaaucugcagagacagcacaucuuucuacaauaagggcugacccauucuaaauaaauuauaguucucucucuucagaagguucauacaauaagcugcuuuuucuguaaauguggugcuuguugagguugaugcuggcagauugguaucacccucccaugccaagcuggucucaccuucaggcuccccauuuguccauccugcagucuauccuuguugccacauuuaucuuuccugagugcugccuuaacccuauugaucuuuccucuaucgacaaacuugacugacuccuuuaucugaaguaacgaccccguccagugucauuauucgacugcucugguccucacauccuguaggcuccugcccaagugccugcucuuuuccuugugcaagcucuugccucauaacccuccaguaauuucaggcccuuuuuacaggccuugugguaccaccuccauuucucagucccuagucacucaaccuagaggguucugucucaccuucuagaguaugcacucuggagggucagaaccacaucugguauauacuugugaccuucauggugccuuugaaaucugagugccaggcagugcaggggaagacaguuuggaccagcaguuugaagcuguuuucguuaggguuuagcaccuucaagagcucuucacaucuuugcucagcaggcagugcagcacagccagggcucugaagcuaggccagcugguucgaaucuggaguucccugcauuccagcuguuugaccugggauaacugcuuugguuuuuuuaacauguaaagaugggagcacucggcugggcgcaguggcucacaccuguaaucccaacacuuugggaggcugaagcgggcagaucaccugaggucaggaguucgagaccagccuguccaaccuggugaaaccccaccucuacuaaaaauacaaaauuagccgggcaugguggcgcaugccuguaaucccagcuacucaggaggcugaggcaggagaaucgcuugaacccgggaggcagaggucacgguuagccgagauugcaccauugcacuucagccugggcaacaagagugaaacuccaucucaaaaaaaaaagggggggagcacucauacccacgcugaagguguugugaggacuguuuagguaaagugcucagugcagucccugguguacacaguuaguaccgaugauugcuggguaauucaccagcuuugucacaaugucagucugcuuuucuggacuucccccucccaccagucaaggcccuccccaccgcuggugcuguugaccguuaacuuauuagcuggugauuuccuuccagauguccaacaucacagucacauacagagauggccgaguggcacagcuggagcagguauacauccguggcagcaaaauccgcuuucugauuuugccugacaugcugaagaacgcacccauguuaaagagcaugaaaaauaaaaaccaaggcucaggggcuggccgaggaaaagcugcuauucucaaggcccaagguaggugcuuuucaugcacagguuuuaaaauauagguuugucuugugucuuguagaaaggggcccuauuacugccuggagacagagaggguuugaccucugcucucuccacacccaccacccacugccaccccuuccccuugcagcguggagugauccugugaggccauuauuuuauuuuuuugagacagagucucgcuuugucacccaggcuggagugcgauggugugaucucagcucacugcaaccucugccucccagguucaagcaauucuccugccucagccuuucaaguagcugagauuacagugcgcacugcccugccuagcuaauuuuuuuauuuuuaauuuauuuuuauuuuuauuuuauuuuuaauuuuuuuuaauuuuuuuauuuuuuugagauggagucucgcucugucgcccaggcuggagugcaguggcgugaucucggcucacugcaaccuccgccucccggguucaagcaguucucugccucagacuccuaaguagcugggauuacaggcacccgccacugcgccgggcuacuuuuuguauuuuuaguagaaacgggguuucaccaccuuggcuaggcuggucuugaacucaugaccuugugauccaccugccucagccucccaaagugcugggauuacaggcgugagccacugcgcccggcuuauuuuuauuuuauuuauuuauuuuuguauuuuuaguagagaugggauuucaccauguuggucaggcuggucuugaaguccugaccucacaugauccaccugccucggcccccugaaaugcugggauuaccagugugagccaccgcaccuggagaggcccaucuuuucuagaaguucugugugagaggugugggaucgcuugcccuugucuaguuugccgagcagacacagcccggagcagaugagcugacucgagugugagggcagcauuuccuagcgagacugggucuuauggauggacaccagcauguacuuagggaggucugauaguggagcuccguuuucagaaauaaagccaccuuuuaguacauuccaaaagugggacuguccuuuucgcaguccccuagucuggucuugcuucuugguuagccuaauuugguuuuauauuuagguucaugaaaguucugucauguugauuagacaacaaaguaauuguggcccuuggaaacugucuuaguguugguaaaaaagguuugcagccaaggaaggcacuggauucuucauugguaucuuuagcugcuguacauguuuuauaugugugugaggaaaaaagucaaacuguguuuuuccucugcucucacaacacaacaaucaacaaagacuucugugaccaagcaagcagucaguucugcaguagacaccagcuggguguccuucaguucugacacuaucuaccuggagauagccugaaaaaccacagguugagggcucggucccacaagacagccccugcaccccccacuauuauucauaagcacaggccuccagaacaucugaauggcuucaagccaggguucucacgucucacuccuuggguucgauuaauuugcuggaguagcucacacaacucgggaaucacauacuuaaauuuacugguuuauaacaggauauuuuauaggcuacaaauaaacagccacaugaagagaugcauagggugagaucuggaagggucgcaagcacaagagcuucuagccccauggaguuuccucccggcacauggaugaguucuuguucaccuuccugucaggcugcgcaugaucagcugucccgaagcuccccuaacccugcccucuugggccuuuuauggagacuuuauuggauagucaugauuaaaggauggacaaccauguggaaaugccauuagacaaaaugggugugaucuaacacuaauagacgggguugggaaaccccgcgaggccuguccagauucuuuuuggccucucucugcagcauuuguuccuccaggguauagggcaggaccuuucucuggagugaggucuuaugacccacaaucagauuaggguccugccuugggcaggugaaaggagggcaggagaaguuucaagagagagauucugucuccugaguccugcuucugaggccuaaagugccccaauguuauaacaaaagacuauaacaaggacuauaggaguuacgagcugggaaccauagaugaaagcucaaguuuaaagauguaauagugugaggggccgggcgcaguggcccaugccuguaauccuagcacuuugggaggccgaggugggcagaucacgaggucaggaguucgagaccagccuggccaacacagugaaaccccgucucuacuaaaaauacaaaaauuagcugggcaugguggcaggucccuguagucccagcuacucgggaggcugaggcaggagaaucgcuugaacccaggagguggagguugcagugagccgaaaucgugccacugcacuccagccuaggugacagagcuagacuccaucucaaaaaaaaagaauauuuuauuuguucuucaaagccugucuucuccuagaaccccuggguuacagaggagaacagcagucuuaucaugcuauuuauauggaguguguuuucuuuuugcuacuaugaaauaauucuuuuuuuuuuuuuuuuuuuuuggagacugagucuccaucacccaggcugcagugcgguggcuugaucucagcucacugccaccuccuccaacucccagguucaagugauucucuugccucagccucccaaguaacugggauuacaggcgcauaccaccacgugcagcuaauuuuuguguguucaguagagaagggguuuugccauguuggccagucuggucucaaacuuaugaccucaagugaucugccugccuuggacucgcaaagcccugggguuacagacaugagccacugcacccagccugaaauaauuauuuucucagaaaaaaauacaaaagauaauauaacccuucucccagaucuaacacauguuaacacuuaacuauauuuguuucagaauugaaaaaauuaauucagugcaucuauaauguuuuucagcucacccaaggccagccccaaggauuugucuuuucuguagcucucagaccaccuucuuugcccucagcaugcugccucccagccucuuguagagagcagugugggacuggaaggcaagagugugcugcuagcuccugcuuugaugccaguccccagccccugccccuccgucuccauccccccuguuaaaugcaguggcugucagcuggacguguuggcuuaugcuuguaauccugacacuuugggaggccgagguggguggaucaccugaggucaggaguuuaagaccagccuggccaacauggugaaacccugucucuacuaaaaauacaggaaauuagccgggcguugugguucacggcuguagucccagcuacucaaguaggaggcugagacaugagaaucgccuaaucccaggagguggagauugcagugagccgagaucaugccacugcacuccagccugggugacagagugggacuccgucucaaaaaauaaaaaaaaaaaaaggcgggagguggaaaugcaauggccagggugguguuggaccagguaacccuucagaacccuucuaacugguguccuagggcccuggcuacucugugcuaugagcauucaccgaccacacugaccuggccucauauuuucucuucccuuucaguggccgcaagaggaagaggacguggaaugggacguggaaacaucuuucaaaagcgaagauaauuuucuaaguugaacagaacuuuguccuuuuuucuuucagguuaucugaguucauuggagugggugcuugugcauauaugcuagguaucuuuugccaucuuucucuuuagaucaggggaaauguuuaagcuaaauaaaucugggggguuuuuuguucuguuuuguuuuguuuucuuugagaaaauaaggacuuuguguucauuugaaguuugcuuuggcuaaauuuugacacccugggggauguccugggagaaugccaguacuuugaaauagcacagcuauugaugagauuuuaagcugcuguuccuggccaguugcagguuaagccccagaaaaguucaccuuggagaagcuccgagaacacacagauugugucucauucaucuucagacacaggcacauaguguggcacuuuguucaguuaacauuuguggagcugucaucagcucagcuuuaacaacacaggugacucuuucccuugauaaagucauagguaauucaggggcugggugcggcggcucacgcauguaaucccagcacuuugggaggccaaggcgggcggau

SEQ ID NO: 192151 - RNA, 121647 nt, Homo sapiens
gcggggggagggcgagcccaagcgcgggggagggaguguaaauagagcgaaggcugcucugugucagccccgucaccgccgggcggcccgcgcggagucugagggagauggaaguugagcaagagcagcggcgcagaaagguggaggccgggaggacgaagguaaacauuaggggcuucuucucuagcugcucuggcgugaaguccuaagggcggcuccggugcccgccaccgcccccugccaggagaggacgcgguccggcggaagccgccgcggaggucucgcuuuuucccgccggcuccgcuggaagccgccuccuggccgccgccaucuugaauccgccgcucuccgccaggucccgcccccgccgcggccacagccaaucagcggccgggacgcgcggcgccucucgggcgggccggggcggggcugcgccugcgucgggggggguggggcgcgggcugggcgcggugcacgccggggcgggguguggcugcagggcggggcuacaggggcguggcguggcugcacggaggggguggggcgcggcaggcgcuggaccccaggcuggaucuuccaguggcucccgcguccuccgggaccggguggccuggggcgggcggccgguauucggguggcugcuuggucuagggccaguuuccugcgcggccggggccgggggcguggcgcggguggccugcagcgccuccccagggugcgccuucgccucguccgucggagaugcuuuccccgcgcguuucucgcggcguugcaguccuuacugugugaaaggcccccgcggcgcucccggccgccgucuucuucccgcgcccuugggcucgcguccugcccguccgggccuggcguacgcugccgggaacccacgcggcgcuggcgccgggcgccuucaagggacgcgcucccgucuuucucccgccccggguuucuccgugaaaaagcgcucgguuugauggccacuguccuagguuucgugggaauaaagcgcgcagagcccaugacucgggggcaggagaaagggagucccgaaagcgcgaggcggaaccgcgggagcaggccggccucugcgaggugcgcgccgcucccccccaggauguucuggcuggggugcuggggaagagcggggcucccgggcacggcggacaggggacgcggggcuaggccggggaagggcugaggcgggcaggaggggaaggggagcccggagccugcagggagcugcgaacaggagcagagcucccaggaggguggaggggggagggagggacaagacgccgccuguagggcgacgcaggccgcagaccaggucugugcuauaucccgacauggauaggugugguggaggaggacaugaaaauaaacgacaugagguugacuuugaaggaaauauuuccuugagagaccauuuucuuguguaaauggccuuguguaauuuuucuggguccaugagcuuguguacuuguguuaucauuuacacaaauguguguuccaugcguuuguuuuuguggccacaguugucuuuugagggaacagaugucuccccgugaaaggcugaugugggaucgaucgcauaccucuugaguaagacguuagcgggagaugaggcucgcacauagucucaaacucucggauuugaggacugagcagagcuaggcugugccuucugaugggcgaugcucuguggaugucccuggugcuuuggugagcugugucaugaaaaauagaacaucugauuccauaaaggaagaugugagauugaccuggcuuaauuaauuuuuugcuauuucuguaucuugucucagaaucuauggcuaggaaguuuuggcugggcuauauauuucuucaguugggggaaaauuggggcaagaagggagagauuuagcuuuuauaucauuuuaaaacuuaaauaugccuugauuaagcuaucaaucuuuuauacaaauuuuuuuuaaaguuuuauuuuucuguaaacugccaagggcuaggaaagcuauucugccaaucagccguaugguuuucuuuaccaggcauaauuagcaguccucauuguuagaccccuuggauauagauauugaugaaggcaguguuuguggagagccaucuguuggccagguguggcagaguagacugggucagcccucgggccucaugguccccaccagucuguugacuuugugguucuguuauuuuuuucucacuuaccuuugccuuuacuacuuaucuacauuuuugcgcagcuugcucacuuccgacagagaaaaacaaaaggugacaguucgcauucggagaaaaagacggcgaagaggaagggcucggcugucgaugcgucuguccaggaggagaguccgguaaccaaggaggacagcgcacucuguggaggaggggacauuugcaaaagcacaucaugugacgacaccccugauggggcaggaggggccuuugcagcucagguagauuugcucaauguuguauuugaacauuucgcuuaucuucuagugauuucuagugugauuuacuaaagauggucuuuggucuguuuuugccuuucaaaagugaggaaagaggguguuauuuuaguuuauaaaaagugagggccgggugcaguggcuuacgccuguaauccccgcacuuugggaggccgaggcaggcggaucaccugaggucaggaguuccagaccagccuggccaacauggagaaacccugucuauacuaaaaauacaaaaauuagccggacaucuggcgcacaccuguaaucccagcuacucgggagguugagggaggagaauagcuucaacuugugaggcagagguugcauugagccgagaucacgccaaugcacuccagacugggugacagagcgagacucucucucaaaaaaaaaaaaacagugaguaaauuuuuaugguuuuauucuuuuuauuuuauuuuuuauuuuuuugagauggauucucgcucugucucccaggcuggagugcaguggcgcgaucucggcucacugcaagcuccgccucccggguucaugccauucuccugccucagccucccaaguagcugggacuacaggcgcccgccaccacgcccggcuaguuuuuguauuuuuaauagaggugggguuucacuguguuagccaggauggucucaaucuccugaccucgugaucugcccgccucggccucccaaagugcugggauuauaggcaugagccaccgugcccggccuaugguuuuauucuuaauaaauuuggguuuucuuuuucuuuuuuuuucuuuuguuuguuccagacaguguuuugcuguguugcccagccuggagugcaguggugugaucacaggucacugcagccucaaaccccugggcucaagugauccucccuccucagccucuuaaaguguugggauuauaggcaugagccacugcgccuggcccuguuuuaucuuuauuauguaauuuugagaaguuuuggauuaacuacuugaagacaagugucaguuguuugcuuuguaauggaagacugggaguucuucguguguggucgugucagccccuuugauggguguuucuugggacauuuaaaacauaauauuccuucacauaguuguaaaugcaccugcuugucacauuugucuuuuaccuuuuuacuaaacgugagaugaagagggaaggggugaagguguugcagacaugguguguugcuggaggagacugggucugcugcuugaggccuugugagcugcaggggcacccccaugggcagguguggcaggugagugcacacugaguccugaaggggcuggccuuccgggcuccuugggggccuacaaaccugccuggaggcgggcuguccuugggccuuuuguaugaauuaugaacgagggccuuagguguugagugucccugcugcugcagcagaaugggugcaggcuuugauguuugcuaggauuugcuggaaaacugguggccaaaggcagaaucuggcucaaggucauaauguauguauccugcuuuacuuaaaaaauugaguuguuggcaacaguuaaaauuuguguuauucuaccuacaaauccugaauuuugcuuuuuaucucuugaguguuuuugguuguuggguugguguguuuuuuuuuuuuuucccguuuucuuuuuaagauacagucucucuguugcccaggcuggagcgcagugacgcgaacucugcucagugcaaccucugccucccaggcugaagcgaucuuccugccucaggcucccaaagugccaggauuacaggauuucugccaccuugcugggcagaaaguuacuuuugauauauucugguugcauauguuuuuugguuuuuuuugaaauggagucucacucuuuugcccaggcuggagugcaguggugcaguccuggcucacuguaaccucugccuccuggguucaagcgauuuuccugcgucagccucccguguagcugggauugcaggcgccugccaccaaacccagcuaauuuuuguauuuuuaguagagacaggguuucaccauguuggucaggcuggucuucaacuccugaccucaagcaauccacccaccuuggccucccaaagugcugggauuacaggcgugagccacugcacccggcccucugguugcacauacuuuuuuuuuuucuuuaaggcgaagucucacucugucauccaggcuggagugcagcggcacgcccucugcuuccugcaaccucugccucccgauuucaagcguuucuccugcaucagccucccgaguagcugggauuacaagugggcaccaccauggccggcuaauuuuuguauuuguuugguugagaugggguuucaccacauuggccaggcuggucucgaacuccugaccucgugauccaccugccucggccucccaaaguguggggauuacaggcgugagccacugugccuggccugcauagacguuuuaaaaguaguaagcugauaaauauaugugggaaucucaggauccuaucagaaaaccauuccaaacuuagcacauuuugugguaaauuguauuuggagacugaugggucguuaacauuagaaggcaugguauagacuccugauuaaacacucauacuuugcuguuucaucagguagagacucucuuaguuucuaacucugcuauuugaugcaugccuucauucaggaagaugaucugaugaaaagcauuuugauuuuuguuuucaaaaccagaagggcauauaccagaaaauuaacagugguggucagaaaggaauagaguuguugguuuuuucguuguuaugguuuuugguauuuccuacaauaaacacauuagguuacuuauauaacauuuuuuuucauuuuagaauuaacuauaccacuaauaaaacauguauuuuggacaucuuaaagcaaucuauaaauaacaggcccauuacugguccccuugacuuagagaugcacacgcacacucacugcacuugcugcauuuugugucaccuccucgugaccacaguggacaggacacuucacccucaagcguggggugguguggcagaugugaggagaggucugcuuucacaaaacuuggugaaacaauggcaagauggccaagguaaagcauucuguuacuuauaacuguugcugugaguaguaacuuaacuguuuaaagcaguauuuuaaaaaccaaaagcugguaaaauguaaggauacuuucucuaggaaaaguaugugcuccugcagccaggauucuucauggaaugaaggcauggcagggccugacugauuuucaucucacaucgucauccugaacuccucugcacaguuacagcuugacaucagcagagacauaccuccucuuccuguccauuggcucuaaaauggugggcaaaggucagguaccagucagcuuuuuccacagaauuccugacauuuuaauaagcuaaacaugcagucaucagguauuaaccccuauuggaucuuggacaucagcuuuuucccccuuuuuuuugagauagggucuuguuuucuugaccaggcuggagugcaguggcgcaaucauggcucauuccagccuugaccuccuggccucaagugacccuccugccucagccucccuaguaccugggacuacaggcaugugccaccauaccuggcuaacuuaaaaaaaaauuuguagagacaguguuacacuguguugucagggcuggucucaaacuccugugcucaaguaauucucccaccucggccucccaaagugcuggaauuauaggugugagccaucccaccuggcuaaaauuuauuuucuuuauacauguauagguaaacuaaguaguauguguagaauagagccauugucuuucugcuguacacuaaguuaggaaucaaauuucuuaagccauuuugucaauuauguauauaaaaaccauuggugcuuuagaagcagauauuucauuaacuuuuuucugauuauaucauuguacaucaucaguucagucuaaaaaggaguuuuuuucauauguauuauaaaauauuucaugauauuugaguuuaguaugccuuuaauccaguuguagauguuaaaauaggaguaauuuuguguucaaaauaaugaucuucugaaaagugaaauucuaggaaagaguccacuguuuaaagcuagcagcugguggccguguggccgaauaaugucccaggccagggcacuccccucucagaugguuggucaugcugcgucggagaucaggaauccucaaggaaccuuuauguuauaguuguaccagugcuuuaaacauaaugaaaggugcauuuguuuuauuuuacccaucuauaaauugugagagguuuggcuauggagagucuagugagcuuauugaacagcauaagaagauaaguguguguguuugugugugugugagaguguguguaugugugugugagggggagggagaaguuauugugcuuuccaacauauaauaaauugcuuacuuugaucacuaacuguuagguaaauacugaugauuucuagcauaagucuuuuuucuuuuuuuuggagacagguccucccucuggcgcccaggcuggagugcaguggcccaaucagcuuacuucagccuugaccucccugacucaggugauccucccaccucggccucccaaagugcugggauuacaggcauaagccgcugugcccagcugauauaagacauauuuuuaaccaacuuuaagaucuuaguuuuuuuucaggaugguuauaagcgaagguagaauugcagaaagacuuugugguaaauauucaggauucggcucuguugccuuacaauuuguuaagugcaugauggaaaaauaguugaaacaaugcaacagcugucucaguucugaaaguuaacucagaaauggcagaaagcaaggucaggcaugguggcuccgagcacuuugggaggccaacgugggaggaugguugaaacucugucucuaugaaaaauauaaaaauuagcugggcaugacagugcacacguguagucccaguuacucaggaggcugaguugggaggaucaccugcgcccaggaguuugaggcuacagugagcuaugguggcaccacugcacgccagccugggcggcagagcaaggccuugucucaaaaaaaaaaaaaucauaaaaauaaagcaaugguagaaagcagaauuugaccuuucaguuacagaugaggaacaaagugaggagaggccauuuuuugguaaaagaaccaucuggcgggacgcauuggcucaugccuguaaucccagcacuuugggaggccaaggcaggaagaucaccugaggucaggaguucgagaccagccuggccaacguggugaaaccccaucucuacuaaaaauacaaaaauuagccgggucucauggcaggcgccuguaaucccagguacucgggaggcugaggcaggagaaucacuugaacccgggaggcagagguugcacugagccgagaucgcgccauugcacuccagccuggaggacaagagcgagacuuuaucuccaaaaaaaagagaaccauccaaaaauugcucagaggucaagaauuucagaagaaaauacaaaaacuuuggcugaagaagauuuaacuagugcuauagaaggcuuaagaagugugguucuagcacuuuuccaacucauauuuguaucaaauaccaggaaaaauaguuaucaccauuuaucaucuagauuucugggccguuuuacuguuuugucauuuuaaguuguuuuacacguaauuuacagaaguaagaauaaagcaauaauuuaaaacaacuuuauaagaaauuugauccaaccucuuuguaucaaguaaguuuugacacacaaacauuagaaguguccucuuaaggaaguggaugguccagguuccuuugaagugugaucauucaugugagcgggcagcugauugagacuacuguguccccuuuucgucccucacuuccucuugauucugagaagauugaucuaggguauugucaaaugaagacuugucugagauuuuauuuucacgucaguuuugccaucaucauuggccaugggugcucucucucugcauucaucuugugacucaucuaaugaucccgaaaagucgacacugucauguuucuuugcuauuuugggaagaaauugaaauguucuuagugaaucaucuuguuaaagcaagcuaaucugggcacuguggcucaugccuguauugccagcauuuugggaugcugaggugggaggauugcuugagcccaggauuuugaggccagcuuuggaacauaaugaacagagacccugucucuacaaaaaaauaaaaaauaagcugggcacaguggcgcaugccaguaguuccagcuacucagguggcugaggcaggaggaucacuugagcccaggagguuaagguugcagugagcugggauugcaccacugcacgccagccugggugacagagcaagaccuugucucaaaaaauuaauuaaauuucuuuuuuaaaguagaauucauggccgggcgcagugacucacaccuguaaucccagcacuuugggaggccgaguugggcagaucacaaggucaagagauugagaccauccuggucaacauggugaaaccccgauucuacuaaaaauacaaaaauuagcugggcaugguggcacgcgccuguagucccagcuacucaggaggcugaggcaggagaauggcgugaacccgggaggcagagcuuacagugagcugagauugugccacugcacuccagccugggugacagagugagacuucgucucaaaaaagacaaaaaagaaaaaaaaaauuagccgggcgugguggcaugcgccuguagucccagcuacucgggaggcugaggcaggagaauuguuugaacccggaggcggagguugcagugagccgaggucaugccaccagccugggcgacggagugaaacuuugucucaaaaaaaaaaaaaaauuacaggcugggcacgguuacucacaccuguaaucccagcacuuggggaggccgaggcggguggaucaccugaggucaggaguucaagaccagucuggccaacauggugaaacccccgggagguugagacaggagaaucacuugaacccaggagguggagguuucagugagccgaguucgugcaacugcauugcagccuggcaacagagcaagacuccgucucaaaaaaaaaaaaaaaaguagaauucauuaagaagaggggcaggaacaucauuagggaaauuacuugcauuauaaaaauguuuagagcuggccaggugugguggcucaugccuguaaucccagcacuuugggaggccaaggcgggcggaucacgaggucaggagaucaagaccaucuuggcuaacauggugaaacccugucucuacuaaaaauacaaaaauuagcugggcgugguggcgggcacccauagucccagcuacuagggaggcugaggcaggggaauggcgugaacccaggaggcggagauugcagugagcugagauugugccacugcacuccagccugggcgacagagcaagacuccgucucaaaaaaaaaaaaaaaaauguuuagagcuugggaauuguuaaugcggaaggugcacguucugaacagguggaagugagcucuacuuguuaaaugaagucagcacaggccugcagauagaggagcugggaagggccugaggcugcagcccuagaccuugcuuuaaaugcuucuuucugguccuccccuucuuagccggaggacugugauggagagaagagagaggacuuggaacagcugcagcagaagcaagucaaugaccauccuccagagcagugugggauguucacagucagugaccacccaccagaacagcaugggauguucacagucggugaccacccaccagaacagcgugggauguucacagucagugaccacccaccagaacagcaugggauguucacagucagugaccacccaccagaacagcgugggauguucacaaucagugaccaccaaccggaacagcgugggauguucacagucagugaccacacaccagaacagcgugggaucuucacaaucagugaccacccagcagaacagcgugggauguucacaaagguauucuuuaaguucucuguuaagguguauucuuugucaaaagauuucuuuauguuguagaaauccaaaccagugagaggaccuuccaucucugcagggccucucuuuagaaguggaaacuggaagcauagagagcuggaggcagaggcucacccuguaggccccacgugcugccgccugcacguucuuaguguugccugugaaugggaagccucucuucauacccuucucccugagcucaaaucugccucccuugugaucuuccuuuuuuguuuuucccaugggacauugaagagaagccacccuucauaaguuugaggaaugucaugaauucccuuuauucuaguugcccuugucgauugacucaccugucuguucagccuguuucuuaggccugguaccucguuucucacaucaucaguuugugacuggaaguccugugccaguugagagccuggcagggcagggaggcuguggucagucugcaugucccugguuucugccacguuccuggugggaugaauuccauacguguugaguugauuaccuuuauuuuauugacauguuuuuuguuagcauguggaggaaaacauuaaguuuggaauugacuacuuuugaaguguuauguuaaaagcauauauuuuaggcugggcacgguggcucacgccuguaaucccagcacuuugggaggccgaggugggcggaucacgaggucaggaauuuuagaccagccuggccaauauggugaaaccccucucuacuaaaaauacaaaauuagcugggugccacugcacuucagccugggagacagaccgagauuccaucucacaaaaaaaaaagccucuauuuuagccauuugauucuagcuagacucaguucacacugcuuuaggcaaguuugguuguuuuuugguuuuugggguuuuuuuuuuuuuuuuaaauagagacggagucuugcucuauugcccaggcugguggugcgaucuuggcuuacuguaaccuccgccuccuggguucaagcgauucuccugccucagccucccaaguagcugugauuauaagcacccaccaccaugccuggcuaauuauuguauuuuuaguagagacaggguuuccucauguuggucaggcuggugcugaccucaagugaucugcucgucucagccuccugaaguguugggauuacaggcguaagccacugcacuuggccggcaaauuguuuguuuuuugagauggaguuuugcucuugcccaggcuggagugcaguggcgcgaucucggcucacugcaaccuccgccucccagguucaagugguucuucugccucagccucccaaguagcugggauuacaggagcaugccaccacgccuggcuaauuuuuauauuuuuaguagagaagggguuucaucauauuggucagacuggucucgaacuccugaccucaggugauccuccugccuuggccuccccaagugcugggauuacaggcgugagccacuaugcaggccaaguuuaguuuuuaaucugcauuauugcaggaaagaucuaacuccuaggugaggccuggaagcacagucucugguggguucuauaaaacccacucuucauuuauuuauugacuucuugggaccgggucucauucuguccccugggcuggaguaugguggugccaucacagcuuaguguagccucaacauuuugauucuuaaguuguugcagcucuguccguggggagccccuucagguggcuccugugucauguguuugaagcacauccuggcuugugacacugcaaguuggugccgcaggcucaucguguaggcccugucuccguucugaguccgcuguuucuccaaggagucuuggugccuuuuacuagauuaugguguugagaccaagaccugggcucuaggugugcucacuccugcugggauguugcugcugcuucugggcucucuccguggacagagugaggaagggugugccugggagcuagucuguguguacacucauagcuguauuuauguucauuuguauuuauagacauauauguuaaauaggaauacauacugauaccucagagccuaauccagcaccacagaguucauucugcccucccccccagguuuauuugcaguuuccuucucggauagugagaagccuggcucucacuucugccauuuauuuacuuuaaaaaaaaaaauuagaagguuguuuuuuuuguuuguuuguuuguuuguuuguuuuuuugagacagucucgcucuguugcccaggcuggagugcaguggcaggaucucggcuugcugcagccucugccuccugggcucaagugauucuccugccucagccucucuaguagcugcgauuacaagugcugccaccaugccuggcuaauugggguuucaccauguuggucaggcuggucuccaacuccugaccucagaugauccacccgccucaaccccccaaagugcugggauuacaggugugggccaccacgcccggccccauuuauuuacuuauuuguucaacucuccuguaaguguauaauaguuucagaauuagcaacccacaucauauaagaaacaaauuuaccaaguggauuuaaguguuuguuuacagcuccuuugucuccauuuucaguuuccagucacaacuguuuuccaagguuacucaggucacuccucucuuccccagcccuucacuaagguugugucuucacuggugaguauguagucagguucauuggucacuggcuacuuccuauccugggaucccacaacauccuggucaauuuuuuaaaguugcauacuguuuuguuuuguuuuuugagauggaguuucgcucuuguugcccaggcuggagugcaguggcgcgaucucggcucuccgcaaucuccgcuucccggauucaagcgauucuccuaccucagccucccgaguugcugggauuacaggcaugcgccaccacgccuggcuaguuuuguauuuuuaguagagaugggguuucaccauguuggucaggcugaucuugaacucccaaccucaggugauccgcccccaccucggccucccaaagugcuaggauuacaggcaugagccaccgcgcagacuguuuuuuuugagacagugucuugcucuguuguccaggcuguagugcagcgguacaaucuuggcucacuacagccuugaacuccuaggcuuaggcaguccucccaccucagccucccaaguagcugggauuacaggcacguuccaccacaccuggcuaaguuuuguuuuuauuuuuuuguagagacagggucucacuguguugacaggacuggucuugaacucuugggcucaagugauccuccugccucggccuccaaaaugcugggauuacaggugugagccaccucgcccacccuaaaauuugcaugcuucuaaguucauucuuugugaugcacaauuguguagagucauauucaccacccaguuacccucgagaacaaccccagcccccaagagggcccguguccucuuucuaaccagccgcucucuccuuccccagccucuggcaaccaguggucuguuuuuuguucuaugguuuugccuuuuccagaauguucuacagauggaauucuauaauauguaggcuuuuggguccagguuuuuaaaucacuuagcaaaaugaguugaagauucauccaagcuuuagauugaucaguagcucauuccuuuuugaugcugguuaguacuucauugugugcaugguacacaguuuguuuauccacucaccuggugagggacaucuuucuucuagcuuuuuugugaauaugaauaaugaaugugucuuuuuuuuuuuuuuuuugagacggaguuuugcucuugcacucuugucgcccaggcuggagcggugaucucggcucacuauaaccucugccuccugggcucaagcgauucuccugcuucagccucccgaguagcugggauuacaggugugcaccaccaugccuggcuaauuuuuguauuuauuuauuuauuuauuuugagacagggucucucacucgcccagccuagagugcaguggcccauucucagcucacugcaaccucugccucccaggcucaagggguucucccgccucagccucccgaguaccugggauuacaggugcaugccacuaucacuuggcuaauuuuuguauuucuaguagagacgggguuucaccauguuggccaggcuggucucgaacuccugaccucaaaugauccacccgccucggccucccaaagugcugggauuacaggcgugagccaccgcacccggccuaauuuuuguauuuuuaguagggauaguuuuaccauguuggccaggcugaucucgaacucaugaucucaggugaucugcucaccucggccucccaaagugcugggauuacuggugugaacaacugugccuggccuguuuuuauuucccuucuugaaagccuggcuggcguagacauauaguuggcaguuggugucuugcuugccggugguuucgcucugccccucucuagcuuguguucacugccguggccacccugaaggcuuuugucuuugguguucugcaguuuugauuuuauguguucuuuagagggacagaacuaaaaggauagauagacauauaaaggggaguuuauuaaggagcaucgagucacauaaucacaaggugaggucccacaguaagccaucugcaggcugaggagcaaggaagccagucugaguccgaaagcugaagaacuuggagucugauguuugagggcaggaagcauccagcaugggagaaagauggaggccagagggcuaaccagucuagucuaguccuuccacgcucuucugccugguuuuauuuuggccacacuggcagcugauuagaugguggcaacccagauugaggguggaucugccuuucccaguccauugacucaaauuuuaaucuccuuuggcaacacccucacagacacauucagggacaauacuuuguauccuucaauccaaucaaguugacaauguuaacuaucacaccagguauggcuuuuuaugaugucuuugauucugcuugggaucuaggguuuucuucaauguguggaugaugcuuuucucaucuguugccucaaauccuaaccaguaucuccaucauaccuucuaccuguucuuucucuccauuaaguuuuagaguucucuugcauaccguauuuguccauucucaugcugcuaauaaaggcauacccaagacuggguaauuaaggaagagagguuuaauggacucacaguuccacguggcuggggaggccucacagucaugguggaaggcaaggaggaccaagucacaucuuagguggaugguggaaggcaaagagagagaacuugugcagaggaacuccucuuuauaaaaccaucggaucuagugagacuuauucacucucaggagacaagcacgggaaagacccgcccccaugauucaguuaccucccacugggccccucccaugacacgugggaauugugggagcuacaagucaagaugagauuuggguggggacacagcccaaucauaucacauacguauagcucagcccacuuuugugcuugccuucuuuuugcucuuggccguaggcuggaucguuuuaucuguguuaucucccauuuuucuaaaccucuguucaucuguauauaaucugcuguuaaauacguccagaguuguuaauuuuguucuugcuguuuuuaguucuauuuggauucuuuaaaauugguuguuauucugcauaauuuuuuguuuccuagagauauuuucaaacuuauuuuaacuguacaucuuuuuuugugagugaauuggucuccacuuuggccugguauuuggaggugcagugagccuauccacuuuguuuuuuauugagauggagucuuucucuguugcccagacuggaguguaauggugugaucucggcucacugcaaccuucaccucccagguucaagugauucuccuaccucagccucccaaguagcugggauuacaggugcccgccaccaugcugggcuaauuuuuguauuuuuuuuuaguagagacgggguuuugccauguuggccaggcuggucucgaacucuugagacgaagucucacucuguagcccaggcuggagugcaguggugccaucucagcucacugcaaccucugccucccagguucaagagauucucaugccucagccuccugaguagcuggaauuacagacgugugccaccauauccggcugauuuuuguauuuuuaguagagauggguuuccccauguuggccaggcuggucuugagcuccugaccucaagugaucugcccaccuuggccucccaaagugaggggguuacaggcaugagucaccgcgccuggccagcccauccacuuugaauggaauguguugcucggguugauuuggaucacuauuauuuugggucugccgugggugccacuucucaggaucuuuuuuugguuccuugaauguuuucuguuuuccauauguccguuauuccgcuuggaguagcacauugucuggucuuuuuuagugagguguuuguguuacuuuugugagaagucuguguuauggcucgugggagucccuucaaguucagugccacauuuucaucugaucagucuuccaaaaauaucccuuucccuagacacguuuuaauauaauuuuuauuuuuuauuuuauuuuuucucacgucuaguaaggcagggaauauuuuuaaauuuuuuuguagagaugggaucucacuauauugaccaggguaggcucuaacugcuggucucaagccauucuccugccucggccucccaaagugcugggauuauagguaugagccuccacaccuggccuccuggacguguuuuguuuuguuuuuuaauuuugagacggggucuuacccuguugcccaugcugcaguaaguggcacaaucguagcuuacugcacucuccaccccugggcucaagcagucuuucuacucagccuccugaguagcugggaacacaggcaugcaccaccaugccuggcaaauuuuuaaauauuuuguagagauggagucuuguuacauucacuaggcuggucucaaacuucuggccucaagugaugcuccugcuuuacaugcuuuuuacuuauuuuuuuuuuuuugagauggagucccgcucuguugcccagccucgaguguggugaugcaaauucggcucauugcaaccucugccucccagguucaagugauucucaugccucagccuccugaggagcugggauuauaggcaugcaccgccaugccugacuaauuuuuuauuuuuaguagagaugggguuuugccauguuggccaggcuggagugcaauggugcaaucuuggcucacugcaaccucugccuccuaggcuuaagugauucuccugccucagccuccuaaguagcugggauuacaggcgugcacaacugcggccagcuaauuuuuguauuuuuaguagagacaggguuucaccaugucgcccaggcuggucuugaacuccugaccucaggugaucugccccccucgcccucccaaagugcugugauuacaggcgugagccacugugccuggucuccauacuguauuuuuauagugauuguacuaguuuacguucccaccagcagugcaaagguuuucuguuuucacugcauccauaccaaccuggauguguuuuuuaucuguuugugucaucaauucuuucuuuuuuuuuuuucuuuuuuuuuugagacggaguuuugcucuuguugcccaggcuggaaugcaauggcaugaucucggcucacugcaaccuccgccucccggguucaagugauucuucuaccucagcuuccagaguaguugggaauacaggcaugugccaccacgcccagcuaauuuuuguauuuuuaguagagacggaguuucagcagauggucucaaucucuugaccucgugauccgccugccucggccucccaaagugcugggauugcaggugugagccaccgugcgcagccagcgauuucuuucagcaguguuuugugguuucccuuguagagauuuuucgccuccuugguuaggaauauuccuaaguauuuuauuuuauuuuuugcagccaucguaaaagguguugaguucuucauuugguucucagcuuggucacuuuugggguauagcagugcuacugauuuguguauguugauuucguguccugaaacuuuacugaauucaucgaucagauguaggagcuuucuggaugagucuccaggguuuuguagguaaacgauccugucaucagcagacagggacuguuuuuccucuuuacugauuuggaugcccucuauuucuucucuugucugauugcucuggcuaggacuccagagcaguggugaaagugagcauccuugucuuuuuccaguucuaaaaugccuucaacuucucccuuuucaguauaauguuggcuguggguuugucaugaauggcuuuuauugucccuucuaugccgauuuugcugaggguuuuaaucguaaagggauccuggauuuugucaaaugcuucuucugcaucuauugagaugaucauaugauuuuucuuuuuaaugcuguuuaugggguauaucacauuuguuaacuuguguguguugaaccuucaucccugguaugaaacccaaguguauuaucuuuuuuaugugcuguuggauuccguuagcuaguauuuuguugaagauuuuugcaucuauguucaucagggauauuggucuguaguuuucuuuuuuuguuauguccuuuccugguuuugguauuagggugauacugacuucauagaaugauuuaggaaggauucuuucuuucucuaucuuuuggaauaguuucaguaggauuaguaccaauucuucuuugaaugucugauagaauucagcugugaaucccucugguccuggacaauuuuuguuggcaauuuuuaaauuacuguuucagucuugcugcuuguuacuggucuguucagaauuucuguuucuuccuggucuaaucucgaagggauguauauuuccaggaauuuauccaucgccuccagguuuucuaguuugugcacauaaagguguucauaguggccuugagugaucuuugguauuucugugguauugguuguaaugucucccauuuaguuuccaauugagcuuauuuggaucuucucucuuccuuuccugguuaaucucacuaaugaucuaucaguuuuguuuaucuuuucuuuucuuuucuuuuuuuuuuuuugagauggaguaucgcucugucacccaggcuggagugcaguggcgcgaucucuguucacugcaagcucugccgggucugccucccggguucaugccauucuccugccucagccucccgaguagcugggacuacaggcgccugccaccacgcccagcuaauuuuuuuguauuuuugguagagagaggguuucaccauguuggccaggauguucucaaucuccugaccucaugauccaccugccucagccucccaaagugcugggauuccaggugugaaccaccgcgcccggcccgagcuccugacauugaagggagauguugcugcacucauguggccgcccacccuggggacgaguccccgcacaggcagcccuuguggagcccaccaugccgcccuucccuguccaguuccuccgggggccuuucuagcuuuugcaacuguaucaagccuguaucucuccaucccuagccaguuccccaguuggggcagaaaaauuuaguuugggucauuuuuuaaucggaaguacucugugagcaagugggucaccuggagcccagaaaggugccuggcugaugcaggggaagccagagaauggucgcuuccacaggcaggggauacgucccaggcgccagucgaggggcaggagccugcagggagggccacagugacggugggcucaggauccgugccgacgggcccccugcagcuuuucuuuucccuuuggguuauugcugcugaaaagguuuccagaggugggaauguugagacagggaaaggcuuucuguggcucgaccuguguugccaaaauggcugcugagaaaaaaguugaagcaacugauucugauguugguagcauuugggugcauuuguuucuugugacugugguggcacugaggauucguaauauucuucccaacuuuugcugauuuaguggccauacaaggaucuuuaaaguuugugucucuagauugguuuaccuuucaucgguacccacuuuuuccaggcauuuuaugcacauuuucucucuguaggcgucauuuccgccuuuuuccugagagcagguuguuuguuccucccguggcagcacugcuguggcguggggagaguccacagcuucuguuucugggacuuuauuuuguuuauuuauuuuuuugagguggagucucgcucuguugcccaggauggagugcaguggugugaucucagcucacugcaaccucugccuuccagguucaagugauccuccugccucagccucccaaguagcugggacuacaggugcccgccaccacgccuggcuaauuuuuguauuuuuaguagagaugggguuucaccauguuggccaggcuggucucgaacuccugaccucagguaaucugccugccucggccucccaaauucugggauuauaggcgugagccaccaugccuggccuguuucugggacuuugacuuuacauugugauuuaagcgaguuuaauauuuuuccuucuucuuuuuuuaaugagauacaauuaacaagcauacgauucaccauuuuaaaguacagaccucaguggcacuuaguacacucacagcaugugugagcaccaucuccaguggcuccagacaucaucaucaccccagaaggaagcccggugcucgcggcagccaccccgcucuccucccucagcuccucgcagccuccaggcugcuccaugucuacggauuugcagauccugaacacuugauguaaacggaaccucaccauacguggccuucugugucugcucugucacucagccucacgucuucagggcuccucuguguugcagccugaguuggggcuucguuccuucuuguggcugaauggcagcccacguuuguucaaccauucaucccucaggaggcauuuggguugcucccaccuucuggccguugcgaguggugcugcugugaacagcugcgaacgggguuuugugaggacgugcgucgucaguucuugagcacaucacuguggcuucucaugugaauucuggaccuacauucuuugccuuuuuuccccaggagugugaacaagaaugugaacuugccauuacugaccuggagagcggccgugaagaugaggcuggccugcaucagagucaggugacccggcggggccugcacaggcucacagcaugggcucuguuauccccacagggcacagugggcauccggguggggguggggugggcgcugccaucuccuuucucugaguugucuguuuccacguucuguguguggggccaucagcagggccgguggaggagacacacguggaugcugggggucagggggcuuggucaggugcaggccacaugaaugacacacugaccucaggccgguugcucucccugucagcugcgaagcccccuccagguacacacagugccgucauacagcgagggaauucggggugcuggugcucagggcagugaugcgcuguggggucacuggcagaggagcuggguggcaucucaguggcauccgggccucuguguccugccccugcuuccacgggaugucugcuguuucauuuucugugucuuccuuacucauucucauucaugcuucugugucucccugaugcgcccugguucugaccaugggcccuuaucagaggccuuuucuccgccgcaggccgugcauggccuugagcuggaggcgcugcgccugagucugagcaacaugcacacggcgcagcuggagcugacacaggccaaccuccagaaggagaaggagacggcauugacggagcugcgggagaugcucaacagccggcgugcccaggagcuggcccugcuacagagcaggcagcagcacgagcuggagcuccucagggagcagcacgcacgggagaaggaggagguggugcucagguguggacaggaagcagguacugcauggcuaggcgggcacgggcagcgugugggcucggugugggcauucuagugccuguucccucuugggguugggagcuggggcgcccuagcaccgucuccccaucucuguucucagcaccuugccuggugucuggcaccaugagaggggugaacaaagggggcccuuggguuuuuguggccaggagauuauuagagcagguuuccagguggucugugauaggugcgacccagggcugaccuucaccuccucucuuagaucguccugugugucuggaagucacgguguccucaguuuguuauuaaagccaagcaucaucacagacacauccugcuagcccgugaaugcuggcacguguccagugggugccagagccuggucguuuccugggcaguugggucacugaaaagguugagauggaguggccugagcugcuuuuuguuuuucuugcagcugagcugaaggagaaguuacaaucagaaauggagaaaaacgcccagauaguaaagguacccgggaucgauucuaaaaugcacgccucuguguauguuguuuuuccuuucucgccaggucccaugagaacgcuccucaccuugauucagacagaagccagucgaggcuuuauuagaauaugcugguugaaaguguauugcguucuuuguuuauuuauaucauuuguauuugucagaaaacuuguuuuguuguuucacauugacuugcauaacacaaaggcacugcucggccccuccaugcugucuucugaguggcccccauggccugccccugagcuguguucugggacacagccucugcccucguggauguggcaguucccugcagugcauggggugugggugcuggggugccggggagaauaccacacagggaggagguuuugggugggguggguugcaccugcuguggguggccucacuggggaccacagguagcagugccccgucauugccaggcccuccgcuagagggcugagcugucagccaugcugaguguggaggcccuuccugagucaggcaucugggcagcucucaggcccuuggcagacgauggguguuaguccaggcuugggguuguguuccggucaccugcuccucugacgcaggcagugagacccauuucucagaacacuugggacagagcccagcccuuggguggagguuggcaaaguugccauuggccccugggacuuauagggagauguauuacuaacgcuuugagggugacuguguggauuaggccuugcgugcagaggcucgucuguuucggggugggugguccuugugcagaggcuggucuguuucaggguaggugguccucucgcuuugugcagaugcaggucuguuuugggguggauggucccugugcagaggcuggucuguuucaggguggguugucccugugcagaggcuggucuguuucagggugggugguccucgugugcagauggcagucuguuuuguggugggugguccuugcucacuuuuccucaacugcuugccuccuggaugcuucugcuuuucuguccugccagcauucaggggagagacuggguguaaggccugucaggacaguuuaguugggggccaugacugcccauucuuuuuuuucuuugagacagggucucauucugccucccaggcuggagugcaguggcacaaucacagcucacugcagucuugaccuccugggcucaauugauccuccugccucagccucccgaguagcugggacuauaguugcaugccaccacaucccacuaauuuuuguauuuuuuuuuuuguagagauggggucucacuauguugcccgggcuggucuguaacccuaacuccugggcucaggcgaucugccugccucagccucucaaagugcugggauuagaggcaugagccacguugccuggccugcucagagguuuugacugugugauuuaaauuucuuuagcacagauaaucaacuauugaguuuaauuuuuuuuucuuuuaaauuagacccugaaggaagauugggaaucugaaaaagauuuauguuuagaaaaucuacgcaaagaacugucugcaaagcaucaaucagaaauggaggauuuacaaaaccaguuucagaaagaauuggcagaacagagagcugaguuggagaagauuuuucaagacaaaaaccaggcugaacguaaguaaugaaaaugagcaaguuuggagugggacugaauuuuccuagguaguacuggaaggaaugucguucaugucaccaugcgucauugcgcacguuuccuaccuucuaaaugcuggauggccccaugcacgugugacacgcugguggccgucaugggucacaggucucucaggguccuuaaaccuuccugaucuuuguuucagagauuuuucuuggcauguucaguugcuaaauuauuacaaagcagcagcuuugugguuguucacuuuucauacuccaggguuguguguuccagcuugacccucaugguggguggcauggguaggcgauguccccuggugcuaucaggcaugugaggcucaaacgaggggcccgggggcgcccaggauggggcucuggguggcagcgcucugggugcaccauuauugucacugaggucgcuguugaggagagugaugucuuguaaaccaagugccauugcuuuaccuuucuaggggcccuuaggaaccuggagagucaucaucaagcagccauugagaaguuacgugaagaccugcaguccgagcacggccgguguuuagaagacuuggaguucaaguucaaagagagcgagaaagaaaaacagcuggaggugggcagcagcuucguuauuuaauuacuugguauauuagggaaguuuuaacagauuuuggaauugggcuauuucguauuguguuauuugcuaaaacuuaaguucuaaauuuaaagagacuggcugggaacagugguucacgccuguaacucuaucacuuugggaggccaaggugggcagaucaugagcucaggaguuugagacaaaaauuagccaggcaugguggugggcaucuguaaucccagcuacucgggaggcugaggcacgagaaucgcuugaaccuaggagguggagguugcagugagcugagaucucaccacugcacuccauccugggcaacagcgagccuccgucucaaaagcaaauaaauaaaauaaaaugaaauaaaaaaauaaauagaguguuaguggugaauaaaaguguaaggauauagucucugagacugauuuaauaauuacguucaaucuuguacuuaggaaugcauguucuuugcaggcgucccugagacaguuacacaaaucgcagacacuagguaggaguguaaggccacauccucuaaccgugauccaguacacacgagauuccuaggaaaaguuaacaagcauuucuuucugcuguguguauucaagaugcuucucuaaugaagcacuacaaucaaaauguugauguggccagguccucauuggaggccugacaaaccugagacucaaacugaguaucccaagaaucaguugaagaaauuaaagcauaaaucagagauaggguuaaucguggugugugaaagauuuacaaacaugagaauauggaaguaguuggggucuagggucuuagggaggccuguccugggccccuugugucucccagcgggacucuggugcccacacacccuccucuccugcagagaguccaggccggggcucacuccacacccccagucucucccuggucccuuccaggcucucccuccgagaugggaaagagggggcugguagcaucuucugguccugaugcccaugauugggaaagguaggaggagccguuuccaugaggaggacaggccagccccaggugcagcguugcccaggaggaaaucacgccaugcugcgcugggcugggcucuugcugauuguacagaaaaguuuagugucacgguguaagagguaccugcuuccuuaauguagaaguauugaaacugagagaccuccuauuugggagucuuggguacugugggcuaguaagacucccuaaauuccauucagcagucuguauguaugacccuaaaccgaagcagggaggugcacaagaugaaacugcaccgcugcggccggcauggaaccuggccgugccaccuccucagcugagacagaccuggaaguuccugagauucugaaagugccuggccuuguggggucagcgcugaccgaucccucuugucacggacagagcucucucggucucugcuguggcuggcuuucuccgagcugcagguuugggaugugagcuuuuacccuuaggaucgcaguggcagggauaaaaccgcacacgucacugcuggggugggggccuugagcucauuaggguuucaccuggacacuuugcuuuuuccaguuagagaaucuucaagcaucauaugaagaccugaaggcacaaucacaagaagagaucaggcgcuuguggucccagcuugauucugccaggaccaguagacaggaauugaguggugaggaauuguauuggaaaauucagauccucaaaagcugaagcuguguguuuuucauuguuguaacaccaagccagaauuuaacaauucuagcaaacacaaaaaaguggauuuaccuguuugacauccugaagguugaggugucugguuugaaaguggagguuugcuuugugggagagagcccugguuuuaugcuaagcaagucagugcagcagugacgugcaccugugugucccucaaggccaagagcaacacuugcagggggugccuucaugucuaaggaaagcuuaccaguggugcugagcguuugccucggaaggacgguugagugcuguccaagugcgggcucaccuggugucuggggucacagggcagugccccacauccugcugccaggcuccuguggccccagcucuccaggccacuugcugaaggcagcucugcuccagguguccccuuauagcugagcaccucuggagaccccgaccccaggccccccauuccgugucagagaggucuuugugcagcaggcuuggauggugccugagggcaggggcuggccaagcccaauucaggcaccggcgcccagguccacaggacaggagggugagccacugcgugucuccuggcauucaugugccgacagagccuuuuggcccaacuuguccuuguggguggugggauuugaagcaaagagcacuuaggagaaagaacuggagacacugccacugucaccagggcaccaggccuggcuccgccucccagcccugcgcccugccgggaccaggugcagcugagagcaugucgauuuaucuuccucugggggucugucugucgcuggaggcuggagaagagagaagcugagggggccacaggcacagcugcuccccgcgggcuccggcucuggcuugguccucugcuugucucuguccugccucucgggacccaugcagagaaccccgauuugcccucucuggggugcccguugcuggcugucagcugcuguagagcagcgggcuguauucugaccauaguagccauggagacaaguucuuuuaggguccguguugcuucucugcugcuguguaacaaauuaucacaaacuugguggccuaaaacaacacaguugucagcuuacagaaaguccaagaugguacagcuggguuuucuguccagggucccccauagcccacauccaggugucagcugucgugugccaaccugaugagccugcuucugggcucgagguuggucuggauccaguuuccuggggcugcaggaccaucgucugucuccuugcuggcugugccccccacaucccugccacuucgagugcugcuuuugcucccagcccuguggcucuugccaccgcuuggagagagcucuccacauucaggggcguacgagagucuaagccguaggggucccucaucccucuccgguucugggaugggcccuuuuccgaguucugcccccaccacagguaaccaggcucuugccucucgccuggcuuguugugggugucccauuuuaagacgauugccugacuccguuauguugcagagcuacaugagcaacuccuggcgcgcaccucucguguggaagauuuagaacagcugaagcagcgagaaaaaacccagcaugaguccgaacuggagcaacugaggauuuauuuugaaaagaaguuaagggaugcugagaaaacuuaccaagaagaccuaacccuguuacagcagaggcugcagggggcgagggaagaugcucuucuggacucuguggaaguuggguaagcaaagcaguuccagccucagugaguuucugccauacaggggccaggcucugaguucagggguaguuuuguuggugauuucaugcuaguaggcaccaauggccuuuuauacaaacacauuuuaugguccagauuuaaaagaugacacaggcacgggcacccgagaguggccugcaugugugugugcgagccauugguggccacacucuguccaggccugcgugcacauguuggugguggacacgcucguguaggccagcaugugugugugugugcaugagucagugggcacgcucuuguccaggccugcguguguguguguugguggcaggggcgcucuccuccaggcauguguguguguugguggcaggggcacucuccuccaggugugugugugugugugugugugugugugugugugugagagagacagagagagagucaguggcgggcacacuuucuuccagaccugcaugucccugugccgugucucuggcuuugugacugccacggcuccccgcacauggacauugcccguccuugacuggaagcacgaggaggcgccucugcugugagcagucgguccuggggagggaauggcgcacacauggaaaagggguacguguguaaagcuuuuauaaaauguuuucccuucagguuguccuguguggguuuagaagagaaaccugagaaaggaagaaaagaucacguugaugaacucgagccugagcgacauaagguaauuggccgcgcgcugagaagugggggaguccugugcucuugaccuuccagcccugcgucuuccacauuauagagccuguguuuccguccuucccaccuuguccaggggaggaaggcugcuugcggaugcugccccgaccucacugcugcuccgcggugggccucaccaugcacuguuugaucaggaaaggggguggccgggggagccggagccccucccucagcccugggaugcccuggcugugggcaaggccuccacccugcaguggggcugcauucgucagacuugacaguggcaguucaaagggugugaaauugugucuuugcuuugaguccacacggagcgucugcuggcuuuuguguuucuuccuugaguugcuuccgugcugcgacuucugucaccuuuaacuucuguggggcaaacuguccaaacggagcuucugggauguagacuguucugggucugugcugccaguguggugcccagcaguauguguggcuguggagcacuugaugugcagcaugagcaagcccggugucgggcuccgggggacacacgggagggcagggaggagacgcaggggcagcaccgcguggcuuguugcacgguggaaccaguggaggggaacucggggcaucugggcucagcggccaggagcccucacucuggagcagggucccugggccugcuggaggccacaggguguccaggcaggguggcagcgggcugugugccaguuugaguucccugcaaagcggaccccaacacagaauuugcugcacaagaggcuaugggggaaaugccagagaagggcaagggcccggcuggaacaggcagccaggaccuucccacgagcaggccuugcaccagagagaacccaggaagggcugggguggguagccccaccaggcauucguguaucaccugagagccaaccccugccucugcgcgugggugugacgaggacccagcuguuagugggcaguggucacaggaggcuggccuugagagcccagcccugagaugugaggccaccaggggagacgcgaggggcacgugcccuaccgaccuugcugcugagagaauugaggagaggucugcccgguccagggcccugccgcccugaggagcaccagucccugucagugccaccaauucuuguaugucuuccggaggccugacugagagacgggugugggcgggagagcaugugagcacgccagugggcuggcgggguucaccagggcgcagcguguggucucaugaaccuagugagguuugaguuuucuuugugcauagcaggaaacaccuuugaggguuauagcugcgagcgagguagcuuggcucacuaacgugcuugucccacgugguuucucuguaggagagccugccacgcuuccaggcggaguuagaagaaagccacaggcaccagcuggaagcgcuggagucuccccucugcauccagcacgaggggcaugucucagacagaugcugcguagagacuucagcauugggacacgaguggcgucuggaacccucugaagggcacagccaaggugggccccucccgccucgccauggugucggcaggucccgggucugggggacguucucggggagccugggugccuggguucgauccaaguccuccgugaagcagcugagugcuccgaccucuucuucuggggcugacaccucaacagaguguguccugaugaggguuuggcguuagaggcggggucacuggcugggcaggagugcguguccugggccagcgccccagcagggcaggucugaccugggcagccacccugggggucauggggauugcuggauggacauggugaccauucaccucuggagggagaauguguguccacugggcccaggggaggcuuuuccaggauccugcucugcucccagcaggcccagguaccccagcucgccuagucagacuaagguugugggauguccaggcagggcacggggcacagggcuguggggucagaaggugacggagaggaaacugcagucaucccagagucgcggucccauggcgccggacaguggccacugacggguuccaggaggggcaggcggcccuggccacuggcguggacugugcugaugguggggcugccguccauggugggggugaggggcugaggccgcggguccugcugggagguguguggucugacuccauucugggcuguggccaaguugagagaagccugggccugccugggccuccuucaagcuggggguggugcagcggcgccugcaucugguccucacuccugccugcccugcaccacaauuguccccacagccaccccuugaugcccauggucguuggcaccacuggugccuggccagcaccuagucccuucugcuuuuuuccucuucugcagaagaagagaugggccaguggggguagcgugccugggcacagaacagcagggggaggugcugggacaggaacccuggcaggccccugagcucaggcccuguccuuguggcugccucauagacccugggugacacaugugugcccacaucuggucacaggcaugaggcucacucaggaacucauggagggucacaugucacaccugaccugaaggaguagccugggcgggucguguggcugucgugugggcccaggacaucccugugacucgggacggcacugugcuggggcagcauggaggugucccgaaagggaggggagacuugagagagccaugccugcuuucaucacugagucagcacagagcuugaaaauccacagugucugcugucagaagcauuuauagguugccguucugccugugcggacugugggcuccaucgagggccggcaccggccugacugucuucccugcuccuuuuccacacagagcuucccugggugcaucuccagggugugcaggacggggacuuggaggccgacacagagcgggcagccagagucuugggucuggaaacugagcacaaggugcaacuuucgcuucuucagacugagcucaaagaagaaauugaacuccuaaaaauagaaaauagaaauuuguaugggaaguugcagcaugaaacucgucugaaggacgauuuggagaaggugagucgugacuccacagcccagcgccucccgcccgaguccuugcucucuuccaccuggaaggcuuguguccuuguguauggaggggcauccuggggacagcccagugcuguacauggcacauuuguaagggcgacagucccguaaauucuugaaacuauuccuggcaaugccaguaguggguggcgguuggauagaaucuugucagggucagcaccggggcgaaagugaaguucugagugaagauuucuuuuuguuuuguuuuguuuugagacagucucauucuguugcccaggcuggagugcaguggcauggucucagcucacugcaaccucugcuuccugauuucaagugguccccugauagcugggauuacaaacguaugccaccaugccuggcuaauuuuuguauuuuuuuuguagagacaggguuucaccuuguuggccaggcaggugucaaacgccugaccucaagugaucugccugccuuggccuccuacagugcugggauuacaggugugagccaccacgcccggcccucugagucaagauuucuuagggaaacuguccagguguccuaagagggcucugggaggaggcacaagcccgggugccaagcacguggcuggccucugaugcucaccccaagucuuaaauugcguccgcguuccccaggcucuuccugugcuguuuugcaccuguggaagaggcacccucugacucccucgcccuuugcgagugugaggacacugccaugcugucauaaaugaugacaaagcaacacgacagcagccuccacauggcccgaugggcuugguuacagccagggcagcucaggguccaucccaugcuggagcaguggauuucaagugagccgacagggcagcucaggguccgucccaugccggagcaguggaguuaaagugaaccaacagggcagcucaggcuccgucccaugcgggagcaguggaguucaagugaaccgacggggcagcucaggguccaucccgugccagagcaguggaguuaaagugacugaaauugucaugucuugucauguguguucugacucaaccucaugcuugugacaguguuuucauuucuauuuguguccugcuucucccaccccuuugcuccucccugugaaugucucccugagaaugauuuucauucuccaucaagagacagcuucauaggaagcuaugaugaccugcaagucugaucccaugcuguuuguuaaaugcagguguugguaaggacuuccagcaaaauagagguaaggguggagcccuguggggagccggacaggcgguaggugggccgauggucaugugccaauggcaccugcagccaccaguguguggccuucucuggcacuguuggcugaagacagacuucccaagugacuuuuuguuguuguuguuguuuuguuguuuuguuuuuuuuuuuuuugagacugagucuugcucugucgcccaggcuggagcguaguggcgcgaucucagcucacugcaaccuucaccuccuggcuucaagugauucucuugccucagccucccuaguagcuggaauuacaggugcacaccaccaugccuggcuaauuuuuuuuauuuuuuuuuauuuuuuuugagauggagucucgcucugucacccaggcuggagcgcgguggcgcaaucucagcucacugcaagcucugccuccuggguucaugccauucuccugccucagccucccgaguagcugggaagacaggugcccgucaccaugccuggcuaauuuuuuuuuuuuuuguaucuuuaguagagacgagguuucaccguguuagccaggauggucucgaucuccugaccucgugauccacccgccucagccucccaaaguguugggauuacaggugugagccaccgcacccaaccaugcccagcuaauuuuuguauuuuuaguagagacaggguuucaccauguuggccaggcuggucucaaacuccugaucucaagugaucugcccgccuuggccucccaaaguguugggacuacaggcgugagccaccgaaccuggcuccaggugacuuuuugaugcucaugucuuuaugcuuuucacaggccaccauuuuaccuccuuauaucaauuauggggagaggacuguggauuucucucuuguuaauuuuaauucuuguuuugaguauguggaagcucuguuguuacacguguacacauuugugauuguaaugucuuccuaaaaauucacccuuuucugucuuguaguauucuguccaaaaauacaccuguuuuuuuuuuguuuuuuuuuuuuuuuugagacagugucucacucuaucgccaggguggaguguagaggcgugaucuuggcucacuguacccuccgccuccugguuucaagcgauucugcugccucagccucccgaguagcugggacuacaggcacgugccaccacacccggcuaauuuuuguauuuuuaauagagacgggguuucauuauguuggccgggcuggucucgaacuccugaccucaugaucugccugccucagccucccaaauuuuuggguuuacaggcgugagccaccguacccagccucgucuuuuaucaauacagucauuccaaccuucgugugcauuuugucugguguaucuuuuuuuauucguuuuaccuuuuuuuuuuucuuuuuuuuugagacaggcuauugcccaggcuggagugcaguggcacagucuuggcucacugcaaccucuuccucccaggcucaagggauccuccuaccucagccucccaaguaacugggaguacaggugcacacuaccgugcugagcuaauuuuuguauuuuuuguagagaugagguuucgccauguuguccaggcuggucucaagcucuugggcucaagugauccacccgccucggccucccaaagugcugggauuacagaugugagccacugcaccuggccuacuuuuaaucuauucaaaguaaagugcauuuuauguggacagcauauaguuggcaauuuuuuuuuuuuuuuuuuuuuuuuuuaaagacggaaucucacucuguugcccaggcuggagugcaguggcacgaucucggcucacugcaaccucugccucccggguucaugccauucuccuggcucagccucuccgaguagcugggacuacaggcgcccgccaccacgccuggcuaguuuuuuuuuuacauuuuuaguagagaugagguuucaccguguuaggauguucucgaucuccugaccucgugauccgccugccucggacucccaaagugcugggauuacaggugugagccacugcgccggcuuuuuuuuuuuuuucugagacggaauauugcucugucgcccaggcuggagugcaguggugcgauauccgcccacugcaagcuccgccucccagguucacgccauucuccugccucagccucccgaguagcugggacuacaggcguccgccaccacacccagcuaauuuuuuauauuuuuaguagagacgggguuucaccauguuagccaggauggucucaaucuccugacuucccgauccgcccaccucggccucccaaagugcugggauuacaggcgugagccaccacgccuggccauaguuggcaauuuuuaauccauucugauaaucucugccuuucaguugcagugcugagucuauaaauguuuaagguaauuacuggugugguugauuuaggucuuccguuucacuguucauuuucugugagaugcgucugguggucaugguucugcuuuuucuuuuuucuuguguuuuuggauuauuugaauauuuucuagaacugauuuuaauguaucuguugacuauuaaguuauuccucuuugcauuauguuuuuaauaguugcuccagggauuaaaauacacauucuuggcccggcacgguggcucaggccaguaaucccagcacuuugggaggcggguggaucacccaaggucaggaguuugagaccagccuggccaacauggggaaacccugucuuuacuaaaaaauaaaauaaaaaaauuaggcgaguaugguggugcaugccuauaaucccagcuacucgggggccugaggcaggagaaucgcuugaaaccaggaagcagagguugcagugagccacaaucacgccacugcauuccagccugagcggcagagcgagacuccgucucaaagaaaagagaaaaaaaagaauacacauucuuaaccuugucuuuuaucaguacagucuacuaagagucaccaugaugcugcguuguguaaacugugaccucuaacugcacaggugcuuuugucaccuccccuucgucuucugugcugcaguuuucauagacuagacaucacauccgccuccugcagugucaggagauuugcuuuggaaaacauguguuugaaagaaauuaagaggaaaaauggccuuauacuugccauuucuggugcucuucauuucuucuugaagaucugaguguuuggcgucauucccuucagcgugaaggaucuccuucagcaucucuugcugugcugcacacauuuucuccguuuuuugaagucuuuauuuuaccuugauucuugaggaguauuuuuguggcauuaaaaagucuaaggugacagguuucuuguucaggauuuaaagauguuuaaaauccuucucugcagauuuuaugaucuguuuugucuugguguugguuuccauugauuguguuuucucuucagcaggggucacguuuuccugcuuauuuaugggucagcuggguucagguugcauccuggacacugugagugauagauuuggagacuuuggguucuguccugcuccucuggagaguguugguuuucuguugcagcaggcaguucacucgggugacuucagacugcaugcuccccugcgucugugcugggcugcggcaugguguuaauucaguucuuguagcuuuagccggcuugcuugcuuuuggagucugccccucguauguacagaucggggucagccugagacgugggcggguuccuucccaggcguugcagcucucuuuccucccucacucuccaguuccucuggcucagugagggauuugggauuucuguguguggggcauggacagauacuacucuuagugaaaagcuggaaaaagagaauggcucagugcuguuucuuccuucugaauguccagcccucugcagggucugucugcuuguggaucucuccacagccuucagguuuuuuuguacguucuguucaguucauagugguugucucuggagggcuggucuggcgaggugcacaggcaucaccagaaguagcacccuaaacuuuaauaacuuaauuuuuaaauaaggaguugaggucaaucuuacgugccuuuuuuuggguuuuuuguuuguuucuuuuugaugaguucaguaguuuauugaccuacuuuuuucucuuugaaagucaggaagucaggcaugguggcucacaccuguaacaaucccagcacuuugggaggcugaggcuggcggauugcuugagcucaggaguucaagaucagccugggcaacaugcagaacccugucucuauaaaggauugcuugagcccaggaguucgaggcugcagugagcugugauugugccccugcacuccagccugggcgacagacccugucucaaaaaaaaaaaaaagauuaggauauuugcccucugcauucuccuucaucccccucugcacaggaucccuuuacagugugccuugcaguucauccaccccuugcucaaggucuuucauuguccuggcguugaccuuguacagaucgggagcaucgcaccauuggcugcucuugccuccugggcauccgaucaugcuugcugcaguggcccagcgcuaucuguggggcuggcguuccccuaacagaggccugcggccgaucugaguccugccacuggucuuggucugaacaaagaagccuccggcugcugccuuugcucggcugaugugugcugccuucgguuguugguugcugucaaggccacgggcuccagagauaaagaacagucgguucucggugccaggacguaggaggcauuuuauuuaguuuuagacuuguccacuuuagguuucuuccauugucaucaacaugagaaucauuccuguugcugugugcagcguaauggguguguguguggugaaaauucccugucuucagagguggguuuggguugucucuucuaauaaucucuuccauuagcgucuuuccuccuaaaugaaauuauguugucuguagguaaaacacaaucuaauugaagaccaccagaaggaacuaaauaaugcuaagcaaaagacugagcugaugaaacaggaauuccaaagaaaagaaacggacuggaaaguuaugaaggaggagcuacagcgggaagcugaggagaaguuaacauugaugcuacuugaacugagagaaaaggcugaauccgagaaacagaccaucauaaacaaguuugagcuucgagaagcugaaaugaggcagcuucaggaccaacaggcagcccagauccuggaucuggagagguccuugacggagcagcagggccgccugcagcagcuggaacaggaccucacuucagacgacgcccugcauugcagccagugugggcgggagccgcccacagcccaggacggggagcuugcugcgcuccacgugaaggaagacugcgcccugcagcugaugcuggcccggagcagguggguuugcagugacgccaucugcagucccugugaggccagacaccuuggaggguagaaggugggcaggcuccugggaggaggcgcugugggcuccacugggcgaaaaggucuggagggagcuggaacaagguguggcgcucuagguuuucagccuaauugcagugggacagcuuugugcucggacgggcaggcuggcaguugccauccugaagcccccuggccgcagugggacagcuuugugcucggacaggcaggcuagcagucgccgucccggagcccccuggccgcagugggacagcuuugugcucggacgggcaggcuggcaguugcugucccgaagcccccaggcugcaauggggacagcuuugugcuuggaugggcaggcuggcagccgccaccccgaagccccccggccacagugggacagcuuuguguuuggacgggcaggcuggcagcugccgccccaaagccccccaagucugcacucccugggugggugucaggggcggggaucagucauugucucuguuguucuucguguguuuuaagauuugaacagcagaagcuaaaccucuuuuauaggugucauaaggacauggaguuuauccacuaagcguuuuuguguuuuuuuuaacuuaaacaggugauuuuuaaaaauaagcauguuuuucugaaacauacacacucuucuuugaaguuuucaagagguuuagaaagugauuggguucuuugccuguuggugcugacccuuuuugcgagccucagucccagggcugugccguucuuucucaucugucugccccacccagcccuuccccagcaaccagggccgcacagggccccgcucagggauuggagaaacucacguucaggucgcuggggcugcaugaacacgagcaggacgcucuucucaccaggcuacgacaugcaguucgugguagagcugaaccaaggaggcccucaagagaggcuuccaggcgcagaggugccugugccucuugccauccguccugugucgccagugcccauuggaggccuuggcauuuugcaggacccuccagcuccaggcucuuuggccuccugaugggagcagguccuucugugaggacucucccugccucugucuuuggcccugagugccgccugcaccuccuuaauucacugccacgggguucuauucacuuccaugggguucuauucauucacugccauggggguucuauucauucacugccaugggguucuccucacugccgugggguucuauucacugcugugggguucuguucacugccgugggguucuauucauucacucccauggaguucuguucacucccauaggguucuauucacugccaugggguucuauucacugccaugggguucuauucacugccaugggguucuauucacugccgugggguucugaucacugccgugggguucuguucacugccgugggguucugaucacugccgugggguucuauucacugccgugggguucuguucacugccgugggguucuguucacugccgugggguucugaucacugccgugggguucugaucacugccaugggguucuauucacugccgugggguucugaucacugccgugggguucuguucacucccaugggguucugaucacugccauggccuucuauucacugccgugggguucugaucacugccaugggguucuauucacugccauggggguucuauucauucacugccaugggguucuccucacugcugugggguucuguucacugcugugggguucuauucacugccgugggguucuauucauucacucccauggaguucuguucacucccauaggguucuauucacugccaugggguucuauucacugccgugggguuccguucacugccacaggguucuguucacugccgugggguucuauucacucacugucgugggguucuguucacugccaugggguucuauucauucacugcugugggguucuauucacugcugugggguucuguucacugccaugggguucuagucacugccgugggguucuguucacugccgugggguucuauucauucacugccuugggguucuauucacucacugccuugggguucuauucacugccaugagguucuauucauucacugccaugggguucaauucacugccaugggguucucaggccucgcccuccccaugggcccccaugggcagugccccuucccuguugaggagcagagauuaccuugggauucuugguuggaugcuggcucggacgcuguggugugaguaggagguugguugugccugccgugcguggcucuggcggggaugugugugugccaucucuugcugagggcgcugguuccuaccuguggucugugaccuggcgacucccauggcuuuggccuuuggccucugggcuucucuggcuucauggggccucuucacucucccacuuacuauuucugguggucgagggaaaaguaguaagagcaguuaaaaucccgaaacgaugaccugaacaguugaaguggcauuuccugugggaaacugacuuggcuuuugcaagggucauugcuuccugaugcauguuuaacuguccuguguucacuuuguugccgcagguuuuuagaggaacguaaagagaucaccgagaaauucagugcggaacaagaugccuuccugcaggaggcccaggagcagcaugcccgugagcugcagcuccuccaggagagacaccagcagcagcuccugucagugacggcggagcucgaggccagacaccaggccgcguugggcgagcugacagccuccuuagagagcaagcagggggcucugcuggcugcacguguggccgaacugcagacaaaacacgcugccgaccucggcgcucuggagaccagacaucuguccagccuugauucuuuggaauccuguuaccucucugaauuucagaccauccgugaggagcacaggcaggcccuagagcucuuacgagcagacuuugaggaacaacuguggaaaaaggacucucuucaccaaacgauuuugacucaagaguuggagaaacugaagcggaaacacgaaggggagcuacagucugugcgggaccaccugcgaaccgaagugagcacagagcucgccggaaccguggcucacgagcugcagggagugcaccagguaaggcgccagggcccugccccagcccagggcaggccucuccucgcugccuguguguuuccaccgcgugucacaugucugcgugcgugcugugugugccugugcgggugucugugugucucacaggcugccgagaucaguggggacuucuggucucuuugugaacugggcuuuuuuuuuuuuuuuugagccggagucucacucuuucgccaggcuggagugcaguggcgcaaucuuggcucacugcaaccuccgccuccuggguucaagugauucuucugccucagccucccaaguagcugggauuauaggcgccugccaccaugcgcggcuaauuuuuguauuuuuaguagagacugggcuucaccauguuggccaggcuggucucgaacuccugacuucaggcgauccacccgccuugacucccaaagugcugggauuacagguaugagccaccgcacccggccugagcugggcuuuaaaacacugaguugaaggguuauuuugaucgcaggcaccuuguuaaaggcuuugcucucguacguaugugggagggccuagaccuuggugggggauuuugugggcuuuggaguauuccucaaggcugaccagcaccucugcagaagacuugguuuccaggcugcugugggaagaucugauggucauguuguguauucagagccuugguccccuccuuuuauugauguuuccugaaauaaaacccuuuugcuacauuucaagagcagugaugggccaggcacaauggcucacgucuguaaucacagcaguuuaggaggcugaggcaguuggauuacuugagcccaggaguuugaaaccagccugugggcuacgaaaauuaaaaacaauucaccgggcgugggggcacgcaccuguagucucagcuacuuuggaggcugaagcaggaggauugcuugagcccaggaagucgaggcugcagggugagcuaagacugugccacugcacuccagccugggcuguaacagagugagacccugucucaaaaaaaaaacaaaaauagcucacaccuguaaucccagcacuuugggaggccaaggcgggcagaucacaaggucaggugaucgagaccauccuggcuaacacggugaaaccccgucucuacuaaaaauccaaaaaaaaauuagcugggggugguggcggacgccuguagucccagcuacuugggaggcugaggcaggagaaugaugugaacccgggaggcggagcuugcagugauccgagaucgcaccagugcacuccagccugggagacagagcaagacucugucucaaaaaaaaaaaagcggugaugguucauuugacaggcacuuccaaguuuuuaucaugaagaagaauuucuggcgaagucccucuugcccugggcuggcgccugacugcagaagcugcagugccugugacucaggaaaggacacguguugucguaucacacacaccuugugcuuucucugcccucagugaggucucugagguuuucucaccuugaaauagaugagucugcucuguugagcauguggagccacuggggcuggccuaucucccugcaggaaggggaugcauaggccuggcugcacgguggauggggcaugggcuagagcugaugaggcaguuagaaaugguuguucuggcagaucaauaccuugucagacguuuaagaaguacacguuccaaacuauaaacgagggaauugccagcuuggauaagguggauacguugauuuccugauaccagcaugccacgggagggcuuccuccuuccugacuguggggaacaguugugaggcuccaaagcguuggcuuauuguuugcuuuccuucagcucuguguaagaacaggagaaaaguggaaccuucuuuaaucgcugugaggguuucauguuauguuucaggcugucuguuuuguguggucugagcaugugaucuugggggaauuccuagaaagcagaauauguucaggcucccucugcucuccugaguaaggugcagucaguugccugucucaggccucuguguccuguccuugucuucaccacaugucagggaguccuggggauguguuuuguuuguuucuuuuuuguuuuuuaaaagacagggucucccuguguugcccaggcuagucucgaacucuugggcucaagagauccucuugccuuggccucccagguaguuggaauuacaggcaugagccacugcucccagcuugggaggugccucuugagagaagcuggagccauguugucuuucuggacaaaauuagacaggggucugaugcugcugggagcugcccuccaggccaguccucagaugccagcuucaguuuccuuucguucccaguuuugaucauaggcaaacagaugcuuuggagaauagcacuuguucccaagcuguggauuuaaaauuagguuuucuugguuuguuugguuuaaagaaaaugaaguucugaaagaauauucagaaaggaggaacuugcauaucacacaugaaguguguguuucaaaccacggccugauuuagucagaggaagcauguggagcgugugcaccuucugugcccuguguggggauguggcacaucuggauguuuccuggacggaaggagcuggucgcagcccugugcaaucagagacgccugcuggaggcagagaggaccaaagcccuggacagggugggugccaagguccugcuccuggagcaucagcaccaagcggcccugcaggaacucagagauguacgcugccaagaugcaggagcaucaagcagggcaggcggagcuggaggagccgggggagccggagguucugggggugcugggggagcuacaggugcugcgggaggggcugugcaggugagcagcuccacgugugugguucccacaggggugccuccccggcuucucugcccugagucuucaucagagcguucaggcacuuacggauacacuuggagccgcuggauugugcgugcaguggggucugugcucaaagagugcagcuucgugggggcagaugugucagugcaccuggccagcgaggcagcugcaggggugggcauccgggggggggugucuuugguuggccuccccuccuguuggggccuccggagggcaggguucuggucuggucugcaggcagugaguggucuguggcgcgaccagaucuguccuacaggcuacuuggcagcuggacgaaacacaaaguggaggcgauucagagccugggaggugcgggggucggggaggcuggggcucauccugggugucgcgcuaggcagcuggggggauagugaggggugccugccagcugaugauggcauagggaggggcauggagagccugggggcugacaggggaagccacgcuuagcuggaggggucaucccagguuggacuggugcaggggauguggcuuguguagacacagaagcacauuuaguugcucuuauaaaucugcacacgggcugggcuuggggcucaugccuguaaucccagggcuucgggaggccacagugggaugaucucuugagcucaggaguucgagaccagccuggggaacauagcaagaguccacuucuaaaaauaaaaaucggccgggcgcgguggcucacgccuguaaucccagcacuuugggaggcuaaggcgggcagaucaugaggucaggagaucaagaccguccuggcuaacacgguggaaccccguuucuacuaaaaauacaaaaaauuagacaggcaugguggugggcgccuguagucccagcuauucuggagguugaagcaggagaguggugugaacccgggaggcggagguuguggugagcugagaucgcgccauugcccuccagccugggcgacagagcgagacuccgucucaaaaaauauauauaugaaaauaaaaauaauaaauaaaaauuaaccaggcaugguggugcaggccuguaguuccagcuacuugggaggcugaggagagaaaauugcuugaaccugggaaucugaggcugcaggaaaaaaagaaagaaaucugcacacaguaugguuuauuuucuuucuuucuuuuuuuuuuuuuuuuuuuaaagacggagucucaaaaaaagucuagagugcagugucacgauccuggcucacugcaaccucugccucccaggcucaagcaguccucccaccucagccucccaaguagcugggauacaggcacgggccaccacgccucgcuaauuuuuauuguuuugucucccaggcuggucuugaacucaugggcucaagugauccucccgccuuggccuccccaaagcacugggauuacaggugugagccucugcaccuggccaguguaguuacuuacuuuuucaguuuuuuaaaaucuugugugucagaauaugcguaagcacugguaccaaauugugucagaagaagccagacugaguagucggaaucccccuuggauucccaagguggccgugaaggggccuggcugagguccccugccaccugcuguggucuugauucucugcaccuaugcaggacugcauuuaagcagcaaggucuccccacuuguggacccgugcaccugccccauccaggcgccaccaccccgccugcuggucugcaugaugagcacacgcacacacagcacaugugcacacacagcacaugcacacacacaugcagacacagcacauacagcacaugugcacacagcaugugugcacacacacagcacaugcacacacagcacauacacagcacaugugcgcacacagcacaugcgcaugcucacacagcaugugcgcacaaacagcacauacauagcacauacacacaugcagcacaugcacacacacacagcacaugcacacacacagcacauacaugcagcacucacagcauaugugcccauacaaggcacaugcacacagcacaugcgcacacauagcacaugugcauacacagcacaugcacacaugcagcacacucacagcacaugugcccauacaaggcacacgcacacacacagcacaugcacacacagcacacacacagagagcacaugcacacagcacaugugcacacacagcacaugcacauacacagcacaugugcacguguagcacaugcaugcacacagcacauacacauagcagaugugcacacagcacgcacacacaacacgugcacacacaugcacacgugcuuacacagcacauguucauacagcacaugcucauacacgcagcacaugcacacauacacagcacaugcacacaugucauucugcauguuguccugcaggaugaaugccuggggcccuccugcuucuguguucugggucuguacgauuuucuggccuuucuguggggggaggguuagagucuggagcacuucagaaauaauugauaauuuauuugaagcauuaugugcaaauuuuaggugauuaugguacauaugguuucaaggggguuuuaaacaaggacaugcuaagaucucauuucuagccauaaaguaagguuuugaaccugaaagguuugcuuggugaagagggacugcuccugagaaugggugaugcagcgccggauucugagguuagaaaugacuuguuucuucacguggacagcucugggugcugcccaguguggacacuggccccucaguccugaggcacagcccugagaccugcacccugcuggguaucgugugggucugucuucucuggaaaagucagauucugucucgcuuuuccagggacucaugcuaaagaaauucuguccguuuuaucugugcauagcacaaggagguguucguuuucugaaaucgugugucaccuguguccuuuaaccuguacuuuuguucuucuagggugacuguuguuguuguuguuuuggagggaggaucuugcucugucgcccaggccgaagguagugaugcaaccacagcucacugugaccuugaacgccuggccucaagugguccuccugccucagccucuugaguagcugggacuacagaugugcaccaccaugccuggcuaauuuauuuuuuguagagauggggucucacuguguugcccaggcuggucuuaaauuccuggccucaagcaauccuuuugucucagccucccaaagugcugggaccauaggcgugagccgcgccuggccuggacuauuaucggaauacuccuagagcgucuuugcaguauuuuuguaguugagguacagguuugcgcgaguaaguuagcuuuuuacuuugcugcuagggaugugcaugucaauacucuuuuuuuuuuuuuuuuuuugagacagagucucgcucugucuccaggcuggagugcaguggcgugaucuuggcucacugcaaccucugccucccugguucaagggauucuccugccucagccucccaaguagcugggacuacaggcaugcgccaccaugccuaauauuuguauuuuuaguagagaugggguuucaccauguugcccaggguggucugaucucuugaccucgugauccguccgccucacccucccuaagugcugggauuacagaugugagccaccgcgcccagccuuagcuuuuuuuuuuuuuuuuuuuugggcggagucucgcucugucgccaggcuggagugcaguggcaugaucuuggcucacugcaaccuccgccccccggguucaagcgauuuuccugccucagccuccugaguagcugggauuacaggcacauaccaccacgccuggcuaauuuuuauauuuucaguagaaacagcguuucaccauguuggccaggcuggucucgaacuccugaccuugugaucuguccgucuuggccucccaaagugcugggauuacaggcgugagccacugcgcccggccgcucagauacucuuuuaugugauuguuuugguguagcugauuucacagaagaaaacaauugggcuguggggaggugggauguacucuuuauuuuauauuauguuuuuuggggcagagggcagcauuugcaggaauagaauaacucagcaagcccccggucccgcugguuaguggggugcacguucaauacaucagucccccucuccuccugauuguuuagaagcaaauccaagacaccaugugucugcgagugagguguuuucccccaauacagcauaaccaugauccauucucaccuaaaacauccacagcgaucccugcauuucaucacaagcccagcccacgugccagucucuucuggcuggcucacaucaggaucuauuuguuccugugaugcuggucacuguucccucguuccugcaagcguguugguagauccacaggccugugauuggugagaaugcuucuuguaugguggccacuccucuccuggucuccuggucuuuccucaggcuuuacaccgugaaaagacauaacacaagcuggcugcaguggcucacgccuguaaucccagcacuuugggaggccgaggcgggugcaucaccugagguugggaguucgagaccagccugaccaacacagagaaacccugucuuuacuaaaaauacaaaacuagccagccaugguggcacauaccuguaaucccagcuacucgggaggcugaggcaagagaaucgcuugaaccugggagguggagguuguggugagccaagaucgugccguugcacuccagccugggcaacaagagcaaaacuucgucucaaaaaaaaaaaaaaaaaaaaaaguuacacagagcccugccaagcccugacgggaguguuuugggucauugucccagaauagcugggauguccuguucuuccccgcggcgaugcuuuaucugagccucaaauaucuuugcaccuguuggaacagcagucacuugucagcagugugacuugaccuacacuuguggggugauuggauuacuuuccgggauaccgcccuugagaguuugguugugaggaaaguccucugaaaacguaagcuugauuucuuuuugauagaaguauguaucccauaagauuccccugcccugcccugccccgccugugcugguaacacgacgcagagcugagugcagaagugaaucgcaugcggccggugugggaugcucaaggcggugucaucuuuucucggauugaaaacccaaaucuauucauagguuaauuauuuuaauauuaagauaauauuaacguugguuuagauagcauuugaauguccuaaaugcguucucaauugaaugucuuugccuucugacauugguauucucugugcaugccacuuacuuaugauuaaaacauaugugauauuuuucuauaauuguguggauuuuagaaaaaccugaaaauaacuuuuuuugaaacgucuuuuuugauacugaccucacagcuuagaagaacauggucaauuuaaagaguuuuauuccaggcuagagccucugccaggggguugcaggaagaaaaucuccuuugagccggcccggucagauugaggggguggcugaggacgcacgcuucugcucgacauuguggccgagccgaggcccugggccugagggaucacauguggggcacuggccgucucacugcugggccugcaugccugugaccugcccagcccugcccgacgucuccugggggcuguccccccgcggggagccgccucauuuggccuccaccaccuccuacguccucugcaggucugccgaaggccugagagugugcaggcaggacagggccaagcguggacaguuaggguggcuccccugggugcgaggcgguaccugcggguggugcugugccuugaaacaaagcgaaggucaagacugcacacauggagcuuccagcugccaguggguggagggagcgccaccucugucugccaugcccgggcguccuggugggcugcgugcaguguuggcacucccuggcugggguucucuguggagccugcccucuacccucuccgucugcagugugugacucugggaucccggaggccgcggggcuagagcguggcaccagcugugcuccugaguggggcguaguuugggacgccuggagcuuaggccaggcuccgcaggcucuggggguguccaauguucuugggcucccguguuggccucaaacagaaguuugauuuucucauuguuacacgguaggccucuaugagagauuuuuguccaaagagaguaaguagucuguggcucagaaagauguucaaaggaccacugauuucagccuuggacucuugccacauccuuugcugggcaccgggagcgcagagguuugcccucgggccccacaggcugacgcuguggaugccaggagggaagcgccugaucugugccuggcugggccugaggagcccguccacugugucugagcaugagcuguugugggcaccaugguggcgccuggucuugaggauuaauuuuccuguuuucccagucccuuggccucuguccugccgggugcauuggcauuugggguuuuguucuugaauucaccagcguuuugugguugguguacacugaaccagcaucccuguuuggaccucuuacuccuggcccgcugcccccucccuggcuguugguccggaucaaugcgucugucccccaggagacgcacugcugaugguugggguaucagcaagguaauuaaaguucuuuggaaacuuuguagugugcacagcucagaaguuaaucuuaaguccuuccuuucaaacagauggaacuaaaucaaauccaggagagaaaguugauuaaagugaacuguacucacauuccaaauggccuugagaccuugcgagugacuucaguguugugccgugcgaacccguuucuggucccugugacuaagaugcagaugcacagcccaccuggcaccucagcaaguuccaggccggcgcggggggcacccgauccuuuauccuuuuccuccccauggcuuaucacacaaaaaaagguagagaauaaaggucauuucuggugucagggcuuccauguguuuauugaaacuguugccccaguuacuucagaaaaggcacucacucauuguugacgucuuccuccuccugaagcugguggagccccagcccucagcccuccuggccgugcugggcagggagcgggagccggcaauccaccccagauguucuggagcagcaggucccggagcagcaggucccacugcugaggacaugggcuucgugcuguccuuuccugccugcuaaguagauacaaaaaacuuacuuuaucaguuaccuuuucacaugccaagucaaaacacaaaauaauuucauugucuuaaaacugagcuuuuucuaggcaacuuuugucaggccuuuuuauauuuaaaucugcuguguaacacaccuuuucuaccaagaaucugucaucacuuaucuuagagcugagaaaaguuuauucuaaaauauuucaucaccucaaaaagaaacccccaguggcucgugccuauagucccagcaccuugggaggcugaggcaggaggauugcuggagcccaggaguucaagaccaaaaauaaaaaaauacuaaaaauaaaaaaauuagccuggcauguuggcgugcccauauaguuccagcuacucagaggcugaggugggaggaccacuggagcccagaagguugaagcuguagcaagcugacaucgcaccacugcacuccaggcugcaugacagcaaaacguugucucaaaagauaaucaaugaaaauuaaggaagaaaacaagaaacuccccauucucccuucucccccaugccuggugaugugccgucugcuugccguaccugugggcguccuacguacauagacucagcgugugcccucgguguccgcggcuuucacuuuguguguuucccagguuggcgcacguuguagcaugugucaauacuugcuugguauguguuuucugcauaucuuaugcccuuuuuguucuguauuccuccauuacugccuuuuuucacuuuaauuuccuugauguuuccuuuaccauacgguggucgccccuuacccacaggggaugcauuccaagacccccagugggugccugaaaucgugaaugguucugaaccccuuauaugcuguuuuugucuauacauaccugucaucaacuuuuaccuuaaaggaaucacccuguggugucucuggcauaucugaauugcuccgucaucaacuuuuaacugaaaggcaucacucuauggugucucuggcacgucugaauugcagcauugcaauugaacggccucucuugcgcuuuggggccguuauuaaaugaaguaaaggugacuugaacacaggcacugugaugcugugacaguuggucugaucaccgagaugccugcgugugggcagguagugcuugccacguggauaacgccggacagaaggaugacccccggccuggccugcgagauuuccucacaccguucagcuugggggcaggcaguuuaacacucauaagaguuguuuacuucuggaauuuuucauacgauauuuucaaaaugacguugaacacaaguaacugaaaccgcagacaaaggggacugauauauauugaguuauuuucuuagcgcuugcccugagcguuacagcaagcaccuucuaacaaucugguuuggauuaauaccaacuuaauuuuaaaaguuuacaaaaccauuugcuaauguagcaucauucccucgucugcccuuugugcucauauugucguaccaaccacaucuuucuaucuuuuugugcucguuacuuuaugcacgugucuuuuaaaccaggaggaagaagaauuguaaacaaaagccauguuguuuugucuccuguuuucucugugucguuaccugcacuacugcugcucguuucuuccuggaaauucaggucuggugccuuauguuucagcccgaaggacuuccucugggauuucuugaaggacaggucugcuagugaugaauccucuuagcuuuuguuuuugugggaaugucuuaauuucuccuucauccuugagagaucauuuccuggauguggacuucaagauccaggcuuuuccuucagugcugcgugggcucuccgcugccuccccugucauccggggcugcgugucgugagcugcgcccgucuuccugggcugcgugucgugagccgcgcccgucuucccgggccgcgugucgugagccgcacccaucuuccuggggcuacgugucuugagcggcacccauauaccugcugugcacuggcuggccucaagcuuuguccugaacccugcugagguuuggcugugaugggugaagugugggucucugucaguuuguccuacuuggaguucauugagcuuguauguggggauuauuauuuuuauuauuauuguuauuuucaucaaauuugggagguuuuuggccgucgugucuucaaggguuccucugcccuuuucucucccucugucuggcuugagggugccccacaggccuuggagacugcugaguuuucuucauguuucuuucuguucccugacuggaucgucuuaauugaccuaucuuccagcgugugaauucugucuucugccugcucgagucugcugccgaaccccucucuagugaauuuuuuuuucugugauuguauuuuucagcuccagaugucaagggagcucuauuucagucuuucucucugcugagggcccugcgugcauugugcccucagggcucuggcgggcgguggacagccuggcccuggccuucaccccugcugugccaagccacauggucacugcagccggcccaggaccucuugggccuuuccagcgugggcacagcccugcacguguucacaccuuguagagucccagaagaugucagagcuuuccagaggccccuguggacaucgcauucucaaguguuuucuuuuguuuuucuggcagucccuuauuagucccaacugguuucucuacugugggcagugcggcuauuaaacacuugacacugacuguuuccaaccggugcccugggguagauuuuuuuuuuuuuuuuuuuuuuuuuuuuuuuuuuuuuugagacagagucucugucgcccaggcuagagugcaguggcgcaaucuaggcucacugcaagcucugccucccagguucacaccauucuccugccucagacucccgaguaggugggacuacaggugcccaccaccacacccagcuaauuuuuguauuuuuaguagagaugggguuucaccauguuagccaggauggucucgaucuccugaccuugugaucugcccgccuugacuucccaaagugcugggauuacaggcgugagccaccgcgcccggccaacccuggguagaauuuuugacaccgagagcucugacccagucacggcagcaaggugcccggcaggugggcucgggcaguugugcauggaaauuuuggggugcuccaaauccauucugucccccaccccaccccagcagcuacugguuuucagggcuguuagauuggagaggagauauggagucagggcaaaguuaagcaccugaaguuuguucuuauggacacucagccuguguuuuccauaaacacucuucggaugauugcaaaccugaccagauuuccacagcucugaaaacacugguuuugaugguuuuuaccacuuuuucuuuuauagaggaacagauuuuggagguccuuacuuugccauucuagaagugcuaccucuggaaguuuaaaaaaauaagcuuauuucauuaauuuaauuggccgggugcaguggcucacaccuguaaucccagcacuuuuggaggccaguguggguggaucacuugaggucaggaguuucagacuagccuggccaacagguuuugguagaaacccuaucucuacuaaaagaaaaauuacaaaaauuaguugagugugguggcaggcgccuauaaucccagcuacucgggagacugaggcaagagaaucccgugaaccugggagacagagguuguagugagcugagaucacaccacugcauuccagccugggugacagagaagaguccuuccaaaaaaaaaaaaaaaaaaucucuguguguguguguguguguguguguguguguguguguguguguguguguauagaauucaucuauugaaccuuauuuaaaagguuuuguuauuuagaaagaagguuuaaucuuuuaaaagggaaggaaccuagguuuccaaauaucuuggguuuucauggcuguaauuccuugauggugaacuucuuagugugacucuuaaagauguuacaggagccauuugggaaugguagugagcaguugcuuaugacacgcagcugucaccagugcgaacuugugucuccuuaaguguuuuauccccgaaaccaggacuuuguguucccagugaaguccuugaacccauguuuucuuugaugggggcuguggucuggcucaucccggcucuuggugcagagugggggcuccaugcauaucugcugaaugugcugaauuccggcuaacagcaaagaaaguauuuuucuagcuuacugguauuuuuuauuguuauugauguguacagggugaauuuggaagugaaaagaaaacugcuuugcaugaaaaagaggagacacuucggcuucagagugcacaggcacagccuuuucaccaagaggagaaagagucuuugucucugcagcuucaaaagaagaaucaccaaguccagcagguguguggaauacgcuguucccuugugauaagacguguauagcauaaaaaucauuuucacuuuauuucagugcacaguucaguggcaggagugcacucaugguguugugcauuuauaguguuguacauucaguggcggaagcgcauucacaguguuguagauucaguggcggaagcgcauucacgguguugugcauucaauggcggaagcgcauucaccauguuguauauucaguggcggaagcgcauucauaguguucugcauucaguggcagaagcacauucacgguguugugcauucaguggcggaagcgcauucauaguguagauucaguggcggaagcgcauucauaguguagauucaguggcggaagcgcauucauaguguucugcauucaguggcggaagcccauucacgguguugugcauucagugguggaagcgcauucaugguguugugcauucagugguggaagcgcauucacaguguuguauauucaguggcggaagcgcaaucacaguguuguauauucagugacggaagcgcauucacagugcugugcauucagcagcagaagcgcauucacgguguuguauauucaguggcggaagcgcauucaccauguuguauauucagugacggaagcgcauucacgguguugugcauucaguggcagaagcucauucacaguguugugcauaguucaguggcggaagcacauucacgguguuguauauucaguggcggaagcgcauucacgguguugugcauucaguggcggaagcgcauucacgguguugugcguucaguggcggaagcgcauucacggugugcguucaguggcggaagcgcauucacaguguuguauauucaguggcggaagcgcauucacagugcugugcauucaguggcggaagcgcauucaccguguuguauauucagugacagaagcgcauucacggugugcauucaguggcggaagcgcauucacgguguugugcguucaguggcggaagcccauucaugguguugugcauucaguggcggaagcgcauucacgguguugugcauucaguggcggaagugcauucacaguguuguauauucagugacggaagcgcauucacagugcugugcauucaguggcggaagcccauucacgguguugugcauucaguggcggaagcccauucacagugcugcgcauucagcagcggaagcgcauucacaguguuguauauucaguggcggaagcgcauucacagugcugugcauucagugguggaagcccauucacgguguugugcauucaguggcggaagcgcauucacaguguuguauauucaguggcggaagcacauucaccauguuguauauucaguggcggaagcgcauucacaguguuguauauucagugauggaagcgcauucacagugcugugcauucagcagcggaagcgcauucacgguguugugcguucaguggcagaagcacauucacggugugcauucaguggcggaagcgcauucaccauguuguauauucagugacggaagcgcauucacgguguugugcauucaguggcagaagcgcauucacgguguugugcguucaguggcagaagcgcauucacaguguuguauauucaguggcggaagcgcauucaccauguuguauauucaguggcggaagcgcauucacaguguuguauauucagugauggaagugcauucacagugcugugcauucagcagcggaagcgcauucauggugugcguucaguggcagaagcgcauucacgguguugugcauucaguggcggaagcgcauucacaguguuguguauucaguggcggaagcgcauucacaguguuguauauucagugauggaagcgcauucacagugcugugcauucagcagcggaagcgcauucacgguguugugcguucaguggcagaagcgcauucacgguguugugcguucaguggcggaagcgcauucaccauguuguauauucagugacggaagcgcauucacgguguugugcauucaguggcagaagcgcauucacaguguugugcguucaguggcagaagcgcauucacaguguuguauauucaguggcggaagcgcauucaccauguuguauauucaguggcggaagcgcauucacaguguuguauauucagugauggaagcacauucacagugcugugcauucagcagcggaagcgcauucacaguguuguauauucaguggcggaagcgcauucacaguguuguauauucagugauggaagcacauucacagugcugugcauucagcagcggaagcgcauucacgguguugugcguucaguggcagaagcgcauucacgguguugugcguucaguggcggaagcgcauucacaguguuguauauucaguggcggaagcgcauucacagugcugugcauucaguggcggaagcccauucacgguguugugcauucaguggcggaagcgcauucacaguguuguauauucagugacggaagcgcauucacgguguugugcauucagcagcggaagcgcauucaccauguuguauauucagugauggaagcgcauucacgguguugugcauucaguggcagaagcgcauucacgguguuguacauucagugacggaagagcauucacgguguugugcguucaguggcggaagcccauucacgguguugugcauucagugguggaagcccauucacagugcuguacauucaguggcagaagugcauucguggugugcauucaggggcggaagugcauucacgguauugugcauaguucaguggcagaagcgcauucacgguguugugcguugagcggcggaaacacauucaugguguugugcguugagcggcggaagcgcauucacgguguugugcguaguucaguggcggaagugcauucaugguguugugcguugagcggcggaagcgcauucacgguguugugcguucaguggcagaagugcauucacaguguugugcauaguucaguggugcaagugcauucaugguguugugcguaguucaguggugcaggcacauucacgguguuguacauucggugauggaaucacauucacaguauugugcagccaucaccaccauccaucuccagaagucuucaucuugcaaaacugaacucuguccccauuagacucucacuccccauuugcccuccccuggcaccauggcucacaccuuuaaucccagcacuucgggaggcugaggcaggaggaccacuccagcccaggaauucgauaccagccugggcaacauagggagacccugucucuauaaaaaauuaaaaaaauuagccgugugugguggcacgcaccuguagucccagcuucucagaaagcugaggugggaggauuguuugugcccuggaguuugaggcuacagugagcugugauugugccacugcacuccagccugggcaacagagugagacccugucucagaaagaaagaucuuugccugccuggcaacugacuuuugugaaugaccagauacagugacuuauuucgaauugcuguuugagugguggaucucugaugaacuggccccuucccuccccuagccucagguuccaccuggggauguuuguguauucuuuuguaaaugaugaauaauggaggaaaaaccguaucaauaauuuucaccuuuaaucagcaccucguucaccuuugccguauuuuuauuaaaugugcaggugcuccuuggccuuugcugaggucacgccuuugaccacugucaguggaaggcguugugagucgaggaacgugccgaagugccugcuccuuuugccccaucaccaagcugaaaaguccuaagucagagacucucaaauacugaaauuguguugaaagucccuuacagccauuugcuuuuaaccaaauuguuuuaacgaaagcuuuaaccauuuuucucgauagcugaaagaccagguuuuauccuuaagucacgagauagaagagugccgcuccgaguuggaggugcugcagcagaggcgggagcgggagaaccgggaaggcgcaaaccuccucuccaugcucaaggccgacgucaaccugucccacagcgaaaggucaguguguccucggcaccgaggcugccuuguggccgccagcacccgcugggucaugcagaugccauugguccccacggcuccuggccccguggcugcugccaccaugcacgcuggcuccugguggacggggacccggcuuccuucuucucucaguuagaaagauuguaagcaccgggaagaaaucgccugcugugucucaucucccagcccccgugcccuccucccacccugccugcugugucucauuuccccaucuggccagauuaaaaccagccguuaucucccacacagagcccgaccccuccccuuuagugucugcguccccgcagcguguccucguccccggcacggggugcaggcccacaugucucgugguuccugugcuuuggacugugugcaagugucgugccucaugcaucucucucugugacguguguuucugagaccggcccaagcaggggccguagcccuguccguuccuuucuccauugggagccugugccuggguagcugcaggcacugggcugagcgcccagccccgagggcucucccagggcggggugugggucugcuuaccacgggccguggggccgccuucccugaacgcauggguccaggccacauccugccuuggugccuccucaccugcagugaugcuguccagcaggcuugucugcccuuuugucgcguguggggucuugagaaacuuuuugcuccucugacaccauggagguuuuucccaggucaccucacaggguuuuaaguuuugcuuuugugugacucuggggugagccugcagaguuguucuugcuugcaccugucugggcaguggacucggcacuguguugccaaacgcagccuccccuuggugcgcguccuccccguccccuugugugggucuuuggcugcucccauuggcguguccccgcccgaggccucuguguccugcugcugcucccaucuguguguccccgcugaggcuucuggguccagccacugcucccgucugucuguccccgccccaggccucugaguccugcugcugcucccgucuuuguguccccacucgaggccucuggguugugcugcuguguccugaagcucugaacugguuuggcucugcucuggagaccacccaggguccggagaccaggucgggcuuaugggacccucugagcucacagcuguuucuggagcauuggugucugucaugcugaggguccauccguguguggggggugucugugcaggucucucuuuguucuuuucaucaaguuuugugauuuuucugugaggaccuugccuucuguagcacuuggcugugggugucucguagcuuggugcugacucucuccagucacccaggucagugggcgagcgagagcucuaaaccgaggggcacagcggccaguggggcggucugugcucuuaacucgaggggugcagagguggguggugggcgggguagucccaggcucuaaacacaaggggugcagaggugagcccacggucccuggacacuggagaggcugccugucuugaggugggguggcugcagacgcccugaugccugcaggaguugggcauuuugggggguggaagugugcuggggagcagguggcauucucuccgucaagccccuccucaggacucccccucccuguuauuugcccagaaucuucgguuucgcggggccugcacgacacugccucccguugucaccucacgguccccacgaaugaguccucaucgucugcuccucaggguugggcucucuggggacagagcugugagcagaguagagggagggcuggcuguguagucacugggucaacgugccuguccucagcggcgucacagcuccuaaaucauagugcagggagcgagauguggaggggccuguggccucgggagccccuguguguaaaaacagaagcaucccagccgggcgcaguggcucacgcuuguaaucccagcacuuugggaggcugaggcggguggaucaugaggucaggagaucgagaccauccuggcuaacauggugaaaccccaucucuacuaaaaauacaaaaaauuagccgggcguggugacagacgccuguagucccagcuacucgggaggcugaggcaggagaaaggcgugaacccgggagguggagcuugcagugagccaagaucgugccacugcacuccagccugggcgacagagcgagacuccaucucaaaaaaaaaaaaagacagaagcaucccagaccgcacguccacgaggccuagcgagaggcugggagacaccauccucuuccugccacacaacuccugugaauguguggcugaggcgugacuugguguuggacagacaucuugugaaauggcuggcuggugcacccugugcuccaggggaggggcggagccugugugcugcucccgggugauugacgcugugcggccacaucgcacaccugcgggacggguuugccguguuccuaaugugaugccuuuuacacaucagaaauggcaucaggaagaccucaccuaggaaagcccgugucccugagugggcuccacgugguugucuugucuguggccucagcuuccugugcucacaugggcaugaggaucaugucuuccggccccguggggacaggcagccgugggccgaggugugcaaacuggugggcggccccucagcagcauccaggguggggguucuuaugccgugaccagcuugccugaugaugggugucuccugucucagaggggcccuccaggacgcccugcgcaggcugcuggguuuguuuggagagacgcugagggcagccgucacccugaggagccggaucggggagcgcguggggcucugccuggaugacgcgggcgcaggccuggcccugucgacaggugagugugccgggaccagcugcccagcccugugcuugcagccccucugugguccuggagcucucugagaggagccuccguauugggcgaugcccuugggagcacugccguccugguuuccugcuaguuuccgcacuuacagaaggccgagaccgggguuugggcuaaauuugucagcucccguggacguggcgcugacucaucucggcuggggcgacguucugaguucuguggcuuccuugucgucuuggcugccauggccgcggccggcuugcucacugagccgcgugugccggcaucugcucaucuuguagcuccggcgcuggaggagacauggucugauguggcccucccggaguuggacagaacuuugucugaaugugcagagaugucuuccguggcugaaauuagcagccacaugcgugaaagcuuucucaugagcccagaaagugugcgggagugugagcagcccauccggagggucuuccagagccucagccuggccguggacggccucauggagauggcccuggacuccagcaggcaggugaggcccaggcucccgggguccuguggagaugugaacaacugaguagcugaugaugccacacgagccugguggaugccggugccaacgacgcucgcacggguuucuccccaaggaggaggcuuuucugaaccagaucuuugaggaagugggcuugcuacgaaugagagaaucuguuuguuuaauuuggauaauaaacaggcccauuuucuuuacuucaugcacuguugcaauuccauguggaguguuuucauauuuagagauuaucacuaagaaaggaaauuuuuuguaaccguuuuagaacauuuuagacaauuaaaaaagacauuaaguaggaauacacggaaagcaaucaaagaucuuuuuuucagccaggcacagcggcucacuccugcagucccagcacuuugggaggcuaagguaggagguucacuucagccuacuucagcccacgagcucaucuuguagcucuggcgcuggaggagauguggucugauguggcccucccggaguuggacagaacuuugucugaaugugcagagaugucuuccguggcugaaauuagcagccacaugugugaaagcuuucucaugagcccagaaaguguacgggagugugagcaacccauccggagggucuuccagagccucagccuggccguggacggccucauggagauggcccuggacuccagcagccagccugggcaacauagcgagaccucauuuuaaguuagccaggcgugguggcaugcgucugcggucccagcuccucaggaggcugaggcaggaggauugcuugauccugggaggcugaggcugccgugaguugugguugcaccacugcacuccagccugggugcagagcaagacccuaucucaaaaaugaaaauaaaaauucuuuuuugcuaaguuuugaguucagagguaacucugggucucagccuguagauggccugggagccccagacuggacacaguugccaggggagugucuggaggaagggagaggggcccagggcugaacugggaggcugaggagggguccucauuggagacuguggccacagugucucggaggguggcugagaugugcucaggucccgucacccuggccuggcccugccuggguggugacggccugaagggucuggggguagaaguggcguucucuuggucuuaauguaggcuucaguuauuuuugaucuggaguuuugauuugcaaauguguuuuaacagcuggaagaagcacgccaaauucauucucguuuugaaaaagaauuuaguuuuaagaaugaggagacagcacagguugucaggaagcaccaggagcugcuggaguguuugaaggaggagagcgcagcaaaggcagagcuggcgcuggagcugcacaagacucagggugagcagcaugaggccucggggcaccuggagcacaggcacggggagcaggccuggccucacugagggaaggaagccuucagaauaggguuuuuaaagugaaauguaaaaacaaagccaacaugggaggcacccaugguuugggaggaaugggguggucgggagcugcugcggccagcagggcuguuggaggccuacaccuggguccuggaagcugcuggcucuuagcucugcugcucucaggggcaguggccccgucccuuccuccaagcaggcucuccucaguuacacccaggacuggcuuugucagagcaucugugucucccacaaagguacccuugagggauucaagguggagacagcagaucugaaggaggugcuggccgggaaggaggauuccgagcaccgucuggugcuggagcuggagagccugagacggcagcugcagcaggcggcccaggagcaggcggcgcugagggaggagugcacccgucuguggagucggggggaggccacagccacggacgccgaggccagagaagcugguaaggagcgcgggcuguggaggguggugcgagcuguggggcgcggauacagcugccacgguuuccccagcucccaaggacacucagugucucuagagggucaaguguaaaccagcacgcagcuucuccuggaacacugggcaugggaagcuugugcggaucaggugaggcauccacuggcuuugcugcccuuucagagaaggcggguugucugucgguccugcugguuggaggguccccaccucugugagguggaaauaagaggggcucugaguccaacagcagcagcuggaggcagagccgagugcggcaaacaagagcuacuuuaaaauuucauuuaaaauaaccaagugccugauauuaacccucauuaggaaaacauaguguuaacaauauuaguuuguaucuuuucagauuuuuagauauuuuagucucaaagguauuuaaaaugaaaacugucaaaacauaaguuuaaaaugucgagccugcagggagcugcguccucaguagcugguucagcucgagcaaaggcuuuucacauugcauucgugcaucucaggcacgugggaggcagaggggccugcgcuucucuaaaaguuccuuccaggauggccguggccucggggucaucccuucagaacacagauuggaguuagaagcuugggcaucgcaggcaccaccucagccaauucagaagucucauuuauuauuauuauuauuuuuuuacauuuuucucuuuagaaaacaaccagcuuuugauuuuuguggccauucucauuugcugucuucugucuugcugauuuuugcccuuguucgugugauuccuuguuccuaugguuuuguuuuuguuuuuguuuuuuuugagauggagucucgcuguguccccaggcuggaguguaguggcgugaucucaguucacugcaaccuccgccuccuggguucaagugauucuccugccucagccucccaaguagcugggauuacaggugagcaccaccacaccuggcuaauuuuuuauguuuuugguagagaugggguuucaccauguuagccagccuggucucgaacuccugaccucaagugaucugccugccucggccucccauagugcugggaucgcaggcgugagccaccaugcccggccagcuccuaugguuucucacugccuucguuggguuggacgcuuuuggacauguuugcugccuuucacaggaugugggguucaggucgugccuccucguggugccccagccuuuccaccuguggugcucguguugacaucugggucccacaagcuuauaauucuuuggcccagggggcguuuuccaggguggaagacauuggucccacgggauguuuuaaacucugccuaugacugugcccacacuuuguccucuccuuuucuugguucauuucugucauucucguuuaucccguucuauuuuuuauauaaauuucugaugcugaaggauuagccugguguuuuuccccucguguaucuuuucuuguccuuuuauuuuaagucuuuuuuaauacucuguuuuaguugugccuuguauggauaccauauucaugacuguuuuuuaaaagccugucugugaguaucuucuuuuagucauuuagccaaguuuuauuugccgcaccuccuggcguugggcccuugcucggggguggauuuuccuuggccagcugugaaguccucacugcgguguugccugcugccgggcucagggcggcgucaucuccccacgggccucuaagcccuguugcccccgcacucuguguguccacagggggagugcgggggaaccuccagggccaggagggccuggagucucuucaggucccuuccuccaccagugaaguggugcuggagacaugacucgagauccuguuucuuuuccuuugacgcccucguuuuccugcaucuccucaggauuuuucaggguguuuucaggaacgucucugacguccugcaucgcucucagcaucuuugcccuggcggugcuguugcaucugggcguccguugucgcuguuucuccgaugcuuucucugcuuguccucugcuguccgggggcagccucauggucgggccccucccuguagacucugcugccccauuuccagugucuucgcgcccagccagccggcgcugggccacaccccgccgggggagaccaccugguguuucaucaccucgagcccuuggacuucagccagucacuucguuugucaggccuccgggcagauaaagggguguguggccugcauucuguugaacggcccggugaggccggggcccuguggcuagcgcccccgugucaggugccugugucgugcccugggccugagcacgugggucugagcacugcagggcuucuucccaaggcugugguggcccgucugcugccuugccucugguucaucuccugccacaaagccuggcccaccagggagugucgugacagguggaugugggcccuggguguccauagccuggcugggcucccugcaggccccaggauugaagcugaggcuuaccaugggccuugcaguggcaggcgccuggcaugccgggaguggaucucauggagcccuuucgcaggcucgggccaacuuugucacugggaaauucucguuguuucucugggguccucuuuguuugcuuuccuuucgacaugguuaacccugcccuaguuucucacucugguuuguuuucuuuccuuucacccuggcucugcgguugugugacucugcgccagcuaccggcccugaccacucucccggcagggccuaggcucugacgguggcgugaacccggcccuggugugcagcggcccugccucgccguguugcgugacgcccccuucgcugugugguguuuuguggcucucuucagguguugccaucugucccuuuuguucucuuugucuccuugaaaaguugaugggccugcagccgcacaggcaguugugggcauggugggcgcugagucuggagguuguucaaggccagcagcguugcccagagcccugcugcugacgcugccgucacugguucuagcucucacauucucagcugcacguuucuguuuccaccucaguaaacgcaaacucuuguucauaggcacagcugucacugcagcacacaaggacucagguuuguaaagacaaacgauugauuugugugugacgugcuguuuguuugcacuggauuuugcaaauuauuuacuaaagaaaaguacuucagaccuuuuguggcaaacaauaaauacagcgauacucuaaucuucaguauucauaaaaauggguggaguugucccauuuuaacgccccagcaaaacaggagcauuucucuaacggucuuuacuacagugccuaagcuacaguuugugcugcuuuucagaaacugaugucuugugauaguuacagcuguucuugggcugggucccagcucuggucuccagggagggccugggcccccuggauccccugugccuguucagcgugggugucaccugcuucgccagcugggauugcgauccucgugugccucccugagucugcgugcaugucagcaggcacccugccccagugccccuggcccugaagauggugauguucugggccaagcacagcccaggucguguccaggcccagggagugcagucaggggagcagcugcccucaggccucgccgcacgucucagguugugaauguuaccgcagcagcauguuuacagcggacucgccguuaacugcugacaguggcaucaacauuuauugagaauguuacuugcauuggucaugauaguuugugauaaaagacuuaacacuuuuacaaaucaaaaugauuuuuuggaagcuggugaaaugucaguuaacauguaugaauuuaauauuuuaguuuuuggguggcuuaaagacuucaggauucaggccgggagugguagcucacagcuguaaucccagaaccagacuccaucucagaaauaauuauaauaaaauagagacuucgggacucagcagcagagacuccaucucagaaauaauaguaauaaaauagagacuucaggacucagcagcagagacuccaucucagaaauaauaguaauaaaauagagacuucaggacucagcagcagagacuccaucucagaaauaauaguaauaaaauagagacuucaggacucagcagcagagacuccaucucagaaauaauaauaaaauagagacuucaggacucagcaacagagacuccaucucagaaauaauaguaauaaaauagagacuucaggauucagcagcagacacuccaucucagaaauaauaguaauaaaauagagacuucaggauucggcagcagacacuccaucucagaaauaauaguaauaaaauagagacuucaggauucggcagcagagacuccaucucagaaauaauaguaauaaaauggagacuucaggacucggcagcagagacuccaucucagaaauaauaauaauaaaauggagacuucaggacucggcagcagagacuccaucucagaaauaauaguaauaaaauagagacuucaggacucagcagcaggcacuccaucucagaaauaauaguaauaaaauagagacuucaggauucagcagcagagacuccaucucggaaauaauaguaauaaaauagagacuucaggauucagcagcagagacuccaucucagaaauaauaauaauaaaauggaggcuucaggacuuagcagcagagagccccuuuuuccaagacgcuuuuucaucugcaguuuccacuugggccggggcuucgcaccccaggucucaggcugguuuugcugcuggaagagaauuuuugaggcuaggcgauuuaucacagacacacguuugugacuuacaguucuggaggcuagaaagccuaaggucagggugccagcagguuuggugucuggugagguacccaucucugcuucuaaggcagagccuugcacacuguauccuccggaguggagggcuggaucauccuggggcagaggcagaagggccgagugggaggaccacucccaaagccgcuuauugaggcauuaaaacugcugugaggguggagcccuugcggccucgucaccuuuucaaggcccuuccaauaccaucacucuggcaguuaaauuucaacaugaguuuuggaggggacagaaauuuaaacugugguacccaguuaauuuuauuuauuuauuuauuuauuugaaggagucucacuuugucacccaggcuggagugcagcaaugcaaucugggcucacugcaaccuccaucucccggauucaagugauucuccugccucagccucccgaguagcugggauuacaggcacacgccaccauguccagcuaauuuuguauuuuuaguagagacaggguuuuaccaugauggccaggcuggucucaaacuccugacgucgagugauccacccgccucggccucccaaagugcugggauuacaggugugaaccaccccacccgaccuagauucgcuuuugauuuaccgauggggcguuugccuuuccccuagacacgucacaaccccaggcucucagcaccguccgucgucugcugggacugggcuuagucguguguuucugucugggagacuguacugaaggcagaauuccuagagaaucacccacaugucacucagaaguauucuucucaggcuucagaaauuugcuuuagccaauguuguuuuaaaagaugggcguuuuaccccgaauugaagugacuucauuuucgguggguuuugacugaaucaccaucaggagaugcacgugucaugcaccagccucugaggugcggggguguccccgugucuguccuguuugcauccuuagcucuccggaaggaaguggaggaucugaccaaagaacagucggagaccaggaagcaggcugagaaggaccgcucagcccugcucucccagaugaagauuuuggagucugaguuagaagaacagcugucucagcaucgcgggugugccaagcaggcggaggccgucacugcccuggaacagcagguggcaucucuggacaagcauuugcgcaaccagcggcaauucauggauguaagaauucugaauaauacauuuuuuugcaucacuaaaaguugccguuacagcaugaacuucuuuccagaucguuacguaagcuucugcaguaggauguugaagagggcgccccacaccugcugcacaggugcacccaggucgcugacucuuggugggugucuucuugcccacauguuguggcgcagcccucugagggccaccucccauggucuugccaugcuccuucucacagucacggaggcgucacuuggggcccgggcugggccugugcugcagcucucacugguucuuguccucccacccaccagucucagacguuccucuguguuccaugcagagagcuguuuuucuuuacuuaacuccauuuuacaaagugacugugaugagggggguauuuggagucugagcugcugggcaguugcacuuguacgugcaguggaagccuggguggaccuucgcugcaaggggcacgccagccccguugggguggucccaacacgcugccucuccucccaggagcaggcagccgagcgggagcacgagcgcgaggaguuccagcaggagauucagaggcuggaggggcagcuccgccaggcggccaagccgcagcccuggggcccucgcgacagccaggugagucagugcagcgugcagugcugcugguugcugucuuucacuguguuuuuaagcuuuaacuuucuuuaaauuuuugccuuccauguacaugaaaucggcagcaggcgccgcuggauggagaggugaggaggcgucaacgagaugggcacucccugcgcuggcgcccaggcuccccugcgcucgcugggacuguccugccacccacucgcuuuucuugcucuuguuugggcugcagccaucugcuuucucuugucugaggaagcuguaguagguucguuuauuuuuuuaaaaaauuaaugguggauucacacacaguuguaagagguaagacucggaucccucgugccuggcacgugguuccccagaggucucauccacagagccggaaugcagugucacagccaguaugggcagggaucuggugacgcugcagugccuucugccccccacggacccucguguacugggucacggccaugccgccguccuuucucgggcaaccacucaucugucgucuauuucuaaaacuuuaccaucuuccugaugggugaagcgugccugucaucuugggggauugacaccauucaccgagccugacucucuggagauugauccagguuacugaguguagccauaguuuguucuuuauguugcugagaaguauuccauucuuuuuuuuucuuuuucuuuuuuuuuuuuuuuuugaguuggagucucaugcaguugcccaggcuggagugcaguggcgcgaucucagcucacugcaagcuccaccucccggguucacgccauucuccugccucagccucccgaguagcugggacuacaggugcccgccaccacaccccgcuaauuuuuuguauuuuuaguagagacaggguuucacuguguuagccaggauggucuccaucuccugaccucgugaucugccugccucagccucccagagugcugggauuacaggcgugagccaccgcgccggcuguaguauuccauucuuuucuaucagaauagauuucauuuuccuaacaaauucuguauuauagagaaugccuuucuuaacacaacaucacccuauacuuccuuuagaucucuguucagccucugggucuaggucucccugugcagccugugggucugggucucuguucagccugugagucugggucucuuuucagccugugggucuaggucucccugugcagccugugggucuaggucucuguucagccugugggucugggucucucugugcagccugugggucuaggucucccugugcagucuuugcgucugggucucccugugcagccugugagucuaggucucccuuugggucuaggggagggcauagggcaucuauuuugucucuguuguuuuggguacuuuuuuguuuggaaaauggguuuuuauaaaacauucuauuguauuccucaagcauuuuuuguuguuuuagguugaguuguuacaacaaaaguugagagaaaaguuggaugaauuuaaugaauuggcuauacagaaagagucggcagauagacaaguguuaaugcaggaagaagaaauuaaacgucuggaggagaugaacaucaacaucaggaaaaaaguggcccagcuccaggaagaaguggaaaaacagaaaaacaucgugaaagggcuggaacagguaaagcgucuccauguugugguugggcacguggugaggugucccgcaggcauggcuucaucgcugagcuggcagggagugggcagggcguccuucuucacuggcagccaccacgucugcaccagaaacacuggcgucagggagaaacagaagucauuggugacggguagcaagaguacuuugaccuuucuggagauuguugauuuuauuuacuguaguaggauuuauacaauuucuuuaugucucaagaacucugaauuuauccuuaauauuucauaaaguaaacauuuaagauuuuagguuuaaaaaaaucuuagcuuauuaaauacuuugaugagagccccuuguaauuguuucaaucuuugagcucaggaacucaugucagcucccagugaagagaucuccagugaugguuuugcauugcugguguuugccguguuguguguguucguuugugucugagaguuuaaagaggggcuggagcacugagccaggugggccaucucauggcuggagggggcagggcugccugucugcauuucuggguagcggcugugcccuccauugugagcauuuagcuaaaaggaauucagcugacuucuaugagguuaaaagguuacuugaaaagaggcucaguaagaaauuugauuuuagaauuaguaguuuggccucagacacagaugagaggaggagucuuucucaggugugucugauucuuuuuuuuuuuuuuuuuuuuuuuugagacagagucuuguucugucacccaggcuggagugcaguggcgcaaucucggcucacagcaaccuccuccucccggguucaagcgaucucuccuaccuuagcuuccugaguagcugggagcacaggcacgcgccaccacgccuggcuaauuuuuguauuuuuaauagagaugggguuucaccauguuggccaggcuggucucgaacuacugaccucaggugaucugcccgccuuggccucucaaagugcugguauuacaggcgugaaccaccacgcccggccaagugugucugauucucguaagugcugaugagaauuauuaaacuggggccuuuccucaggcccugacguguuuccguuccgcugucgcagggaggaccgcugagcaucaccugcacuuggagcggaguugucccccuggccggccacugcacacauuucagugacagcugcuccagggcggcuucaccccuucugccuucacucagcgaacguuuacugagcuuaguagaugccaggguuagaaaauguguuuuuaucccuucgugaaauuuggacuguguaugcaauuuuauaugucaugcucuugcgcauguaacguauugugaccauuuucgucauauuaaauauuguuugaaaaauuuuuucuaggcagguaauauucauuauaugagcauaccaucagccauugcccuauuuuuuuuggcaaguucuugucaguuuugaaaauauugguaauaguuuggugaauauuacuguagauaaauuccucacaguggacucgggcacaggcuguggcucucagucacguccugcaccaggcaggccucugcugggagguggcuggguccugggugccaguguugccuggugugucacugagugcaggggcgugcagguccaccugcucugcuucaggugcagcuaaagauggucugugcuuuaacaggcagcaguugagguacugaauucccaaauauuugccuaaaauagaguucuuuuuuuuuuaauaggauaaagagguguuaaagaaacagcagaugaguagcuugcuucuggcguccacguugcagucuacacuagaugcaggcagaugucccgagccuccuucgggcagcccuccugaggguccagaaauacaguuagaggugacacagagagcacuccugcggcgcgagagcgaggugagugcagaguggggccaugggacugccagcccugggucaguguccagugggcuucucuguggcagauccgauguccagauaacacaggcgaugggcuugugaccacuguguauucuuuucuuuucuuuuuuuuguuguuguuugagacagaguuuugcucuuguugcccaggcuggagugcaauggugcagucucggcucacugcaaccuccgccuccuggguucaagcgauucuccugccucggccucccgaguagcugggauuacaggugcacccaccgccacgcccggcucaguuuugguauuuuuaguagagacaggguuucaccauguuggccaggcugguuuccaacuccugaccucgggugaucugccugcuugagccucucaaagugcugggauuacaggcgugagcccaugcccagccugaccacuguguauucuuugcaguuuuaccauuugugugcggguacagguacaggguaguaauugcuuuaggcaugugcauuuaaauaucucaaagcuauuuuaauaaugucuuaauuauuaauauuaauagaauauuagaugacuuuuaauacuuuucuucuuuuguuuuaaugaaagguuuuggacuuaaaagaacagcuagaaaagaugaaaggugacuuagaaaguaaaaaugaagaaauacuacaucugaacuuaaaauuggacaugcagaacagccagacugcugucagccucagagaacuugaggaagagaacacgagcuugaagguaagcuaccaaagguccacgugacgcccgaguucauguugcuuaugccggugccgagcggccaccaagacccucaucggggaggcgagucucuggucuucacagacgcccguggcccccauguggcagacagugcagagagcgcccgauucugccuggggacaugugcauggaagcagcuuucuagggaucuugagugaggaaccagcgaccccugccccaaacugcuuucugauugcagcacugauagggaucugaggagaggcacuucccuagggcagcaccccagggcugugagaggcgugaagcuauugggcuguugguggcuugcucuucucaaggaggugacuugaguaaguggcuacucacuguuucucuucccacuggcaugaugggaaaaaaaucuuaagaacaaauuuuuuuuuaaauuuuugugaguacauaguagguguauauuaaaaaaucuauuuuuaaaucuuuuauuuuaauguagccgugcuuuugaagcaaaaaagaaaaccaaaaccaaccuguuuauaguagagaugauauucaaaauugcagagcauucauaacuucacagaugcccuugaaagaccuuguguagaaucguguguguggugcccacacaacacgugcucagugaaugaacacagcgugggagaauuaguguguguggugcccacgcggcgcgugcucggugaaugaacacagcgugggagaaucguguguguguggugcccacgcggcgcaugcucggugaaugaacacagcgugggagaauuguguguguggugcccacgcagcgcgugcucggugaaugaacacagcgugggagaauuguguguguguggugcccacgcggcgcgugcucggugaaugaacacagcgugggagaauuguguguguggugcccacgcggcgcgugauuggugaaugaacacagcgugggagaauuguguguguggugcccacgcggcacgugcuuggugaaugaacacagcgugggagaauuguguguguggugcccacgcggcgugugcucggugaaugaacacagcgugggagaauuguguguguguggugcccacguggcacaugcucggugagugaacacagcgugggagaaucguguguguguggugcccacguggcacaugcucggugaaugaacacagcgugggagaaucguguguguguggugcccacgcggcacgugcuuggugaaugaacacagcgugggagaauaguguguguuuggugcccacgcggcgcgugcucggugaaugaacacagcgugggagaauuguguguguggugcccacgcggcacgugcucggugaaucaacucagcgugggagaaucguguauguguggugcccacgcggcgugugcucggugaaugaacacagcgugggagaauuguguguguggugcccacgcggcgcgugcucggugaaugaacacagcgugggagaauuguguguguggugcccacgcggcgcgugcucggugaaugaacacagcgugggagaauuguguguguguggugcccacguggcgcgugcucggugaaugaacacagcgugggagaauuguguguguggugcccacgcggcgcgugcucggugaaugaacauagcgugggagaauuguguguguguggugcccacguggcgcgugcucggugaaugaacacagcgugggaaugcucccugagugaacacagcgugggagagucucaaaaaacaacaacaauaacaacaaaaaaaauuuucaaauugauuuuccauuuuuccaauuuaaaacuguaggcuuauuuaauuaggacauuucauaucuguagggucaguggaauauuucccuauuaagguucugucggcucuguuuugauaugguuguuguuauuaccauuuccaccggcauuucugcccaacaaagaagaggagauagugcgugugaacgagcagcucuaggcaccgcagguuuaccucggcgagguacgccacucccuggugcugggggagaaggggcucuucucacgcuucuggcuacgccugcgucuccuguacgaaguccucauaguuucugggugugauugacuggggccuuggcuuuccaggaugacagucuucuguuuccucauacaauauuuauaauacuuuucaaaauuaauuuuaucaguugggcacgguggcucaaacgccuguauucucagcacuuugggagacugaggaggguggguuacuugagcucaggaguucgagaccagccuaaacaacaugggaaaaccccaucucuacuaaaaauacaaaaauuagccaggcauggugacacaccacuccggagacugaggcaggagaaucacuugaacccaggagauggaggaugcagugagcugugauugugccacugcacuccagccugggcaacaaagcaagacccugucucaaaaacaaaauuaacuuuauggccgggcacaguggcucucacaccuguaaucccaggaguuugggaaccugaggugggaggaucguuugagcccaggaauucgagaucagccuggacaacguaaugagacccaucucuacaaauuuuuuuaaaaaauuuagccaggcauacaccuauaguaccagcuacucugaaggaugagauaggaagaucacuugagccugggaggccaaggccacagugagcugugaucaugccacuguaauccagcuguaaugacagaacaggacccugccuaaaaaaaaauaauuuuggaggggaccauagaaguaaggagaaguuugucuccaguuugucacuuuuaauuucccuuugacagaggcuacugagauguuaucugucuuaguaucugauuguaucuuguauauuuggcaaaaauuuaaaaauagccuuuuggguuacauugaagaaugccuuuuauggccaggagcgguggcucacgccuguaaucccagcacuuugggaggcccaggcgggcagaucacuugagcucaggaguucgagaccagccuggccaacauggugaaaccccgucucuacuaaaaacacaaaaguuagcugggccugguggccggugccucuaaugguuacuugggaggcugaggcagaagaaucacuugaacccagaagguggagguuggcagugagccgagauugcgccacugcacugcagccugggcgacagagcaagacucgucucaaaaaaaaaagaaugccuuuaaaaaccauugauuacuuuucagaagaaguuguauuauuugucuauagugcucuagaacuugaccucuaacuauaaucuuauauaaugaaaaauauauaaaaaauaguuuacauguuaaggacaguauuuuuguuccauuaagaauugaaagcuuuuuaaggacaauccccaauauuuucuugugggauuuuucuuacagauaugugcaaauucguacauccuucauuuucuguaauucuccuaauuuuuuguaaagaugcggaugcuauuuugcuuuauauaauaaagaaaaguaaaauuccauuuaaagguuugacucuuguuagguuuccaguuauuucaaggaaaccacauuugcuguauucuacccuauuuuaugucagugaagauguuugucuucuagaagcgucuuuuacacuuguggggaaacggagcucccgucucccuggcguggucgugguuguugucacuuguucuguacugccguccuccggggcuccagccauccuaacaccucauccucaaugugggcccucccucccuguguggcuuauucuaacucugggguuagugauguuucuuuaauuuuaccauuuacuucucccuuauucuacagguuuuaauaaagaggucucacgucuuuuguuaaauuuauccuuaaauauuuuagguuuuuugcacuauuguaagugagauuuaaaauaauuaucuaguuguuuaccgugaauacacauacaccuuuuguauguuaaccuugcuguuaccuugcacaauuuauguauauuaguagcguuuuguggauuccugaaggcuuuuuauguauaagauaacaucaucuucagauaaagacaguuuuauuucuuuccaauuuuuguuauuuccuucuuuuauuacaaugucuagcacucccaguacaaaguuaaaacuggcuagggcagucaucuuugcccagcuccuugucuuacagggaaguggucaguguuuugccauuaaguauauuagcuuuagguuuuucacaggugccuuuuuaucagaucaaggaaguucuguuauauuucuaguuugcuuuuucuggaucuauugaaauagugaugauauuuuucucuuuuauucuacuaauaagguuaacuuuauugagugauuuauuucuuggagauuaaacuaaccuugcgguucuaggauaaaccauaccugguagugauguacugcccuuuucauauguuacagauauuacugaauuugauuugcuaauauuuuguuaaugguuuuugcaucuguguucaugagggauguuggugcauaauugucuuuucuugcaguguucccuaaggcuuuguaugaagguuauguuagucucauaaaauagauugggaauuuuuucacuuucuuuucugaaagagguuauuuaacauagcugggauuucuucuuugaauguuuucauagcaucaacaaugaagccauuuggaguuuuauaucuagagagauugaugguaauuaauuuucuuuaacagacugagguauuuggauuucuguuucauguugugauaaguuguauuuuucaaggaacuugugcaugucaucaaaauugucaaauuucuuugcauaaagaaguuuauacuuucucuuuuuuuuuuuuuuuuuuugagacggagucuugcuccgucacccaggcuggagugcaauggcgcgaucucggcucccugcaaccuccgccucccggguucaagugagucuccugccucagccucccgaguagcugggacuacaggcgccugccaccaggcccggcuaauuauuuuuguauuuuuagcacagacgggguuucaccguguuagccaggauggucucgaucuccugaccucgugauccgcccgacucggccucccaaagugcugggauuacaggcgugagccaccgcgcccagucuauacuuucucauuuuguaacuguucaccuuauuaaccauuuccuuacuugccauugaauaucugcagguuuuaugcugauggcccuccuuuuauuccugauauuagugaguucguguuuucucuuuuauucuugagucugucuagcuaguaguuuauccauguugucaguguuuucaaagaaucagcuuuuggcucugauacuuuucucucuuuauuucuuugauuucuccucuuauuuucauuauuggcuuccuucuauuuaccuuggguuuauuuucucuucuuuuucuagcuuuuucagauagaaccuuaggucauugauuauagauacuuauuuuucaguauaacaauuuaaguuuuuuguuuuuagacuucgugcauaguaaaauuaguuuuuuuuaguauacaguuuuauaaauuuugaaaaaaggauuuaguccuguaauaaucaccacaaucucaucacucaaaaaauuuucuuugugcuguuucuuuguggccacccaucaggccugcugucuuccugucuggaauucuguuucgagucagguguuguaaugcacuggaaauugaugcaugcugucgccugugucuguuccuuuaguugcugaguacuguugucuggauggaccacaguuuguugauccauucacccaucgagggacauuuggauaguuucuagguuuuggcagugaugaaucgagccaccauaaacuuucaugcauagcuuuuugggagaaaauaaauguucacuucuuucgguucaguacuuaaacugaaugcauggcugauucauguguaaguauauauuuaaccuuaaaagaaacugucaaacuguuuucuauaguugcacuaccguuuuacauuccaccagcaauagaugaguguuccggguaaccacguucucaucaacauuugguaaggucagucuuuuuuucuagacauucugguagauauguagugguauauccuagaguuuuguauuuccuuaaugacuagugaucuugagcaucuuuuucuaugcuauuugccauccauauugugggggaaauguuugcuuaagucuuucagaaaguuuuuuuuuuuuuuuuuuuuugagacagagucucauucuguggcccaggcugcagugcagcgggaacgugucagcucacugcaaccuccaccuccuggguucaagcaauucuccugccucaaccuccugaguagcugggauuacaggcgccgccaccacacccagcuaauuuuuuaauguuuuuaguagagacgggguuucaucacguuggccaggcuggucucgaacucuugaccucuggugacccaccugccucggcuucccaaaguacugggauuacaggcaugagccaccgugccccaccucagaaaguuuuaaaaaguuggauuguucgguuucuuauuguuuugggaauucuuuauaucuuuugaacgcuuuuuuuugauacaugauuugcagguauuuucucccaauguauggcuggucuuuucauucucuuaacaguauguuuugcagagcaaaacuuuuuacuuuuuuuuuuuuuuuuuugacagagucucucucuguugcccaggcuagaguucaguagcgcauuuuuggcuugcugcaaccuccgccucccaggcucaagcaguccuccugucucagccuccugaguagcugggauuacaggcaccugccacuaugcccagcuaauuuuuguauuuuuaguagagacgggguuucuccauguuggucaggcuggucucgaacgccuaacucagaagauccgccugccuuggccucccaaaguguugggauuacaggcgugagccacugugccccgccagauuauacuuuugaaguucugagagcucuuucccuagcccaauuuuccugagaaauuucauaguuuuacuuugcauucaggucuccuugaauaugcuugcauacgcuuuuugcuuuuuauuuuucuuuuuugacacuaucuugcucugucgcccaggcugcggugcaguggcgcagucucggcuuaccgcaaccucugccuccagaguuuaagugauucucccaccucagccuccugaguagguggaacuacaggugcccacgcccggcuaauuuuuguauuuuuacuagagaccagggugcaccgugucggccaggcugaucuugaacuccugugcucaagugaucugccugccucagccucccaaagugcugggguuacagacgugagccaccgcgcccggccucaguucacugauuucagguuuugguguuuuacauuuagagcuaccuucguaugcuggcuccaguauuuuaacgugauauaugcguugugauuaugaccgucuucagugcgcaccccuugauuccaguuuauuuagugcauuuagggaaugagcagaagcugcguauaaucagaauuguccucgaaauuccuucgcgugccuguagaguacagagacaacggccggugccgcacacaguaaggcacgcgacggggagcagaaugugcagcgggcauuccuagcccgcagcugggaggcugcuuuugcuaaaugcaugguguuguucaucggugguaaaugcauaggaagguguuguugacagcguccaaaccaaagccacagguucauccgguuccuuuguuuuuuuucuguaggccagauuugcauuugaguccagaguaauugugagguaguuccagagaaaccuggaguuguuaugaaacccucaguuuuuuggaagaacauauuagucuauaacaaauaguuuuaaaauuguuagagcacaaauggauuagaauuuuucuauuuuuugucauuaccaggaauguuaucuuaagagaauagaguuuggagcuauauugacauacaucucaauccuaauuuuccacuuacuguuuuuauggguuuagaaagauguuuaauaucucaguuucaauuuuccugucuuuaaaguggaaacaaucguauuuccuuacauggcugaggauuauguuucauggcacaaguaaacucacuucgaugccuggugucaccgaguggcaguggcagagacgccucaucaccagcgucaccacgagcaguguugggauggaaggggagcgugcccggcucaccgcuuuguuggugcagauucucugccuagguuucuuacuuuccuccuggagucagaaugacaccuaaaaucuaaugcaccuucaggaaaaucaaacaaaucaaaguuguuuaaauauuaacaaaauaacauuuaaaggguggugaaagcaucauucuguagauguccuugcauggaaaaugacugcauuagagcuucgucccacgaucagacguggagcacaaggugugcaccagggcccaguggcagccaagguggguguggagugcauccggcaccagcaguuugcuucuauggcugcuuuguuuuucacgcuauggagucuucacuccaagaaugcauucaggauguaacgugcccugaaguagggacauucggaaguggauacauuuaauuugccucugaaauguccucucucuucaggucauauauaccagaaguucugagauugaagagcugaaagccacuauugaaaaucugcaagagaaucagaaacgauuacaaaaggagaaagcagaggaaauugaacaacuccaugaagucauugagaagcugcagcacgagcugucccucauggggccuguggugcacgaagucagcgacagucaggcuggcagucugcagagcgagcugcucugcucccaggccgggggcccucgugggcaggcccuacagggcgagcucgaggcugcgcuggaagccaaggaggcccugagccggcugcuggcugaccaggagcgcaggcacagccaggcccuggaggcccugcagcagcgccuccagggcgcagaggaggcugcggagcuacagcuggcugagcuggagcgcaauguagcccucagggaggcugaggucgaagacauggccucccggauccaggaguucgaagcggcccugaaagcaaaggaagcgacgauugccgagagaaauuuagaaaucgacgcucugaaccagcggaaggcggcccacucugccgagcuggaggccguccuguuggccuuggcccgcauccgccgcgcccuggagcagcagccccuggcagccggggcggcgccucccgagcugcaguggcuccgagcgcagugugcccgccucagccgccagcugcaggugcugcaccagcgguuccugaggugccagguggagcuggacaggcggcaggcccgcagagccacagcucacacacgggugcccggggcccacccacagccucgcauggaugguggcgccaaggcccaggucaccggcgacguggaggccucccaugaugcugcuuuggagccgguugucccugacccacaggugggcuccccccgcgggccauggcaggguauuuuuuuuuacucuccuuuucuccuuugaugucaaugacuucucucugcgcugggcacugggggcugcaguugucaugguggcucaugacacagcggagaaagggggccugaagcucgggccagccugggccuguuccgugucaguacgcagugaagcugggcugaggauuucacuguuuuguaccauuuuaagcuuaucguuuuaagcuuuuaaaaacaauucuuucuuucacauaauagggacuguccagugaaacggagcucacuaugugaggaggguccgcuuaagcugcuucucugguuucuaaccaaaugguuugucugucgaugagcagugccugugugagauguggcgagcgagcucuucuuuuggagcuggaggcccuguagggagucgucuuuuaaggcuuccacuuguauuugagcagaaccuugggaacuuggugccuaccacccccacaccagcugggucuuuguagaguggcucccacucucagaugccccaguccaccuugcucuguggggucguccugggucggggcagcuuucugcuggguccucagccccguucccauguggccugcuguggaccaaggugcucggcuguggaugucacugccaccucccucuggcaucccugcuggcugccguacugguucccagcuccaggccaccugaggggcagccccagcaacagccuccugcaugcucagcuuuccucugucuccucugucaagggugaucugcagccuguccuggugacguugaaggaugcaccucucugcaagcaagaaggcgugaugucagugcucaccgucugccagaggcagcugcagucggagcugcucuuggugaaaaaugaaaugcgccugagucuggaggacggcggcaagguguggggaggggggaaggcgcgagguccccccgggagaggcuggacacgcggcagcaagguguggggagcggggaaggcacgaggcccacccgggagaggcuggacacgcggcagcaagguguggggagcggggaaggcacgaggcccacccgggagaggcuggacacgcggcagcaagguguggggagcggggaaggcacgaggcccacccgggagaggcuggacacgcagcagcaagguguggggagggggaaggcgugaggccccccugggagaggcuggacacgcggcagcaagguguggggaacggggaaggcacgaggcccacccgggagaggcuggacacgcggcagcaagguguggggaggggggaaggcgugaggccccccugggagaggcugggugcagaacaugugggucuugcccugggcagaggcggguauucugcugaggugaggagcacaguccgugccugcagugacauguucucugaauccuuucuguucuguaacgagcuguccauaacuguugugaaauuucguacgugcuucauuuaagccacucuguagaaacaaucaguuggguuuuuuucuuguaauugauccaaauggauuuaacugugcucgaggguuaguccugguuugucuuuucaugggaggaccacaucgcccccgugggccucaccucagcucaggacuuugauggccagcgucuguuuuacuuugaaaggccucagauuuauucuuguaaucuguucaccucacuccauauugucacuugaaaaaaagcuggcacuucuuuuccccggggaaggagguugcaccuugaccaucucaaauuguagcaggguggagauuuagcgagaaaagcgggugcuggugcuucucccacccagugcaccaggggcagguccccagugccccuaggaaacaccugcgcaggagcugcccucuccucaggccgcaucaggugcagauggcaccuuuauuuuuuuucucucuuuuuuuuuuuuuuugagacagagucuugcucugucgcccaggcuggagugcaguggcacgaucucagcucacugcaaccucugccucccgaguucaagugauucugcagccucagccucccgaguagcugggacugcaggcaugcgccaccacacccagcugauuuuuguauuuuuaguagagacgggguuucaccauguuggccaggcuggucuugaacucuugaccuuaggugauccacccuccucagccucccgaagugcugggauuacaggcgugagccaccacgcccagccuuagauggcaccuuuugaugcacugucugcaccucgccuccuccaguccaaggcccagcgcagccucccuggacacacagccacccacccuucuccuccuucuccucugggacacacaucuguccacccuccuccuccuccuccuccuggacacagucgcccacccuccuccuccuggacacacagccgcccacucuccucuuccuccuccuucucgacacacaaccacccacccugcuccuccuccuccuccuccuggacaugcagccgcccacccuccuccuccuggacacgcagccgcccacccugcuccuccuccuccuccuggacacacagccgcccacucuccuccuccuggacaugcagccacccacccugcuccuccuccuccuccuggacacacagcugcccacacuccuccuccuggacacacagcugcccacccuccuccuccuggacacgcagccgcccacccuccuccuggacacacagccgcccacucuccuccuccuggacaugcagccgcccacccugcuccuccuccuccuggacacacagacaccuacccuccuccugcuggacacacagccacccacccugcucuuccuccucccccuccucccugcuguuugcuaaaugugccccaacuacuccuccaggcucugaaacccagaggcucuaacaccagaagugcugggcagguguuuuauggucucuaggguggcacggaagcaugcuuggugcugaagccugcugagaccugggcucacccgagccccucgcagcccucgugagugucccgcacgucgcugggacguuucuugcaugagugcaggugccgccuguuccuggguccacacugcgugcaccucauuggcguuuagagccugaaagauucuuaauuccacagaaaucagggaaggaugggccuaggcccgcaguucugaggagacccaugaaccugguucgugugcuugucaugugcucucgggaaauacauccuguguggagagcccuucgcaucuccugcggcaaacagucuuggggcccucaugacaggaacguuucuuugaauuuuuuuuuuuuuuuuuuuuuuuuuuuuuugagacagagucucgcucugucgcccaggcuggagugcaguggcgagaucuugagaucuuggcucacugcaaccuccaccuccuggguucaagcaauucacugccucagccucccgaguagcuaggauuacaggcacccgccaccaugccuggcuaauuuuuguauuuuuaguagagacaggguuucaccauuuuggccaggguggucucgaacuccugaccucgugauccaccugucucagccucccaaaaugcuaggauuacaggcgugagccacugcacccggcccaauuuuuugaauucuuaagagaaagcucagcccugccugccaaauucuuagaaguuacacacacagaaacuccaaauucaucacauaaaccacaauuuuguguuuucggugcucagauauagaaccuucccauccuuuuucccuuguaugaagcuuguguccucaaucaccgcagaaauagguuaugacaguugccuuuuaagcaaggagauguaagccuugguucuguuucucauagaauuaaauaaacuugaaaugugcagggcucauuguggaaucacccgagugcuccgaaacucccugaaauccacucauuaacaccagacaggugcgacuccuggugagccagguauuccaccgugcaccuguucuguuucaccugcaggguaaagaaaaaguacuggaagauugucagcugccgaaggucgaucucguagcucaggugaaacagcuucaggaaaaacugaaccguuugcuguauuccaugaccuuccagaauguggaugcugccgacaccaaaucucuguggcccauggccucagcacaccuguuggagagcagcuggagugaugauuccugugacggagaagagccugacauaucaccccacauagacacaugugaugccaauacagccacgggggguguaacugauguuaucaaaaaucaggccauagacgcgugugaugccaauacaaccccaggggguguaacugauguuaucaaaaauugggauuccuugauaccagaugaaaugccagauucucccauucaagaaaaaucagaaugucaggacaugucucuuucuucaccgaccagcguacuugguggcucccgccaccagagccacacugcagaggcugggccccggaagagcccggucgggaugcuggaccugucuuccuggagcuccccugagguccucaggaaggacuggacccuggagcccuggcccagccuccccgugacaccccacucaggagcccugagccugugcagugccgacacaucccugggggacagggcggacaccucgcugccacagacccaggggccggggcugcuuuguuccccaggcgugucugcagcagcgcuggcacugcagugggccgagucuccgccggcugacgaccaccaugugcagaggacggcugugguaggugccugcucugcucccaggccugcuguucccgugggaauguggucugcccggcgccacggcagcugccauuguuuguucaccuccugacagcacacaccucgcagugcuguguggggccagcucugcaggacuggcaucaugggcgcauuuagauuauuucaguuguucagguauuuuuaaaaugccugagaugcauuugccugccucagacauacccugggcaugcuucuccacugacgcugacuccaacgggcauagcccagacacgucuucgugugugaugggcauaggguucuuuguccagaaugguuuuuuagauuuauuuuuaggaaugcuuccuuuuuuuuuuuuuuuuuuuuuuuuugugagauggagucucgcucugucacccaggcuagagugcagugacgcaaucucggcucacugcagccuccgccuccccagguucaagcaaaucuccugccucagccucccuaguagcugggacuacaggcacacgccaccacacccggcuaauuuuuguaguuuaguagagacgggguuuuaccuuauuggucaggcuggucucgaacuccugaccucaugauccacccaccucagccucccaaagugcugggcuuacaggcgugagccaccaugcucagccagaaaugcuucauauuuuuaacagguuucacauaugcuaauuaauuuuaauuuaugaguuagaucguauuauuucuaacauaaucauuuugggauuuuguguaucuugaguaagauaaaauuaaaaaucagguaugguugggcucaugcuuguagucucagcacuuugggaggcugaggcgggaggauugcuugagcccaggaauuugagaccaggcuggguaacacggugagacccugucucuacaaaaaaaacacaaaaaauuagcugggcgugcuggugccgcccauggucccugcucuucaggaggcugaggcaggaggaucacuugaccuugggagguugaggaugcagugagccaagauugaaccacugcacuccagccugggugacagagugagacccucccucaaaaaauaauaauuuagcagauacauauuaucugaaacauccauauacuaucauuucaugcaaaacaauuuaaaucugaaauauuuacuauuggcuacauuaaaauauuccuaaagagcugugggugaaucugauuaaauuguuggaagcauucgaccuguguguucaccaguuuugaguuguuucaucuggggucuaugugggaagauaaauucaggccuuugaaaguuuucaccuggcaaagucagcgcuaugauguaauuacucauuauuuuaugaccauuuaaaaaucucuuaacaggagaaagaugucgaagauuuuaucacaacauccuuugauucucaagaaacauuaaguucaccuccuccuggauuagaaggaaaagcugauagaagugagaaaagugaguugguuaucuuucauuuuuaauuuuuuauuucagugguuuccuagcacagaauagucaaaagaauuccugcauccuuugccugguucugcgucugccccccgcugaccuccaccccggcucugcgcuuugucgggcgugcaccuggggccucuugacuucugaaaacacgccuguaccuuucacagagccaagguugcuggcccgggccacgcuccacccuggaauguucacccugauccaaggcuggcaucucagcuacagcuacagaccuugcucagauucacccauugucccaguaguguccuuuauggaaaagacaccccagcucacaggcuguguucaggugucuuuggcaggauggagacuggggcggugcacgccauguuuccaggcucugcugccuugccugcccacccugccuuucccuccccuugggguggacgucccucucucugcuguggguuucggggcaccggcccuggagaggagccgaggggccgcugacuguggcguguccucgcgauggugcguggggggcugcgucuccccggaccucguggcgggaggugcgugggcuugacuugggccuuugucugugauggugccugccagguuuccuccaccuccuucugugggagaugcggagacugaguauucucuucccucucaugcucacgcccacuggucucagccucccuugguugcccuggcccgcaucaguuguuguggcgguuaccugccacaccguccuuuuuuucauuucauaacuuuuucuauaauuguugucuuuuuacaagucagucaccuuuugaggugcucuaacuuuuuaaaaaaucuguuggauuuuucagcgauuuaguguuuuuugagaacauggucacaauuuaauuagaaauuuuaguauuugcagaguagggccagcagcuuuuuaauuuuguuuuuauuuauuugaugaauagugagcacgcagggugacaguuaugggugcugaggggaccguuuccugagcagccugugucccagcuccccacucaggacugcagcucccuggggaugccacauucaacucucagaaaugucuucucguauuugcuuuauuuucaaacucuauuugcuguuuaaaguggcaucuucagcccuccuagccccucgccacacgccccuugcuacacgaggugcagucugcacgcccugugcugucacagccaagguuugcccuuaaaggacgcgccccguguuccagcagagccgcugggagcgugcgucccccucgagccacuuuuguuuuucuuggcucaguuucuccugugugcuucacugcuguccucgcacacaguguccaggugaaugucauccaagccuuccaagcacagcaggugcuuccccaacaacucucaggggcucccaggcggccccuugccccuccucaacggucucuuauuuaccgagacagggucuugcucucucacgcaggcuggagugcaguggcguagucucgacucacugcagccuccaccucccguacucaagucauccucccaccuuagccucccaaagugcugggauuacaggcaugagccacugcgccuggccagcccccucuuuuuuaaggaaacauguccccagaagccucuguagaaaaggugucugguaggugcuuguuuuugagaacuuccucgucucccuggugguugucgguugguuggcugggugcagacacuuggguuggaagguaucgcgugccuguccacugccucugugcccgcgcccuccagugacgcacaaccuuugaggggccugcgcggucaggguguccgccgccucugugccugcgcccuccagugacacgcgaccuuggaggccugcgcggucgggguggaggauuuccuccucguucguccuuccuccauucacguauccuaugauuuucucucuucuuuuuguaauuccuguuauucaacuauaucaggccuccaagauugauugucaaauuuucuuuccuuauuucuacuucuuuuauuuuuguucucauuucuaagagguuuucuuuagaacuuuauuuuucaacauuugugcugaguguucuguuucugugcucauauuuuaaauuucucagaaaucuuucuuauccuaacuguuccucucuccuuuagcuuuagcuccuugguuucuuucuuuuuuggagggcguucuugaguuuauuuugggcacagccaggugagaggucccugcaccugaaggaagguguugggcuccgaggugaagcaugguuugugcugaaggcacaggguccagugggacaauggggaauguggucuuggacuuguggagcucugaccacccgcuggcggcaccugcuggcugugaucuccucuggauggagugggcuggggcauggugcugggcacccaugucucgguggcacugggugacaguguccgcagcagucacaucccagaguuccugguacacgcugugggagccgcagcucaggcagaugcaacauccuucacccucagagauuucucaaacaccugaaguagaugauuuccccaaagauuucuucguugucaucuuuagcugagauacacagggcagaaguaggacuuggcaccauuauuagacacaaagauuugcaggcgguggguggccugaggcauuuugagggguacaggcagcaacccagcacccugcacccuugcacugcuccugaggccuucaugcugcucucucggcacuugccgccacucacaaaaagcacuuuguugguucauuuugugaaugacgugcccguuauuucucugagggggucaucgucauccucugagguuguacucugccugcaucguuggccucuacuccuccccagugugcccucugcucagcaggcugugccggggcaucaucccccaggugcccaagugcugcagccuccgcuccccagggagcuuuguccacacgggggccccgucucgcuggcauccucauccuccuguuuugaagucuaacacccuuuuuccagggcgccuccuccucgucugggucucgugucccuuacacgauccugccucaguuuccaaagcgccccccucccugugggcuggcgcagcugcaggucucugggauggaccagggcccugggagguuuugaauuuuccuccuugagaccccaugcccaccugacacaggagcugcaccgcagggaccccauggcaggcacggucagcguuuccugagcagucauuggaugcccguccgcugccugccuuaucuccguggcuggcguggagggugcaggccccgcacgucccgcugcucuugagcuugcccaggccaucuggguuuuguggagucuuugggggccacgucuggagaagugagcagagguccccuaagauuggcgcuggaaucagggacucaggugauguucucaaccugugaaguugcguuuucuuacuugacgugcgucuuucucaccaggguuauguuuuuaugaagcauuuuuggggccaucaguguuuucuccgugagcagaaucacggugugguugucgcuggggacugcgggccgaucaccccuguccugccucugcagugcguccccuggggaacccccuggagagcugugggugggacccugacccugugguguuuuuaggugacggcucggguuuuggagcaagacugagcccggggucaggaggcccugaggcucaaacugcugguccugugaccccugcuuccaucucuggaagguuucagccgcugccggaagccaugaaggagaaggaagugcguccgaagcacgugaagguauggcuggcaggggcggcccucacagcuucacaugugcagccucggggcaucccccaagcccuguguccugccuugccggggagagccuuggagggccagcuuuuccugggugccucugagcaccugcauuuuaaugacucacgggaggcagccccacgguggccccggaagccgcccacccagcccugcacuggccccuuagguggccgccucccaucugggcagggaggguccugugagcccgugggcaggugguguugccccgagucgcagagccggccugugccucucucccgccugugccucccuccugccugugcccuguagagaagccgaggcaccagacgccgcagugcucuaggacugagccgaguucucuucagacgaugggagagaagccacucagccuccuuggaaucaaccuugaaggcagaauuuuguggaacuuuucauagguuuucuuuccucucccaguuuagcagaucauuuuauggcaaaaccauugacaaaaacuuggcuaaacaagugagugauagaaugaugccacuacaggagcuuagucaagugguaaacauauucccaaacaaaacagucuucacaucagugaaaccucuucugagacugcgcaguaaguccucacuuagcguugccccgagguuccuggaaacugaccuuguaggaaggacacuccugugcugcuggccgcagcucccguugucucagagggcccugagggugccuuuguuacaugcguuuaaaagucgcgguuuccaaaacccauccaugacguuaagugaggacuuacugcauucagaauaaaacuuguuuuacuuuauuuggcugggcacgguggcucaugccuaugaucccagcacuucgggaggcugagacaggaggaucguuggagcccaggaguucaagaccagccugggcaacauaguaagaccccucucugucagaacugagucaguuaaaccucuuuuuuucauuaaaauaaaaaaacuuauuuuacuuucuuaaacauggaaauuggagauuuuuuuuuuaaucaguuuuuuauaucuucuuugcauuuccuuuuuuuuuuuuuggugagacagagucucacucugucacccagcagugcagucacagcucacugcaaccucugccuccugggcucaaacgauccucccaccucagccucccaagcagcuuggauuacaggcgugagccaccacacccagcuaauuuuuguauuuucuguaaagauggaguguugccauguuacccaggcuggucuugagcuccugagcucaaguaaucugcccaccucagccucccaaggugcugggauuacagugugagccacagcgccuggccucaaauuuuuauacaauauaaaacgucaaggagauguuucuguuaguguuuccuauggaaaacaaccuaauauuagaauuccugauuuuuaaggaauaaauuugauuaauguuaacucuucauacuuagguuucauaauuuaaaaagaaaagcacaaaaggcaggaaaggccuccuguagcccuugaggcagcagcugcgaagcagaggaggagggggagaggaggaggaagagaaggggagggggaggggaagaggggaggaggaggaagagaagggagggggaugaggagggggaggggaggaggaagagaagggggagugggaggggaggagggggagggggaggggagaggggaggaggaggaagaggaggaacugcuguccagggagcaccuccagcuuugaaaggucccaaguccaguugaaaaucacaaggaguuuuuuucauggaugucucagacuguuucaaacucaggguuuuccuuuauugucuuaauuucuggccuguguuuuagaguguggagcccugggguugugcccacacugacgccgcaguggggaacugaguggagcugggugcuugccccacuuggagguggcuccaggcgcgugggggacacccacugcucagaugcagccacagacgccaagaguguggucgacgcucuaauagccccuguggucccuaugcugaggaggcugagagguccugagcacggguggggccccggccacucuuggccaccucuggccgugccuggaauugagccauaagugggcaggguaggugcuggagcucaggaaaugaggacuccccugccuccgccgcugccaccaccaccacugcugacaggcagagccgccugguccugaguguggagauggcagaaccuucucagcccuagugauugugucugugggaccccccaggcugccucacaggccauguucuaagguacccacuggucucugccccacuucccggccucacgggaacccaccugcaagggccccgugucaccuggcgggaagcuguggcccagggccucugcaucucuucuuuguaagagauguuuuuuaaaaugcauuuucuccucuauacagaaucuagaaaagcauauuaaaaagaaggaaauggccuguccucugcagcuggaagagaggggccaagcagcuucagggccugcccgccgcccugcucccccggcccugcucccacugcgccccccccaacccugcucccccagccacggccuugcuccccccgucuccgcuccuccccgcaccaccccgcuccccucaaccccacccugcucugccgcagaccucaguuugcauccauccugugccacauacguuauguuuaaaguaaaaguguuuucaguuguuagagaugaacauagugugcaauuugguuucacacuuuaguguuaauauuugaccuuuuuuggcauaucguuaaaauuacaggaaagccuauuuucagucagucacacccgucguaggcuucaucauugccucauuuugcauuucccucuuuuuggacuuuauuagauuauuuuucucuucagguuuuuaugcagacguguccugugcuugggugugugcucaugugguggugaccgcgcugagccucugggcucugggcucuaggcuggucgugacaccagcuucuccauagggccgucugcuuaccccucagccucucuggcgagacagucaaguguguguccggacaccagcugcugcguaaucggugggauaaagcagccgccucguguucacagaccugugggcagggccugcuggggaugguuuucucugcuccccgugcccagcacaggcagcuucaccccacgcugguggucggcacuggccucagccggaccacgcacagaggccuccuggguggccaucguguggccuucucguagcgucccaggugggcagggagugugugauauguuugugaucucgcuguggacauuggccuaaagcccugcccugagcuuuguccaggcuuaggcgggggacggugucccccucagggagcagguggaguggaggaaguggcggggccaucuuuggaguggcuuauagagaaauucacuccaagccuggcuuccguguugucucucugaaggucgggagaggugggcuugaaaaccuuguagcuugagaagugggugccgccuguacgaagccgaggcggugcccucccucuccacagcugcccgcccuucacagaguccuggcggcagcucggggccgcaggugguguagagcguggcugugugggguggcaggcaacucccuucugacgcgcuuucccgccacaggcuuuacugcagauggugcgugacgagagccaccagauccuggcgcugucagaaggccuugcacccccaagcggcgagccacacccaccccggaaggaagacgagauacaggacaucucgcuccaugggggaaagacgcagguuuauuuugcccuucacacacuucuuuuccaaaggauuuaaggagcuugugguaauggccgcguccuuagggccacguggacacuaggauuucuuucuuuuuuuuuuuuuuuuuuuuuuuuuuugagacucggcucacugcaaccuccaccaccccgggucaagcaguucucugccucagccucccgaguagcugggauuacaggugcaugccaccaugcccagcuaauuuuuguauuuuuaguagagacgggcuuucaccaucuuagcuaggcuggucuugaacuccagaccuugugauccacccgccucagccucccaaagugcugggauuacaggcaugagccaccgugccuggccuaggauuuuuuuuagcacggccaaaaagacugagguccaagaacccuggggaggccuucccaucucccacagccagcgcaggcucucggggcagguucccugcgggacguggagguguguggggggcagaagggcucagggcuuucaggccugugcccugugugagccugcggggaggcugagaguggucccuccuggccauguggcccugcggacucggcccauuccagcacuugucccccagggccucuccuccugccacucgggugacuugcccuccggccucauuccuccccuugggucucuccuaccucccccuccacaccccaagccccagcaacuggaccucagggccucaccucugugcugucgaccccgcaccccacuuuuccccaaguccuccccaucucccugccugucugcuuccaucaccagggcuuguggagguuguggagugggugccaacucccaucacgcucccucccaucuccgugcccacccuguccugccccugugccugccucugacugggaucaaagcuuugugagggagggaagggcuuucucccugugccuggaacgcacagggugugcuggugccauggagagccggugggagggucagccccacccgccuccgcucgccccuccagcaggcccugguugugugcgagcggcagccuggcuggcauucaggaggcucauuggugcugcacgcugccccuggggaccagcggguagccccuugcagccuuagguccccuccaggcccugggccuugaaggcacagcagcaggaaaagagggaaggagcuuugcugacauuuuccugaccuuacuuuaucgucuuuuucagucucuucugugcucaugauggcagccuuugcuucucgugccuugaauggcccugggcagugugugucuucucuucugucagggucauuucuguuugaacggcugucagucugcucagcugccguaacagaacaccccagaccagggggcuuaaacagcagacauugauuucaccuguuguggcaucagggugcccacaggguuggauucugguguaggcgcccuuccugguuugcggacagcgucuccgugcuguguccucauaugauggagacagcgagugagcucuggugucucuuccucuucuuaagaggccucauuuacccugaaucaccucccgcaggccccaucuccaaacgcagucacacugcgaacuuuagggcacaaggaugcaggugcauuugugaggacgccacguuucuuccuucuuccuuuaggaagugcccaccgcgugccccgauuggagaggggaccuucugcagguugugcaagaggccuuugaaaaagagcaggagaugcaggggguugagcugcagccccgacucaguggcucagaucuggggggucacagcucccugcucgaaaggcuggagaagaucauccgugagcaggugagugucagcucugccaccaggccucaguuugccccagggguccagcccuggcagagagggugacacagacuguuuugugugugaauuucgguuuguguguuucucucgaccgcuggaauguggcugucacuuacccagguguugacgcucaguccaugcaggaugcugcacuuuuccaccugcagcuguaacaggacaggugugcucgagaugcacccucaggccucacucuuuucugagauagguggcuaaagaaacguucuccauuccaaguagccccuccuagguugagaggugcucugugugcagggcuggguggcguuggugccguggggacacuggaaauccuguuccugccagcauacacgaggaaaccuaguguugagaguaacuggcuugcaggccucacgcaggguagugcagcccagcccugacgccugcaggccccagagcugaggcccagcagauacugugcacccaucccagacucagcaggcuugucccggcggagcugguuuugagggcgggcagcagggaaggccggggcaugggguggcugcccaaugcucaggcugcuugucccauugugcccccagggagaccugcaggaaaagucccuggagcaucuucgcuugccggaccggagcagccugcuguccgagauccaggcgcugcgugcccagcugcgcaugacgcaccugcagaaccaggagaagcugcagcacuugcgcacggcgcugacaagcgcagaggcgcgcgggagccagcaggagcaccagcugcgcaggcagggugggugucacugucuacacugccuggggcccggccucugcaccugcccgcccgacacucaccuguguggccuugggagcagaggguggugacagggcaucaucuagucaagccccugaguguugccaugguugucagcugauaggacugagcagaaaggacccuggagacaggcagcgcuggguggggcuggcacggaggccucacucuugggccugaugugggcaagaggggccuggguugggcucugagugcuggcagauucuugggagcucaugcuagaguucaggaaugucucguagguuucuacauuuaauuuagcuucuucgggaguuuuuauguagaugcucaggucaucuguggguaaguaacgauuuuuuguuucuugcccguguucucucacgugcugugccgucagcugugugggcagaugccauucccugcucuuaguuuugggggcaggagcuggucucguaccaucgcauguggggucaggcgcccuuggucagcuugggcaagugcccucuguuccuaguuuuggauuccgucaaggggaacggccuugcaguucagcccacggcccuugucccggcgcccaugcccuuugugcucucuggggcugggggccggcgcugugcacaugcucgugaggggcauggguggggcuggcgcugugcaagcgcuugucaggggcaugggcggggggugccggcgcugugcgagcgcucgugagaggcaugggggggcuggcgcugugcacgugcucgugaggggcacgggcagggggugccggcgcugugcgagcgcucgugaggggcaugggggggcuggcgcugugcacgugcucgugaggggcacaggggggccggcacugugcgaucgcucgugaggggcauggggguggugggccggugcugucugagugcucgugaggggcacuggucuguuuucuguugugccuuuuuggucuuggugcuggguagcgccagccccacggggugcgggaaguauuugggaaguagccccuccgcccuccguugucuagaauugggguuauuucuuccuuaaguuuugggagaauuuuccaguaaagccaccugggccuggaguucccucuguuggaggcaguuuagggugugagugggggugagguggcauuuuuaggauggccccagggcuauaucacuccuggacucugugucucccggccaggugggugggcccuggaaggaaaugggcccagagggcagaauugagcauccugguuccacccgcagugaaagcuucuaguccacagaaccuccuuucuucccgaagcacauacaccucacgcccccacgagucugucucuaaccuggugucacuugugcagcacgaggagcucaugggggccuguuacuguucuuuugucuuucucaguugaacugcuggcuuauaaaguagagcaggagaagugcauugcuggugacuugcagaagacgcugagugaagagcaagagaaggcaaacagcgugcagaagcuccuggcggcggagcagacuguagugcgagauuugaaguccgaccucugugagagcaggcagaagagcgaacagcugucccggucccucugcgaggugcagcaggagguccuccagcugaggugcgccugaucccccuuccugggacacuggcgggaguccccccguugugccauguuuucuuggugaugaagggagacagaaccucuggugggccgcaguugggcagccccaggggcaccgcgcccugcugucccuggguugauaauccugugguggggggugaagcacacgugugggaccuggcagggcucugccuccccuccuggagcucccagcccccgggaacacacucuggcccacguggucagauuguucugcgaugucuccacgcagauccaugcugagcaguaaggagaacgagcugaaggccgcgcuucaggagcuggagagugagcaggggaaggggcgugcccugcagagccagcuggaggaggagcagcugcggcaccugcagagggagagccagagugccaaggcccuggagguaacagggugucagggcaaggcagccggcaugggcugugugcacuggaagccugaagccaugcuccucuuucauccuucuuuuccuguucuucauggcagugcacccaguugacagcagugugacguagcaggauagggcuguguuugcagguaaaauugcaccuugguguaguggcagccaccacagggcgaagagugcgaugacccgugguggcacgauaccccugcucggagcccccccccgucccugagcacuugcuguggagauggacacagccuccucgcuggcauccagacagagcacagccucagaggucugugcacaaggcaggcuggugguggggccucugcuuugcauggcggaggcccagcaggccugcuguggcuucugagcaagucugugccaguuccauggguuauggcuuucaacagcauggaaguggugguuccuagcaagcuggguguguaucucugagccucugguggagugauuuucugaagagggggcaggagccucugguggagugauuuucugaagagggggcaggagccucugguggagugauuuucuggagagggggcgggcaggggacaucucugaaucauuuucuggagagggacagacugggaacaucucugaacccaggacucaacaccauuuccgaaaaaaguaugucaucuccgcagucuggguuuuuuguuacuugaugaacuaacaaaaaaauguugucccuacauguggcuaauagggugcauuucaaaagguagaauugcugggcuaaaguauauaaacaaauguggacaggaaaaccauguagacacuuuuccucuugauucagugucucccaucguauguguuugcugucuaggagcugcgggcgucuuuggagacacagcgugcucagagcagucgacucugcguggcacugaaacacgagcagacggccaaggacaaccugcagaaggagcugcguaucgagcacucacgcugcgaggccuugcuggcucaggagcggagccagcucucugagcuccagaaggaccuugcggcugagaagagccgcacccuggagcugucagaggccuugcggcacgagcggcuccugaccgagcagcugagccagaggacacaggaggcuugcgugcaccaggacacacaggcccaucacgcucugcugcagaagcugaaggaggagaagucccgggugguggacuugcaagcgaugcuugaaaaggugcagcagcaagcccugcauucucagcagcagcuugaggcugaggcucagaagcacugugaggcgcucaggagagagaaggagguaagugccacacugaagucgacgguggaagcccugcacacccaaaaacgagagcugagaugcucucuggagagagagagggagaaaccagcgugguugcaggcagaauuagagcagucacacccacgguugaaagagcaagaaggacgcaaggcugcgaggaggagcgcggaggccaggcagagcccagcggcugcggagcaguggaggaaguggcagagagacaaggagaagcuggugagagccgccugccggcggacguccacaccuaaaaacgauaagcaauuggaguuaggaugguucacgugggggacgcgagauuuaugucuggcccucugaccuggucugcucuggucugugugcccugacgcuggcaccacacugcuguuacuguagcuuucuagaaaguauugaaaucaggaagugugaguucuccaacuucguucuuccucuucaagauaguuucagcucuguggggcuucuugcuauuccacaggaauuugaggauugguguuuguauuucugcagaaccugccacugggauuuucuuagggauggcauuaaaugugcugauugcucuggguaguauugacaucuggacagugugaggucuuuugauccacgauuacagaaugugucucuucauuuaauuaggauuuuuuugagauagggucuggcucugucacccaggcuggagugcagugaugugaucucagcucacugcagucgccgccuccuggguucaagcaauucuucugccucagccucccacguagcugggacugcaggcacaugccaccacgccuggcuaauuuuuggauuaguagagacaggguuuuccauguuggccaggcuggucucaaacuucugaccucaggugauccgcccgccugggccucucagacugcugggauuacaggcgucagccaccacacucggcuguuuacuuaggccuucuuuaguuucuuucaguaguguuucauugcuuucaaaauauaaguuuuauacuuuuguuaaauuuauuuacuuauuuauuuuuugagauggagucucauuccgucacucaggcuggagugcaguggcacgaacucaacaauguugaauagaagggaugagagcaggccgggcacgguggccgaugccuguaaucccagcacuuugggaggccaaggcaggcagaucauuugaggucaggaguucaagaccagccuggccaacaaggcgaaagcccauuucuacuaaaaauacaaaaaauuagccgggcaugguagugugcaccuguaaucccagcuauucgggaggcuggggcaggagaauugcuugaacccgcaaggcggagguugcagugagccgggauugcaccgcugcacuucagccugggcaacaagagcgagacuccaucucaaaaaaacaaaaacacucuuuggaauagucguaguuuuuuuuaucuccagaagccuuggagaguagggaggugguuuggugguacagacaguguggccaagcauggcaggggcgucuacacaggaccccagcugagggugagacgugguguguguguuugccuuucuccugggcaagagcucauccuuugauggaaugcucaaaggagucuuuacuuuuugagaacuuccugaaaccacgccugaaguugccagccaaaaccuuuaauuuugauuguuucuuaaaaaaaauaguaacaugagugcuuagaaaauauuuucuaaguugcuugcuucaggaugcaucuugaccuguauuuugagugagguggcccuuccagagugauuuauuuauuaauuuuuuuuuugagguagagucucgcucugucuuccaagcuggagugcaauggcacgaucuuggcucacugcaaccuccaccucccggguucaagugauucuccugccucagccuccugaguagcugggauuacaggugcaugucaccacgcccagcccagcuaauuuuuguauuuuuaguagagacgggguuuuaccacauuggucaggcuggucuugaacuccugaccuugugauugauccgcccaccuuggccucccaaagugcuggauuacaggcgugagccacugugcccggccuccagaguguuuuuuacugaggauagugaauuugaucuggauuauagaacccuucucuagcuguagccauggaagccucccaagauaguggcaugcuggauacaauuccaucuuuucuaaauaauacaaucucauuaguuccucuguaucuuacuuuccuuacuagaaaauagaaaagauacucauuccuguuuaagaggcccgagcauugagugaggcgcugucaggaggguagagucugagcugcacccuggucaccgcaguggcaggggcgcuggugccacacagugcaggcucagcuguggguccucugggcugggaaggccucagcucagugcugggguucccucccugacacggcaagccgccucugugugucugcaucuugggccucuucccgcuggaucugucuuuguguugucacaaggaagccccagcggcgcugcugggaaucagaggcccuucagaggcugcuucguccuuccuugccccaucgugcaguagaccuucuguccccugccuggugggagucgggcccugggcaggggcucaggcgcuugcugacacgcuucucccgggcaccagacauggccugugcccccguccugcagaaggaaaggcugcugcuccuugaggucuggcuuaggagcucaggcccacguggccacccaggcucagccccagggcugcacucaggcucauacgugugugcauguucacaugcacaaaugugccugucugugucuauguugguaugagcgucugggcgugugcguguacauauguggaugagugggaccagggcacagggaagcgucauccggucuguucuguuucagcuucucaggcuccucuccuuuggaccccgcgugcuugcccugggccugaugaaagccugauaguuuuaaaaacuacgauggaaacgcuuuuaccacugaaucauucuggggugugugauucagcugccuccaugcuggagggacacagagcagcacagcacgagggugugcagugugucagcugugggucccaguacaggaccacaggggcugccugcccgagggccuguuucuggucugugaggggccuccccuguaacgcggcuguguguuuugggcuuuugcuuggcaguuguuguuuuuuuuguuuugguuugguuuuuuuugguagauggagucucacucugucgccaggcuggagugcaguggcgcaaucucagcucacuguaaccucuaccuucuagguucaagugauucuccugccucagccucccgaguagcugggauuacaggugcgcaccaccacgcccagcuaauuuuuauauuuuuaguagagacgggguuuccucauguuggccagacuggucucgaacuccugaccucaggugauccgcuugcugcagucucccaaagugcugggauuacaggcgugagccaccacacccugcuggcaguuuuguguuuuguuuuguuuuguuuuguuugagauggagucucacucuguuguccaggcugaagugcaguggcgcaaucucggcucacugcaagcucugccucccggguucacgccauucuccugccucauccucucgaguagcugggacuacaggcgcccgccaccacgcccggcuaauuuuuuguauuuuuaguagaggugggguuucacuguguuggccagcauggucucaaucuccugaccucaugaucugcccgccucggccucccaaagugcuaggauuacaggcaugaaccaccgcgcccggccggcaguuuuguuuuuggacacugacgugaacgucuucucugucuuuuuucuguuaacaacagcgagaauuagaacugcagcgucagcgugacuugcauaagaucaagcagcuucagcagacagugagagaccuggagucgaaggacgaggugccuggcagccgccuccaccuagguucugcccgcagggcugccggcucggaugcggaccaccuccgggaacagcagcgagagcuggaggcgaugaggcagcggcugcucucugccgcccggcuucucaccagcuucaccagccaggccguggacaggugugcacccacgccaccuggcgcucacuggucccuugcagccaccccucugucccagacccggcccgagggcuggggcgcgucuggugugaggccccugcuccuuugcacuuaacgcucuaguccucuuucugagacuuugcugagggauuccggauuggcaagauggcauguucauauucuaaugucagagaaaaaaauccugugauucaaaauacgccugacguggggcuuccauguuccuuugaggguuggcuugguucucuuuacacucuguguaguugcucaccacccacagggucggguuuggagccuccuguggccccccccccccccccccgcuggcacugcccagugucacucaaggccacucacacccaggaugacgaucgugauauuucauaugggcagaaaggguaaugcuaauguuugucuuuuucccuauacacagaaacucggcaaacacaguucuccuuucuauacuuggacuuaauguauagagcagcaugauuucuaagcaaaguuucacuuaggacagcauuuuaaaucauucauuccagaggaaagccacggggccuggcaggcgguggcuucccgugcucgguggcgcgccucccggcuggagguuucugagcucugcagaagcguccagccacaggccuguugcccccgugggccccuggcucugccucacggcuggacgaagugauucacacacaggcuccucagaaaccugucuugucucucuugagccgugagcucuuguuuaguuuugcauaauggucacuuggggcgcguaugcaacuuugagugcccauuuauuuuuacaggacaguuaaugauuggacgucauccaaugagaaagcagugaugucuuuacugcacacguuggaggagcugaagucugacuugagcaggcccaccuccucccagguaaggggugagcgcccccaggucccuggccuggcuccucccccagaggggcccucucggcagcuuugugguucuuuuucacgcuuccccauuguucuuccucccucgcugccuucucugaauucaugguugcuaucugggugaguggguggggucgacccugugggccgaguggggacggauguccuccauguccuggggcacuuguguggucuucgggggcugagcccugcugccaugggaugcugugugacuguguggucuucgggggcugagcccugcugccaugggaugcugcgugacugguagagcccccucacaugcugcucgcugugcaugaccuggacacauugcaggucgcuggucaggaggggcuaugguucugcucuggugcuggcggccgauguucaccuccaccuggcccagccugcuggcuuuguguuugcguugacggccuuugcuagaaacaaaaacccaaguccuccuuggaaagucugagcucacuguaagcugccucugaaggaggugggaaucuggcugcugguauaaauucuugauguguguucuguggcauuuaugaaaucaugacuuugaucguggagcccacgcaugugaggugcaggggagcugcgccgcuuacccucuggccccgccagcugaacgucguuguggguggggugcacccugcccccuguguugggcccuggugaccuuucagcgugcccacccuccacaggcugaacguccuuuugaugguggaaguaauaaaccuguuuugaggggcuucacauccgcccccuugggaugaacuaacaacgguccagccaccuguuaauuucagugcuguuagaacaaccaaacgggcuaugcuuugugacaggccugcguuguucauacaagccaguugcgugcaaagucugugauucaaugacuuuuacaauuuucugccagcuccacaagcuucucauugaaccccagacacauuaauuacaaucccuaaaaauaacuguugacaaaaaacacaaguaauguucaugcccuuuaacaacaaauucuuacaaauuuauuuucuuuucuccaagaaaaaaauggcagcagagcugcaguuccaguuuguggacguccugcugaaagacaauguuucccucacaaaagcgcucagcacggugacccaggagaagcuggagcugagcagagccgugucuaagcuugagaaguugcugaagcaccaucugcagaagggcugcagcccaagcguaggugucugugcuuaacucuuaccugccucagccuaacccaccaugguccagagcagcuccaccccacaagaggccgggcucccuuuagggaccuggggaugugggcgucaccuucucccuaaccgccaggcucuguugccucugucugaagccuugcuaaauguugugggauguuugaacaucucagccgacuuccagcuccgccacagacggcguccucacugacccugaccgcuacuugauguuuggugcauguucauaaaaggguauuuugacuaagaauauuauaaucugaucuaauuuagaguuuuaguuaaagugauuuauaauuuuuuuuuuuuuuuuuuuuugagaccgagucuugcucuguugcccaggcuagagugcaguggugcgaucucagcucacugcaaccuccaccucccagguucaagcaauucuccugugucagccucccaaguagcugagauuacaagugcccgccaccacacauggcuaauuuuuauauuuuuaguagagaugggguuuugccauguuggccaggcuggucucaaaauccugacgugauuccgcccaccucagccucccaaagugcugggauuacagacaugagccaccgugcccggccuaaagugacuuauaauuuucauaaugguauaguuggauagaguuaucuuccggaaugucucauuuuuuuuucuuuuguauuuaggcuauuuuguuugugauuugcuuuauuuuuuauaacuuuuuaaaaauuauuuuuaaauuuacauacaguaaaauuugcccuuuccugguguagugucauacaaguucacacacacacacaucccuguaaccuucauaaguaaccaccauucacagagcacacagcgauggcccccccaaaaagagcagcaggcaucuccgccugccacaggcccuggcucucucccagaaaggugugucaguggaaccagcccgucugggaccuccuaaacuggcuuuuuucacuuuuuggguuuuuuuucugagacagggccuugcugcaucucccaggcuggagugcaguggagcagucacagcucacuucagccuugaccucccagguucagggauccuccugccucagccuccugaccugcaguggugucagcagcaaccugugcacguccucccguacacucuuaagucaucucuaagaucacuugcagcaccucauucaguguaaaugccacguaaauaguugucauccuguauuguuuaggguguaggggcaagaaaagaagcacacguuugguacagacacaucguuuuuucugaauauuuuucacccacaguugguugaauccauggauguggaacccacagcugucgagaguugacugugcuuguaguuaccagugguuggcauuucuaggaccggagaauaugagaguguuuaaggcuuaaagcuuugaauuuggggugauuuuacaaagaauugguuuucuguuucuguuaaaauguaccuuuuuugcaaucauacuucagcaaguggcaugucguaauuacuccauguuaauucuuuggcugaucacagcacggcguaaccuaggcccugcugagggggugcugaaguugaggaggggccaggugugguguggucagccuggccuccccgcacauggccuucucccucaccugcccccggcugcgucucuaagaugcucuuguugacgagcagcucuguagacagcgcuggcugugcuuccuuacagaggucggaaaggucugcuuggaagccagacgaaacggcuccacagaguucccugaggcgcccagaccccggccggcuuccaccagcugccagcgaggaagcacacaccagcaaugucaagguaggaacggugccacgaguauagaacuuuggugcuuuuuuaaguccuggguuugcaaauugcaggcaaagcauuuuugugaccacaagguucucgucugccggguguagcagucacaucacuaaaggaaaggacguucacagaauaaacuucggcuugaauuuuguuuuaauugugcacaaauacugaguuucugugcuuguuaagcguggaacguggaaggcuuugacaaagucagcaaauggcggccucugcagccugagggaggccuggcccaggggcuugccgggauucggcccaagaucugcugcagucuccugauggcacacgguccccaccccgugacguccaucucaugcccaguuuggaccuuaccuaaggggugaaaugcaagaagcuucauaggggcucauuugaugaugcuguggagaggagcuugugguccuagaucuugucugacaaacacaaauugaucuuccaacagcaagguuguuucuggccacagauacuguuggaaggccgauggcucugugaugauuugaugggaaaaaacaaucugacucuuuggaaagagcaaugguguuaaugugcuuuugucagcaagacagucuuuguuuccuaugauaaaauuuuacugcuuuuuuucuuuuagauggaaaaauuguaccugcauuacuugagagcagagagcuuuagaaaagcucugauuuaucaaaagaaguaucuuuugcuguugauugguggauuccaggauucugaacaagaaacacucuccaugauugcccauuuggggguauuuccuuccaaagcagaacggaaaaucacaucucguccuuucaccagguuccgcacggccgucaggguggucauugcaauauuaagguaaaugccaugacguucagucagugcguuccgcgucugucuccgugagugggcagcacacugcaugguuuuuuggucauuuuauuccuugaaacuccauaauauguucuuuuuaaagaugaauggcauuugaggccuuagagaaaauacagaugaugaacuugucuucaagaagucauguguaugaaucucucaccuucuaaaacuaaagauuuaagggcaccuuuguauuacagaggaacaucuugacuuuuaauggguuucgugccacaaagaacgugcugaauuucuaaaacuguuuuucccccuaaacacugugcggcugugccugcucccugaugccacagagguguuucccaaggccacgcgcgggccugucuggaguagcagaugcagcagagagcagcuaggaaucccgcuccuuucagagaccaggugccgagccaguucagucaucgcggcugcaggcugggccaaaguggggugcaggcgaggccuccuggguugcuguacucucagcuucucugguccuggggcacuuugucuccucgucucugagcuccccugaccguaggccuccaccguccauccuuccacccacccaucuguccauccuguguucauggggagaacacccugcaggaggaagcauuuuaggcacuagauaggggagguaagcagacccagauccuaccuccugucgaggaggggagaucuuuugaaggcaguggugucccagaaaggagcagucucugugucccugugagggcacugccuaggguagcugccaccaaggggccuugacaggucuuauggaggaaucggcagugucugcuaugccucaaaggagggaagccacaggcaugaugcuuguuccgaaggccauccuagcagggcgucuggggcccugcacacugaccugcaugcccucgucaccugcacucugcaugcucaccaucugacggacuccugcgagggcuggggucuccguguucugagccuguccaguggcaucugugacaggaugaagaugggaggguccugcacaccaggcgggagcggcauguguuuccuagucacugguguggccggcugacuuugaacuggagucguccugagcugggccauggugggugucuaggggaccauaugguccacgguggggccgcagugaggcuuugucaggugguugggcaugggaaggucgccgccgccggcagcccugcgagcacuuuggaugugugcacccggcaugccaggcccgagucaacagacuggccgaccuuggcguccugguccccaugggcagcgaggcccccauucugcuuguuuggucacagugggguuuucauugcucuuucccuuccugucuugccguacuuuuaagugugucuugucucuuuuuuuuguagauuacguuuuuugguuaagaaauggcaagaaguagaucggaaaggagcucuggcacaaggcaaagccccucgcccaggugggacuccagcugcuguugaccgcuggacucacaaaccuuucuuucuacucuuguuuuucauucacuuugggucauuuuucaguguugauggggacguaauaaagcacgguaagaaaauccgugaauuccgucagagcagucguccagagggaaggcgcgcccggcguagggaggucagagcucauguuagcuaugaacacaggucacaggggcguacggcgaugggaaacacugagaugcucaauauauugauuauuuaauaguguuuagcaaaauggucuuuuuuuauuccuuaaaucaacugaaacucacuucacgucucuuuccuuguagagcaucaugcuuauuucuggcucacucacaucuuugucucgggaguucucugccgagccauugcccccuacagcagagagcacagcuggcugcacuagugcugaaggagccagccccagagcagggcauuuccaggggcucuugucccagagcggcaggcguugugugcagagaacgccccucccacgcagcacagagaacgcgggguggguguguggcuccgggccuguggggcuuaggcugccugaaccaccgccgacuggcaccaugacucggcauuccuggaagugccuuaccaaguuguuguuguuguuuuguuguuuuuuaagagacgggcuugcucuaucauccaggcucgagugcaauggcacagucacagcucacugcagccuugaacucgugggcucaagccauccuccugugucagccuccccaguaccugggacugugggcaugagcacugcgccuggcagcuguaucaguguugacuccacauuuuaauaguugcuucuugaaauuaaaaugcuuugauucagccuucaagccaucaggaaaguuugccccucugagucacaccugguggucuccaggguuccugccccucccuccugagccagcuccucagagcggauagaggcaggacccccacccaggucuugagaccccccugccccgcacucccccggagacgggcuaccccugcagaugcagauagucaaagcucagguuucuuccaaagcuuuuaaaaagauauuguaccuugagcacuuuaaaaaugucuuaaaauugccauacaggcucuuaaaagcuuauacguuuaaacuguugauagaugggccuuuacuaaaaugcauucauuuauuuuccuaaucccuugguuguuaaauaauucuggggaagggccccgagcacgacagccgcagucuccacccagaaccagagagucccccccaacccgggauguacccucuggccacaccagggacccugccagaggccgcagacuggcagcagcagccuccccacacagugggggaaggucagugugaugccuucaggccccgucuccugccagggcucucccuccagccuacauagggccucagagaaaugcauuuuuaguucuggcuuuggcccagcccagggcaaggcaggaaacucuccagcgugaguccgugagggccaagaagucccgcccuguucugggggaggaccuggcuuuucuggugucucuggugcccgagagcccggugcugccaucuuuagugaaagaguaaaugguggccgagggcuccuuuugugagggaugugccuuggugaagaaggcauguucccugccgugaagauacuuggaagcucuggguggagagggaaaagggauaccccuggugcucccugggccuggcggaaggcuaggaggaaggacagcugaggugaggacugaguggggcagguaucacccugacaaacaguuugggaagaucaggaaaggcaggugagaccuggugcagaauccagguuggguaauagauacaucgucgaagauguagcaagcaaaguaauauacucaacucuggaacauugcacagaagcuuuuaaagcacucugugacacuuuuuguaaugagggaucugaaggaaacggccccagagucacccauccccacgggucugguuggcggggcuggugccuuucuucugcacucagucaccauggcuccgucugucaaacucaacucuuuuuuuuuuuuuuuuucuucucuuggugugguaauuuguuugaagagccacuccauccccaaauucaagauuagaaagaucccugacugcuucucaagauccagaacauuccuugacagaguauauucaccauuuagaagugauccagcaaagauugggagggguacuaccagguaaugcaaguccucgccgaguauuuauuaagcugauuaucacuguacccuggaaacguagggucuguugaaagauggcugguauucagcuuaguaaccaaaguuucagucugaacaaucagugucacuaauaguauuagaauagaggcuacaagugaagaaucucacagaagucuaagccaguguacucagugauacgugcugaggucaguuugacuuaaucaccgucuggacuuuuuuguccuuucucuuacauugauagcgaacauaaagauuauauuucgaccaggauauaauuuguucaguguuucuuaaauaucauaauuuaaaccacuguauaauucauauuuuuaccaaaauuuacaugaauucagugauaguguuucaaaauuguggaauucuuuucaaaaaaucugugaagccuuguaaccaauuugcugccucauuuuuauuuauaugcagauucuacuucaaagaaauccugccacccgaugauuaaacagugaauaaaaugucauggcucuuuccugcgacaauucuauuugaggaaaagauuuguuuuucccuuuucccaaggaagcucgugggacagcaugggcacuacucuucaugugcggugacaccagcccccagaugccuugaauuaaguguccucaccuuuaugcaugacugcaaagccagcuggagcauuuucuauggagccuccguauguuuuaggcccaugaccuucgugaggugacgggcacucacucccaugagcccuggcugugugcuguugugugccuaucggcagauccauccuuccugccuccaaggaggauacacagagaauggcuuccuguuguuuuguuuauuuucuuaacguguacagauggaaacuucauuuaaaaauaaaaacaaaacaacucaaaaaggaauaaaauuuaaucacuguuuuguuugugaaua

SEQ ID NO: 192152 - RNA, 121647 nt, Homo sapiens
uauucacaaacaaaacagugauuaaauuuuauuccuuuuugaguuguuuuguuuuuauuuuuaaaugaaguuuccaucuguacacguuaagaaaauaaacaaaacaacaggaagccauucucuguguauccuccuuggaggcaggaaggauggaucugccgauaggcacacaacagcacacagccagggcucaugggagugagugcccgucaccucacgaaggucaugggccuaaaacauacggaggcuccauagaaaaugcuccagcuggcuuugcagucaugcauaaaggugaggacacuuaauucaaggcaucugggggcuggugucaccgcacaugaagaguagugcccaugcugucccacgagcuuccuugggaaaagggaaaaacaaaucuuuuccucaaauagaauugucgcaggaaagagccaugacauuuuauucacuguuuaaucaucggguggcaggauuucuuugaaguagaaucugcauauaaauaaaaaugaggcagcaaauugguuacaaggcuucacagauuuuuugaaaagaauuccacaauuuugaaacacuaucacugaauucauguaaauuuugguaaaaauaugaauuauacagugguuuaaauuaugauauuuaagaaacacugaacaaauuauauccuggucgaaauauaaucuuuauguucgcuaucaauguaagagaaaggacaaaaaaguccagacggugauuaagucaaacugaccucagcacguaucacugaguacacuggcuuagacuucugugagauucuucacuuguagccucuauucuaauacuauuagugacacugauuguucagacugaaacuuugguuacuaagcugaauaccagccaucuuucaacagacccuacguuuccaggguacagugauaaucagcuuaauaaauacucggcgaggacuugcauuaccugguaguaccccucccaaucuuugcuggaucacuucuaaauggugaauauacucugucaaggaauguucuggaucuugagaagcagucagggaucuuucuaaucuugaauuuggggauggaguggcucuucaaacaaauuaccacaccaagagaagaaaaaaaaaaaaaaaaagaguugaguuugacagacggagccauggugacugagugcagaagaaaggcaccagccccgccaaccagacccguggggaugggugacucuggggccguuuccuucagaucccucauuacaaaaagugucacagagugcuuuaaaagcuucugugcaauguuccagaguugaguauauuacuuugcuugcuacaucuucgacgauguaucuauuacccaaccuggauucugcaccaggucucaccugccuuuccugaucuucccaaacuguuugucagggugauaccugccccacucaguccucaccucagcuguccuuccuccuagccuuccgccaggcccagggagcaccagggguaucccuuuucccucuccacccagagcuuccaaguaucuucacggcagggaacaugccuucuucaccaaggcacaucccucacaaaaggagcccucggccaccauuuacucuuucacuaaagauggcagcaccgggcucucgggcaccagagacaccagaaaagccagguccucccccagaacagggcgggacuucuuggcccucacggacucacgcuggagaguuuccugccuugcccugggcugggccaaagccagaacuaaaaaugcauuucucugaggcccuauguaggcuggagggagagcccuggcaggagacggggccugaaggcaucacacugaccuucccccacuguguggggaggcugcugcugccagucugcggccucuggcagggucccugguguggccagaggguacaucccggguugggggggacucucugguucuggguggagacugcggcugucgugcucggggcccuuccccagaauuauuuaacaaccaagggauuaggaaaauaaaugaaugcauuuuaguaaaggcccaucuaucaacaguuuaaacguauaagcuuuuaagagccuguauggcaauuuuaagacauuuuuaaagugcucaagguacaauaucuuuuuaaaagcuuuggaagaaaccugagcuuugacuaucugcaucugcagggguagcccgucuccgggggagugcggggcaggggggucucaagaccuggguggggguccugccucuauccgcucugaggagcuggcucaggagggaggggcaggaacccuggagaccaccaggugugacucagaggggcaaacuuuccugauggcuugaaggcugaaucaaagcauuuuaauuucaagaagcaacuauuaaaauguggagucaacacugauacagcugccaggcgcagugcucaugcccacagucccagguacuggggaggcugacacaggaggauggcuugagcccacgaguucaaggcugcagugagcugugacugugccauugcacucgagccuggaugauagagcaagcccgucucuuaaaaaacaacaaaacaacaacaacaacuugguaaggcacuuccaggaaugccgagucauggugccagucggcggugguucaggcagccuaagccccacaggcccggagccacacacccaccccgcguucucugugcugcgugggaggggcguucucugcacacaacgccugccgcucugggacaagagccccuggaaaugcccugcucuggggcuggcuccuucagcacuagugcagccagcugugcucucugcuguagggggcaauggcucggcagagaacucccgagacaaagaugugagugagccagaaauaagcaugaugcucuacaaggaaagagacgugaagugaguuucaguugauuuaaggaauaaaaaaagaccauuuugcuaaacacuauuaaauaaucaauauauugagcaucucaguguuucccaucgccguacgccccugugaccuguguucauagcuaacaugagcucugaccucccuacgccgggcgcgccuucccucuggacgacugcucugacggaauucacggauuuucuuaccgugcuuuauuacguccccaucaacacugaaaaaugacccaaagugaaugaaaaacaagaguagaaagaaagguuugugaguccagcggucaacagcagcuggagucccaccugggcgaggggcuuugccuugugccagagcuccuuuccgaucuacuucuugccauuucuuaaccaaaaaacguaaucuacaaaaaaaagagacaagacacacuuaaaaguacggcaagacaggaagggaaagagcaaugaaaaccccacugugaccaaacaagcagaaugggggccucgcugcccauggggaccaggacgccaaggucggccagucuguugacucgggccuggcaugccgggugcacacauccaaagugcucgcagggcugccggcggcggcgaccuucccaugcccaaccaccugacaaagccucacugcggccccaccguggaccauaugguccccuagacacccaccauggcccagcucaggacgacuccaguucaaagucagccggccacaccagugacuaggaaacacaugccgcucccgccuggugugcaggacccucccaucuucauccugucacagaugccacuggacaggcucagaacacggagaccccagcccucgcaggaguccgucagauggugagcaugcagagugcaggugacgagggcaugcaggucagugugcagggccccagacgcccugcuaggauggccuucggaacaagcaucaugccuguggcuucccuccuuugaggcauagcagacacugccgauuccuccauaagaccugucaaggccccuugguggcagcuacccuaggcagugcccucacagggacacagagacugcuccuuucugggacaccacugccuucaaaagaucuccccuccucgacaggagguaggaucugggucugcuuaccuccccuaucuagugccuaaaaugcuuccuccugcaggguguucuccccaugaacacaggauggacagauggguggguggaaggauggacgguggaggccuacggucaggggagcucagagacgaggagacaaagugccccaggaccagagaagcugagaguacagcaacccaggaggccucgccugcaccccacuuuggcccagccugcagccgcgaugacugaacuggcucggcaccuggucucugaaaggagcgggauuccuagcugcucucugcugcaucugcuacuccagacaggcccgcgcguggccuugggaaacaccucuguggcaucagggagcaggcacagccgcacaguguuuagggggaaaaacaguuuuagaaauucagcacguucuuuguggcacgaaacccauuaaaagucaagauguuccucuguaauacaaaggugcccuuaaaucuuuaguuuuagaaggugagagauucauacacaugacuucuugaagacaaguucaucaucuguauuuucucuaaggccucaaaugccauucaucuuuaaaaagaacauauuauggaguuucaaggaauaaaaugaccaaaaaaccaugcagugugcugcccacucacggagacagacgcggaacgcacugacugaacgucauggcauuuaccuuaauauugcaaugaccacccugacggccgugcggaaccuggugaaaggacgagaugugauuuuccguucugcuuuggaaggaaauacccccaaaugggcaaucauggagaguguuucuuguucagaauccuggaauccaccaaucaacagcaaaagauacuucuuuugauaaaucagagcuuuucuaaagcucucugcucucaaguaaugcagguacaauuuuuccaucuaaaagaaaaaaagcaguaaaauuuuaucauaggaaacaaagacugucuugcugacaaaagcacauuaacaccauugcucuuuccaaagagucagauuguuuuuucccaucaaaucaucacagagccaucggccuuccaacaguaucuguggccagaaacaaccuugcuguuggaagaucaauuuguguuugucagacaagaucuaggaccacaagcuccucuccacagcaucaucaaaugagccccuaugaagcuucuugcauuucaccccuuagguaagguccaaacugggcaugagauggacgucacgggguggggaccgugugccaucaggagacugcagcagaucuugggccgaaucccggcaagccccugggccaggccucccucaggcugcagaggccgccauuugcugacuuugucaaagccuuccacguuccacgcuuaacaagcacagaaacucaguauuugugcacaauuaaaacaaaauucaagccgaaguuuauucugugaacguccuuuccuuuagugaugugacugcuacacccggcagacgagaaccuuguggucacaaaaaugcuuugccugcaauuugcaaacccaggacuuaaaaaagcaccaaaguucuauacucguggcaccguuccuaccuugacauugcuggugugugcuuccucgcuggcagcugguggaagccggccggggucugggcgccucagggaacucuguggagccguuucgucuggcuuccaagcagaccuuuccgaccucuguaaggaagcacagccagcgcugucuacagagcugcucgucaacaagagcaucuuagagacgcagccgggggcaggugagggagaaggccaugugcggggaggccaggcugaccacaccacaccuggccccuccucaacuucagcacccccucagcagggccuagguuacgccgugcugugaucagccaaagaauuaacauggaguaauuacgacaugccacuugcugaaguaugauugcaaaaaagguacauuuuaacagaaacagaaaaccaauucuuuguaaaaucaccccaaauucaaagcuuuaagccuuaaacacucucauauucuccgguccuagaaaugccaaccacugguaacuacaagcacagucaacucucgacagcuguggguuccacauccauggauucaaccaacugugggugaaaaauauucagaaaaaacgaugugucuguaccaaacgugugcuucuuuucuugccccuacacccuaaacaauacaggaugacaacuauuuacguggcauuuacacugaaugaggugcugcaagugaucuuagagaugacuuaagaguguacgggaggacgugcacagguugcugcugacaccacugcaggucaggaggcugaggcaggaggaucccugaaccugggaggucaaggcugaagugagcugugacugcuccacugcacuccagccugggagaugcagcaaggcccugucucagaaaaaaaacccaaaaagugaaaaaagccaguuuaggaggucccagacgggcugguuccacugacacaccuuucugggagagagccagggccuguggcaggcggagaugccugcugcucuuuuugggggggccaucgcugugugcucugugaauggugguuacuuaugaagguuacagggaugugugugugugugaacuuguaugacacuacaccaggaaagggcaaauuuuacuguauguaaauuuaaaaauaauuuuuaaaaaguuauaaaaaauaaagcaaaucacaaacaaaauagccuaaauacaaaagaaaaaaaaaugagacauuccggaagauaacucuauccaacuauaccauuaugaaaauuauaagucacuuuaggccgggcacgguggcucaugucuguaaucccagcacuuugggaggcugaggugggcggaaucacgucaggauuuugagaccagccuggccaacauggcaaaaccccaucucuacuaaaaauauaaaaauuagccaugugugguggcgggcacuuguaaucucagcuacuugggaggcugacacaggagaauugcuugaaccugggagguggagguugcagugagcugagaucgcaccacugcacucuagccugggcaacagagcaagacucggucucaaaaaaaaaaaaaaaaaaaaauuauaaaucacuuuaacuaaaacucuaaauuagaucagauuauaauauucuuagucaaaauacccuuuuaugaacaugcaccaaacaucaaguagcggucagggucagugaggacgccgucuguggcggagcuggaagucggcugagauguucaaacaucccacaacauuuagcaaggcuucagacagaggcaacagagccuggcgguuagggagaaggugacgcccacauccccaggucccuaaagggagcccggccucuugugggguggagcugcucuggaccaugguggguuaggcugaggcagguaagaguuaagcacagacaccuacgcuugggcugcagcccuucugcagauggugcuucagcaacuucucaagcuuagacacggcucugcucagcuccagcuucuccugggucaccgugcugagcgcuuuugugagggaaacauugucuuucagcaggacguccacaaacuggaacugcagcucugcugccauuuuuuucuuggagaaaagaaaauaaauuuguaagaauuuguuguuaaagggcaugaacauuacuuguguuuuuugucaacaguuauuuuuagggauuguaauuaaugugucugggguucaaugagaagcuuguggagcuggcagaaaauuguaaaagucauugaaucacagacuuugcacgcaacuggcuuguaugaacaacgcaggccugucacaaagcauagcccguuugguuguucuaacagcacugaaauuaacagguggcuggaccguuguuaguucaucccaagggggcggaugugaagccccucaaaacagguuuauuacuuccaccaucaaaaggacguucagccuguggagggugggcacgcugaaaggucaccagggcccaacacagggggcagggugcaccccacccacaacgacguucagcuggcggggccagaggguaagcggcgcagcuccccugcaccucacaugcgugggcuccacgaucaaagucaugauuucauaaaugccacagaacacacaucaagaauuuauaccagcagccagauucccaccuccuucagaggcagcuuacagugagcucagacuuuccaaggaggacuuggguuuuuguuucuagcaaaggccgucaacgcaaacacaaagccagcaggcugggccagguggaggugaacaucggccgccagcaccagagcagaaccauagccccuccugaccagcgaccugcaauguguccaggucaugcacagcgagcagcaugugagggggcucuaccagucacgcagcaucccauggcagcagggcucagcccccgaagaccacacagucacacagcaucccauggcagcagggcucagcccccgaagaccacacaagugccccaggacauggaggacauccguccccacucggcccacagggucgaccccacccacucacccagauagcaaccaugaauucagagaaggcagcgagggaggaagaacaauggggaagcgugaaaaagaaccacaaagcugccgagagggccccucugggggaggagccaggccagggaccugggggcgcucaccccuuaccugggaggaggugggccugcucaagucagacuucagcuccuccaacgugugcaguaaagacaucacugcuuucucauuggaugacguccaaucauuaacuguccuguaaaaauaaaugggcacucaaaguugcauacgcgccccaagugaccauuaugcaaaacuaaacaagagcucacggcucaagagagacaagacagguuucugaggagccugugugugaaucacuucguccagccgugaggcagagccaggggcccacgggggcaacaggccuguggcuggacgcuucugcagagcucagaaaccuccagccgggaggcgcgccaccgagcacgggaagccaccgccugccaggccccguggcuuuccucuggaaugaaugauuuaaaaugcuguccuaagugaaacuuugcuuagaaaucaugcugcucuauacauuaaguccaaguauagaaaggagaacuguguuugccgaguuucuguguauagggaaaaagacaaacauuagcauuacccuuucugcccauaugaaauaucacgaucgucauccugggugugaguggccuugagugacacugggcagugccagcggggggggggggggggggccacaggaggcuccaaacccgacccuguggguggugagcaacuacacagaguguaaagagaaccaagccaacccucaaaggaacauggaagccccacgucaggcguauuuugaaucacaggauuuuuuucucugacauuagaauaugaacaugccaucuugccaauccggaaucccucagcaaagucucagaaagaggacuagagcguuaagugcaaaggagcaggggccucacaccagacgcgccccagcccucgggccgggucugggacagagggguggcugcaagggaccagugagcgccagguggcgugggugcacaccuguccacggccuggcuggugaagcuggugagaagccgggcggcagagagcagccgcugccucaucgccuccagcucucgcugcuguucccggaggugguccgcauccgagccggcagcccugcgggcagaaccuagguggaggcggcugccaggcaccucguccuucgacuccaggucucucacugucugcugaagcugcuugaucuuaugcaagucacgcugacgcugcaguucuaauucucgcuguuguuaacagaaaaaagacagagaagacguucacgucaguguccaaaaacaaaacugccggccgggcgcggugguucaugccuguaauccuagcacuuugggaggccgaggcgggcagaucaugaggucaggagauugagaccaugcuggccaacacagugaaaccccaccucuacuaaaaauacaaaaaauuagccgggcgugguggcgggcgccuguagucccagcuacucgagaggaugaggcaggagaauggcgugaacccgggaggcagagcuugcagugagccgagauugcgccacugcacuucagccuggacaacagagugagacuccaucucaaacaaaacaaaacaaaacaaaacacaaaacugccagcagggugugguggcucacgccuguaaucccagcacuuugggagacugcagcaagcggaucaccugaggucaggaguucgagaccagucuggccaacaugaggaaaccccgucucuacuaaaaauauaaaaauuagcugggcgugguggugcgcaccuguaaucccagcuacucgggaggcugaggcaggagaaucacuugaaccuagaagguagagguuacagugagcugagauugcgccacugcacuccagccuggcgacagagugagacuccaucuaccaaaaaaaaccaaaccaaaacaaaaaaaacaacaacugccaagcaaaagcccaaaacacacagccgcguuacaggggaggccccucacagaccagaaacaggcccucgggcaggcagccccugugguccuguacugggacccacagcugacacacugcacacccucgugcugugcugcucugugucccuccagcauggaggcagcugaaucacacaccccagaaugauucagugguaaaagcguuuccaucguaguuuuuaaaacuaucaggcuuucaucaggcccagggcaagcacgcgggguccaaaggagaggagccugagaagcugaaacagaacagaccggaugacgcuucccugugcccuggucccacucauccacauauguacacgcacacgcccagacgcucauaccaacauagacacagacaggcacauuugugcaugugaacaugcacacacguaugagccugagugcagcccuggggcugagccuggguggccacgugggccugagcuccuaagccagaccucaaggagcagcagccuuuccuucugcaggacgggggcacaggccaugucuggugcccgggagaagcgugucagcaagcgccugagccccugcccagggcccgacucccaccaggcaggggacagaaggucuacugcacgauggggcaaggaaggacgaagcagccucugaagggccucugauucccagcagcgccgcuggggcuuccuugugacaacacaaagacagauccagcgggaagaggcccaagaugcagacacacagaggcggcuugccgugucagggagggaaccccagcacugagcugaggccuucccagcccagaggacccacagcugagccugcacuguguggcaccagcgccccugccacugcggugaccagggugcagcucagacucuacccuccugacagcgccucacucaaugcucgggccucuuaaacaggaaugaguaucuuuucuauuuucuaguaaggaaaguaagauacagaggaacuaaugagauuguauuauuuagaaaagauggaauuguauccagcaugccacuaucuugggaggcuuccauggcuacagcuagagaaggguucuauaauccagaucaaauucacuauccucaguaaaaaacacucuggaggccgggcacaguggcucacgccuguaauccagcacuuugggaggccaaggugggcggaucaaucacaaggucaggaguucaagaccagccugaccaaugugguaaaaccccgucucuacuaaaaauacaaaaauuagcugggcugggcguggugacaugcaccuguaaucccagcuacucaggaggcugaggcaggagaaucacuugaacccgggagguggagguugcagugagccaagaucgugccauugcacuccagcuuggaagacagagcgagacucuaccucaaaaaaaaaauuaauaaauaaaucacucuggaagggccaccucacucaaaauacaggucaagaugcauccugaagcaagcaacuuagaaaauauuuucuaagcacucauguuacuauuuuuuuuaagaaacaaucaaaauuaaagguuuuggcuggcaacuucaggcgugguuucaggaaguucucaaaaaguaaagacuccuuugagcauuccaucaaaggaugagcucuugcccaggagaaaggcaaacacacacaccacgucucacccucagcugggguccuguguagacgccccugccaugcuuggccacacugucuguaccaccaaaccaccucccuacucuccaaggcuucuggagauaaaaaaaacuacgacuauuccaaagaguguuuuuguuuuuuugagauggagucucgcucuuguugcccaggcugaagugcagcggugcaaucccggcucacugcaaccuccgccuugcggguucaagcaauucuccugccccagccucccgaauagcugggauuacaggugcacacuaccaugcccggcuaauuuuuuguauuuuuaguagaaaugggcuuucgccuuguuggccaggcuggucuugaacuccugaccucaaaugaucugccugccuuggccucccaaagugcugggauuacaggcaucggccaccgugcccggccugcucucaucccuucuauucaacauuguugaguucgugccacugcacuccagccugagugacggaaugagacuccaucucaaaaaauaaauaaguaaauaaauuuaacaaaaguauaaaacuuauauuuugaaagcaaugaaacacuacugaaagaaacuaaagaaggccuaaguaaacagccgagugugguggcugacgccuguaaucccagcagucugagaggcccaggcgggcggaucaccugaggucagaaguuugagaccagccuggccaacauggaaaacccugucucuacuaauccaaaaauuagccaggcgugguggcaugugccugcagucccagcuacgugggaggcugaggcagaagaauugcuugaacccaggaggcggcgacugcagugagcugagaucacaucacugcacuccagccugggugacagagccagacccuaucucaaaaaaauccuaauuaaaugaagagacacauucuguaaucguggaucaaaagaccucacacuguccagaugucaauacuacccagagcaaucagcacauuuaaugccaucccuaagaaaaucccaguggcagguucugcagaaauacaaacaccaauccucaaauuccuguggaauagcaagaagccccacagagcugaaacuaucuugaagaggaagaacgaaguuggagaacucacacuuccugauuucaauacuuucuagaaagcuacaguaacagcaguguggugccagcgucagggcacacagaccagagcagaccaggucagagggccagacauaaaucucgcgucccccacgugaaccauccuaacuccaauugcuuaucguuuuuagguguggacguccgccggcaggcggcucucaccagcuucuccuugucucucugccacuuccuccacugcuccgcagccgcugggcucugccuggccuccgcgcuccuccucgcagccuugcguccuucuugcucuuucaaccgugggugugacugcucuaauucugccugcaaccacgcugguuucucccucucucucuccagagagcaucucagcucucguuuuugggugugcagggcuuccaccgucgacuucaguguggcacuuaccuccuucucucuccugagcgccucacagugcuucugagccucagccucaagcugcugcugagaaugcagggcuugcugcugcaccuuuucaagcaucgcuugcaaguccaccacccgggacuucuccuccuucagcuucugcagcagagcgugaugggccuguguguccuggugcacgcaagccuccuguguccucuggcucagcugcucggucaggagccgcucgugccgcaaggccucugacagcuccagggugcggcucuucucagccgcaagguccuucuggagcucagagagcuggcuccgcuccugagccagcaaggccucgcagcgugagugcucgauacgcagcuccuucugcagguuguccuuggccgucugcucguguuucagugccacgcagagucgacugcucugagcacgcugugucuccaaagacgcccgcagcuccuagacagcaaacacauacgaugggagacacugaaucaagaggaaaagugucuacaugguuuuccuguccacauuuguuuauauacuuuagcccagcaauucuaccuuuugaaaugcacccuauuagccacauguagggacaacauuuuuuuguuaguucaucaaguaacaaaaaacccagacugcggagaugacauacuuuuuucggaaaugguguugaguccuggguucagagauguucccagucugucccucuccagaaaaugauucagagauguccccugcccgcccccucuccagaaaaucacuccaccagaggcuccugcccccucuucagaaaaucacuccaccagaggcuccugcccccucuucagaaaaucacuccaccagaggcucagagauacacacccagcuugcuaggaaccaccacuuccaugcuguugaaagccauaacccauggaacuggcacagacuugcucagaagccacagcaggccugcugggccuccgccaugcaaagcagaggccccaccaccagccugccuugugcacagaccucugaggcugugcucugucuggaugccagcgaggaggcuguguccaucuccacagcaagugcucagggacgggggggggcuccgagcagggguaucgugccaccacgggucaucgcacucuucgcccugugguggcugccacuacaccaaggugcaauuuuaccugcaaacacagcccuauccugcuacgucacacugcugucaacugggugcacugccaugaagaacaggaaaagaaggaugaaagaggagcauggcuucaggcuuccagugcacacagcccaugccggcugccuugcccugacacccuguuaccuccagggccuuggcacucuggcucucccucugcaggugccgcagcugcuccuccuccagcuggcucugcagggcacgccccuuccccugcucacucuccagcuccugaagcgcggccuucagcucguucuccuuacugcucagcauggaucugcguggagacaucgcagaacaaucugaccacgugggccagaguguguucccgggggcugggagcuccaggaggggaggcagagcccugccaggucccacacgugugcuucaccccccaccacaggauuaucaacccagggacagcagggcgcggugccccuggggcugcccaacugcggcccaccagagguucugucucccuucaucaccaagaaaacauggcacaacggggggacucccgccagugucccaggaagggggaucaggcgcaccucagcuggaggaccuccugcugcaccucgcagagggaccgggacagcuguucgcucuucugccugcucucacagaggucggacuucaaaucucgcacuacagucugcuccgccgccaggagcuucugcacgcuguuugccuucucuugcucuucacucagcgucuucugcaagucaccagcaaugcacuucuccugcucuacuuuauaagccagcaguucaacugagaaagacaaaagaacaguaacaggcccccaugagcuccucgugcugcacaagugacaccagguuagagacagacucgugggggcgugagguguaugugcuucgggaagaaaggagguucuguggacuagaagcuuucacugcggguggaaccaggaugcucaauucugcccucugggcccauuuccuuccagggcccacccaccuggccgggagacacagaguccaggagugauauagcccuggggccauccuaaaaaugccaccucacccccacucacacccuaaacugccuccaacagagggaacuccaggcccagguggcuuuacuggaaaauucucccaaaacuuaaggaagaaauaaccccaauucuagacaacggagggcggaggggcuacuucccaaauacuucccgcaccccguggggcuggcgcuacccagcaccaagaccaaaaaggcacaacagaaaacagaccagugccccucacgagcacucagacagcaccggcccaccacccccaugccccucacgagcgaucgcacagugccggccccccugugccccucacgagcacgugcacagcgccagcccccccaugccccucacgagcgcucgcacagcgccggcacccccugcccgugccccucacgagcacgugcacagcgccagcccccccaugccucucacgagcgcucgcacagcgccggcaccccccgcccaugccccugacaagcgcuugcacagcgccagccccacccaugccccucacgagcaugugcacagcgccggcccccagccccagagagcacaaagggcaugggcgccgggacaagggccgugggcugaacugcaaggccguuccccuugacggaauccaaaacuaggaacagagggcacuugcccaagcugaccaagggcgccugaccccacaugcgaugguacgagaccagcuccugcccccaaaacuaagagcagggaauggcaucugcccacacagcugacggcacagcacgugagagaacacgggcaagaaacaaaaaaucguuacuuacccacagaugaccugagcaucuacauaaaaacucccgaagaagcuaaauuaaauguagaaaccuacgagacauuccugaacucuagcaugagcucccaagaaucugccagcacucagagcccaacccaggccccucuugcccacaucaggcccaagagugaggccuccgugccagccccacccagcgcugccugucuccaggguccuuucugcucaguccuaucagcugacaaccauggcaacacucaggggcuugacuagaugaugcccugucaccacccucugcucccaaggccacacaggugagugucgggcgggcaggugcagaggccgggccccaggcaguguagacagugacacccacccugccugcgcagcuggugcuccugcuggcucccgcgcgccucugcgcuugucagcgccgugcgcaagugcugcagcuucuccugguucugcaggugcgucaugcgcagcugggcacgcagcgccuggaucucggacagcaggcugcuccgguccggcaagcgaagaugcuccagggacuuuuccugcaggucucccugggggcacaaugggacaagcagccugagcauugggcagccaccccaugccccggccuucccugcugcccgcccucaaaaccagcuccgccgggacaagccugcugagucugggaugggugcacaguaucugcugggccucagcucuggggccugcaggcgucagggcugggcugcacuacccugcgugaggccugcaagccaguuacucucaacacuagguuuccucguguaugcuggcaggaacaggauuuccaguguccccacggcaccaacgccacccagcccugcacacagagcaccucucaaccuaggaggggcuacuuggaauggagaacguuucuuuagccaccuaucucagaaaagagugaggccugagggugcaucucgagcacaccuguccuguuacagcugcagguggaaaagugcagcauccugcauggacugagcgucaacaccuggguaagugacagccacauuccagcggucgagagaaacacacaaaccgaaauucacacacaaaacagucugugucacccucucugccagggcuggaccccuggggcaaacugaggccugguggcagagcugacacucaccugcucacggaugaucuucuccagccuuucgagcagggagcugugaccccccagaucugagccacugagucggggcugcagcucaacccccugcaucuccugcucuuuuucaaaggccucuugcacaaccugcagaagguccccucuccaaucggggcacgcggugggcacuuccuaaaggaagaaggaagaaacguggcguccucacaaaugcaccugcauccuugugcccuaaaguucgcagugugacugcguuuggagauggggccugcgggaggugauucaggguaaaugaggccucuuaagaagaggaagagacaccagagcucacucgcugucuccaucauaugaggacacagcacggagacgcuguccgcaaaccaggaagggcgccuacaccagaauccaacccugugggcacccugaugccacaacaggugaaaucaaugucugcuguuuaagcccccuggucugggguguucuguuacggcagcugagcagacugacagccguucaaacagaaaugacccugacagaagagaagacacacacugcccagggccauucaaggcacgagaagcaaaggcugccaucaugagcacagaagagacugaaaaagacgauaaaguaaggucaggaaaaugucagcaaagcuccuucccucuuuuccugcugcugugccuucaaggcccagggccuggaggggaccuaaggcugcaaggggcuacccgcugguccccaggggcagcgugcagcaccaaugagccuccugaaugccagccaggcugccgcucgcacacaaccagggccugcuggaggggcgagcggaggcggguggggcugacccucccaccggcucuccauggcaccagcacacccugugcguuccaggcacagggagaaagcccuucccucccucacaaagcuuugaucccagucagaggcaggcacaggggcaggacagggugggcacggagaugggagggagcgugaugggaguuggcacccacuccacaaccuccacaagcccuggugauggaagcagacaggcagggagauggggaggacuuggggaaaaguggggugcggggucgacagcacagaggugaggcccugagguccaguugcuggggcuugggguguggagggggagguaggagagacccaaggggaggaaugaggccggagggcaagucacccgaguggcaggaggagaggcccugggggacaagugcuggaaugggccgaguccgcagggccacauggccaggagggaccacucucagccuccccgcaggcucacacagggcacaggccugaaagcccugagcccuucugccccccacacaccuccacgucccgcagggaaccugccccgagagccugcgcuggcugugggagaugggaaggccuccccaggguucuuggaccucagucuuuuuggccgugcuaaaaaaaauccuaggccaggcacgguggcucaugccuguaaucccagcacuuugggaggcugaggcggguggaucacaaggucuggaguucaagaccagccuagcuaagauggugaaagcccgucucuacuaaaaauacaaaaauuagcugggcaugguggcaugcaccuguaaucccagcuacucgggaggcugaggcagagaacugcuugacccggggugguggagguugcagugagccgagucucaaaaaaaaaaaaaaaaaaaaaaaaaaagaaagaaauccuaguguccacguggcccuaaggacgcggccauuaccacaagcuccuuaaauccuuuggaaaagaagugugugaagggcaaaauaaaccugcgucuuucccccauggagcgagauguccuguaucucgucuuccuuccgggguggguguggcucgccgcuugggggugcaaggccuucugacagcgccaggaucugguggcucucgucacgcaccaucugcaguaaagccuguggcgggaaagcgcgucagaagggaguugccugccaccccacacagccacgcucuacaccaccugcggccccgagcugccgccaggacucugugaagggcgggcagcuguggagagggagggcaccgccucggcuucguacaggcggcacccacuucucaagcuacaagguuuucaagcccaccucucccgaccuucagagagacaacacggaagccaggcuuggagugaauuucucuauaagccacuccaaagauggccccgccacuuccuccacuccaccugcucccugagggggacaccgucccccgccuaagccuggacaaagcucagggcagggcuuuaggccaauguccacagcgagaucacaaacauaucacacacucccugcccaccugggacgcuacgagaaggccacacgauggccacccaggaggccucugugcgugguccggcugaggccagugccgaccaccagcguggggugaagcugccugugcugggcacggggagcagagaaaaccauccccagcaggcccugcccacaggucugugaacacgaggcggcugcuuuaucccaccgauuacgcagcagcugguguccggacacacacuugacugucucgccagagaggcugagggguaagcagacggcccuauggagaagcuggugucacgaccagccuagagcccagagcccagaggcucagcgcggucaccaccacaugagcacacacccaagcacaggacacgucugcauaaaaaccugaagagaaaaauaaucuaauaaaguccaaaaagagggaaaugcaaaaugaggcaaugaugaagccuacgacgggugugacugacugaaaauaggcuuuccuguaauuuuaacgauaugccaaaaaaggucaaauauuaacacuaaagugugaaaccaaauugcacacuauguucaucucuaacaacugaaaacacuuuuacuuuaaacauaacguauguggcacaggauggaugcaaacugaggucugcggcagagcagggugggguugaggggagcgggguggugcggggaggagcggagacggggggagcaaggccguggcugggggagcaggguuggggggggcgcagugggagcagggccgggggagcagggcggcgggcaggcccugaagcugcuuggccccucucuuccagcugcagaggacaggccauuuccuucuuuuuaauaugcuuuucuagauucuguauagaggagaaaaugcauuuuaaaaaacaucucuuacaaagaagagaugcagaggcccugggccacagcuucccgccaggugacacggggcccuugcagguggguucccgugaggccgggaaguggggcagagaccaguggguaccuuagaacauggccugugaggcagccuggggggucccacagacacaaucacuagggcugagaagguucugccaucuccacacucaggaccaggcggcucugccugucagcagugguggugguggcagcggcggaggcaggggaguccucauuuccugagcuccagcaccuacccugcccacuuauggcucaauuccaggcacggccagagguggccaagaguggccggggccccacccgugcucaggaccucucagccuccucagcauagggaccacaggggcuauuagagcgucgaccacacucuuggcgucuguggcugcaucugagcagugggugucccccacgcgccuggagccaccuccaaguggggcaagcacccagcuccacucaguuccccacugcggcgucagugugggcacaaccccagggcuccacacucuaaaacacaggccagaaauuaagacaauaaaggaaaacccugaguuugaaacagucugagacauccaugaaaaaaacuccuugugauuuucaacuggacuugggaccuuucaaagcuggaggugcucccuggacagcaguuccuccucuuccuccuccuccccucuccccucccccucccccuccuccccucccacucccccuucucuuccuccuccccucccccuccucaucccccucccuucucuuccuccuccuccccucuuccccucccccuccccuucucuuccuccuccucucccccuccuccucugcuucgcagcugcugccucaagggcuacaggaggccuuuccugccuuuugugcuuuucuuuuuaaauuaugaaaccuaaguaugaagaguuaacauuaaucaaauuuauuccuuaaaaaucaggaauucuaauauuagguuguuuuccauaggaaacacuaacagaaacaucuccuugacguuuuauauuguauaaaaauuugaggccaggcgcuguggcucacacuguaaucccagcaccuugggaggcugaggugggcagauuacuugagcucaggagcucaagaccagccuggguaacauggcaacacuccaucuuuacagaaaauacaaaaauuagcugggugugguggcucacgccuguaauccaagcugcuugggaggcugaggugggaggaucguuugagcccaggaggcagagguugcagugagcugugacugcacugcugggugacagagugagacucugucucaccaaaaaaaaaaaaaggaaaugcaaagaagauauaaaaaacugauuaaaaaaaaaaucuccaauuuccauguuuaagaaaguaaaauaaguuuuuuuauuuuaaugaaaaaaagagguuuaacugacucaguucugacagagaggggucuuacuauguugcccaggcuggucuugaacuccugggcuccaacgauccuccugucucagccucccgaagugcugggaucauaggcaugagccaccgugcccagccaaauaaaguaaaacaaguuuuauucugaaugcaguaaguccucacuuaacgucauggauggguuuuggaaaccgcgacuuuuaaacgcauguaacaaaggcacccucagggcccucugagacaacgggagcugcggccagcagcacaggaguguccuuccuacaaggucaguuuccaggaaccucggggcaacgcuaagugaggacuuacugcgcagucucagaagagguuucacugaugugaagacuguuuuguuugggaauauguuuaccacuugacuaagcuccuguaguggcaucauucuaucacucacuuguuuagccaaguuuuugucaaugguuuugccauaaaaugaucugcuaaacugggagaggaaagaaaaccuaugaaaaguuccacaaaauucugccuucaagguugauuccaaggaggcugaguggcuucucucccaucgucugaagagaacucggcucaguccuagagcacugcggcgucuggugccucggcuucucuacagggcacaggcaggagggaggcacaggcgggagagaggcacaggccggcucugcgacucggggcaacaccaccugcccacgggcucacaggacccucccugcccagaugggaggcggccaccuaaggggccagugcagggcugggugggcggcuuccggggccaccguggggcugccucccgugagucauuaaaaugcaggugcucagaggcacccaggaaaagcuggcccuccaaggcucuccccggcaaggcaggacacagggcuugggggaugccccgaggcugcacaugugaagcugugagggccgccccugccagccauaccuucacgugcuucggacgcacuuccuucuccuucauggcuuccggcagcggcugaaaccuuccagagauggaagcaggggucacaggaccagcaguuugagccucagggccuccugaccccgggcucagucuugcuccaaaacccgagccgucaccuaaaaacaccacagggucagggucccacccacagcucuccaggggguuccccaggggacgcacugcagaggcaggacaggggugaucggcccgcaguccccagcgacaaccacaccgugauucugcucacggagaaaacacugauggccccaaaaaugcuucauaaaaacauaacccuggugagaaagacgcacgucaaguaagaaaacgcaacuucacagguugagaacaucaccugagucccugauuccagcgccaaucuuaggggaccucugcucacuucuccagacguggcccccaaagacuccacaaaacccagauggccugggcaagcucaagagcagcgggacgugcggggccugcacccuccacgccagccacggagauaaggcaggcagcggacgggcauccaaugacugcucaggaaacgcugaccgugccugccauggggucccugcggugcagcuccugugucaggugggcauggggucucaaggaggaaaauucaaaaccucccagggcccugguccaucccagagaccugcagcugcgccagcccacagggaggggggcgcuuuggaaacugaggcaggaucguguaagggacacgagacccagacgaggaggaggcgcccuggaaaaaggguguuagacuucaaaacaggaggaugaggaugccagcgagacggggcccccguguggacaaagcucccuggggagcggaggcugcagcacuugggcaccugggggaugaugccccggcacagccugcugagcagagggcacacuggggaggaguagaggccaacgaugcaggcagaguacaaccucagaggaugacgaugacccccucagagaaauaacgggcacgucauucacaaaaugaaccaacaaagugcuuuuugugaguggcggcaagugccgagagagcagcaugaaggccucaggagcagugcaagggugcagggugcuggguugcugccuguaccccucaaaaugccucaggccacccaccgccugcaaaucuuugugucuaauaauggugccaaguccuacuucugcccuguguaucucagcuaaagaugacaacgaagaaaucuuuggggaaaucaucuacuucagguguuugagaaaucucugagggugaaggauguugcaucugccugagcugcggcucccacagcguguaccaggaacucugggaugugacugcugcggacacugucacccagugccaccgagacaugggugcccagcaccaugccccagcccacuccauccagaggagaucacagccagcaggugccgccagcggguggucagagcuccacaaguccaagaccacauuccccauugucccacuggacccugugccuucagcacaaaccaugcuucaccucggagcccaacaccuuccuucaggugcagggaccucucaccuggcugugcccaaaauaaacucaagaacgcccuccaaaaaagaaagaaaccaaggagcuaaagcuaaaggagagaggaacaguuaggauaagaaagauuucugagaaauuuaaaauaugagcacagaaacagaacacucagcacaaauguugaaaaauaaaguucuaaagaaaaccucuuagaaaugagaacaaaaauaaaagaaguagaaauaaggaaagaaaauuugacaaucaaucuuggaggccugauauaguugaauaacaggaauuacaaaaagaagagagaaaaucauaggauacgugaauggaggaaggacgaacgaggaggaaauccuccaccccgaccgcgcaggccuccaaggucgcgugucacuggagggcgcaggcacagaggcggcggacacccugaccgcgcaggccccucaaagguugugcgucacuggagggcgcgggcacagaggcaguggacaggcacgcgauaccuuccaacccaagugucugcacccagccaaccaaccgacaaccaccagggagacgaggaaguucucaaaaacaagcaccuaccagacaccuuuucuacagaggcuucuggggacauguuuccuuaaaaaagagggggcuggccaggcgcaguggcucaugccuguaaucccagcacuuugggaggcuaaggugggaggaugacuugaguacgggagguggaggcugcagugagucgagacuacgccacugcacuccagccugcgugagagagcaagacccugucucgguaaauaagagaccguugaggaggggcaaggggccgccugggagccccugagaguuguuggggaagcaccugcugugcuuggaaggcuuggaugacauucaccuggacacugugugcgaggacagcagugaagcacacaggagaaacugagccaagaaaaacaaaaguggcucgagggggacgcacgcucccagcggcucugcuggaacacggggcgcguccuuuaagggcaaaccuuggcugugacagcacagggcgugcagacugcaccucguguagcaaggggcguguggcgaggggcuaggagggcugaagaugccacuuuaaacagcaaauagaguuugaaaauaaagcaaauacgagaagacauuucugagaguugaauguggcauccccagggagcugcaguccugaguggggagcugggacacaggcugcucaggaaacgguccccucagcacccauaacugucacccugcgugcucacuauucaucaaauaaauaaaaacaaaauuaaaaagcugcuggcccuacucugcaaauacuaaaauuucuaauuaaauugugaccauguucucaaaaaacacuaaaucgcugaaaaauccaacagauuuuuuaaaaaguuagagcaccucaaaaggugacugacuuguaaaaagacaacaauuauagaaaaaguuaugaaaugaaaaaaaggacgguguggcagguaaccgccacaacaacugaugcgggccagggcaaccaagggaggcugagaccagugggcgugagcaugagagggaagagaauacucagucuccgcaucucccacagaaggagguggaggaaaccuggcaggcaccaucacagacaaaggcccaagucaagcccacgcaccucccgccacgagguccggggagacgcagccccccacgcaccaucgcgaggacacgccacagucagcggccccucggcuccucuccagggccggugccccgaaacccacagcagagagagggacguccaccccaaggggagggaaaggcagggugggcaggcaaggcagcagagccuggaaacauggcgugcaccgccccagucuccauccugccaaagacaccugaacacagccugugagcuggggugucuuuuccauaaaggacacuacugggacaaugggugaaucugagcaaggucuguagcuguagcugagaugccagccuuggaucagggugaacauuccaggguggagcguggcccgggccagcaaccuuggcucugugaaagguacaggcguguuuucagaagucaagaggccccaggugcacgcccgacaaagcgcagagccgggguggaggucagcggggggcagacgcagaaccaggcaaaggaugcaggaauucuuuugacuauucugugcuaggaaaccacugaaauaaaaaauuaaaaaugaaagauaaccaacucacuuuucucacuucuaucagcuuuuccuucuaauccaggaggaggugaacuuaauguuucuugagaaucaaaggauguugugauaaaaucuucgacaucuuucuccuguuaagagauuuuuaaauggucauaaaauaaugaguaauuacaucauagcgcugacuuugccaggugaaaacuuucaaaggccugaauuuaucuucccacauagaccccagaugaaacaacucaaaacuggugaacacacaggucgaaugcuuccaacaauuuaaucagauucacccacagcucuuuaggaauauuuuaauguagccaauaguaaauauuucagauuuaaauuguuuugcaugaaaugauaguauauggauguuucagauaauauguaucugcuaaauuauuauuuuuugagggagggucucacucugucacccaggcuggagugcagugguucaaucuuggcucacugcauccucaaccucccaaggucaagugauccuccugccucagccuccugaagagcagggaccaugggcggcaccagcacgcccagcuaauuuuuuguguuuuuuuuguagagacagggucucaccguguuacccagccuggucucaaauuccugggcucaagcaauccucccgccucagccucccaaagugcugagacuacaagcaugagcccaaccauaccugauuuuuaauuuuaucuuacucaagauacacaaaaucccaaaaugauuauguuagaaauaauacgaucuaacucauaaauuaaaauuaauuagcauaugugaaaccuguuaaaaauaugaagcauuucuggcugagcaugguggcucacgccuguaagcccagcacuuugggaggcugagguggguggaucaugaggucaggaguucgagaccagccugaccaauaagguaaaaccccgucucuacuaaacuacaaaaauuagccgggugugguggcgugugccuguagucccagcuacuagggaggcugaggcaggagauuugcuugaaccuggggaggcggaggcugcagugagccgagauugcgucacugcacucuagccugggugacagagcgagacuccaucucacaaaaaaaaaaaaaaaaaaaaaaaaaggaagcauuccuaaaaauaaaucuaaaaaaccauucuggacaaagaacccuaugcccaucacacacgaagacgugucugggcuaugcccguuggagucagcgucaguggagaagcaugcccaggguaugucugaggcaggcaaaugcaucucaggcauuuuaaaaauaccugaacaacugaaauaaucuaaaugcgcccaugaugccaguccugcagagcuggccccacacagcacugcgaggugugugcugucaggaggugaacaaacaauggcagcugccguggcgccgggcagaccacauucccacgggaacagcaggccugggagcagagcaggcaccuaccacagccguccucugcacaugguggucgucagccggcggagacucggcccacugcagugccagcgcugcugcagacacgccuggggaacaaagcagccccggccccugggucuguggcagcgagguguccgcccugucccccagggaugugucggcacugcacaggcucagggcuccugaguggggugucacggggaggcugggccagggcuccaggguccaguccuuccugaggaccucaggggagcuccaggaagacagguccagcaucccgaccgggcucuuccggggcccagccucugcaguguggcucugguggcgggagccaccaaguacgcuggucggugaagaaagagacauguccugacauucugauuuuucuugaaugggagaaucuggcauuucaucugguaucaaggaaucccaauuuuugauaacaucaguuacacccccugggguuguauuggcaucacacgcgucuauggccugauuuuugauaacaucaguuacaccccccguggcuguauuggcaucacaugugucuauguggggugauaugucaggcucuucuccgucacaggaaucaucacuccagcugcucuccaacaggugugcugaggccaugggccacagagauuuggugucggcagcauccacauucuggaaggucauggaauacagcaaacgguucaguuuuuccugaagcuguuucaccugagcuacgagaucgaccuucggcagcugacaaucuuccaguacuuuuucuuuacccugcaggugaaacagaacaggugcacgguggaauaccuggcucaccaggagucgcaccugucugguguuaaugaguggauuucagggaguuucggagcacucgggugauuccacaaugagcccugcacauuucaaguuuauuuaauucuaugagaaacagaaccaaggcuuacaucuccuugcuuaaaaggcaacugucauaaccuauuucugcggugauugaggacacaagcuucauacaagggaaaaaggaugggaagguucuauaucugagcaccgaaaacacaaaauugugguuuaugugaugaauuuggaguuucuguguguguaacuucuaagaauuuggcaggcagggcugagcuuucucuuaagaauucaaaaaauugggccgggugcaguggcucacgccuguaauccuagcauuuugggaggcugagacagguggaucacgaggucaggaguucgagaccacccuggccaaaauggugaaacccugucucuacuaaaaauacaaaaauuagccaggcaugguggcgggugccuguaauccuagcuacucgggaggcugaggcagugaauugcuugaacccaggagguggagguugcagugagccaagaucucaagaucucgccacugcacuccagccugggcgacagagcgagacucugucucaaaaaaaaaaaaaaaaaaaaaaaaaaaaaauucaaagaaacguuccugucaugagggccccaagacuguuugccgcaggagaugcgaagggcucuccacacaggauguauuucccgagagcacaugacaagcacacgaaccagguucaugggucuccucagaacugcgggccuaggcccauccuucccugauuucuguggaauuaagaaucuuucaggcucuaaacgccaaugaggugcacgcaguguggacccaggaacaggcggcaccugcacucaugcaagaaacgucccagcgacgugcgggacacucacgagggcugcgaggggcucgggugagcccaggucucagcaggcuucagcaccaagcaugcuuccgugccacccuagagaccauaaaacaccugcccagcacuucugguguuagagccucuggguuucagagccuggaggaguaguuggggcacauuuagcaaacagcagggaggagggggaggaggaagagcaggguggguggcuguguguccagcaggaggaggguaggugucuguguguccaggaggaggaggagcagggugggcggcugcauguccaggaggaggagagugggcggcuguguguccaggaggagggugggcggcugcguguccaggaggaggagggugggcagcuguguguccaggaggaggagugugggcagcuguguguccaggaggaggaggaggagcaggguggguggcugcauguccaggaggaggagagugggcggcuguguguccaggaggaggaggaggagcagggugggcggcugcguguccaggaggaggagggugggcggcugcauguccaggaggaggaggaggaggagcagggugggugguugugugucgagaaggaggaggaagaggagagugggcggcuguguguccaggaggaggagggugggcgacuguguccaggaggaggaggaggaggaggguggacagaugugugucccagaggagaaggaggagaaggguggguggcuguguguccagggaggcugcgcugggccuuggacuggaggaggcgaggugcagacagugcaucaaaaggugccaucuaaggcugggcgugguggcucacgccuguaaucccagcacuucgggaggcugaggaggguggaucaccuaaggucaagaguucaagaccagccuggccaacauggugaaaccccgucucuacuaaaaauacaaaaaucagcugggugugguggcgcaugccugcagucccagcuacucgggaggcugaggcugcagaaucacuugaacucgggaggcagagguugcagugagcugagaucgugccacugcacuccagccugggcgacagagcaagacucugucucaaaaaaaaaaaaaaagagagaaaaaaaauaaaggugccaucugcaccugaugcggccugaggagagggcagcuccugcgcagguguuuccuaggggcacuggggaccugccccuggugcacugggugggagaagcaccagcacccgcuuuucucgcuaaaucuccacccugcuacaauuugagauggucaaggugcaaccuccuuccccggggaaaagaagugccagcuuuuuuucaagugacaauauggagugaggugaacagauuacaagaauaaaucugaggccuuucaaaguaaaacagacgcuggccaucaaaguccugagcugaggugaggcccacgggggcgaugugguccucccaugaaaagacaaaccaggacuaacccucgagcacaguuaaauccauuuggaucaauuacaagaaaaaaacccaacugauuguuucuacagaguggcuuaaaugaagcacguacgaaauuucacaacaguuauggacagcucguuacagaacagaaaggauucagagaacaugucacugcaggcacggacugugcuccucaccucagcagaauacccgccucugcccagggcaagacccacauguucugcacccagccucucccaggggggccucacgccuuccccccuccccacaccuugcugccgcguguccagccucucccgggugggccucgugccuuccccguuccccacaccuugcugccgcguguccagccucucccaggggggccucacgccuucccccuccccacaccuugcugcugcguguccagccucucccgggugggccucgugccuuccccgcuccccacaccuugcugccgcguguccagccucucccgggugggccucgugccuuccccgcuccccacaccuugcugccgcguguccagccucucccgggugggccucgugccuuccccgcuccccacaccuugcugccgcguguccagccucucccggggggaccucgcgccuuccccccuccccacaccuugccgccguccuccagacucaggcgcauuucauuuuucaccaagagcagcuccgacugcagcugccucuggcagacggugagcacugacaucacgccuucuugcuugcagagaggugcauccuucaacgucaccaggacaggcugcagaucacccuugacagaggagacagaggaaagcugagcaugcaggaggcuguugcuggggcugccccucagguggccuggagcugggaaccaguacggcagccagcagggaugccagagggagguggcagugacauccacagccgagcaccuugguccacagcaggccacaugggaacggggcugaggacccagcagaaagcugccccgacccaggacgaccccacagagcaagguggacuggggcaucugagagugggagccacucuacaaagacccagcuggugugggggugguaggcaccaaguucccaagguucugcucaaauacaaguggaagccuuaaaagacgacucccuacagggccuccagcuccaaaagaagagcucgcucgccacaucucacacaggcacugcucaucgacagacaaaccauuugguuagaaaccagagaagcagcuuaagcggacccuccucacauagugagcuccguuucacuggacagucccuauuaugugaaagaaagaauuguuuuuaaaagcuuaaaacgauaagcuuaaaaugguacaaaacagugaaauccucagcccagcuucacugcguacugacacggaacaggcccaggcuggcccgagcuucaggcccccuuucuccgcugugucaugagccaccaugacaacugcagcccccagugcccagcgcagagagaagucauugacaucaaaggagaaaaggagaguaaaaaaaaauacccugccauggcccgcggggggagcccaccugugggucagggacaaccggcuccaaagcagcaucaugggaggccuccacgucgccggugaccugggccuuggcgccaccauccaugcgaggcugugggugggccccgggcacccgugugugagcuguggcucugcgggccugccgccuguccagcuccaccuggcaccucaggaaccgcuggugcagcaccugcagcuggcggcugaggcgggcacacugcgcucggagccacugcagcucgggaggcgccgccccggcugccaggggcugcugcuccagggcgcggcggaugcgggccaaggccaacaggacggccuccagcucggcagagugggccgccuuccgcugguucagagcgucgauuucuaaauuucucucggcaaucgucgcuuccuuugcuuucagggccgcuucgaacuccuggauccgggaggccaugucuucgaccucagccucccugagggcuacauugcgcuccagcucagccagcuguagcuccgcagccuccucugcgcccuggaggcgcugcugcagggccuccagggccuggcugugccugcgcuccuggucagccagcagccggcucagggccuccuuggcuuccagcgcagccucgagcucgcccuguagggccugcccacgagggcccccggccugggagcagagcagcucgcucugcagacugccagccugacugucgcugacuucgugcaccacaggccccaugagggacagcucgugcugcagcuucucaaugacuucauggaguuguucaauuuccucugcuuucuccuuuuguaaucguuucugauucucuugcagauuuucaauaguggcuuucagcucuucaaucucagaacuucugguauauaugaccugaagagagaggacauuucagaggcaaauuaaauguauccacuuccgaaugucccuacuucagggcacguuacauccugaaugcauucuuggagugaagacuccauagcgugaaaaacaaagcagccauagaagcaaacugcuggugccggaugcacuccacacccaccuuggcugccacugggcccuggugcacaccuugugcuccacgucugaucgugggacgaagcucuaaugcagucauuuuccaugcaaggacaucuacagaaugaugcuuucaccacccuuuaaauguuauuuuguuaauauuuaaacaacuuugauuuguuugauuuuccugaaggugcauuagauuuuaggugucauucugacuccaggaggaaaguaagaaaccuaggcagagaaucugcaccaacaaagcggugagccgggcacgcuccccuuccaucccaacacugcucguggugacgcuggugaugaggcgucucugccacugccacucggugacaccaggcaucgaagugaguuuacuugugccaugaaacauaauccucagccauguaaggaaauacgauuguuuccacuuuaaagacaggaaaauugaaacugagauauuaaacaucuuucuaaacccauaaaaacaguaaguggaaaauuaggauugagauguaugucaauauagcuccaaacucuauucucuuaagauaacauuccugguaaugacaaaaaauagaaaaauucuaauccauuugugcucuaacaauuuuaaaacuauuuguuauagacuaauauguucuuccaaaaaacugaggguuucauaacaacuccagguuucucuggaacuaccucacaauuacucuggacucaaaugcaaaucuggccuacagaaaaaaaacaaaggaaccggaugaaccuguggcuuugguuuggacgcugucaacaacaccuuccuaugcauuuaccaccgaugaacaacaccaugcauuuagcaaaagcagccucccagcugcgggcuaggaaugcccgcugcacauucugcuccccgucgcgugccuuacugugugcggcaccggccguugucucuguacucuacaggcacgcgaaggaauuucgaggacaauucugauuauacgcagcuucugcucauucccuaaaugcacuaaauaaacuggaaucaaggggugcgcacugaagacggucauaaucacaacgcauauaucacguuaaaauacuggagccagcauacgaagguagcucuaaauguaaaacaccaaaaccugaaaucagugaacugaggccgggcgcgguggcucacgucuguaaccccagcacuuugggaggcugaggcaggcagaucacuugagcacaggaguucaagaucagccuggccgacacggugcacccuggucucuaguaaaaauacaaaaauuagccgggcgugggcaccuguaguuccaccuacucaggaggcugaggugggagaaucacuuaaacucuggaggcagagguugcgguaagccgagacugcgccacugcaccgcagccugggcgacagagcaagauagugucaaaaaagaaaaauaaaaagcaaaaagcguaugcaagcauauucaaggagaccugaaugcaaaguaaaacuaugaaauuucucaggaaaauugggcuagggaaagagcucucagaacuucaaaaguauaaucuggcggggcacaguggcucacgccuguaaucccaacacuuugggaggccaaggcaggcggaucuucugaguuaggcguucgagaccagccugaccaacauggagaaaccccgucucuacuaaaaauacaaaaauuagcugggcauaguggcaggugccuguaaucccagcuacucaggaggcugagacaggaggacugcuugagccugggaggcggagguugcagcaagccaaaaaugcgcuacugaacucuagccugggcaacagagagagacucugucaaaaaaaaaaaaaaaaaaguaaaaaguuuugcucugcaaaacauacuguuaagagaaugaaaagaccagccauacauugggagaaaauaccugcaaaucauguaucaaaaaaaagcguucaaaagauauaaagaauucccaaaacaauaagaaaccgaacaauccaacuuuuuaaaacuuucugagguggggcacgguggcucaugccuguaaucccaguacuuugggaagccgaggcaggugggucaccagaggucaagaguucgagaccagccuggccaacgugaugaaaccccgucucuacuaaaaacauuaaaaaauuagcugggugugguggcggcgccuguaaucccagcuacucaggagguugaggcaggagaauugcuugaacccaggagguggagguugcagugagcugacacguucccgcugcacugcagccugggccacagaaugagacucugucucaaaaaaaaaaaaaaaaaaaaacuuucugaaagacuuaagcaaacauuucccccacaauauggauggcaaauagcauagaaaaagaugcucaagaucacuagucauuaaggaaauacaaaacucuaggauauaccacuacauaucuaccagaaugucuagaaaaaaagacugaccuuaccaaauguugaugagaacgugguuacccggaacacucaucuauugcugguggaauguaaaacgguagugcaacuauagaaaacaguuugacaguuucuuuuaagguuaaauauauacuuacacaugaaucagccaugcauucaguuuaaguacugaaccgaaagaagugaacauuuauuuucucccaaaaagcuaugcaugaaaguuuaugguggcucgauucaucacugccaaaaccuagaaacuauccaaaugucccucgaugggugaauggaucaacaaacugugguccauccagacaacaguacucagcaacuaaaggaacagacacaggcgacagcaugcaucaauuuccagugcauuacaacaccugacucgaaacagaauuccagacaggaagacagcaggccugauggguggccacaaagaaacagcacaaagaaaauuuuuugagugaugagauuguggugauuauuacaggacuaaauccuuuuuucaaaauuuauaaaacuguauacuaaaaaaaacuaauuuuacuaugcacgaagucuaaaaacaaaaaacuuaaauuguuauacugaaaaauaaguaucuauaaucaaugaccuaagguucuaucugaaaaagcuagaaaaagaagagaaaauaaacccaagguaaauagaaggaagccaauaaugaaaauaagaggagaaaucaaagaaauaaagagagaaaaguaucagagccaaaagcugauucuuugaaaacacugacaacauggauaaacuacuagcuagacagacucaagaauaaaagagaaaacacgaacucacuaauaucaggaauaaaaggagggccaucagcauaaaaccugcagauauucaauggcaaguaaggaaaugguuaauaaggugaacaguuacaaaaugagaaaguauagacugggcgcgguggcucacgccuguaaucccagcacuuugggaggccgagucgggcggaucacgaggucaggagaucgagaccauccuggcuaacacggugaaaccccgucugugcuaaaaauacaaaaauaauuagccgggccugguggcaggcgccuguagucccagcuacucgggaggcugaggcaggagacucacuugaacccgggaggcggagguugcagggagccgagaucgcgccauugcacuccagccugggugacggagcaagacuccgucucaaaaaaaaaaaaaaaaaaagagaaaguauaaacuucuuuaugcaaagaaauuugacaauuuugaugacaugcacaaguuccuugaaaaauacaacuuaucacaacaugaaacagaaauccaaauaccucagucuguuaaagaaaauuaauuaccaucaaucucucuagauauaaaacuccaaauggcuucauuguugaugcuaugaaaacauucaaagaagaaaucccagcuauguuaaauaaccucuuucagaaaagaaagugaaaaaauucccaaucuauuuuaugagacuaacauaaccuucauacaaagccuuagggaacacugcaagaaaagacaauuaugcaccaacaucccucaugaacacagaugcaaaaaccauuaacaaaauauuagcaaaucaaauucaguaauaucuguaacauaugaaaagggcaguacaucacuaccagguaugguuuauccuagaaccgcaagguuaguuuaaucuccaagaaauaaaucacucaauaaaguuaaccuuauuaguagaauaaaagagaaaaauaucaucacuauuucaauagauccagaaaaagcaaacuagaaauauaacagaacuuccuugaucugauaaaaaggcaccugugaaaaaccuaaagcuaauauacuuaauggcaaaacacugaccacuucccuguaagacaaggagcugggcaaagaugacugcccuagccaguuuuaacuuuguacugggagugcuagacauuguaauaaaagaaggaaauaacaaaaauuggaaagaaauaaaacugucuuuaucugaagaugauguuaucuuauacauaaaaagccuucaggaauccacaaaacgcuacuaauauacauaaauugugcaagguaacagcaagguuaacauacaaaagguguauguguauucacgguaaacaacuagauaauuauuuuaaaucucacuuacaauagugcaaaaaaccuaaaauauuuaaggauaaauuuaacaaaagacgugagaccucuuuauuaaaaccuguagaauaagggagaaguaaaugguaaaauuaaagaaacaucacuaaccccagaguuagaauaagccacacagggagggagggcccacauugaggaugagguguuaggauggcuggagccccggaggacggcaguacagaacaagugacaacaaccacgaccacgccagggagacgggagcuccguuuccccacaaguguaaaagacgcuucuagaagacaaacaucuucacugacauaaaauaggguagaauacagcaaaugugguuuccuugaaauaacuggaaaccuaacaagagucaaaccuuuaaauggaauuuuacuuuucuuuauuauauaaagcaaaauagcauccgcaucuuuacaaaaaauuaggagaauuacagaaaaugaaggauguacgaauuugcacauaucuguaagaaaaaucccacaagaaaauauuggggauuguccuuaaaaagcuuucaauucuuaauggaacaaaaauacuguccuuaacauguaaacuauuuuuuauauauuuuucauuauauaagauuauaguuagaggucaaguucuagagcacuauagacaaauaauacaacuucuucugaaaaguaaucaaugguuuuuaaaggcauucuuuuuuuuuugagacgagucuugcucugucgcccaggcugcagugcaguggcgcaaucucggcucacugccaaccuccaccuucuggguucaagugauucuucugccucagccucccaaguaaccauuagaggcaccggccaccaggcccagcuaacuuuuguguuuuuaguagagacgggguuucaccauguuggccaggcuggucucgaacuccugagcucaagugaucugcccgccugggccucccaaagugcugggauuacaggcgugagccaccgcuccuggccauaaaaggcauucuucaauguaacccaaaaggcuauuuuuaaauuuuugccaaauauacaagauacaaucagauacuaagacagauaacaucucaguagccucugucaaagggaaauuaaaagugacaaacuggagacaaacuucuccuuacuucuaugguccccuccaaaauuauuuuuuuuuaggcaggguccuguucugucauuacagcuggauuacaguggcaugaucacagcucacuguggccuuggccucccaggcucaagugaucuuccuaucucauccuucagaguagcugguacuauagguguaugccuggcuaaauuuuuuaaaaaaauuuguagagaugggucucauuacguuguccaggcugaucucgaauuccugggcucaaacgauccucccaccucagguucccaaacuccugggauuacaggugugagagccacugugcccggccauaaaguuaauuuuguuuuugagacagggucuugcuuuguugcccaggcuggagugcaguggcacaaucacagcucacugcauccuccaucuccuggguucaagugauucuccugccucagucuccggaguggugugucaccaugccuggcuaauuuuuguauuuuuaguagagaugggguuuucccauguuguuuaggcuggucucgaacuccugagcucaaguaacccacccuccucagucucccaaagugcugagaauacaggcguuugagccaccgugcccaacugauaaaauuaauuuugaaaaguauuauaaauauuguaugaggaaacagaagacugucauccuggaaagccaaggccccagucaaucacacccagaaacuaugaggacuucguacaggagacgcaggcguagccagaagcgugagaagagccccuucucccccagcaccagggaguggcguaccucgccgagguaaaccugcggugccuagagcugcucguucacacgcacuaucuccucuucuuuguugggcagaaaugccgguggaaaugguaauaacaacaaccauaucaaaacagagccgacagaaccuuaauagggaaauauuccacugacccuacagauaugaaauguccuaauuaaauaagccuacaguuuuaaauuggaaaaauggaaaaucaauuugaaaauuuuuuuuguuguuauuguuguuguuuuuugagacucucccacgcuguguucacucagggagcauucccacgcuguguucauucaccgagcacgcgccacgugggcaccacacacacacaauucucccacgcuauguucauucaccgagcacgcgccgcgugggcaccacacacacaauucucccacgcuguguucauucaccgagcacgcgccacgugggcaccacacacacacaauucucccacgcuguguucauucaccgagcacgcgccgcgugggcaccacacacacaauucucccacgcuguguucauucaccgagcacgcgccgcgugggcaccacacacacaauucucccacgcuguguucauucaccgagcacacgccgcgugggcaccacacauacacgauucucccacgcugaguugauucaccgagcacgugccgcgugggcaccacacacacaauucucccacgcuguguucauucaccgagcacgcgccgcgugggcaccaaacacacacuauucucccacgcuguguucauucaccaagcacgugccgcgugggcaccacacacacacgauucucccacgcuguguucauucaccgagcaugugccacgugggcaccacacacacacgauucucccacgcuguguucacucaccgagcaugugccacgugggcaccacacacacacaauucucccacgcuguguucauucaccgagcacacgccgcgugggcaccacacacacaauucucccacgcuguguucauucaccaagcacgugccgcgugggcaccacacacacaauucucccacgcuguguucauucaccaaucacgcgccgcgugggcaccacacacacaauucucccacgcuguguucauucaccgagcacgcgccgcgugggcaccacacacacacaauucucccacgcuguguucauucaccgagcacgcgcugcgugggcaccacacacacaauucucccacgcuguguucauucaccgagcaugcgccgcgugggcaccacacacacacgauucucccacgcuguguucauucaccgagcacgcgccgcgugggcaccacacacacuaauucucccacgcuguguucauucacugagcacguguugugugggcaccacacacacgauucuacacaaggucuuucaagggcaucugugaaguuaugaaugcucugcaauuuugaauaucaucucuacuauaaacagguugguuuugguuuucuuuuuugcuucaaaagcacggcuacauuaaaauaaaagauuuaaaaauagauuuuuuaauauacaccuacuauguacucacaaaaauuuaaaaaaaaauuuguucuuaagauuuuuuucccaucaugccagugggaagagaaacagugaguagccacuuacucaagucaccuccuugagaagagcaagccaccaacagcccaauagcuucacgccucucacagcccuggggugcugcccuagggaagugccucuccucagaucccuaucagugcugcaaucagaaagcaguuuggggcaggggucgcugguuccucacucaagaucccuagaaagcugcuuccaugcacauguccccaggcagaaucgggcgcucucugcacugucugccacaugggggccacgggcgucugugaagaccagagacucgccuccccgaugagggucuugguggccgcucggcaccggcauaagcaacaugaacucgggcgucacguggaccuuugguagcuuaccuucaagcucguguucucuuccucaaguucucugaggcugacagcagucuggcuguucugcauguccaauuuuaaguucagauguaguauuucuucauuuuuacuuucuaagucaccuuucaucuuuucuagcuguucuuuuaaguccaaaaccuuucauuaaaacaaaagaagaaaaguauuaaaagucaucuaauauucuauuaauauuaauaauuaagacauuauuaaaauagcuuugagauauuuaaaugcacaugccuaaagcaauuacuacccuguaccuguacccgcacacaaaugguaaaacugcaaagaauacacaguggucaggcugggcaugggcucacgccuguaaucccagcacuuugagaggcucaagcaggcagaucacccgaggucaggaguuggaaaccagccuggccaacauggugaaacccugucucuacuaaaaauaccaaaacugagccgggcguggcggugggugcaccuguaaucccagcuacucgggaggccgaggcaggagaaucgcuugaacccaggaggcggagguugcagugagccgagacugcaccauugcacuccagccugggcaacaagagcaaaacucugucucaaacaacaacaaaaaaaagaaaagaaaagaauacacaguggucacaagcccaucgccuguguuaucuggacaucggaucugccacagagaagcccacuggacacugacccagggcuggcagucccauggccccacucugcacucaccucgcucucgcgccgcaggagugcucucugugucaccucuaacuguauuucuggacccucaggagggcugcccgaaggaggcucgggacaucugccugcaucuaguguagacugcaacguggacgccagaagcaagcuacucaucugcuguuucuuuaacaccucuuuauccuauuaaaaaaaaaagaacucuauuuuaggcaaauauuugggaauucaguaccucaacugcugccuguuaaagcacagaccaucuuuagcugcaccugaagcagagcagguggaccugcacgccccugcacucagugacacaccaggcaacacuggcacccaggacccagccaccucccagcagaggccugccuggugcaggacgugacugagagccacagccugugcccgaguccacugugaggaauuuaucuacaguaauauucaccaaacuauuaccaauauuuucaaaacugacaagaacuugccaaaaaaaauagggcaauggcugaugguaugcucauauaaugaauauuaccugccuagaaaaaauuuuucaaacaauauuuaauaugacgaaaauggucacaauacguuacaugcgcaagagcaugacauauaaaauugcauacacaguccaaauuucacgaagggauaaaaacacauuuucuaacccuggcaucuacuaagcucaguaaacguucgcugagugaaggcagaaggggugaagccgcccuggagcagcugucacugaaaugugugcaguggccggccagggggacaacuccgcuccaagugcaggugaugcucagcgguccucccugcgacagcggaacggaaacacgucagggccugaggaaaggccccaguuuaauaauucucaucagcacuuacgagaaucagacacacuuggccgggcguggugguucacgccuguaauaccagcacuuugagaggccaaggcgggcagaucaccugaggucaguaguucgagaccagccuggccaacauggugaaaccccaucucuauuaaaaauacaaaaauuagccaggcgugguggcgcgugccugugcucccagcuacucaggaagcuaagguaggagagaucgcuugaacccgggaggaggagguugcugugagccgagauugcgccacugcacuccagccugggugacagaacaagacucugucucaaaaaaaaaaaaaaaaaaaaaaaagaaucagacacaccugagaaagacuccuccucucaucugugucugaggccaaacuacuaauucuaaaaucaaauuucuuacugagccucuuuucaaguaaccuuuuaaccucauagaagucagcugaauuccuuuuagcuaaaugcucacaauggagggcacagccgcuacccagaaaugcagacaggcagcccugcccccuccagccaugagauggcccaccuggcucagugcuccagccccucuuuaaacucucagacacaaacgaacacacacaacacggcaaacaccagcaaugcaaaaccaucacuggagaucucuucacugggagcugacaugaguuccugagcucaaagauugaaacaauuacaaggggcucucaucaaaguauuuaauaagcuaagauuuuuuuaaaccuaaaaucuuaaauguuuacuuuaugaaauauuaaggauaaauucagaguucuugagacauaaagaaauuguauaaauccuacuacaguaaauaaaaucaacaaucuccagaaaggucaaaguacucuugcuacccgucaccaaugacuucuguuucucccugacgccaguguuucuggugcagacgugguggcugccagugaagaaggacgcccugcccacucccugccagcucagcgaugaagccaugccugcgggacaccucaccacgugcccaaccacaacauggagacgcuuuaccuguuccagcccuuucacgauguuuuucuguuuuuccacuucuuccuggagcugggccacuuuuuuccugauguugauguucaucuccuccagacguuuaauuucuucuuccugcauuaacacuugucuaucugccgacucuuucuguauagccaauucauuaaauucauccaacuuuucucucaacuuuuguuguaacaacucaaccuaaaacaacaaaaaaugcuugaggaauacaauagaauguuuuauaaaaacccauuuuccaaacaaaaaaguacccaaaacaacagagacaaaauagaugcccuaugcccuccccuagacccaaagggagaccuagacucacaggcugcacagggagacccagacgcaaagacugcacagggagaccuagacccacaggcugcacagagagacccagacccacaggcugaacagagaccuagacccacaggcugcacagggagaccuagacccacaggcugaaaagagacccagacucacaggcugaacagagacccagacccacaggcugcacagggagaccuagacccagaggcugaacagagaucuaaaggaaguauagggugauguuguguuaagaaaggcauucucuauaauacagaauuuguuaggaaaaugaaaucuauucugauagaaaagaauggaauacuacagccggcgcgguggcucacgccuguaaucccagcacucugggaggcugaggcaggcagaucacgaggucaggagauggagaccauccuggcuaacacagugaaacccugucucuacuaaaaauacaaaaaauuagcggggugugguggcgggcaccuguagucccagcuacucgggaggcugaggcaggagaauggcgugaacccgggagguggagcuugcagugagcugagaucgcgccacugcacuccagccugggcaacugcaugagacuccaacucaaaaaaaaaaaaaaaaagaaaaagaaaaaaaaagaauggaauacuucucagcaacauaaagaacaaacuauggcuacacucaguaaccuggaucaaucuccagagagucaggcucggugaauggugucaaucccccaagaugacaggcacgcuucacccaucaggaagaugguaaaguuuuagaaauagacgacagaugagugguugcccgagaaaggacggcggcauggccgugacccaguacacgaggguccguggggggcagaaggcacugcagcgucaccagaucccugcccauacuggcugugacacugcauuccggcucuguggaugagaccucuggggaaccacgugccaggcacgagggauccgagucuuaccucuuacaacugugugugaauccaccauuaauuuuuuaaaaaaauaaacgaaccuacuacagcuuccucagacaagagaaagcagauggcugcagcccaaacaagagcaagaaaagcgaguggguggcaggacagucccagcgagcgcaggggagccugggcgccagcgcagggagugcccaucucguugacgccuccucaccucuccauccagcggcgccugcugccgauuucauguacauggaaggcaaaaauuuaaagaaaguuaaagcuuaaaaacacagugaaagacagcaaccagcagcacugcacgcugcacugacucaccuggcugucgcgagggccccagggcugcggcuuggccgccuggcggagcugccccuccagccucugaaucuccugcuggaacuccucgcgcucgugcucccgcucggcugccugcuccugggaggagaggcagcguguugggaccaccccaacggggcuggcgugccccuugcagcgaagguccacccaggcuuccacugcacguacaagugcaacugcccagcagcucagacuccaaauaccccccucaucacagucacuuuguaaaauggaguuaaguaaagaaaaacagcucucugcauggaacacagaggaacgucugagacuggugggugggaggacaagaaccagugagagcugcagcacaggcccagcccgggccccaagugacgccuccgugacugugagaaggagcauggcaagaccaugggagguggcccucagagggcugcgccacaacaugugggcaagaagacacccaccaagagucagcgaccugggugcaccugugcagcagguguggggcgcccucuucaacauccuacugcagaagcuuacguaacgaucuggaaagaaguucaugcuguaacggcaacuuuuagugaugcaaaaaaauguauuauucagaauucuuacauccaugaauugccgcugguugcgcaaaugcuuguccagagaugccaccugcuguuccagggcagugacggccuccgccugcuuggcacacccgcgaugcugagacagcuguucuucuaacucagacuccaaaaucuucaucugggagagcagggcugagcgguccuucucagccugcuuccuggucuccgacuguucuuuggucagauccuccacuuccuuccggagagcuaaggaugcaaacaggacagacacggggacacccccgcaccucagaggcuggugcaugacacgugcaucuccugauggugauucagucaaaacccaccgaaaaugaagucacuucaauucgggguaaaacgcccaucuuuuaaaacaacauuggcuaaagcaaauuucugaagccugagaagaauacuucugagugacaugugggugauucucuaggaauucugccuucaguacagucucccagacagaaacacacgacuaagcccagucccagcagacgacggacggugcugagagccugggguugugacgugucuaggggaaaggcaaacgccccaucgguaaaucaaaagcgaaucuaggucggguggggugguucacaccuguaaucccagcacuuugggaggccgaggcggguggaucacucgacgucaggaguuugagaccagccuggccaucaugguaaaacccugucucuacuaaaaauacaaaauuagcuggacaugguggcgugugccuguaaucccagcuacucgggaggcugaggcaggagaaucacuugaauccgggagauggagguugcagugagcccagauugcauugcugcacuccagccugggugacaaagugagacuccuucaaauaaauaaauaaauaaauaaaauuaacuggguaccacaguuuaaauuucuguccccuccaaaacucauguugaaauuuaacugccagagugaugguauuggaagggccuugaaaaggugacgaggccgcaagggcuccacccucacagcaguuuuaaugccucaauaagcggcuuugggagugguccucccacucggcccuucugccucugccccaggaugauccagcccuccacuccggaggauacagugugcaaggcucugccuuagaagcagagauggguaccucaccagacaccaaaccugcuggcacccugaccuuaggcuuucuagccuccagaacuguaagucacaaacgugugucugugauaaaucgccuagccucaaaaauucucuuccagcagcaaaaccagccugagaccuggggugcgaagccccggcccaaguggaaacugcagaugaaaaagcgucuuggaaaaaggggcucucugcugcuaaguccugaagccuccauuuuauuauuauuauuucugagauggagucucugcugcugaauccugaagucucuauuuuauuacuauuauuuccgagauggagucucugcugcugaauccugaagucucuauuuuauuacuauuauuucugagauggagugccugcugcugaguccugaagucucuauuuuauuacuauuauuucugagauggagucucugcugccgaguccugaagucuccauuuuauuauuauuauuucugagauggagucucugcugccgaguccugaagucuccauuuuauuacuauuauuucugagauggagucucugcugccgaauccugaagucucuauuuuauuacuauuauuucugagauggagugucugcugccgaauccugaagucucuauuuuauuacuauuauuucugagauggagugucugcugcugaauccugaagucucuauuuuauuacuauuauuucugagauggagucucuguugcugaguccugaagucucuauuuuauuauuauuucugagauggagucucugcugcugaguccugaagucucuauuuuauuacuauuauuucugagauggagucucugcugcugaguccugaagucucuauuuuauuacuauuauuucugagauggagucucugcugcugaguccugaagucucuauuuuauuacuauuauuucugagauggagucucugcugcugagucccgaagucucuauuuuauuauaauuauuucugagauggagucugguucugggauuacagcugugagcuaccacucccggccugaauccugaagucuuuaagccacccaaaaacuaaaauauuaaauucauacauguuaacugacauuucaccagcuuccaaaaaaucauuuugauuuguaaaaguguuaagucuuuuaucacaaacuaucaugaccaaugcaaguaacauucucaauaaauguugaugccacugucagcaguuaacggcgaguccgcuguaaacaugcugcugcgguaacauucacaaccugagacgugcggcgaggccugagggcagcugcuccccugacugcacucccugggccuggacacgaccugggcugugcuuggcccagaacaucaccaucuucagggccaggggcacuggggcagggugccugcugacaugcacgcagacucagggaggcacacgaggaucgcaaucccagcuggcgaagcaggugacacccacgcugaacaggcacaggggauccagggggcccaggcccucccuggagaccagagcugggacccagcccaagaacagcuguaacuaucacaagacaucaguuucugaaaagcagcacaaacuguagcuuaggcacuguaguaaagaccguuagagaaaugcuccuguuuugcuggggcguuaaaaugggacaacuccacccauuuuuaugaauacugaagauuagaguaucgcuguauuuauuguuugccacaaaaggucugaaguacuuuucuuuaguaaauaauuugcaaaauccagugcaaacaaacagcacgucacacacaaaucaaucguuugucuuuacaaaccugaguccuugugugcugcagugacagcugugccuaugaacaagaguuugcguuuacugagguggaaacagaaacgugcagcugagaaugugagagcuagaaccagugacggcagcgucagcagcagggcucugggcaacgcugcuggccuugaacaaccuccagacucagcgcccaccaugcccacaacugccugugcggcugcaggcccaucaacuuuucaaggagacaaagagaacaaaagggacagauggcaacaccugaagagagccacaaaacaccacacagcgaagggggcgucacgcaacacggcgaggcagggccgcugcacaccagggccggguucacgccaccgucagagccuaggcccugccgggagaguggucagggccgguagcuggcgcagagucacacaaccgcagagccagggugaaaggaaagaaaacaaaccagagugagaaacuagggcaggguuaaccaugucgaaaggaaagcaaacaaagaggaccccagagaaacaacgagaauuucccagugacaaaguuggcccgagccugcgaaagggcuccaugagauccacucccggcaugccaggcgccugccacugcaaggcccaugguaagccucagcuucaauccuggggccugcagggagcccagccaggcuauggacacccagggcccacauccaccugucacgacacucccuggugggccaggcuuuguggcaggagaugaaccagaggcaaggcagcagacgggccaccacagccuugggaagaagcccugcagugcucagacccacgugcucaggcccagggcacgacacaggcaccugacacgggggcgcuagccacagggccccggccucaccgggccguucaacagaaugcaggccacacaccccuuuaucugcccggaggccugacaaacgaagugacuggcugaaguccaagggcucgaggugaugaaacaccagguggucucccccggcgggguguggcccagcgccggcuggcugggcgcgaagacacuggaaauggggcagcagagucuacagggaggggcccgaccaugaggcugcccccggacagcagaggacaagcagagaaagcaucggagaaacagcgacaacggacgcccagaugcaacagcaccgccagggcaaagaugcugagagcgaugcaggacgucagagacguuccugaaaacacccugaaaaauccugaggagaugcaggaaaacgagggcgucaaaggaaaagaaacaggaucucgagucaugucuccagcaccacuucacugguggaggaagggaccugaagagacuccaggcccuccuggcccuggagguucccccgcacucccccuguggacacacagagugcgggggcaacagggcuuagaggcccguggggagaugacgccgcccugagcccggcagcaggcaacaccgcagugaggacuucacagcuggccaaggaaaauccacccccgagcaagggcccaacgccaggaggugcggcaaauaaaacuuggcuaaaugacuaaaagaagauacucacagacaggcuuuuaaaaaacagucaugaauaugguauccauacaaggcacaacuaaaacagaguauuaaaaaagacuuaaaauaaaaggacaagaaaagauacacgaggggaaaaacaccaggcuaauccuucagcaucagaaauuuauauaaaaaauagaacgggauaaacgagaaugacagaaaugaaccaagaaaaggagaggacaaagugugggcacagucauaggcagaguuuaaaacaucccgugggaccaaugucuuccacccuggaaaacgcccccugggccaaagaauuauaagcuugugggacccagaugucaacacgagcaccacagguggaaaggcuggggcaccacgaggaggcacgaccugaaccccacauccugugaaaggcagcaaacauguccaaaagcguccaacccaacgaaggcagugagaaaccauaggagcuggccgggcaugguggcucacgccugcgaucccagcacuaugggaggccgaggcaggcagaucacuugaggucaggaguucgagaccaggcuggcuaacauggugaaaccccaucucuaccaaaaacauaaaaaauuagccaggugugguggugcucaccuguaaucccagcuacuugggaggcugaggcaggagaaucacuugaacccaggaggcggagguugcagugaacugagaucacgccacuacacuccagccuggggacacagcgagacuccaucucaaaaaaaacaaaaacaaaaacaaaaccauaggaacaaggaaucacacgaacaagggcaaaaaucagcaagacagaagacagcaaaugagaauggccacaaaaaucaaaagcugguuguuuucuaaagagaaaaauguaaaaaaauaauaauaauaauaaaugagacuucugaauuggcugagguggugccugcgaugcccaagcuucuaacuccaaucuguguucugaagggaugaccccgaggccacggccauccuggaaggaacuuuuagagaagcgcaggccccucugccucccacgugccugagaugcacgaaugcaaugugaaaagccuuugcucgagcugaaccagcuacugaggacgcagcucccugcaggcucgacauuuuaaacuuauguuuugacaguuuucauuuuaaauaccuuugagacuaaaauaucuaaaaaucugaaaagauacaaacuaauauuguuaacacuauguuuuccuaaugaggguuaauaucaggcacuugguuauuuuaaaugaaauuuuaaaguagcucuuguuugccgcacucggcucugccuccagcugcugcuguuggacucagagccccucuuauuuccaccucacagagguggggacccuccaaccagcaggaccgacagacaacccgccuucucugaaagggcagcaaagccaguggaugccucaccugauccgcacaagcuucccaugcccaguguuccaggagaagcugcgugcugguuuacacuugacccucuagagacacugaguguccuugggagcuggggaaaccguggcagcuguauccgcgccccacagcucgcaccacccuccacagcccgcgcuccuuaccagcuucucuggccucggcguccguggcuguggccuccccccgacuccacagacgggugcacuccucccucagcgccgccugcuccugggccgccugcugcagcugccgucucaggcucuccagcuccagcaccagacggugcucggaauccuccuucccggccagcaccuccuucagaucugcugucuccaccuugaaucccucaaggguaccuuugugggagacacagaugcucugacaaagccaguccuggguguaacugaggagagccugcuuggaggaagggacggggccacugccccugagagcagcagagcuaagagccagcagcuuccaggacccagguguaggccuccaacagcccugcuggccgcagcagcucccgaccaccccauuccucccaaaccaugggugccucccauguuggcuuuguuuuuacauuucacuuuaaaaacccuauucugaaggcuuccuucccucagugaggccaggccugcuccccgugccugugcuccaggugccccgaggccucaugcugcucacccugagucuugugcagcuccagcgccagcucugccuuugcugcgcucuccuccuucaaacacuccagcagcuccuggugcuuccugacaaccugugcugucuccucauucuuaaaacuaaauucuuuuucaaaacgagaaugaauuuggcgugcuucuuccagcuguuaaaacacauuugcaaaucaaaacuccagaucaaaaauaacugaagccuacauuaagaccaagagaacgccacuucuacccccagacccuucaggccgucaccacccaggcagggccaggccagggugacgggaccugagcacaucucagccacccuccgagacacuguggccacagucuccaaugaggaccccuccucagccucccaguucagcccugggccccucucccuuccuccagacacuccccuggcaacuguguccagucuggggcucccaggccaucuacaggcugagacccagaguuaccucugaacucaaaacuuagcaaaaaagaauuuuuauuuucauuuuugagauagggucuugcucugcacccaggcuggagugcaguggugcaaccacaacucacggcagccucagccucccaggaucaagcaauccuccugccucagccuccugaggagcugggaccgcagacgcaugccaccacgccuggcuaacuuaaaaugaggucucgcuauguugcccaggcuggcugcuggaguccagggccaucuccaugaggccguccacggccaggcugaggcucuggaagacccuccggauggguugcucacacucccguacacuuucugggcucaugagaaagcuuucacacauguggcugcuaauuucagccacggaagacaucucugcacauucagacaaaguucuguccaacuccgggagggccacaucagaccacaucuccuccagcgccagagcuacaagaugagcucgugggcugaaguaggcugaagugaaccuccuaccuuagccucccaaagugcugggacugcaggagugagccgcugugccuggcugaaaaaaagaucuuugauugcuuuccguguauuccuacuuaaugucuuuuuuaauugucuaaaauguucuaaaacgguuacaaaaaauuuccuuucuuagugauaaucucuaaauaugaaaacacuccacauggaauugcaacagugcaugaaguaaagaaaaugggccuguuuauuauccaaauuaaacaaacagauucucucauucguagcaagcccacuuccucaaagaucugguucagaaaagccuccuccuuggggagaaacccgugcgagcgucguuggcaccggcauccaccaggcucguguggcaucaucagcuacucaguuguucacaucuccacaggaccccgggagccugggccucaccugccugcuggaguccagggccaucuccaugaggccguccacggccaggcugaggcucuggaagacccuccggaugggcugcucacacucccgcacacuuucugggcucaugagaaagcuuucacgcauguggcugcuaauuucagccacggaagacaucucugcacauucagacaaaguucuguccaacuccgggagggccacaucagaccaugucuccuccagcgccggagcuacaagaugagcagaugccggcacacgcggcucagugagcaagccggccgcggccauggcagccaagacgacaaggaagccacagaacucagaacgucgccccagccgagaugagucagcgccacguccacgggagcugacaaauuuagcccaaaccccggucucggccuucuguaagugcggaaacuagcaggaaaccaggacggcagugcucccaagggcaucgcccaauacggaggcuccucucagagagcuccaggaccacagaggggcugcaagcacagggcugggcagcuggucccggcacacucaccugucgacagggccaggccugcgcccgcgucauccaggcagagccccacgcgcuccccgauccggcuccucagggugacggcugcccucagcgucucuccaaacaaacccagcagccugcgcagggcguccuggagggccccucugagacaggagacacccaucaucaggcaagcuggucacggcauaagaacccccacccuggaugcugcugaggggccgcccaccaguuugcacaccucggcccacggcugccuguccccacggggccggaagacaugauccucaugcccaugugagcacaggaagcugaggccacagacaagacaaccacguggagcccacucagggacacgggcuuuccuaggugaggucuuccugaugccauuucugauguguaaaaggcaucacauuaggaacacggcaaacccgucccgcaggugugcgauguggccgcacagcgucaaucacccgggagcagcacacaggcuccgccccuccccuggagcacagggugcaccagccagccauuucacaagaugucuguccaacaccaagucacgccucagccacacauucacaggaguuguguggcaggaagaggauggugucucccagccucucgcuaggccucguggacgugcggucugggaugcuucugucuuuuuuuuuuuuugagauggagucucgcucugucgcccaggcuggagugcaguggcacgaucuuggcucacugcaagcuccaccucccggguucacgccuuucuccugccucagccucccgaguagcugggacuacaggcgucugucaccacgcccggcuaauuuuuuguauuuuuaguagagaugggguuucaccauguuagccaggauggucucgaucuccugaccucaugauccacccgccucagccucccaaagugcugggauuacaagcgugagccacugcgcccggcugggaugcuucuguuuuuacacacaggggcucccgaggccacaggccccuccacaucucgcucccugcacuaugauuuaggagcugugacgccgcugaggacaggcacguugacccagugacuacacagccagcccucccucuacucugcucacagcucuguccccagagagcccaacccugaggagcagacgaugaggacucauucguggggaccgugaggugacaacgggaggcagugucgugcaggccccgcgaaaccgaagauucugggcaaauaacagggagggggaguccugaggaggggcuugacggagagaaugccaccugcuccccagcacacuuccaccccccaaaaugcccaacuccugcaggcaucagggcgucugcagccaccccaccucaagacaggcagccucuccaguguccagggaccgugggcucaccucugcaccccuuguguuuagagccugggacuaccccgcccaccacccaccucugcaccccucgaguuaagagcacagaccgccccacuggccgcugugccccucgguuuagagcucucgcucgcccacugaccugggugacuggagagagucagcaccaagcuacgagacacccacagccaagugcuacagaaggcaagguccucacagaaaaaucacaaaacuugaugaaaagaacaaagagagaccugcacagacaccccccacacacggauggacccucagcaugacagacaccaaugcuccagaaacagcugugagcucagagggucccauaagcccgaccuggucuccggacccuggguggucuccagagcagagccaaaccaguucagagcuucaggacacagcagcacaacccagaggccucgaguggggacacaaagacgggagcagcagcaggacucagaggccuggggcggggacagacagacgggagcaguggcuggacccagaagccucagcggggacacacagaugggagcagcagcaggacacagaggccucgggcggggacacgccaaugggagcagccaaagacccacacaaggggacggggaggacgcgcaccaaggggaggcugcguuuggcaacacagugccgaguccacugcccagacaggugcaagcaagaacaacucugcaggcucaccccagagucacacaaaagcaaaacuuaaaacccugugaggugaccugggaaaaaccuccauggugucagaggagcaaaaaguuucucaagaccccacacgcgacaaaagggcagacaagccugcuggacagcaucacugcaggugaggaggcaccaaggcaggauguggccuggacccaugcguucagggaaggcggccccacggcccgugguaagcagacccacaccccgcccugggagagcccucggggcugggcgcucagcccagugccugcagcuacccaggcacaggcucccaauggagaaaggaacggacagggcuacggccccugcuugggccggucucagaaacacacgucacagagagagaugcaugaggcacgacacuugcacacaguccaaagcacaggaaccacgagacaugugggccugcaccccgugccggggacgaggacacgcugcggggacgcagacacuaaaggggaggggucgggcucugugugggagauaacggcugguuuuaaucuggccagauggggaaaugagacacagcaggcagggugggaggagggcacgggggcugggagaugagacacagcaggcgauuucuucccggugcuuacaaucuuucuaacugagagaagaaggaagccggguccccguccaccaggagccagcgugcaugguggcagcagccacggggccaggagccguggggaccaauggcaucugcaugacccagcgggugcuggcggccacaaggcagccucggugccgaggacacacugaccuuucgcugugggacagguugacgucggccuugagcauggagaggagguuugcgccuucccgguucucccgcucccgccucugcugcagcaccuccaacucggagcggcacucuucuaucucgugacuuaaggauaaaaccuggucuuucagcuaucgagaaaaaugguuaaagcuuucguuaaaacaauuugguuaaaagcaaauggcuguaagggacuuucaacacaauuucaguauuugagagucucugacuuaggacuuuucagcuuggugauggggcaaaaggagcaggcacuucggcacguuccucgacucacaacgccuuccacugacaguggucaaaggcgugaccucagcaaaggccaaggagcaccugcacauuuaauaaaaauacggcaaaggugaacgaggugcugauuaaaggugaaaauuauugauacgguuuuuccuccauuauucaucauuuacaaaagaauacacaaacauccccagguggaaccugaggcuaggggagggaaggggccaguucaucagagauccaccacucaaacagcaauucgaaauaagucacuguaucuggucauucacaaaagucaguugccaggcaggcaaagaucuuucuuucugagacagggucucacucuguugcccaggcuggagugcaguggcacaaucacagcucacuguagccucaaacuccagggcacaaacaauccucccaccucagcuuucugagaagcugggacuacaggugcgugccaccacacacggcuaauuuuuuuaauuuuuuauagagacagggucucccuauguugcccaggcugguaucgaauuccugggcuggagugguccuccugccucagccucccgaagugcugggauuaaaggugugagccauggugccaggggagggcaaauggggagugagagucuaauggggacagaguucaguuuugcaagaugaagacuucuggagauggaugguggugauggcugcacaauacugugaaugugauuccaucaccgaauguacaacaccgugaaugugccugcaccacugaacuacgcacaacaccaugaaugcacuugcaccacugaacuaugcacaacacugugaaugcacuucugccacugaacgcacaacaccgugaaugcgcuuccgccgcucaacgcacaacaccaugaaugcacuuccgccacugaacuacgcacaacaccgugaaugcgcuuccgccgcucaacgcacaacaccaugaauguguuuccgccgcucaacgcacaacaccgugaaugcgcuucugccacugaacuaugcacaauaccgugaaugcacuuccgccccugaaugcacaccacgaaugcacuucugccacugaauguacagcacugugaaugggcuuccaccacugaaugcacaacaccgugaaugggcuuccgccacugaacgcacaacaccgugaaugcucuuccgucacugaauguacaacaccgugaaugcgcuucugccacugaaugcacaacaccgugaaugcgcuuccaucacugaauauacaacauggugaaugcgcuuccgcugcugaaugcacaacaccgugaaugcgcuuccgucacugaauauacaacacugugaaugcgcuuccgccacugaaugcacaacaccgugaaugggcuuccgccacugaaugcacagcacugugaaugcgcuuccgccacugaauauacaacacugugaaugcgcuuccgccacugaacgcacaacaccgugaaugcgcuucugccacugaacgcacaacaccgugaaugcgcuuccgcugcugaaugcacagcacugugaaugugcuuccaucacugaauauacaacacugugaaugcgcuuccgccacugaauauacaacacugugaaugcgcuuccgcugcugaaugcacagcacugugaaugugcuuccaucacugaauauacaacacugugaaugcgcuuccgccacugaauauacaacauggugaaugcgcuuccgccacugaauauacaacacugugaaugcgcuucugccacugaacgcacaacacugugaaugcgcuucugccacugaaugcacaacaccgugaaugcgcuuccgucacugaauauacaacauggugaaugcgcuuccgccacugaacgcacaacaccgugaaugcgcuucugccacugaacgcacaacaccgugaaugcgcuuccgcugcugaaugcacagcacugugaaugcgcuuccaucacugaauauacaacacugugaaugcgcuuccgccacugaauacacaacacugugaaugcgcuuccgccacugaaugcacaacaccgugaaugcgcuucugccacugaacgcacaccaugaaugcgcuuccgcugcugaaugcacagcacugugaaugcacuuccaucacugaauauacaacacugugaaugcgcuuccgccacugaauauacaacauggugaaugcgcuuccgccacugaauauacaacacugugaaugcgcuucugccacugaacgcacaacaccgugaaugcgcuucugccacugaaugcacaacaccgugaaugcgcuuccgucacugaauauacaacauggugaaugcgcuuccgccacugaaugcacaccgugaaugugcuucugccacugaacgcacaacaccgugaaugcgcuuccgcugcugaaugcacagcacugugaaugcgcuuccaucacugaauauacaacacugugaaugcgcuuccgccacugaauauacaacauggugaaugugcuuccgccacugaauauacaacacugugaaugcgcuuccgccacugaaugcacaacaccgugaaugggcuuccaccacugaaugcacagcacugugaaugcgcuuccgccacugaauauacaacacugugaaugcgcuuccgcugcugaaugcgcagcacugugaaugggcuuccgccacugaaugcacaacaccgugaaugggcuuccgccacugaaugcacagcacugugaaugcgcuuccgucacugaauauacaacacugugaaugcacuuccgccacugaaugcacaacaccgugaaugcgcuuccgccacugaaugcacaacaccaugaaugggcuuccgccacugaacgcacaacaccgugaaugcgcuuccgccacugaaugcacaccgugaaugcgcuucugucacugaauauacaacacggugaaugcgcuuccgccacugaaugcacagcacugugaaugcgcuuccgccacugaauauacaacacugugaaugcgcuuccgccacugaacgcacaccgugaaugcgcuuccgccacugaacgcacaacaccgugaaugcgcuuccgccacugaaugcacaacaccgugaaugcgcuuccgccacugaauauacaacaccgugaaugugcuuccgccacugaacuaugcacaacacugugaaugagcuucugccacugaaugcacaacaccgugaaugcgcuuccgucacugaauauacaacauggugaaugcgcuuccgccacugaauauacaacaccgugaaugcgcuucugcugcugaaugcacagcacugugaaugcgcuuccgucacugaauauacaacacugugauugcgcuuccgccacugaauauacaacacugugaaugcgcuuccaccacugaaugcacaacaccaugaaugcgcuuccaccacugaaugcacaacaccgugaaugggcuuccgccacugaaugcagaacacuaugaaugcgcuuccgccacugaaucuacacuaugaaugcgcuuccgccacugaaucuacacuaugaaugcgcuuccgccacugaaugcacaacaccgugaaugugcuucugccacugaaugcagaacacuaugaaugcgcuuccgccacugaauauacaacauggugaaugcgcuuccgccauugaaugcacaacaccgugaaugcgcuuccgccacugaaucuacaacacugugaaugcgcuuccgccacugaauguacaacacuauaaaugcacaacaccaugagugcacuccugccacugaacugugcacugaaauaaagugaaaaugauuuuuaugcuauacacgucuuaucacaagggaacagcguauuccacacaccugcuggacuuggugauucuucuuuugaagcugcagagacaaagacucuuucuccucuuggugaaaaggcugugccugugcacucugaagccgaagugucuccucuuuuucaugcaaagcaguuuucuuuucacuuccaaauucacccuguacacaucaauaacaauaaaaaauaccaguaagcuagaaaaauacuuucuuugcuguuagccggaauucagcacauucagcagauaugcauggagcccccacucugcaccaagagccgggaugagccagaccacagcccccaucaaagaaaacauggguucaaggacuucacugggaacacaaaguccugguuucggggauaaaacacuuaaggagacacaaguucgcacuggugacagcugcgugucauaagcaacugcucacuaccauucccaaauggcuccuguaacaucuuuaagagucacacuaagaaguucaccaucaaggaauuacagccaugaaaacccaagauauuuggaaaccuagguuccuucccuuuuaaaagauuaaaccuucuuucuaaauaacaaaaccuuuuaaauaagguucaauagaugaauucuauacacacacacacacacacacacacacacacacacacacacacacacacagagauuuuuuuuuuuuuuuuuuggaaggacucuucucugucacccaggcuggaaugcaguggugugaucucagcucacuacaaccucugucucccagguucacgggauucucuugccucagucucccgaguagcugggauuauaggcgccugccaccacacucaacuaauuuuuguaauuuuucuuuuaguagagauaggguuucuaccaaaaccuguuggccaggcuagucugaaacuccugaccucaagugauccacccacacuggccuccaaaagugcugggauuacaggugugagccacugcacccggccaauuaaauuaaugaaauaagcuuauuuuuuuaaacuuccagagguagcacuucuagaauggcaaaguaaggaccuccaaaaucuguuccucuauaaaagaaaaagugguaaaaaccaucaaaaccaguguuuucagagcuguggaaaucuggucagguuugcaaucauccgaagaguguuuauggaaaacacaggcugaguguccauaagaacaaacuucaggugcuuaacuuugcccugacuccauaucuccucuccaaucuaacagcccugaaaaccaguagcugcugggguggggugggggacagaauggauuuggagcaccccaaaauuuccaugcacaacugcccgagcccaccugccgggcaccuugcugccgugacugggucagagcucucggugucaaaaauucuacccaggguuggccgggcgcgguggcucacgccuguaaucccagcacuuugggaagucaaggcgggcagaucacaaggucaggagaucgagaccauccuggcuaacauggugaaaccccaucucuacuaaaaauacaaaaauuagcugggugugguggugggcaccuguagucccaccuacucgggagucugaggcaggagaauggugugaaccugggaggcagagcuugcagugagccuagauugcgccacugcacucuagccugggcgacagagacucugucucaaaaaaaaaaaaaaaaaaaaaaaaaaaaaaaaaaaaaaucuaccccagggcaccgguuggaaacagucagugucaaguguuuaauagccgcacugcccacaguagagaaaccaguugggacuaauaagggacugccagaaaaacaaaagaaaacacuugagaaugcgauguccacaggggccucuggaaagcucugacaucuucugggacucuacaaggugugaacacgugcagggcugugcccacgcuggaaaggcccaagagguccugggccggcugcagugaccauguggcuuggcacagcaggggugaaggccagggccaggcuguccaccgcccgccagagcccugagggcacaaugcacgcagggcccucagcagagagaaagacugaaauagagcucccuugacaucuggagcugaaaaauacaaucacagaaaaaaaaauucacuagagagggguucggcagcagacucgagcaggcagaagacagaauucacacgcuggaagauaggucaauuaagacgauccagucagggaacagaaagaaacaugaagaaaacucagcagucuccaaggccuguggggcacccucaagccagacagagggagagaaaagggcagaggaacccuugaagacacgacggccaaaaaccucccaaauuugaugaaaauaacaauaauaauaaaaauaauaauccccacauacaagcucaaugaacuccaaguaggacaaacugacagagacccacacuucacccaucacagccaaaccucagcaggguucaggacaaagcuugaggccagccagugcacagcagguauaugggugccgcucaagacacguagccccaggaagaugggugcggcucacgacacgcggcccgggaagacgggcgcggcucacgacacgcagcccaggaagacgggcgcagcucacgacacgcagccccggaugacaggggaggcagcggagagcccacgcagcacugaaggaaaagccuggaucuugaaguccacauccaggaaaugaucucucaaggaugaaggagaaauuaagacauucccacaaaaacaaaagcuaagaggauucaucacuagcagaccuguccuucaagaaaucccagaggaaguccuucgggcugaaacauaaggcaccagaccugaauuuccaggaagaaacgagcagcaguagugcagguaacgacacagagaaaacaggagacaaaacaacauggcuuuuguuuacaauucuucuuccuccugguuuaaaagacacgugcauaaaguaacgagcacaaaaagauagaaagaugugguugguacgacaauaugagcacaaagggcagacgagggaaugaugcuacauuagcaaaugguuuuguaaacuuuuaaaauuaaguugguauuaauccaaaccagauuguuagaaggugcuugcuguaacgcucagggcaagcgcuaagaaaauaacucaauauauaucaguccccuuugucugcgguuucaguuacuuguguucaacgucauuuugaaaauaucguaugaaaaauuccagaaguaaacaacucuuaugaguguuaaacugccugcccccaagcugaacggugugaggaaaucucgcaggccaggccgggggucauccuucuguccggcguuauccacguggcaagcacuaccugcccacacgcaggcaucucggugaucagaccaacugucacagcaucacagugccuguguucaagucaccuuuacuucauuuaauaacggccccaaagcgcaagagaggccguucaauugcaaugcugcaauucagacgugccagagacaccauagagugaugccuuucaguuaaaaguugaugacggagcaauucagauaugccagagacaccacagggugauuccuuuaagguaaaaguugaugacagguauguauagacaaaaacagcauauaagggguucagaaccauucacgauuucaggcacccacugggggucuuggaaugcauccccuguggguaaggggcgaccaccguaugguaaaggaaacaucaaggaaauuaaagugaaaaaaggcaguaauggaggaauacagaacaaaaagggcauaagauaugcagaaaacacauaccaagcaaguauugacacaugcuacaacgugcgccaaccugggaaacacacaaagugaaagccgcggacaccgagggcacacgcugagucuauguacguaggacgcccacagguacggcaagcagacggcacaucaccaggcaugggggagaagggagaauggggaguuucuuguuuucuuccuuaauuuucauugauuaucuuuugagacaacguuuugcugucaugcagccuggagugcaguggugcgaugucagcuugcuacagcuucaaccuucugggcuccagugguccucccaccucagccucugaguagcuggaacuauaugggcacgccaacaugccaggcuaauuuuuuuauuuuuaguauuuuuuuauuuuuggucuugaacuccugggcuccagcaauccuccugccucagccucccaaggugcugggacuauaggcacgagccacuggggguuucuuuuugaggugaugaaauauuuuagaauaaacuuuucucagcucuaagauaagugaugacagauucuugguagaaaagguguguuacacagcagauuuaaauauaaaaaggccugacaaaaguugccuagaaaaagcucaguuuuaagacaaugaaauuauuuuguguuuugacuuggcaugugaaaagguaacugauaaaguaaguuuuuuguaucuacuuagcaggcaggaaaggacagcacgaagcccauguccucagcagugggaccugcugcuccgggaccugcugcuccagaacaucugggguggauugccggcucccgcucccugcccagcacggccaggagggcugagggcuggggcuccaccagcuucaggaggaggaagacgucaacaaugagugagugccuuuucugaaguaacuggggcaacaguuucaauaaacacauggaagcccugacaccagaaaugaccuuuauucucuaccuuuuuuugugugauaagccauggggaggaaaaggauaaaggaucgggugccccccgcgccggccuggaacuugcugaggugccaggugggcugugcaucugcaucuuagucacagggaccagaaacggguucgcacggcacaacacugaagucacucgcaaggucucaaggccauuuggaaugugaguacaguucacuuuaaucaacuuucucuccuggauuugauuuaguuccaucuguuugaaaggaaggacuuaagauuaacuucugagcugugcacacuacaaaguuuccaaagaacuuuaauuaccuugcugauaccccaaccaucagcagugcgucuccugggggacagacgcauugauccggaccaacagccagggagggggcagcgggccaggaguaagagguccaaacagggaugcugguucaguguacaccaaccacaaaacgcuggugaauucaagaacaaaaccccaaaugccaaugcacccggcaggacagaggccaagggacugggaaaacaggaaaauuaauccucaagaccaggcgccaccauggugcccacaacagcucaugcucagacacaguggacgggcuccucaggcccagccaggcacagaucaggcgcuucccuccuggcauccacagcgucagccuguggggcccgagggcaaaccucugcgcucccggugcccagcaaaggauguggcaagaguccaaggcugaaaucagugguccuuugaacaucuuucugagccacagacuacuuacucucuuuggacaaaaaucucucauagaggccuaccguguaacaaugagaaaaucaaacuucuguuugaggccaacacgggagcccaagaacauuggacacccccagagccugcggagccuggccuaagcuccaggcgucccaaacuacgccccacucaggagcacagcuggugccacgcucuagccccgcggccuccgggaucccagagucacacacugcagacggagaggguagagggcaggcuccacagagaaccccagccagggagugccaacacugcacgcagcccaccaggacgcccgggcauggcagacagagguggcgcucccuccacccacuggcagcuggaagcuccaugugugcagucuugaccuucgcuuuguuucaaggcacagcaccacccgcagguaccgccucgcacccaggggagccacccuaacuguccacgcuuggcccuguccugccugcacacucucaggccuucggcagaccugcagaggacguaggaggugguggaggccaaaugaggcggcuccccgcggggggacagcccccaggagacgucgggcagggcugggcaggucacaggcaugcaggcccagcagugagacggccagugccccacaugugaucccucaggcccagggccucggcucggccacaaugucgagcagaagcgugcguccucagccacccccucaaucugaccgggccggcucaaaggagauuuucuuccugcaacccccuggcagaggcucuagccuggaauaaaacucuuuaaauugaccauguucuucuaagcugugaggucaguaucaaaaaagacguuucaaaaaaaguuauuuucagguuuuucuaaaauccacacaauuauagaaaaauaucacauauguuuuaaucauaaguaaguggcaugcacagagaauaccaaugucagaaggcaaagacauucaauugagaacgcauuuaggacauucaaaugcuaucuaaaccaacguuaauauuaucuuaauauuaaaauaauuaaccuaugaauagauuuggguuuucaauccgagaaaagaugacaccgccuugagcaucccacaccggccgcaugcgauucacuucugcacucagcucugcgucguguuaccagcacaggcggggcagggcagggcaggggaaucuuaugggauacauacuucuaucaaaaagaaaucaagcuuacguuuucagaggacuuuccucacaaccaaacucucaagggcgguaucccggaaaguaauccaaucaccccacaaguguaggucaagucacacugcugacaagugacugcuguuccaacaggugcaaagauauuugaggcucagauaaagcaucgccgcggggaagaacaggacaucccagcuauucugggacaaugacccaaaacacucccgucagggcuuggcagggcucuguguaacuuuuuuuuuuuuuuuuuuuuuugagacgaaguuuugcucuuguugcccaggcuggagugcaacggcacgaucuuggcucaccacaaccuccaccucccagguucaagcgauucucuugccucagccucccgaguagcugggauuacagguaugugccaccauggcuggcuaguuuuguauuuuuaguaaagacaggguuucucuguguuggucaggcuggucucgaacucccaaccucaggugaugcacccgccucggccucccaaagugcugggauuacaggcgugagccacugcagccagcuuguguuaugucuuuucacgguguaaagccugaggaaagaccaggagaccaggagaggaguggccaccauacaagaagcauucucaccaaucacaggccuguggaucuaccaacacgcuugcaggaacgagggaacagugaccagcaucacaggaacaaauagauccugaugugagccagccagaagagacuggcacgugggcugggcuugugaugaaaugcagggaucgcuguggauguuuuaggugagaauggaucaugguuaugcuguauugggggaaaacaccucacucgcagacacauggugucuuggauuugcuucuaaacaaucaggaggagagggggacugauguauugaacgugcaccccacuaaccagcgggaccgggggcuugcugaguuauucuauuccugcaaaugcugcccucugccccaaaaaacauaauauaaaauaaagaguacaucccaccuccccacagcccaauuguuuucuucugugaaaucagcuacaccaaaacaaucacauaaaagaguaucugagcggccgggcgcaguggcucacgccuguaaucccagcacuuugggaggccaagacggacagaucacaaggucaggaguucgagaccagccuggccaacauggugaaacgcuguuucuacugaaaauauaaaaauuagccaggcguggugguaugugccuguaaucccagcuacucaggaggcugaggcaggaaaaucgcuugaacccggggggcggagguugcagugagccaagaucaugccacugcacuccagccuggcgacagagcgagacuccgcccaaaaaaaaaaaaaaaaaaaagcuaaggcugggcgcgguggcucacaucuguaaucccagcacuuagggagggugaggcggacggaucacgaggucaagagaucagaccacccugggcaacauggugaaaccccaucucuacuaaaaauacaaauauuaggcaugguggcgcaugccuguagucccagcuacuugggaggcugaggcaggagaaucccuugaaccagggaggcagagguugcagugagccaagaucacgccacugcacuccagccuggagacagagcgagacucugucucaaaaaaaaaaaaaaaaaaagaguauugacaugcacaucccuagcagcaaaguaaaaagcuaacuuacucgcgcaaaccuguaccucaacuacaaaaauacugcaaagacgcucuaggaguauuccgauaauaguccaggccaggcgcggcucacgccuauggucccagcacuuugggaggcugagacaaaaggauugcuugaggccaggaauuuaagaccagccugggcaacacagugagaccccaucucuacaaaaaauaaauuagccaggcaugguggugcacaucuguagucccagcuacucaagaggcugaggcaggaggaccacuugaggccaggcguucaaggucacagugagcugugguugcaucacuaccuucggccugggcgacagagcaagauccucccuccaaaacaacaacaacaacagucacccuagaagaacaaaaguacagguuaaaggacacaggugacacacgauuucagaaaacgaacaccuccuugugcuaugcacagauaaaacggacagaauuucuuuagcaugagucccuggaaaagcgagacagaaucugacuuuuccagagaagacagacccacacgauacccagcagggugcaggucucagggcugugccucaggacugaggggccaguguccacacugggcagcacccagagcuguccacgugaagaaacaagucauuucuaaccucagaauccggcgcugcaucacccauucucaggagcagucccucuucaccaagcaaaccuuucagguucaaaaccuuacuuuauggcuagaaaugagaucuuagcauguccuuguuuaaaacccccuugaaaccauauguaccauaaucaccuaaaauuugcacauaaugcuucaaauaaauuaucaauuauuucugaagugcuccagacucuaacccuccccccacagaaaggccagaaaaucguacagacccagaacacagaagcaggagggccccaggcauucauccugcaggacaacaugcagaaugacaugugugcaugugcuguguaugugugcaugugcugcguguaugagcaugugcuguaugaacaugugcuguguaagcacgugugcaugugugugcacguguugugugugcgugcugugugcacaucugcuauguguaugugcugugugcaugcaugugcuacacgugcacaugugcuguguaugugcaugugcugugugugcacaugugcugugugcaugugcucucugugugugugcugugugugcaugugcugugugugugcgugugccuuguaugggcacaugugcugugagugugcugcaugugugcaugugcuguguaugcacaugugcuaugugugcgcaugugcugugugcaugugccuuguaugggcacauaugcugugagugcugcauguaugugcugugugugugcaugugcugugugugugugcaugugcugcauguguguaugugcuauguaugugcuguuugugcgcacaugcugugugagcaugcgcaugugcugugugcgcacaugugcuguguaugugcugugugugcaugugcugugugugugcacacaugcugugugcacaugugcuguaugugcugugucugcaugugugugugcaugugcugugugugcacaugugcugugugugcgugugcucaucaugcagaccagcaggcggggugguggcgccuggauggggcaggugcacggguccacaaguggggagaccuugcugcuuaaaugcaguccugcauaggugcagagaaucaagaccacagcagguggcaggggaccucagccaggccccuucacggccaccuugggaauccaagggggauuccgacuacucagucuggcuucuucugacacaauuugguaccagugcuuacgcauauucugacacacaagauuuuaaaaaacugaaaaaguaaguaacuacacuggccaggugcagaggcucacaccuguaaucccagugcuuuggggaggccaaggcgggaggaucacuugagcccaugaguucaagaccagccugggagacaaaacaauaaaaauuagcgaggcgugguggcccgugccuguaucccagcuacuugggaggcugaggugggaggacugcuugagccugggaggcagagguugcagugagccaggaucgugacacugcacucuagacuuuuuuugagacuccgucuuuaaaaaaaaaaaaaaaaaaagaaagaaagaaaauaaaccauacugugugcagauuucuuucuuuuuuuccugcagccucagauucccagguucaagcaauuuucucuccucagccucccaaguagcuggaacuacaggccugcaccaccaugccugguuaauuuuuauuuauuauuuuuauuuucauauauauauuuuuugagacggagucucgcucugucgcccaggcuggagggcaauggcgcgaucucagcucaccacaaccuccgccucccggguucacaccacucuccugcuucaaccuccagaauagcugggacuacaggcgcccaccaccaugccugucuaauuuuuuguauuuuuaguagaaacgggguuccaccguguuagccaggacggucuugaucuccugaccucaugaucugcccgccuuagccucccaaagugcugggauuacaggcgugagccaccgcgcccggccgauuuuuauuuuuagaaguggacucuugcuauguuccccaggcuggucucgaacuccugagcucaagagaucaucccacuguggccucccgaagcccugggauuacaggcaugagccccaagcccagcccgugugcagauuuauaagagcaacuaaaugugcuucugugucuacacaagccacauccccugcaccaguccaaccugggaugaccccuccagcuaagcguggcuuccccugucagcccccaggcucuccaugccccucccuaugccaucaucagcuggcaggcaccccucacuauccccccagcugccuagcgcgacacccaggaugagccccagccuccccgacccccgcaccucccaggcucugaaucgccuccacuuuguguuucguccagcugccaaguagccuguaggacagaucuggucgcgccacagaccacucacugccugcagaccagaccagaacccugcccuccggaggccccaacaggaggggaggccaaccaaagacacccccccccggaugcccaccccugcagcugccucgcuggccaggugcacugacacaucugcccccacgaagcugcacucuuugagcacagaccccacugcacgcacaauccagcggcuccaaguguauccguaagugccugaacgcucugaugaagacucagggcagagaagccggggaggcaccccugugggaaccacacacguggagcugcucaccugcacagccccucccgcagcaccuguagcucccccagcacccccagaaccuccggcucccccggcuccuccagcuccgccugcccugcuugaugcuccugcaucuuggcagcguacaucucugaguuccugcagggccgcuuggugcugaugcuccaggagcaggaccuuggcacccacccuguccagggcuuugguccucucugccuccagcaggcgucucugauugcacagggcugcgaccagcuccuuccguccaggaaacauccagaugugccacauccccacacagggcacagaaggugcacacgcuccacaugcuuccucugacuaaaucaggccgugguuugaaacacacacuucaugugugauaugcaaguuccuccuuucugaauauucuuucagaacuucauuuucuuuaaaccaaacaaaccaagaaaaccuaauuuuaaauccacagcuugggaacaagugcuauucuccaaagcaucuguuugccuaugaucaaaacugggaacgaaaggaaacugaagcuggcaucugaggacuggccuggagggcagcucccagcagcaucagaccccugucuaauuuuguccagaaagacaacauggcuccagcuucucucaagaggcaccucccaagcugggagcaguggcucaugccuguaauuccaacuaccugggaggccaaggcaagaggaucucuugagcccaagaguucgagacuagccugggcaacacagggagacccugucuuuuaaaaaacaaaaaagaaacaaacaaaacacauccccaggacucccugacauguggugaagacaaggacaggacacagaggccugagacaggcaacugacugcaccuuacucaggagagcagagggagccugaacauauucugcuuucuaggaauucccccaagaucacaugcucagaccacacaaaacagacagccugaaacauaacaugaaacccucacagcgauuaaagaagguuccacuuuucuccuguucuuacacagagcugaaggaaagcaaacaauaagccaacgcuuuggagccucacaacuguuccccacagucaggaaggaggaagcccucccguggcaugcugguaucaggaaaucaacguauccaccuuauccaagcuggcaauucccucguuuauaguuuggaacguguacuucuuaaacgucugacaagguauugaucugccagaacaaccauuucuaacugccucaucagcucuagcccaugccccauccaccgugcagccaggccuaugcauccccuuccugcagggagauaggccagccccaguggcuccacaugcucaacagagcagacucaucuauuucaaggugagaaaaccucagagaccucacugagggcagagaaagcacaaggugugugugauacgacaacacguguccuuuccugagucacaggcacugcagcuucugcagucaggcgccagcccagggcaagagggacuucgccagaaauucuucuucaugauaaaaacuuggaagugccugucaaaugaaccaucaccgcuuuuuuuuuuuugagacagagucuugcucugucucccaggcuggagugcacuggugcgaucucggaucacugcaagcuccgccucccggguucacaucauucuccugccucagccucccaaguagcugggacuacaggcguccgccaccacccccagcuaauuuuuuuuuggauuuuuaguagagacgggguuucaccguguuagccaggauggucucgaucaccugaccuugugaucugcccgccuuggccucccaaagugcugggauuacaggugugagcuauuuuuguuuuuuuuuugagacagggucucacucuguuacagcccaggcuggagugcaguggcacagucuuagcucacccugcagccucgacuuccugggcucaagcaauccuccugcuucagccuccaaaguagcugagacuacaggugcgugcccccacgcccggugaauuguuuuuaauuuucguagcccacaggcugguuucaaacuccugggcucaaguaauccaacugccucagccuccuaaacugcugugauuacagacgugagccauugugccuggcccaucacugcucuugaaauguagcaaaaggguuuuauuucaggaaacaucaauaaaaggaggggaccaaggcucugaauacacaacaugaccaucagaucuucccacagcagccuggaaaccaagucuucugcagaggugcuggucagccuugaggaauacuccaaagcccacaaaaucccccaccaaggucuaggcccucccacauacguacgagagcaaagccuuuaacaaggugccugcgaucaaaauaacccuucaacucaguguuuuaaagcccagcucaggccgggugcgguggcucauaccuguaaucccagcacuuugggagucaaggcggguggaucgccugaagucaggaguucgagaccagccuggccaacauggugaagcccagucucuacuaaaaauacaaaaauuagccgcgcaugguggcaggcgccuauaaucccagcuacuugggaggcugaggcagaagaaucacuugaacccaggaggcggagguugcagugagccaagauugcgccacugcacuccagccuggcgaaagagugagacuccggcucaaaaaaaaaaaaaaaagcccaguucacaaagagaccagaaguccccacugaucucggcagccugugagacacacagacacccgcacaggcacacacagcacgcacgcagacaugugacacgcgguggaaacacacaggcagcgaggagaggccugcccugggcuggggcagggcccuggcgccuuaccuggugcacucccugcagcucgugagccacgguuccggcgagcucugugcucacuucgguucgcagguggucccgcacagacuguagcuccccuucguguuuccgcuucaguuucuccaacucuugagucaaaaucguuuggugaagagaguccuuuuuccacaguuguuccucaaagucugcucguaagagcucuagggccugccugugcuccucacggauggucugaaauucagagagguaacaggauuccaaagaaucaaggcuggacagaugucuggucuccagagcgccgaggucggcagcguguuuugucugcaguucggccacacgugcagccagcagagcccccugcuugcucucuaaggaggcugucagcucgcccaacgcggccuggugucuggccucgagcuccgccgucacugacaggagcugcugcuggugucucuccuggaggagcugcagcucacgggcaugcugcuccugggccuccugcaggaaggcaucuuguuccgcacugaauuucucggugaucucuuuacguuccucuaaaaaccugcggcaacaaagugaacacaggacaguuaaacaugcaucaggaagcaaugacccuugcaaaagccaagucaguuucccacaggaaaugccacuucaacuguucaggucaucguuucgggauuuuaacugcucuuacuacuuuucccucgaccaccagaaauaguaagugggagagugaagaggccccaugaagccagagaagcccagaggccaaaggccaaagccaugggagucgccaggucacagaccacagguaggaaccagcgcccucagcaagagauggcacacacacauccccgccagagccacgcacggcaggcacaaccaaccuccuacucacaccacagcguccgagccagcauccaaccaagaaucccaagguaaucucugcuccucaacagggaaggggcacugcccaugggggcccauggggagggcgaggccugagaaccccauggcagugaauugaaccccauggcagugaaugaauagaaccucauggcagugaauagaaccccaaggcagugagugaauagaaccccaaggcagugaaugaauagaaccccacggcagugaacagaaccccacggcagugacuagaaccccauggcagugaacagaaccccacagcagugaauagaaccccacagcagugaaugaauagaaccccauggcagugaacagaaccccacgacagugagugaauagaaccccacggcagugaacagaacccuguggcagugaacggaaccccacggcagugaauagaaccccauggcagugaauagaacccuaugggagugaacagaacuccaugggagugaaugaauagaaccccacggcagugaauagaaccccacagcagugaacagaaccccacagcagugaggagaaccccauggcagugaaugaauagaacccccauggcagugaauagaaccccauggcagugaucagaaccccacggcagugaauagaaggccauggcagugaucagaaccccaugggagugaacagaaccccacggcagugaucagaaccccacggcagugaauagaaccccauggcagugaucagaaccccacggcagugaucagaaccccacggcagugaacagaaccccacggcagugaacagaaccccacggcagugaauagaaccccacggcagugaucagaaccccacggcagugaacagaaccccacggcagugaucagaaccccacggcagugaauagaaccccauggcagugaauagaaccccauggcagugaauagaaccccauggcagugaauagaacccuaugggagugaacagaacuccaugggagugaaugaauagaaccccacggcagugaacagaaccccacagcagugaauagaaccccacggcagugaggagaaccccauggcagugaaugaauagaacccccauggcagugaaugaauagaaccccauggaagugaauagaaccccguggcagugaauuaaggaggugcaggcggcacucagggccaaagacagaggcagggagaguccucacagaaggaccugcucccaucaggaggccaaagagccuggagcuggaggguccugcaaaaugccaaggccuccaaugggcacuggcgacacaggacggauggcaagaggcacaggcaccucugcgccuggaagccucucuugagggccuccuugguucagcucuaccacgaacugcaugucguagccuggugagaagagcguccugcucguguucaugcagccccagcgaccugaacgugaguuucuccaaucccugagcggggcccugugcggcccugguugcuggggaagggcuggguggggcagacagaugagaaagaacggcacagcccugggacugaggcucgcaaaaagggucagcaccaacaggcaaagaacccaaucacuuucuaaaccucuugaaaacuucaaagaagaguguguauguuucagaaaaacaugcuuauuuuuaaaaaucaccuguuuaaguuaaaaaaaacacaaaaacgcuuaguggauaaacuccauguccuuaugacaccuauaaaagagguuuagcuucugcuguucaaaucuuaaaacacacgaagaacaacagagacaaugacugauccccgccccugacacccacccagggagugcagacuuggggggcuuuggggcggcagcugccagccugcccguccaaacacaaagcugucccacuguggccggggggcuucgggguggcggcugccagccugcccauccaagcacaaagcuguccccauugcagccugggggcuucgggacagcaacugccagccugcccguccgagcacaaagcugucccacugcggccagggggcuccgggacggcgacugcuagccugccuguccgagcacaaagcugucccacugcggccagggggcuucaggauggcaacugccagccugcccguccgagcacaaagcugucccacugcaauuaggcugaaaaccuagagcgccacaccuuguuccagcucccuccagaccuuuucgcccaguggagcccacagcgccuccucccaggagccugcccaccuucuacccuccaaggugucuggccucacagggacugcagauggcgucacugcaaacccaccugcuccgggccagcaucagcugcagggcgcagucuuccuucacguggagcgcagcaagcuccccguccugggcugugggcggcucccgcccacacuggcugcaaugcagggcgucgucugaagugagguccuguuccagcugcugcaggcggcccugcugcuccgucaaggaccucuccagauccaggaucugggcugccuguugguccugaagcugccucauuucagcuucucgaagcucaaacuuguuuaugauggucuguuucucggauucagccuuuucucucaguucaaguagcaucaauguuaacuucuccucagcuucccgcuguagcuccuccuucauaacuuuccaguccguuucuuuucuuuggaauuccuguuucaucagcucagucuuuugcuuagcauuauuuaguuccuucugguggucuucaauuagauuguguuuuaccuacagacaacauaauuucauuuaggaggaaagacgcuaauggaagagauuauuagaagagacaacccaaacccaccucugaagacagggaauuuucaccacacacacacccauuacgcugcacacagcaacaggaaugauucucauguugaugacaauggaagaaaccuaaaguggacaagucuaaaacuaaauaaaaugccuccuacguccuggcaccgagaaccgacuguucuuuaucucuggagcccguggccuugacagcaaccaacaaccgaaggcagcacacaucagccgagcaaaggcagcagccggaggcuucuuuguucagaccaagaccaguggcaggacucagaucggccgcaggccucuguuaggggaacgccagccccacagauagcgcugggccacugcagcaagcaugaucggaugcccaggaggcaagagcagccaauggugcgaugcucccgaucuguacaaggucaacgccaggacaaugaaagaccuugagcaagggguggaugaacugcaaggcacacuguaaagggauccugugcagagggggaugaaggagaaugcagagggcaaauauccuaaucuuuuuuuuuuuuuugagacagggucugucgcccaggcuggagugcaggggcacaaucacagcucacugcagccucgaacuccugggcucaagcaauccuuuauagagacaggguucugcauguugcccaggcugaucuugaacuccugagcucaagcaauccgccagccucagccucccaaagugcugggauuguuacaggugugagccaccaugccugacuuccugacuuucaaagagaaaaaaguaggucaauaaacuacugaacucaucaaaaagaaacaaacaaaaaacccaaaaaaaggcacguaagauugaccucaacuccuuauuuaaaaauuaaguuauuaaaguuuagggugcuacuucuggugaugccugugcaccucgccagaccagcccuccagagacaaccacuaugaacugaacagaacguacaaaaaaaccugaaggcuguggagagauccacaagcagacagacccugcagagggcuggacauucagaaggaagaaacagcacugagccauucucuuuuuccagcuuuucacuaagaguaguaucuguccaugccccacacacagaaaucccaaaucccucacugagccagaggaacuggagagugagggaggaaagagagcugcaacgccugggaaggaacccgcccacgucucaggcugaccccgaucuguacauacgaggggcagacuccaaaagcaagcaagccggcuaaagcuacaagaacugaauuaacaccaugccgcagcccagcacagacgcaggggagcaugcagucugaagucacccgagugaacugccugcugcaacagaaaaccaacacucuccagaggagcaggacagaacccaaagucuccaaaucuaucacucacaguguccaggaugcaaccugaacccagcugacccauaaauaagcaggaaaacgugaccccugcugaagagaaaacacaaucaauggaaaccaacaccaagacaaaacagaucauaaaaucugcagagaaggauuuuaaacaucuuuaaauccugaacaagaaaccugucaccuuagacuuuuuaaugccacaaaaauacuccucaagaaucaagguaaaauaaagacuucaaaaaacggagaaaaugugugcagcacagcaagagaugcugaaggagauccuucacgcugaagggaaugacgccaaacacucagaucuucaagaagaaaugaagagcaccagaaauggcaaguauaaggccauuuuuccucuuaauuucuuucaaacacauguuuuccaaagcaaaucuccugacacugcaggaggcggaugugaugucuagucuaugaaaacugcagcacagaagacgaaggggaggugacaaaagcaccugugcaguuagaggucacaguuuacacaacgcagcaucauggugacucuuaguagacuguacugauaaaagacaagguuaagaauguguauucuuuuuuuucucuuuucuuugagacggagucucgcucugccgcucaggcuggaaugcaguggcgugauuguggcucacugcaaccucugcuuccugguuucaagcgauucuccugccucaggcccccgaguagcugggauuauaggcaugcaccaccauacucgccuaauuuuuuuauuuuauuuuuuaguaaagacaggguuuccccauguuggccaggcuggucucaaacuccugaccuugggugauccacccgccucccaaagugcugggauuacuggccugagccaccgugccgggccaagaauguguauuuuaaucccuggagcaacuauuaaaaacauaaugcaaagaggaauaacuuaauagucaacagauacauuaaaaucaguucuagaaaauauucaaauaauccaaaaacacaagaaaaaagaaaaagcagaaccaugaccaccagacgcaucucacagaaaaugaacagugaaacggaagaccuaaaucaaccacaccaguaauuaccuuaaacauuuauagacucagcacugcaacugaaaggcagagauuaucagaauggauuaaaaauugccaacuauggccaggcgugguggcucacgccuguaaucccagcacuuugggaggccgaggugggcggaucgggaagucaggagauugagaccauccuggcuaacauggugaaaccccgucucuacuaaaaauauaaaaaauuagcugggugugguggcggacgccuguagucccagcuacucgggaggcugaggcaggagaauggcgugaaccugggaggcggagcuugcagugggcggauaucgcaccacugcacuccagccugggcgacagagcaauauuccgucucagaaaaaaaaaaaaaagccggcgcaguggcucacaccuguaaucccagcacuuugggaguccgaggcaggcggaucacgaggucaggagaucgagaacauccuaacacggugaaaccucaucucuacuaaaaauguaaaaaaaaaacuagccaggcgugguggcgggcgccuguagucccagcuacucggagaggcugagccaggagaauggcaugaacccgggaggcagagguugcagugagccgagaucgugccacugcacuccagccugggcaacagagugagauuccgucuuuaaaaaaaaaaaaaaaaaaaaaaaaaauugccaacuauaugcuguccacauaaaaugcacuuuacuuugaauagauuaaaaguaggccaggugcaguggcucacaucuguaaucccagcacuuugggaggccgaggcggguggaucacuugagcccaagagcuugagaccagccuggacaacauggcgaaaccucaucucuacaaaaaauacaaaaauuagcucagcacgguagugugcaccuguacucccaguuacuugggaggcugagguaggaggaucccuugagccugggaggaagagguugcagugagccaagacugugccacugcacuccagccugggcaauagccugucucaaaaaaaaagaaaaaaaaaaagguaaaacgaauaaaaaaagauacaccagacaaaaugcacacgaagguuggaaugacuguauugauaaaagacgaggcuggguacgguggcucacgccuguaaacccaaaaauuugggaggcugaggcaggcagaucaugaggucaggaguucgagaccagcccggccaacauaaugaaaccccgucucuauuaaaaauacaaaaauuagccgggugugguggcacgugccuguagucccagcuacucgggaggcugaggcagcagaaucgcuugaaaccaggaggcggaggguacagugagccaagaucacgccucuacacuccacccuggcgauagagugagacacugucucaaaaaaaaaaaaaaaacaaaaaaaaaacagguguauuuuuggacagaauacuacaagacagaaaagggugaauuuuuaggaagacauuacaaucacaaauguguacacguguaacaacagagcuuccacauacucaaaacaagaauuaaaauuaacaagagagaaauccacaguccucuccccauaauugauauaaggagguaaaaugguggccugugaaaagcauaaagacaugagcaucaaaaagucaccuggagccagguucgguggcucacgccuguagucccaacacuuugggaggccaaggcgggcagaucacuugagaucaggaguuugagaccagccuggccaacauggugaaacccugucucuacuaaaaauacaaaaauuagcugggcaugguugggugcgguggcucacaccuguaaucccaacacuuugggaggcugaggcggguggaucacgaggucaggagaucgagaccauccuggcuaacacggugaaaccucgucucuacuaaagauacaaaaaaaaaaaaaauuagccaggcauggugacgggcaccugucuucccagcuacucgggaggcugaggcaggagaauggcaugaacccaggaggcagagcuugcagugagcugagauugcgccaccgcgcuccagccugggugacagagcgagacuccaucucaaaaaaaauaaaaaaaaauaaaaaaaauuagccaggcaugguggugugcaccuguaauuccagcuacuagggaggcugaggcaagagaaucacuugaagccaggaggugaagguugcagugagcugagaucgcgccacuacgcuccagccugggcgacagagcaagacucagucucaaaaaaaaaaaaaacaaaacaacaaaacaacaacaacaacaaaaagucacuugggaagucugucuucagccaacagugccagagaaggccacacacugguggcugcaggugccauuggcacaugaccaucggcccaccuaccgccuguccggcuccccacagggcuccacccuuaccucuauuuugcuggaaguccuuaccaacaccugcauuuaacaaacagcaugggaucagacuugcaggucaucauagcuuccuaugaagcugucucuugauggagaaugaaaaucauucucagggagacauucacagggaggagcaaaggggugggagaagcaggacacaaauagaaaugaaaacacugucacaagcaugagguugagucagaacacacaugacaagacaugacaauuucagucacuuuaacuccacugcucuggcacgggauggacccugagcugccccgucgguucacuugaacuccacugcucccgcaugggacggagccugagcugcccuguugguucacuuuaacuccacugcuccggcaugggacggacccugagcugcccugucggcucacuugaaauccacugcuccagcaugggauggacccugagcugcccuggcuguaaccaagcccaucgggccauguggaggcugcugucguguugcuuugucaucauuuaugacagcauggcaguguccucacacucgcaaagggcgagggagucagagggugccucuuccacaggugcaaaacagcacaggaagagccuggggaacgcggacgcaauuuaagacuuggggugagcaucagaggccagccacgugcuuggcacccgggcuugugccuccucccagagcccucuuaggacaccuggacaguuucccuaagaaaucuugacucagagggccgggcgugguggcucacaccuguaaucccagcacuguaggaggccaaggcaggcagaucacuugaggucaggcguuugacaccugccuggccaacaaggugaaacccugucucuacaaaaaaaauacaaaaauuagccaggcaugguggcauacguuuguaaucccagcuaucaggggaccacuugaaaucaggaagcagagguugcagugagcugagaccaugccacugcacuccagccugggcaacagaaugagacugucucaaaacaaaacaaaacaaaaagaaaucuucacucagaacuucacuuucgccccggugcugacccugacaagauucuauccaaccgccacccacuacuggcauugccaggaauaguuucaagaauuuacgggacugucgcccuuacaaaugugccauguacagcacugggcuguccccaggaugccccuccauacacaaggacacaagccuuccagguggaagagagcaaggacucgggcgggaggcgcugggcuguggagucacgacucaccuucuccaaaucguccuucagacgaguuucaugcugcaacuucccauacaaauuucuauuuucuauuuuuaggaguucaauuucuucuuugagcucagucugaagaagcgaaaguugcaccuugugcucaguuuccagacccaagacucuggcugcccgcucugugucggccuccaaguccccguccugcacacccuggagaugcacccagggaagcucuguguggaaaaggagcagggaagacagucaggccggugccggcccucgauggagcccacaguccgcacaggcagaacggcaaccuauaaaugcuucugacagcagacacuguggauuuucaagcucugugcugacucagugaugaaagcaggcauggcucucucaagucuccccucccuuucgggacaccuccaugcugccccagcacagugccgucccgagucacagggauguccugggcccacacgacagccacacgacccgcccaggcuacuccuucaggucaggugugacaugugacccuccaugaguuccugagugagccucaugccugugaccagaugugggcacacaugugucacccagggucuaugaggcagccacaaggacagggccugagcucaggggccugccaggguuccugucccagcaccucccccugcuguucugugcccaggcacgcuacccccacuggcccaucucuucuucugcagaagaggaaaaaagcagaagggacuaggugcuggccaggcaccaguggugccaacgaccaugggcaucaagggguggcuguggggacaauuguggugcagggcaggcaggagugaggaccagaugcaggcgccgcugcaccacccccagcuugaaggaggcccaggcaggcccaggcuucucucaacuuggccacagcccagaauggagucagaccacacaccucccagcaggacccgcggccucagccccucacccccaccauggacggcagccccaccaucagcacaguccacgccaguggccagggccgccugccccuccuggaacccgucaguggccacuguccggcgccaugggaccgcgacucugggaugacugcaguuuccucuccgucaccuucugaccccacagcccugugccccgugcccugccuggacaucccacaaccuuagucugacuaggcgagcugggguaccugggccugcugggagcagagcaggauccuggaaaagccuccccugggcccaguggacacacauucucccuccagaggugaauggucaccauguccauccagcaauccccaugacccccaggguggcugcccaggucagaccugcccugcuggggcgcuggcccaggacacgcacuccugcccagccagugaccccgccucuaacgccaaacccucaucaggacacacucuguugaggugucagccccagaagaagaggucggagcacucagcugcuucacggaggacuuggaucgaacccaggcacccaggcuccccgagaacgucccccagacccgggaccugccgacaccauggcgaggcgggaggggcccaccuuggcugugcccuucagaggguuccagacgccacucgugucccaaugcugaagucucuacgcagcaucugucugagacaugccccucgugcuggaugcagaggggagacuccagcgcuuccagcuggugccuguggcuuucuucuaacuccgccuggaagcguggcaggcucuccuacagagaaaccacgugggacaagcacguuagugagccaagcuaccucgcucgcagcuauaacccucaaagguguuuccugcuaugcacaaagaaaacucaaaccucacuagguucaugagaccacacgcugcgcccuggugaaccccgccagcccacuggcgugcucacaugcucucccgcccacacccgucucucagucaggccuccggaagacauacaagaauugguggcacugacagggacuggugcuccucagggcggcagggcccuggaccgggcagaccucuccucaauucucucagcagcaaggucgguagggcacgugccccucgcgucuccccugguggccucacaucucagggcugggcucucaaggccagccuccugugaccacugcccacuaacagcuggguccucgucacacccacgcgcagaggcagggguuggcucucaggugauacacgaaugccugguggggcuacccaccccagcccuuccuggguucucucuggugcaaggccugcucgugggaagguccuggcugccuguuccagccgggcccuugcccuucucuggcauuucccccauagccucuugugcagcaaauucuguguugggguccgcuuugcagggaacucaaacuggcacacagcccgcugccacccugccuggacacccuguggccuccagcaggcccagggacccugcuccagagugagggcuccuggccgcugagcccagaugccccgaguuccccuccacugguuccaccgugcaacaagccacgcggugcugccccugcgucuccucccugcccucccgugugucccccggagcccgacaccgggcuugcucaugcugcacaucaagugcuccacagccacacauacugcugggcaccacacuggcagcacagacccagaacagucuacaucccagaagcuccguuuggacaguuugccccacagaaguuaaaggugacagaagucgcagcacggaagcaacucaaggaagaaacacaaaagccagcagacgcuccguguggacucaaagcaaagacacaauuucacacccuuugaacugccacugucaagucugacgaaugcagccccacugcaggguggaggccuugcccacagccagggcaucccagggcugagggaggggcuccggcucccccggccacccccuuuccugaucaaacagugcauggugaggcccaccgcggagcagcagugaggucggggcagcauccgcaagcagccuuccuccccuggacaaggugggaaggacggaaacacaggcucuauaauguggaagacgcagggcuggaaggucaagagcacaggacucccccacuucucagcgcgcggccaauuaccuuaugucgcucaggcucgaguucaucaacgugaucuuuucuuccuuucucagguuucucuucuaaacccacacaggacaaccugaagggaaaacauuuuauaaaagcuuuacacacguaccccuuuuccaugugugcgccauucccuccccaggaccgacugcucacagcagaggcgccuccucgugcuuccagucaaggacgggcaauguccaugugcggggagccguggcagucacaaagccagagacacggcacagggacaugcaggucuggaagaaagugugcccgccacugacucucucucugucucucucacacacacacacacacacacacacacacacacacaccuggaggagagugccccugccaccaacacacacacaugccuggaggagagcgccccugccaccaacacacacacacgcaggccuggacaagagcgugcccacugacucaugcacacacacacacaugcuggccuacacgagcguguccaccaccaacaugugcacgcaggccuggacagaguguggccaccaauggcucgcacacacacaugcaggccacucucgggugcccgugccugugucaucuuuuaaaucuggaccauaaaauguguuuguauaaaaggccauuggugccuacuagcaugaaaucaccaacaaaacuaccccugaacucagagccuggccccuguauggcagaaacucacugaggcuggaacugcuuugcuuacccaacuuccacagaguccagaagagcaucuucccucgcccccugcagccucugcuguaacaggguuaggucuucuugguaaguuuucucagcaucccuuaacuucuuuucaaaauaaauccucaguugcuccaguucggacucaugcuggguuuuuucucgcugcuucagcuguucuaaaucuuccacacgagaggugcgcgccaggaguugcucauguagcucugcaacauaacggagucaggcaaucgucuuaaaaugggacacccacaacaagccaggcgagaggcaagagccugguuaccuguggugggggcagaacucggaaaagggcccaucccagaaccggagagggaugagggaccccuacggcuuagacucucguacgccccugaauguggagagcucucuccaagcgguggcaagagccacagggcugggagcaaaagcagcacucgaaguggcagggauguggggggcacagccagcaaggagacagacgaugguccugcagccccaggaaacuggauccagaccaaccucgagcccagaagcaggcucaucagguuggcacacgacagcugacaccuggaugugggcuaugggggacccuggacagaaaacccagcuguaccaucuuggacuuucuguaagcugacaacuguguuguuuuaggccaccaaguuugugauaauuuguuacacagcagcagagaagcaacacggacccuaaaagaacuugucuccauggcuacuauggucagaauacagcccgcugcucuacagcagcugacagccagcaacgggcaccccagagagggcaaaucgggguucucugcaugggucccgagaggcaggacagagacaagcagaggaccaagccagagccggagcccgcggggagcagcugugccuguggcccccucagcuucucucuucuccagccuccagcgacagacagacccccagaggaagauaaaucgacaugcucucagcugcaccuggucccggcagggcgcagggcugggaggcggagccaggccuggugcccuggugacaguggcagugucuccaguucuuucuccuaagugcucuuugcuucaaaucccaccacccacaaggacaaguugggccaaaaggcucugucggcacaugaaugccaggagacacgcaguggcucacccuccuguccuguggaccugggcgccggugccugaauugggcuuggccagccccugcccucaggcaccauccaagccugcugcacaaagaccucucugacacggaauggggggccuggggucggggucuccagaggugcucagcuauaaggggacaccuggagcagagcugccuucagcaaguggccuggagagcuggggccacaggagccuggcagcaggauguggggcacugcccugugaccccagacaccaggugagcccgcacuuggacagcacucaaccguccuuccgaggcaaacgcucagcaccacugguaagcuuuccuuagacaugaaggcacccccugcaaguguugcucuuggccuugagggacacacaggugcacgucacugcugcacugacuugcuuagcauaaaaccagggcucucucccacaaagcaaaccuccacuuucaaaccagacaccucaaccuucaggaugucaaacagguaaauccacuuuuuuguguuugcuagaauuguuaaauucuggcuugguguuacaacaaugaaaaacacacagcuucagcuuuugaggaucugaauuuuccaauacaauuccucaccacucaauuccugucuacugguccuggcagaaucaagcugggaccacaagcgccugaucucuucuugugauugugccuucaggucuucauaugaugcuugaagauucucuaacuggaaaaagcaaaguguccaggugaaacccuaaugagcucaaggcccccaccccagcagugacgugugcgguuuuaucccugccacugcgauccuaaggguaaaagcucacaucccaaaccugcagcucggagaaagccagccacagcagagaccgagagagcucuguccgugacaagagggaucggucagcgcugaccccacaaggccaggcacuuucagaaucucaggaacuuccaggucugucucagcugaggagguggcacggccagguuccaugccggccgcagcggugcaguuucaucuugugcaccucccugcuucgguuuagggucauacauacagacugcugaauggaauuuagggagucuuacuagcccacaguacccaagacucccaaauaggaggucucucaguuucaauacuucuacauuaaggaagcagguaccucuuacaccgugacacuaaacuuuucuguacaaucagcaagagcccagcccagcgcagcauggcgugauuuccuccugggcaacgcugcaccuggggcuggccuguccuccucauggaaacggcuccuccuaccuuucccaaucaugggcaucaggaccagaagaugcuaccagcccccucuuucccaucucggagggagagccuggaagggaccagggagagacuggggguguggagugagccccggccuggacucucugcaggagaggagggugugugggcaccagagucccgcugggagacacaaggggcccaggacaggccucccuaagacccuagaccccaacuacuuccauauucucauguuuguaaaucuuucacacaccacgauuaacccuaucucugauuuaugcuuuaauuucuucaacugauucuugggauacucaguuugagucucagguuugucaggccuccaaugaggaccuggccacaucaacauuuugauuguagugcuucauuagagaagcaucuugaauacacacagcagaaagaaaugcuuguuaacuuuuccuaggaaucucguguguacuggaucacgguuagaggauguggccuuacacuccuaccuagugucugcgauuuguguaacugucucagggacgccugcaaagaacaugcauuccuaaguacaagauugaacguaauuauuaaaucagucucagagacuauauccuuacacuuuuauucaccacuaacacucuauuuauuuuuuuauuucauuuuauuuuauuuauuugcuuuugagacggaggcucgcuguugcccaggauggagugcaguggugagaucucagcucacugcaaccuccaccuccuagguucaagcgauucucgugccucagccucccgaguagcugggauuacagaugcccaccaccaugccuggcuaauuuuugucucaaacuccugagcucaugaucugcccaccuuggccucccaaagugauagaguuacaggcgugaaccacuguucccagccagucucuuuaaauuuagaacuuaaguuuuagcaaauaacacaauacgaaauagcccaauuccaaaaucuguuaaaacuucccuaauauaccaaguaauuaaauaacgaagcugcugcccaccuccagcuguuuuucuuucucgcucucuuugaacuugaacuccaagucuucuaaacaccggccgugcucggacugcaggucuucacguaacuucucaauggcugcuugaugaugacucuccagguuccuaagggccccuagaaagguaaagcaauggcacuugguuuacaagacaucacucuccucaacagcgaccucagugacaauaauggugcacccagagcgcugccacccagagccccauccugggcgcccccgggccccucguuugagccucacaugccugauagcaccaggggacaucgccuacccaugccacccaccaugagggucaagcuggaacacacaacccuggaguaugaaaagugaacaaccacaaagcugcugcuuuguaauaauuuagcaacugaacaugccaagaaaaaucucugaaacaaagaucaggaagguuuaaggacccugagagaccugugacccaugacggccaccagcgugucacacgugcauggggccauccagcauuuagaagguaggaaacgugcgcaaugacgcauggugacaugaacgacauuccuuccaguacuaccuaggaaaauucagucccacuccaaacuugcucauuuucauuacuuacguucagccugguuuuugucuugaaaaaucuucuccaacucagcucucuguucugccaauucuuucugaaacugguuuuguaaauccuccauuucugauugaugcuuugcagacaguucuuugcguagauuuucuaaacauaaaucuuuuucagauucccaaucuuccuucagggucuaauuuaaaagaaaaaaaaauuaaacucaauaguugauuaucugugcuaaagaaauuuaaaucacacagucaaaaccucugagcaggccaggcaacguggcucaugccucuaaucccagcacuuugagaggcugaggcaggcagaucgccugagcccaggaguuaggguuacagaccagcccgggcaacauagugagaccccaucucuacaaaaaaaaaaauacaaaaauuagugggaugugguggcaugcaacuauagucccagcuacucgggaggcugaggcaggaggaucaauugagcccaggaggucaagacugcagugagcugugauugugccacugcacuccagccugggaggcagaaugagacccugucucaaagaaaaaaaagaaugggcagucauggcccccaacuaaacuguccugacaggccuuacacccagucucuccccugaaugcuggcaggacagaaaagcagaagcauccaggaggcaagcaguugaggaaaagugagcaaggaccacccaccacaaaacagacugccaucugcacacgaggaccacccacccugaaacagaccagccucugcacagggacaacccacccugaaacagaccagccucugcacagggaccauccaccccaaaacagaccugcaucugcacaaagcgagaggaccaccuacccugaaacagaccagccucugcacaaggaccacccaccccgaaacagacgagccucugcacgcaaggccuaauccacacagucacccucaaagcguuaguaauacaucucccuauaagucccaggggccaauggcaacuuugccaaccuccacccaagggcugggcucugucccaaguguucugagaaaugggucucacugccugcgucagaggagcaggugaccggaacacaaccccaagccuggacuaacacccaucgucugccaagggccugagagcugcccagaugccugacucaggaagggccuccacacucagcauggcugacagcucagcccucuagcggagggccuggcaaugacggggcacugcuaccugugguccccagugaggccacccacagcaggugcaacccaccccacccaaaaccuccucccugugugguauucuccccggcaccccagcacccacaccccaugcacugcagggaacugccacauccacgagggcagaggcugugucccagaacacagcucaggggcaggccaugggggccacucagaagacagcauggaggggccgagcagugccuuuguguuaugcaagucaaugugaaacaacaaaacaaguuuucugacaaauacaaaugauauaaauaaacaaagaacgcaauacacuuucaaccagcauauucuaauaaagccucgacuggcuucugucugaaucaaggugaggagcguucucaugggaccuggcgagaaaggaaaaacaacauacacagaggcgugcauuuuagaaucgaucccggguaccuuuacuaucugggcguuuuucuccauuucugauuguaacuucuccuucagcucagcugcaagaaaaacaaaaagcagcucaggccacuccaucucaaccuuuucagugacccaacugcccaggaaacgaccaggcucuggcacccacuggacacgugccagcauucacgggcuagcaggaugugucugugaugaugcuuggcuuuaauaacaaacugaggacaccgugacuuccagacacacaggacgaucuaagagaggaggugaaggucagcccugggucgcaccuaucacagaccaccuggaaaccugcucuaauaaucuccuggccacaaaaacccaagggcccccuuuguucaccccucucauggugccagacaccaggcaaggugcugagaacagagauggggagacggugcuagggcgccccagcucccaaccccaagagggaacaggcacuagaaugcccacaccgagcccacacgcugcccgugcccgccuagccaugcaguaccugcuuccuguccacaccugagcaccaccuccuccuucucccgugcgugcugcucccugaggagcuccagcucgugcugcugccugcucuguagcagggccagcuccugggcacgccggcuguugagcaucucccgcagcuccgucaaugccgucuccuucuccuucuggagguuggccugugucagcuccagcugcgccgugugcauguugcucagacucaggcgcagcgccuccagcucaaggccaugcacggccugcggcggagaaaaggccucugauaagggcccauggucagaaccagggcgcaucagggagacacagaagcaugaaugagaaugaguaaggaagacacagaaaaugaaacagcagacaucccguggaagcaggggcaggacacagaggcccggaugccacugagaugccacccagcuccucugccagugaccccacagcgcaucacugcccugagcaccagcaccccgaauucccucgcuguaugacggcacuguguguaccuggagggggcuucgcagcugacagggagagcaaccggccugaggucagugugucauucauguggccugcaccugaccaagcccccugacccccagcauccacgugugucuccuccaccggcccugcugauggccccacacacagaacguggaaacagacaacucagagaaaggagauggcagcgcccaccccacccccacccggaugcccacugugcccuguggggauaacagagcccaugcugugagccugugcaggccccgccgggucaccugacucugaugcaggccagccucaucuucacggccgcucuccaggucaguaauggcaaguucacauucuuguucacacuccuggggaaaaaaggcaaagaauguagguccagaauucacaugagaagccacagugaugugcucaagaacugacgacgcacguccucacaaaaccccguucgcagcuguucacagcagcaccacucgcaacggccagaaggugggagcaacccaaaugccuccugagggaugaaugguugaacaaacgugggcugccauucagccacaagaaggaacgaagccccaacucaggcugcaacacagaggagcccugaagacgugaggcugagugacagagcagacacagaaggccacguauggugagguuccguuuacaucaaguguucaggaucugcaaauccguagacauggagcagccuggaggcugcgaggagcugagggaggagagcgggguggcugccgcgagcaccgggcuuccuucuggggugaugaugaugucuggagccacuggagauggugcucacacaugcugugaguguacuaagugccacugaggucuguacuuuaaaauggugaaucguaugcuuguuaauuguaucucauuaaaaaaagaagaaggaaaaauauuaaacucgcuuaaaucacaauguaaagucaaagucccagaaacaggccaggcaugguggcucacgccuauaaucccagaauuugggaggccgaggcaggcagauuaccugaggucaggaguucgagaccagccuggccaacauggugaaaccccaucucuacuaaaaauacaaaaauuagccaggcgugguggcgggcaccuguagucccagcuacuugggaggcugaggcaggaggaucacuugaaccuggaaggcagagguugcagugagcugagaucacaccacugcacuccauccugggcaacagagcgagacuccaccucaaaaaaauaaauaaacaaaauaaagucccagaaacagaagcuguggacucuccccacgccacagcagugcugccacgggaggaacaaacaaccugcucucaggaaaaaggcggaaaugacgccuacagagagaaaaugugcauaaaaugccuggaaaaaguggguaccgaugaaagguaaaccaaucuagagacacaaacuuuaaagauccuuguauggccacuaaaucagcaaaaguugggaagaauauuacgaauccucagugccaccacagucacaagaaacaaaugcacccaaaugcuaccaacaucagaaucaguugcuucaacuuuuuucucagcagccauuuuggcaacacaggucgagccacagaaagccuuucccugucucaacauucccaccucuggaaaccuuuucagcagcaauaacccaaagggaaaagaaaagcugcagggggcccgucggcacggauccugagcccaccgucacuguggcccucccugcaggcuccugccccucgacuggcgccugggacguauccccugccuguggaagcgaccauucucuggcuuccccugcaucagccaggcaccuuucugggcuccaggugacccacuugcucacagaguacuuccgauuaaaaaaugacccaaacuaaauuuuucugccccaacuggggaacuggcuagggauggagagauacaggcuugauacaguugcaaaagcuagaaaggcccccggaggaacuggacagggaagggcggcauggugggcuccacaagggcugccugugcggggacucguccccagggugggcggccacaugagugcagcaacaucucccuucaaugucaggagcucgggccgggcgcggugguucacaccuggaaucccagcacuuugggaggcugaggcagguggaucaugaggucaggagauugagaacauccuggccaacauggugaaacccucucucuaccaaaaauacaaaaaaauuagcugggcgugguggcaggcgccuguagucccagcuacucgggaggcugaggcaggagaauggcaugaacccgggaggcagacccggcagagcuugcagugaacagagaucgcgccacugcacuccagccugggugacagagcgauacuccaucucaaaaaaaaaaaaagaaaagaaaagaaaagauaaacaaaacugauagaucauuagugagauuaaccaggaaaggaagagagaagauccaaauaagcucaauuggaaacuaaaugggagacauuacaaccaauaccacagaaauaccaaagaucacucaaggccacuaugaacaccuuuaugugcacaaacuagaaaaccuggaggcgauggauaaauuccuggaaauauacaucccuucgagauuagaccaggaagaaacagaaauucugaacagaccaguaacaagcagcaagacugaaacaguaauuuaaaaauugccaacaaaaauuguccaggaccagagggauucacagcugaauucuaucagacauucaaagaagaauugguacuaauccuacugaaacuauuccaaaagauagagaaagaaagaauccuuccuaaaucauucuaugaagucaguaucacccuaauaccaaaaccaggaaaggacauaacaaaaaaagaaaacuacagaccaauaucccugaugaacauagaugcaaaaaucuucaacaaaauacuagcuaacggaauccaacagcacauaaaaaagauaauacacuuggguuucauaccagggaugaagguucaacacacacaaguuaacaaaugugauauaccccauaaacagcauuaaaaagaaaaaucauaugaucaucucaauagaugcagaagaagcauuugacaaaauccaggaucccuuuacgauuaaaacccucagcaaaaucggcauagaagggacaauaaaagccauucaugacaaacccacagccaacauuauacugaaaagggagaaguugaaggcauuuuagaacuggaaaaagacaaggaugcucacuuucaccacugcucuggaguccuagccagagcaaucagacaagagaagaaauagagggcauccaaaucaguaaagaggaaaaacagucccugucugcugaugacaggaucguuuaccuacaaaacccuggagacucauccagaaagcuccuacaucugaucgaugaauucaguaaaguuucaggacacgaaaucaacauacacaaaucaguagcacugcuauaccccaaaagugaccaagcugagaaccaaaugaagaacucaacaccuuuuacgauggcugcaaaaaauaaaauaaaauacuuaggaauauuccuaaccaaggaggcgaaaaaucucuacaagggaaaccacaaaacacugcugaaagaaaucgcuggcugcgcacgguggcucacaccugcaaucccagcacuuugggaggccgaggcaggcggaucacgaggucaagagauugagaccaucugcugaaacuccgucucuacuaaaaauacaaaaauuagcugggcgugguggcacaugccuguauucccaacuacucuggaagcugagguagaagaaucacuugaacccgggaggcggagguugcagugagccgagaucaugccauugcauuccagccugggcaacaagagcaaaacuccgucucaaaaaaaaaagaaaaaaaaaaaagaaagaauugaugacacaaacagauaaaaaacacauccagguugguauggaugcagugaaaacagaaaaccuuugcacugcuggugggaacguaaacuaguacaaucacuauaaaaauacaguauggagaccaggcacaguggcucacgccuguaaucacagcacuuugggagggcgaggggggcagaucaccugaggucaggaguucaagaccagccugggcgacauggugaaacccugucucuacuaaaaauacaaaaauuagcuggccgcaguugugcacgccuguaaucccagcuacuuaggaggcugaggcaggagaaucacuuaagccuaggaggcagagguugcagugagccaagauugcaccauugcacuccagccuggccaacauggcaaaaccccaucucuacuaaaaauaaaaaauuagucaggcauggcggugcaugccuauaaucccagcuccucaggaggcugaggcaugagaaucacuugaaccugggaggcagagguugcaaugagccgaauuugcaucaccacacucgaggcugggcaacagagcgggacuccaucucaaaaaaaaaaaaauaaguaaaaagcauguaaagcaggagcaucacuugaggccagaaguuugagaccagccuagugaauguaacaagacuccaucucuacaaaauauuuaaaaauuugccaggcaugguggugcaugccuguguucccagcuacucaggaggcugaguagaaagacugcuugagcccagggguggagagugcaguaagcuacgauugugccacuuacugcagcaugggcaacaggguaagaccccgucucaaaauuaaaaaacaaaacaaaacacguccaggaggccagguguggaggcucauaccuauaaucccagcacuuugggaggccgaggcaggagaauggcuugagaccagcaguuagagccuacccuggucaauauagugagaucccaucucuacaaaaaaauuuaaaaauauucccugccuuacuagacgugagaaaaaauaaaauaaaaaauaaaaauuauauuaaaacgugucuagggaaagggauauuuuuggaagacugaucagaugaaaauguggcacugaacuugaagggacucccacgagccauaacacagacuucucacaaaaguaacacaaacaccucacuaaaaaagaccagacaaugugcuacuccaagcggaauaacggacauauggaaaacagaaaacauucaaggaaccaaaaaaagauccugagaaguggcacccacggcagacccaaaauaauagugauccaaaucaacccgagcaacacauuccauucaaaguggaugggcuggccaggcgcggugacucaugccuguaacccccucacuuugggaggccaaggugggcagaucacuugaggucaggagcucaagaccagccuggccaacauggggaaacccaucucuacuaaaaauacaaaaaucagccggauaugguggcacacgucuguaauuccagcuacucaggaggcugaggcaugagaaucucuugaaccugggaggcagagguugcagugagcugagauggcaccacugcacuccagccugggcuacagagugagacuucgucucaagaguucgagaccagccuggccaacauggcaaaaccccgucucuacuaaaaaaaaauacaaaaauuagcccagcaugguggcgggcaccuguaaucccagcuacuugggaggcugagguaggagaaucacuugaaccugggaggugaagguugcagugagccgagaucacaccauuacacuccagucugggcaacagagaaagacuccaucucaauaaaaaacaaaguggauaggcucacugcaccuccaaauaccaggccaaaguggagaccaauucacucacaaaaaaagauguacaguuaaaauaaguuugaaaauaucucuaggaaacaaaaaauuaugcagaauaacaaccaauuuuaaagaauccaaauagaacuaaaaacagcaagaacaaaauuaacaacucuggacguauuuaacagcagauuauauacagaugaacagagguuuagaaaaaugggagauaacacagauaaaacgauccagccuacggccaagagcaaaaagaaggcaagcacaaaagugggcugagcuauacguaugugauaugauugggcuguguccccacccaaaucucaucuugacuuguagcucccacaauucccacgugucaugggaggggcccagugggagguaacugaaucaugggggcgggucuuucccgugcuugucuccugagagugaauaagucucacuagauccgaugguuuuauaaagaggaguuccucugcacaaguucucucucuuugccuuccaccauccaccuaagaugugacuugguccuccuugccuuccaccaugacugugaggccuccccagccacguggaacugugaguccauuaaaccucucuuccuuaauuacccagucuuggguaugccuuuauuagcagcaugagaauggacaaauacgguaugcaagagaacucuaaaacuuaauggagagaaagaacagguagaagguaugauggagauacugguuaggauuugaggcaacagaugagaaaagcaucauccacacauugaagaaaacccuagaucccaagcagaaucaaagacaucauaaaaagccauaccuggugugauaguuaacauugucaacuugauuggauugaaggauacaaaguauugucccugaaugugucugugaggguguugccaaaggagauuaaaauuugagucaauggacugggaaaggcagauccacccucaaucuggguugccaccaucuaaucagcugccaguguggccaaaauaaaaccaggcagaagagcguggaaggacuagacuagacugguuagcccucuggccuccaucuuucucccaugcuggaugcuuccugcccucaaacaucagacuccaaguucuucagcuuucggacucagacuggcuuccuugcuccucagccugcagauggcuuacugugggaccucaccuugugauuaugugacucgaugcuccuuaauaaacuccccuuuauaugucuaucuauccuuuuaguucugucccucuaaagaacacauaaaaucaaaacugcagaacaccaaagacaaaagccuucaggguggccacggcagugaacacaagcuagagaggggcagagcgaaaccaccggcaagcaagacaccaacugccaacuauaugucuacgccagccaggcuuucaagaagggaaauaaaaacaggccaggcacaguuguucacaccaguaaucccagcacuuugggaggccgaggugagcagaucaccugagaucaugaguucgagaucagccuggccaacaugguaaaacuaucccuacuaaaaauacaaaaauuaggccgggugcgguggcucacgccuguaaucccagcacuuugggaggccgaggcggguggaucauuugaggucaggaguucgagaccagccuggccaacauggugaaaccccgucucuacuagaaauacaaaaauuagccaagugauaguggcaugcaccuguaaucccagguacucgggaggcugaggcgggagaaccccuugagccugggaggcagagguugcagugagcugagaaugggccacugcacucuaggcugggcgagugagagacccugucucaaaauaaauaaauaaauaaauacaaaaauuagccaggcaugguggugcacaccuguaaucccagcuacucgggaggcugaagcaggagaaucgcuugagcccaggaggcagagguuauagugagccgagaucaccgcuccagccugggcgacaagagugcaagagcaaaacuccgucucaaaaaaaaaaaaaaaaagacacauucauuauucauauucacaaaaaagcuagaagaaagaugucccucaccaggugaguggauaaacaaacuguguaccaugcacacaaugaaguacuaaccagcaucaaaaaggaaugagcuacugaucaaucuaaagcuuggaugaaucuucaacucauuuugcuaagugauuuaaaaaccuggacccaaaagccuacauauuauagaauuccaucuguagaacauucuggaaaaggcaaaaccauagaacaaaaaacagaccacugguugccagaggcuggggaaggagagagcggcugguuagaaagaggacacgggcccucuugggggcugggguuguucucgaggguaacuggguggugaauaugacucuacacaauugugcaucacaaagaaugaacuuagaagcaugcaaauuuuagggugggcgagguggcucacaccuguaaucccagcauuuuggaggccgaggcaggaggaucacuugagcccaagaguucaagaccaguccugucaacacagugagacccugucucuacaaaaaaauaaaaacaaaacuuagccaggugugguggaacgugccuguaaucccagcuacuugggaggcugaggugggaggacugccuaagccuaggaguucaaggcuguagugagccaagauuguaccgcugcacuacagccuggacaacagagcaagacacugucucaaaaaaaacagucugcgcgguggcucaugccuguaauccuagcacuuugggaggccgaggugggggcggaucaccugagguugggaguucaagaucagccugaccaacauggugaaaccccaucucuacuaaaaauacaaaacuagccaggcgugguggcgcaugccuguaaucccagcaacucgggaggcugagguaggagaaucgcuugaauccgggaagcggagauugcggagagccgagaucgcgccacugcacuccagccugggcaacaagagcgaaacuccaucucaaaaaacaaaacaaaacaguaugcaacuuuaaaaaauugaccaggauguugugggaucccaggauaggaaguagccagugaccaaugaaccugacuacauacucaccagugaagacacaaccuuagugaagggcuggggaagagaggagugaccugaguaaccuuggaaaacaguugugacuggaaacugaaaauggagacaaaggagcuguaaacaaacacuuaaauccacuugguaaauuuguuucuuauaugauguggguugcuaauucugaaacuauuauacacuuacaggagaguugaacaaauaaguaaauaaauggggccgggcgugguggcccacaccuguaaucccagcacuuugggggguugaggcggguggaucaucugaggucaggaguuggagaccagccugaccaacauggugaaaccccaauuagccaggcaugguggcagcacuuguaaucgcagcuacuagagaggcugaggcaggagaaucacuugagcccaggaggcagaggcugcagcaagccgagauccugccacugcacuccagccugggcaacagagcgagacugucucaaaaaaacaaacaaacaaacaaacaaacaaaaaaaacaaccuucuaauuuuuuuuuuuaaaguaaauaaauggcagaagugagagccaggcuucucacuauccgagaaggaaacugcaaauaaaccugggggggagggcagaaugaacucuguggugcuggauuaggcucugagguaucaguauguauuccuauuuaacauauaugucuauaaauacaaaugaacauaaauacagcuaugaguguacacacagacuagcucccaggcacacccuuccucacucuguccacggagagagcccagaagcagcagcaacaucccagcaggagugagcacaccuagagcccaggucuuggucucaacaccauaaucuaguaaaaggcaccaagacuccuuggagaaacagcggacucagaacggagacagggccuacacgaugagccugcggcaccaacuugcagugucacaagccaggaugugcuucaaacacaugacacaggagccaccugaaggggcuccccacggacagagcugcaacaacuuaagaaucaaaauguugaggcuacacuaagcugugauggcaccaccauacuccagcccaggggacagaaugagacccggucccaagaagucaauaaauaaaugaagaguggguuuuauagaacccaccagagacugugcuuccaggccucaccuaggaguuagaucuuuccugcaauaaugcagauuaaaaacuaaacuuggccugcauaguggcucacgccuguaaucccagcacuuggggaggccaaggcaggaggaucaccugaggucaggaguucgagaccagucugaccaauaugaugaaaccccuucucuacuaaaaauauaaaaauuagccaggcgugguggcaugcuccuguaaucccagcuacuugggaggcugaggcagaagaaccacuugaaccugggaggcggagguugcagugagccgagaucgcgccacugcacuccagccugggcaagagcaaaacuccaucucaaaaaacaaacaauuugccggccaagugcaguggcuuacgccuguaaucccaacacuucaggaggcugagacgagcagaucacuugaggucagcaccagccugaccaacaugaggaaacccugucucuacuaaaaauacaauaauuagccaggcaugguggugggugcuuauaaucacagcuacuugggaggcugaggcaggagaaucgcuugaacccaggaggcggagguuacaguaagccaagaucgcaccaccagccugggcaauagagcaagacuccgucucuauuuaaaaaaaaaaaaaaaaccccaaaaaccaaaaaacaaccaaacuugccuaaagcagugugaacugagucuagcuagaaucaaauggcuaaaauagaggcuuuuuuuuuugugagauggaaucucggucugucucccaggcugaagugcaguggcacccagcuaauuuuguauuuuuaguagagagggguuucaccauauuggccaggcuggucuaaaauuccugaccucgugauccgcccaccucggccucccaaagugcugggauuacaggcgugagccaccgugcccagccuaaaauauaugcuuuuaacauaacacuucaaaaguagucaauuccaaacuuaauguuuuccuccacaugcuaacaaaaaacaugucaauaaaauaaagguaaucaacucaacacguauggaauucaucccaccaggaacguggcagaaaccagggacaugcagacugaccacagccucccugcccugccaggcucucaacuggcacaggacuuccagucacaaacugaugaugugagaaacgagguaccaggccuaagaaacaggcugaacagacaggugagucaaucgacaagggcaacuagaauaaagggaauucaugacauuccucaaacuuaugaaggguggcuucucuucaaugucccaugggaaaaacaaaaaaggaagaucacaagggaggcagauuugagcucagggagaaggguaugaagagaggcuucccauucacaggcaacacuaagaacgugcaggcggcagcacguggggccuacagggugagccucugccuccagcucucuaugcuuccaguuuccacuucuaaagagaggcccugcagagauggaagguccucucacugguuuggauuucuacaacauaaagaaaucuuuugacaaagaauacaccuuaacagagaacuuaaagaauaccuuugugaacaucccacgcuguucugcuggguggucacugauugugaagaucccacgcuguucugguguguggucacugacugugaacaucccacgcuguuccgguugguggucacugauugugaacaucccacgcuguucugguggguggucacugacugugaacaucccaugcuguucugguggguggucacugacugugaacaucccacgcuguucugguggguggucaccgacugugaacaucccaugcuguucugguggguggucacugacugugaacaucccacacugcucuggaggauggucauugacuugcuucugcugcagcuguuccaaguccucucucuucucuccaucacaguccuccggcuaagaaggggaggaccagaaagaagcauuuaaagcaaggucuagggcugcagccucaggcccuucccagcuccucuaucugcaggccugugcugacuucauuuaacaaguagagcucacuuccaccuguucagaacgugcaccuuccgcauuaacaauucccaagcucuaaacauuuuuuuuuuuuuuuuugagacggagucuugcucugucgcccaggcuggagugcaguggcacaaucucagcucacugcaaucuccgccuccuggguucacgccauuccccugccucagccucccuaguagcugggacuaugggugcccgccaccacgcccagcuaauuuuuguauuuuuaguagagacaggguuucaccauguuagccaagauggucuugaucuccugaccucgugauccgcccgccuuggccucccaaagugcugggauuacaggcaugagccaccacaccuggccagcucuaaacauuuuuauaaugcaaguaauuucccuaaugauguuccugccccucuucuuaaugaauucuacuuuuuuuuuuuuuuuugagacggagucuugcucuguugccaggcugcaaugcaguugcacgaacucggcucacugaaaccuccaccuccuggguucaagugauucuccugucucaaccucccggggguuucaccauguuggccagacuggucuugaacuccugaccucaggugauccacccgccucggccuccccaagugcugggauuacaggugugaguaaccgugcccagccuguaauuuuuuuuuuuuuuugagacaaaguuucacuccgucgcccaggcugguggcaugaccucggcucacugcaaccuccgccuccggguucaaacaauucuccugccucagccucccgaguagcugggacuacaggcgcaugccaccacgcccggcuaauuuuuuuuuucuuuuuugucuuuuuugagacgaagucucacucugucacccaggcuggagugcaguggcacaaucucagcucacuguaagcucugccucccggguucacgccauucuccugccucagccuccugaguagcugggacuacaggcgcgugccaccaugcccagcuaauuuuuguauuuuuaguagaaucgggguuucaccauguugaccaggauggucucaaucucuugaccuugugaucugcccaacucggccucccaaagugcugggauuacaggugugagucacugcgcccggccaugaauucuacuuuaaaaaagaaauuuaauuaauuuuuugagacaaggucuugcucugucacccaggcuggcgugcaguggugcaaucccagcucacugcaaccuuaaccuccugggcucaagugauccuccugccucagccaccugaguagcuggaacuacuggcaugcgccacugugcccagcuuauuuuuuauuuuuuuguagagacagggucucuguucauuauguuccaaagcuggccucaaaauccugggcucaagcaauccucccaccucagcaucccaaaaugcuggcaauacaggcaugagccacagugcccagauuagcuugcuuuaacaagaugauucacuaagaacauuucaauuucuucccaaaauagcaaagaaacaugacagugucgacuuuucgggaucauuagaugagucacaagaugaaugcagagagagagcacccauggccaaugaugauggcaaaacugacgugaaaauaaaaucucagacaagucuucauuugacaauacccuagaucaaucuucucagaaucaagaggaagugagggacgaaaaggggacacaguagucucaaucagcugcccgcucacaugaaugaucacacuucaaaggaaccuggaccauccacuuccuuaagaggacacuucuaauguuugugugucaaaacuuacuugauacaaagagguuggaucaaauuucuuauaaaguuguuuuaaauuauugcuuuauucuuacuucuguaaauuacguguaaaacaacuuaaaaugacaaaacaguaaaacggcccagaaaucuagaugauaaauggugauaacuauuuuuccugguauuugauacaaauaugaguuggaaaagugcuagaaccacacuucuuaagccuucuauagcacuaguuaaaucuucuucagccaaaguuuuuguauuuucuucugaaauucuugaccucugagcaauuuuuggaugguucucuuuuuuuuggagauaaagucucgcucuuguccuccaggcuggagugcaauggcgcgaucucggcucagugcaaccucugccucccggguucaagugauucuccugccucagccucccgaguaccugggauuacaggcgccugccaugagacccggcuaauuuuuguauuuuuaguagagaugggguuucaccacguuggccaggcuggucucgaacuccugaccucaggugaucuuccugccuuggccucccaaagugcugggauuacaggcaugagccaaugcgucccgccagaugguucuuuuaccaaaaaauggccucuccucacuuuguuccucaucuguaacugaaaggucaaauucugcuuucuaccauugcuuuauuuuuaugauuuuuuuuuuuuugagacaaggccuugcucugccgcccaggcuggcgugcaguggugccaccauagcucacuguagccucaaacuccugggcgcaggugauccucccaacucagccuccugaguaacugggacuacacgugugcacugucaugcccagcuaauuuuuauauuuuucauagagacagaguuucaaccauccucccacguuggccucccaaagugcucggagccaccaugccugaccuugcuuucugccauuucugaguuaacuuucagaacugagacagcuguugcauuguuucaacuauuuuuccaucaugcacuuaacaaauuguaaggcaacagagccgaauccugaauauuuaccacaaagucuuucugcaauucuaccuucgcuuauaaccauccugaaaaaaaacuaagaucuuaaaguugguuaaaaauaugucuuauaucagcugggcacagcggcuuaugccuguaaucccagcacuuugggaggccgaggugggaggaucaccugagucagggaggucaaggcugaaguaagcugauugggccacugcacuccagccugggcgccagagggaggaccugucuccaaaaaaaagaaaaaagacuuaugcuagaaaucaucaguauuuaccuaacaguuagugaucaaaguaagcaauuuauuauauguuggaaagcacaauaacuucucccucccccucacacacacauacacacacucucacacacacacaaacacacacacuuaucuucuuaugcuguucaauaagcucacuagacucuccauagccaaaccucucacaauuuauagauggguaaaauaaaacaaaugcaccuuucauuauguuuaaagcacugguacaacuauaacauaaagguuccuugaggauuccugaucuccgacgcagcaugaccaaccaucugagaggggagugcccuggccugggacauuauucggccacacggccaccagcugcuagcuuuaaacaguggacucuuuccuagaauuucacuuuucagaagaucauuauuuugaacacaaaauuacuccuauuuuaacaucuacaacuggauuaaaggcauacuaaacucaaauaucaugaaauauuuuauaauacauaugaaaaaaacuccuuuuuagacugaacugaugauguacaaugauauaaucagaaaaaaguuaaugaaauaucugcuucuaaagcaccaaugguuuuuauauacauaauugacaaaauggcuuaagaaauuugauuccuaacuuaguguacagcagaaagacaauggcucuauucuacacauacuacuuaguuuaccuauacauguauaaagaaaauaaauuuuagccaggugggauggcucacaccuauaauuccagcacuuugggaggccgaggugggagaauuacuugagcacaggaguuugagaccagcccugacaacacaguguaacacugucucuacaaauuuuuuuuuaaguuagccagguaugguggcacaugccuguagucccagguacuagggaggcugaggcaggagggucacuugaggccaggaggucaaggcuggaaugagccaugauugcgccacugcacuccagccuggucaagaaaacaagacccuaucucaaaaaaaagggggaaaaagcugauguccaagauccaauagggguuaauaccugaugacugcauguuuagcuuauuaaaaugucaggaauucuguggaaaaagcugacugguaccugaccuuugcccaccauuuuagagccaauggacaggaagaggagguaugucucugcugaugucaagcuguaacugugcagaggaguucaggaugacgaugugagaugaaaaucagucaggcccugccaugccuucauuccaugaagaauccuggcugcaggagcacauacuuuuccuagagaaaguauccuuacauuuuaccagcuuuugguuuuuaaaauacugcuuuaaacaguuaaguuacuacucacagcaacaguuauaaguaacagaaugcuuuaccuuggccaucuugccauuguuucaccaaguuuugugaaagcagaccucuccucacaucugccacaccaccccacgcuugagggugaaguguccuguccacuguggucacgaggaggugacacaaaaugcagcaagugcagugagugugcgugugcaucucuaagucaaggggaccaguaaugggccuguuauuuauagauugcuuuaagauguccaaaauacauguuuuauuagugguauaguuaauucuaaaaugaaaaaaaauguuauauaaguaaccuaauguguuuauuguaggaaauaccaaaaaccauaacaacgaaaaaaccaacaacucuauuccuuucugaccaccacuguuaauuuucugguauaugcccuucugguuuugaaaacaaaaaucaaaaugcuuuucaucagaucaucuuccugaaugaaggcaugcaucaaauagcagaguuagaaacuaagagagucucuaccugaugaaacagcaaaguaugaguguuuaaucaggagucuauaccaugccuucuaauguuaacgacccaucagucuccaaauacaauuuaccacaaaaugugcuaaguuuggaaugguuuucugauaggauccugagauucccacauauauuuaucagcuuacuacuuuuaaaacgucuaugcaggccaggcacaguggcucacgccuguaauccccacacuuugggaggccgaggcagguggaucacgaggucaggaguucgagaccagccuggccaauguggugaaaccccaucucaaccaaacaaauacaaaaauuagccggccaugguggugcccacuuguaaucccagcuacucgggaggcugaugcaggagaaacgcuugaaaucgggaggcagagguugcaggaagcagagggcgugccgcugcacuccagccuggaugacagagugagacuucgccuuaaagaaaaaaaaaaaguaugugcaaccagagggccgggugcaguggcucacgccuguaaucccagcacuuugggaggccaagguggguggauugcuugaggucaggaguugaagaccagccugaccaacauggugaaacccugucucuacuaaaaauacaaaaauuagcuggguuugguggcaggcgccugcaaucccagcuacacgggaggcugacgcaggaaaaucgcuugaacccaggaggcagagguuacagugagccaggacugcaccacugcacuccagccugggcaaaagagugagacuccauuucaaaaaaaaccaaaaaacauaugcaaccagaauauaucaaaaguaacuuucugcccagcaagguggcagaaauccuguaauccuggcacuuugggagccugaggcaggaagaucgcuucagccugggaggcagagguugcacugagcagaguucgcgucacugcgcuccagccugggcaacagagagacuguaucuuaaaaagaaaacgggaaaaaaaaaaaaaacacaccaacccaacaaccaaaaacacucaagagauaaaaagcaaaauucaggauuuguagguagaauaacacaaauuuuaacuguugccaacaacucaauuuuuuaaguaaagcaggauacauacauuaugaccuugagccagauucugccuuuggccaccaguuuuccagcaaauccuagcaaacaucaaagccugcacccauucugcugcagcagcagggacacucaacaccuaaggcccucguucauaauucauacaaaaggcccaaggacagcccgccuccaggcagguuuguaggcccccaaggagcccggaaggccagccccuucaggacucagugugcacucaccugccacaccugcccaugggggugccccugcagcucacaaggccucaagcagcagacccagucuccuccagcaacacaccaugucugcaacaccuucaccccuucccucuucaucucacguuuaguaaaaagguaaaagacaaaugugacaagcaggugcauuuacaacuaugugaaggaauauuauguuuuaaaugucccaagaaacacccaucaaaggggcugacacgaccacacacgaagaacucccagucuuccauuacaaagcaaacaacugacacuugucuucaaguaguuaauccaaaacuucucaaaauuacauaauaaagauaaaacagggccaggcgcaguggcucaugccuauaaucccaacacuuuaagaggcugaggagggaggaucacuugagcccagggguuugaggcugcagugaccugugaucacaccacugcacuccaggcugggcaacacagcaaaacacugucuggaacaaacaaaagaaaaaaaaagaaaaagaaaacccaaauuuauuaagaauaaaaccauaggccgggcacgguggcucaugccuauaaucccagcacuuugggaggccgaggcgggcagaucacgaggucaggagauugagaccauccuggcuaacacagugaaaccccaccucuauuaaaaauacaaaaacuagccgggcgugguggcgggcgccuguagucccagcuacuugggaggcugaggcaggagaauggcaugaacccgggaggcggagcuugcagugagccgagaucgcgccacugcacuccagccugggagacagagcgagaauccaucucaaaaaaauaaaaaauaaaauaaaaagaauaaaaccauaaaaauuuacucacuguuuuuuuuuuuuugagagagagucucgcucugucacccagucuggagugcauuggcgugaucucggcucaaugcaaccucugccucacaaguugaagcuauucuccucccucaaccucccgaguagcugggauuacaggugugcgccagauguccggcuaauuuuuguauuuuuaguauagacaggguuucuccauguuggccaggcuggucuggaacuccugaccucaggugauccgccugccucggccucccaaagugcggggauuacaggcguaagccacugcacccggcccucacuuuuuauaaacuaaaauaacacccucuuuccucacuuuugaaaggcaaaaacagaccaaagaccaucuuuaguaaaucacacuagaaaucacuagaagauaagcgaaauguucaaauacaacauugagcaaaucuaccugagcugcaaaggccccuccugccccaucaggggugucgucacaugaugugcuuuugcaaauguccccuccuccacagagugcgcuguccuccuugguuaccggacucuccuccuggacagacgcaucgacagccgagcccuuccucuucgccgucuuuuucuccgaaugcgaacugucaccuuuuguuuuucucugucggaagugagcaagcugcgcaaaaauguagauaaguaguaaaggcaaagguaagugagaaaaaaauaacagaaccacaaagucaacagacugguggggaccaugaggcccgagggcugacccagucuacucugccacaccuggccaacagauggcucuccacaaacacugccuucaucaauaucuauauccaaggggucuaacaaugaggacugcuaauuaugccugguaaagaaaaccauacggcugauuggcagaauagcuuuccuagcccuuggcaguuuacagaaaaauaaaacuuuaaaaaaaauuuguauaaaagauugauagcuuaaucaaggcauauuuaaguuuuaaaaugauauaaaagcuaaaucucucccuucuugccccaauuuucccccaacugaagaaauauauagcccagccaaaacuuccuagccauagauucugagacaagauacagaaauagcaaaaaauuaauuaagccaggucaaucucacaucuuccuuuauggaaucagauguucuauuuuucaugacacagcucaccaaagcaccagggacauccacagagcaucgcccaucagaaggcacagccuagcucugcucaguccucaaauccgagaguuugagacuaugugcgagccucaucucccgcuaacgucuuacucaagagguaugcgaucgaucccacaucagccuuucacggggagacaucuguucccucaaaagacaacuguggccacaaaaacaaacgcauggaacacacauuuguguaaaugauaacacaaguacacaagcucauggacccagaaaaauuacacaaggccauuuacacaagaaaauggucucucaaggaaauauuuccuucaaagucaaccucaugucguuuauuuucauguccuccuccaccacaccuauccaugucgggauauagcacagaccuggucugcggccugcgucgcccuacaggcggcgucuugucccucccuccccccuccacccuccugggagcucugcuccuguucgcagcucccugcaggcuccgggcuccccuuccccuccugcccgccucagcccuuccccggccuagccccgcguccccuguccgccgugcccgggagccccgcucuuccccagcaccccagccagaacauccugggggggagcggcgcgcaccucgcagaggccggccugcucccgcgguuccgccucgcgcuuucgggacucccuuucuccugcccccgagucaugggcucugcgcgcuuuauucccacgaaaccuaggacaguggccaucaaaccgagcgcuuuuucacggagaaacccggggcgggagaaagacgggagcgcgucccuugaaggcgcccggcgccagcgccgcguggguucccggcagcguacgccaggcccggacgggcaggacgcgagcccaagggcgcgggaagaagacggcggccgggagcgccgcgggggccuuucacacaguaaggacugcaacgccgcgagaaacgcgcggggaaagcaucuccgacggacgaggcgaaggcgcacccuggggaggcgcugcaggccacccgcgccacgcccccggccccggccgcgcaggaaacuggcccuagaccaagcagccacccgaauaccggccgcccgccccaggccacccggucccggaggacgcgggagccacuggaagauccagccugggguccagcgccugccgcgccccacccccuccgugcagccacgccacgccccuguagccccgcccugcagccacaccccgccccggcgugcaccgcgcccagcccgcgccccaccccccccgacgcaggcgcagccccgccccggcccgcccgagaggcgccgcgcgucccggccgcugauuggcuguggccgcggcgggggcgggaccuggcggagagcggcggauucaagauggcggcggccaggaggcggcuuccagcggagccggcgggaaaaagcgagaccuccgcggcggcuuccgccggaccgcguccucuccuggcagggggcgguggcgggcaccggagccgcccuuaggacuucacgccagagcagcuagagaagaagccccuaauguuuaccuucguccucccggccuccaccuuucugcgccgcugcucuugcucaacuuccaucucccucagacuccgcgcgggccgcccggcggugacggggcugacacagagcagccuucgcucuauuuacacucccucccccgcgcuugggcucgcccuccccccgc

SEQ ID NO: 192153 - RNA, 50189 nt, Homo sapiens
uaauacuuaauuaccuucuaauaauuggagcagaagaugaacccaacuaauccuuucagugggcagcagccuagugcuuuuucggcgucuucuaguaauguaggaacacuuccaucuaagccgccauuucgauuuggucaaccuucucuuuuuggacaaaacaguaccuuaucugggaagagcucgggauuuucacagguauccagcuuuccagcgucuucuggaguaagucauuccucuucagugcaaacauuaggguucacccaaaccucaaguguuggacccuuuucuggacuugagcacacuuccaccuuuguggcuaccucugggccuucaaguucaucugugcugggaaacacaggauuuaguuuuaaaucacccaccaguguuggggcuuucccaagcacuucugcuuuuggacaagaagcuggagaaauagugaacucugguuuugggaaaacagaauucagcuuuaaaccucuggaaaaugcaguguucaaaccaauacugggggcugaaucugagccagagaaaacccagagccaaauugcuucuggguuuuuuacauuuucccacccaauuaguagugcaccuggaggccuggccccuuucucuuuuccucaaguaacaaguaguucagcuaccacuucaaauuuuaccuuuucaaaaccuguuaguaguaauaauucauuaucugccuuuaccccugcuuugucaaaccaaaauguagaggaagagaagagaggaccuaagucaauauuuggaaguucuaauaauagcuucaguagcuucccuguaucaucugcgguuuugggcgaaccuuuccaggcuagcaaagcaggugucaggcaggggugugaagaagcuguuucccagguggaaccacuucccagccuaaugaaaggacugaaaaggaaggaggaccaggaucgcuccccaaggagacauggccacgagccagcagaagauucggauccucugucccggggcgaucauccuccagacaaacgaccuguccgccugaaucgaccccggggagguacuuuauuuggucggacgauacaggauguuuucaaaagcaauaaggaaguaggucgucugggcaacaaggaggccaaaaaggaaacuggcuuuguugagucugcagaaagugaccacauggcuaucccaggagggaaucagucuguccuggcaccuucccggauuccaggugugaauaaagaggaagaaacugaaaguagagagaagaaagaaggugagcucugaaaauguagcacauagaguaaauccugcaggcagguuuucaauacguuucucuggguguuagcuugauuuuucagauaaaucucccauaaacauuagggauucuaacaugucaucggagcaggucuuacaucugaaaauuuccucugcuucgacacaguuggugccuccuguuguuggaaacaucugaugguuuaaguguccauucucugaaccccuagauucucuaagaggaacuccggcgcgucagaguaacagaagcgagagcacagacagucuugggggcuugucucccucugaagucacagccauccagugcaagaacaucccugacuaccucaacgacaggaccauucuggagaaccauuuuggcaaaauugcuaaagugcagcgcaucuuuaccaggcgcagcaaaaagcuugcagugguacauuucuuugaucaugugaguacucccaucuugccauuuguuacccuagauuugaaccuugucacuuuaaaaccuguuuuuuuuuuuuggucccucaguuguuugcuuacuauaauauagagaaaguacucaaauaucuuauuagcauaggcugggauagcacuauuuauuucauaacuuggcauauucuaggucccuacagaauauaguacucuagaaaugcugggagaguuguucucaugaagugaaauucuucugaaaggcuuuagaaauucagaaauucuucugaaaggcucuaaccacauaguacuuuuggaaguugaguuuuuugguuuuguuuuuguuuuauuuggucauagaagaugaucgcuguaaacguucaaacaauacagaaaaagugaaauuggccgggcgugguggcuuacgcuuguagucccagcaccuggggaggccaaggugggcggaucaugaggucaggagauccagaccauccuggcuaacacggugaaaccccaucucuacuaaaaauacaaaaaauuagcugggugugguggcucgcgccugucaucucagcuacucgggaggcugaggcaggagaauugcuugaauccgggaggcggcgguugcagugagccgaguucgugccacugcacuccagucugggagacagagccagacuccgucucaaaaaaaagaaaaagaaaaaaagugaaauuccccuugucagucuguccucuagagauaacugcuuugaagcacuggguuuguauccugacuuuaaauguaugcauaauacuuucuuuuuauuuauuuauuuauuuuuuugagauggagucuugcucugucacccaggcuggagugccguggcaugaucucggcucacugcaagcuccacuucccggguucacgccauucuccugccucagccuccggaguagcuggaacuacaggcgcccgccaccacacccggcuaauuuuuuuguauuuuuaguagauacgggcuuucacugugucagccaggauggucucgaucuccugaccucacgaucugccugccucggccucccaaagugcugggauuacaggcgugagccacugcgcccagccuaaauguaugcauaauacuuucuagggugcagugaacguggacugcuuauguuauauagcuuuauaucgucacuauuuuuucugaguauucucauagacaaaauuacguucuauaggaauuuauaaaguauaaauuuauaaagugaaugauacuacauugaguggauggacuacguuuuguugauucgucuguuggcagacgcggguuguuucuacuuuuuggcuauugugaauaauguucauuggcauaugacuuauuugagucccugcuuucaguuuuuugggguauauucuuaggauuggaauugcugggucauaugguaauccuaauuuguuuuuaguuuuaauuuuuuuaauuaaaaaaaguuuguauuuuuacauuuguauagauggggucuuacuguguugcucaggcaggucucgaacuccgguccucaagcuguccuccugccuuagccucccaaaauguugggauuacagaccugagucauuguaccggcucucauuuuuguuguuguuguuuuugagacggggccuugcucugucucccagccuguauuguaguggcgcaaucuuggcucacuucaaccuuuaccuuuccaguucaagcgauucuccucccucagccucccaaguagcugggauugugugugcaccaccaugccuggcuaauuuuuguaguuuuaguggagaggggguuucaccacguuggccaggcuggucucgaacuccugaccucaguguuccacgcaccuuggccucccaaagugcugggauuacaggcgugagccaccaugccuggccuuguuuuuauuauuuauuacuacuauuuauuuuauuguuauuuuauuauuuauuuauuuuuuugagaugaaguuucacuauguggcccaggcugguccuaaauuccugggcacaagugauccucccaccuccaccucccaaagugcuaggauaacgggcaugagccaccaugcccaacccccuuuuguuuuuacaguuauuuuuugccuguugcaaugugcuuauuuucccagcugaaccuuaaauauuuuaugacauaacuaauauguaaauagacugccuuuauaaacaauucauugauacagacaaaacugaauauccucaucucuccuguuacucaggagcaguccaguuaacuagugugauguguauuuuuuuagacauuuuuaugaguguaucuacacggagacuaacgugguugguuuuguguguguuuucugugguaaguggcaucccauguguguuauucugcagcucccuuuugugcuuaauugugacuucgcaaacuuucugucucuguaugugugaucagcuggugagaaucaucucaccaaaugccaacaaggccaaguuugugaguucuaugaagcaaaguuguuaauuaaaaaaaaggggccgggcgcgguggcucacgccuguaaucccagcacuuugggaggccaaggugggcggaucaccugaggucaggagaucaagaccauccuggcuaacacggugaaaccccgucucuacuacaaauacaaaaaauuagccggaugugguggcgggcgccuguagucccagcugcucaggaggcugaggcaggagaaugcaugaacccugaagguggagauugcaguaagcugagaucucaccaccgcacuccagccuggcugacagagcgagacucugucucaaaaaaaaaaagggggaaagagcaaauacaugcuugugagacagguaagggagaugaauacugcugcugccgcagccagagaccaugcaguuagcagacguguggguggagaaaucacugucgugcaaaggacaggagcuccuggugccuuugaauggucuguugugcuuacugcauuugaguuuucaaucccauuuccuuugguuuccugauauacucacacauggcgguuguggacuguuuuccaggcaucugcagcccuggcuagaaagaaggggaaaaguuugcauaaagacauggcuaucuuuuggcacaggaagaaaauaagugaguuuucaauuauucuuuucacuuuuuaaaaaaauuauuuuuauuuauuuuauagagaugagaucucgcuauguugcccagucugaucuugggauuacaggcaugagccauugugcauggcccucuuuucaguuucucaugcucuugguccaaacccuuugagcgugagcccuuuccccagccaguggaggaggcuggcucucaguggauuugcaucucacaguuauuuccuugggcucuucucuaaccuccugugacaaugaaaauaauauuacuuucuuagaaacagagugaaaaaauccaguuccaggugaucugugauugcauaaacucuuuucugccuccuauguccacaggccccaauaagaaacccuuuucccugaaggagaagaaaccaggugacggugaagucagcccgagcacagaggaugcacccuuucagcacucuccucuuggcaaggccgcagggaggacuggugcuagcagccuccugaauaaaaggugggaucggucccuccuaaugaccuuauuccggaaggaccaggaaauagcgcccuauagcgacaccugagucagggugcaagacuguggggaguggugaggagacaaaagccaguugcuagggaugguuggggguggaggggcaggggcucugccccuccugccagcaugggccguuaggaggugggucuguguggggcugguggucccagccagaagagagaauuuucugacacugguaacugccagcugcagagaugguggagagcagugauucuguccugucuuguucucauauacccuagggccaagguugcugagaaagccuuccuuuggggcuggccuuuuuuucuuguuuccaucuuggcauuuucuaugggagaaucucaucacacaguuguuauagcugguacagaccuuucagcugcagcuacaggagauccaggggaggcugcucacuuaggacagcagaacuucuguccuugcacagagugccugcucugugggacacacgcaggcuggcgcccuguggcgggucgcugccugccucacaggauuguaguaggaaaucuccuugcucaucuaacucguccugaaucccacugcaguuaagugcaguuccacuugacauauaaauguauaagcaauaacuuuuuaccucaagacauuuaacuggcuguaauaaaccaugcauuccuuuuuuuuuugagacacagucuggcuguugcccagguuggaguucaguggcacgaucuuggcucacugcaaccucugccuccuggguucaagaaauucuccugccuuagccucccuaguagcugagauuacaggugcgcuccaccacgcccagcuaauauuuuuguauuuuuaguagagaugggguuucaccauguuggccaggcuggucucgaacuccugacuagagaugcaugcccggccaaaccaugcauuucuaauaaucacuuucagcaguuuccagcauuacuuuuuuuuuuuuuuuuuuccugaagagcugucuccuggccgggcgcagugcucacgccuguaaucccagcacuuugggaggccaaggcgggcggaucacaaggucaggagauugagaccauccuggcugauauggugaaaccccaucucuacuaaaaauacaaaaaauuagccgggcaugguggcaggugccuguagucccagcuacuugugaggcugaggcaggagaacugcgugaacccgggaggcggagcuugcagugagccgagauugcgccacugcacuccagacugggcaacagagcgagaccccaucucaaaaaaaaaaaggcugucuccuaaaggaagggcagcaugacuuuuugcaggugcagcuuaucacagugaagcagacacggucggccauguuaguuguguuaaccggcaugugaugugaagugcccuggcuaccuugucugucuggggaacucuguucucaaaggcuuuugcuuuucacaccaggccuacuuugacagaucuccggcugaauccaucuuuucaucuuuuggccaauguauuuuccucacuuuccguuuugugacgagcaguuuaguugcugguuugacauaaucuuugacauucaaguucagaaaaugaugaaagcuagaaaauggggaagcugagagagaaugccugauuccuuuuaguauguccuucuaccaaaauaauuucuguuuuaaaacauguaggcuuaauauuuccuuaugauauuaaagacuuuuuucaugcugaguuuauuucuuugaaauagaaaucaguaaguguucauuuuagcuguuuaaaugagccuaucuuuuuuuuuuuuucggggggugguaaguuagagucucacucugucacccaggcuggagagcagcaguguaauaaucucagcucacugcaaccucugccugccaggcucaagcaauccucucaccccagccucucgaguagcugggacuagaggcacaugccaccaugcccggcuaauuuuuaaauuuuuuguagagauggggucucccuauguugcccaggcuauuuuguuuuucaaaaguaugaaauauuucaaaauuauauuaaagucagugaguaaugugaauaacgcuuuugugcucauuaccauccuuaucaaaacucaucucauuucagugcuuguaguuucucagcuuuagaggaccagaaaaucuugaaagaugaggggacguguucagaaaugaaaaugcucugaaggccuuccugggacgagggcccucagugugguguuuacuuuauagcucuccagugaagaagccaagucuucuaaaggcccaccaauucgagggagacucuuuugacucagccuccgagggcuccgagggccucgggccaugugugcucucccucaguacccugauaggcacuguggcugagacauccaaggagaaguaccgccugcuugaccagagagacaggaucaugcggcaagguauggcacuugguggcagagguucuaggggccuggugaggucgucaucuugggugccaucagggcaggagcaacuccuuuccauugggcucuauugcuguugagucucagagccugugauaugcugugucugaucuucauagucugccugucuucuuggagugaguguugcguguauguguacauaaaugugcaaauauguuugcuaauguauguauaaaauaguagugggaggaugcaaaagaaugggcuccugucuguagagggagcgggauuccgaggggcagagguuaugguggagugcuccgucuuggacagggcauucuuacacuguuacaauguugaacugugugaauguauuaccuacuaaaaaguaaguauuccauuaacacuaaaaauauaugcagggaccaaaaauaaaaggaaaaaacacagguacuucucuuagccaauuuuuuucucuuaaauuucagccgggcugggcaugguggcucacaccuguaaucccagcacuuugggaggcugaggcaugagggaccaccugaggucaggaguuaaagacuagccuggccaacauggcaaaacccccaucucuacaauaaauaaauaaauaauaaauaagcaggcugggugcgguggugugcaucuguagucccagcuaccugggaggcugaggcaggagaaucacuugaacuggcgagguggagguuacagugagccgagauugugccacugcacuccagccuggacaacagggugagauucugucucaaaaaaaaaaaaaaaugcugggcgugguggcucacgccuguaaucccagcacuuuaggaggucgaggcugguggaucaccugaggucaggaguucgagaccagccugaccaacauggaaaaaccccaucucuacuaaaaagacaaaauuagccgggcgugguggcacaugccuguaaucccagcuacuugggaggcugaggcaggagaauggcuugaacccgggaggcugagguugcggugagccgagauugugccauuguacuccagccugggcagcaagagcgaaacuccaucucaaaaagaaaaaaaaaaucagcuauaggaguuuccucuuuuuaaaagcuguggauaauuugaauaaucaccauguuuccuuaauauaauaacauauaguaauaaaagcugccaucaaacaucauaucauugauacagugauuuuuauauucuaaaaauuauuauuagguauuagaauuuuucuuuuuuuuuuuuuccucgagauggagucuugcucuguuacccaugguggaguaccaugacagagugagcgcaacgucagcucacugcaacguccgccucccggguucaagugauugucuugccucagccuccugaguagcugggacuacagccaugcgccaccacgcccggcuaauuuuuguauucuuaguagagaugggguuucuccauguuggucaggcuggucucgaacucccgaccucaggugaucugccagucuuggccucccaaagugcugggauuacaggcgugagccaccaggccgggcccagguauuagaauuuuucaacaugaaaacaauaaguauauauuuugagugugaaguuguugcauuuccuuuuccuugcaagcuacauuguaacuuaaguguaauagcaguuuacucauucagguaagaacccaguuaacguccauuauaugauucuuauauuaaagucauggugaauacugagacaguuuuagaauagugauauauuuugaauauuugcaguuguuacaagucaauccuuuuaguaaacauccugcaccaugauuuuuugucauugaggucauuacaggaguuagaaaacuccggcugaaagugaggacacuccccugcuuuuaucugcagugagggucugugacuguuggagaggugacucgggggucuuucucuuagucugcagugagggucugugacuguuagagagagguggacucgggucuuugggagcuuugaugucccacugccuggcauaauagaccauaaguccucuuugucugaggcucugaguuuuacaaauguuuuucuuuucuuuuguaauguguguguguguuuuaaguuuuaauuucuuuuuaucauuaugagaauacacuucuguagguucgugcuaaccaugugguacauucuuaccuuuuacuugacgucauuuagcucgggugaagagaaccgaucuggacaaagcgaggacuuuuguuggcaccugccuggauauguguccugagaaggagagguacaugcgggagacccguagccagcugagcguguucgaaguggucccagggacugaccagguagagcccugcaucuccccguggagugugggcaggggacggggcugcuuuugucauuucuguacauacuugauuuggguguuuguuuuagacaguguuggguauuugugcuauuaacaaucauauuaagcuguuuugcauugugagauguucacucuguaauugguaccuauacaugauaagguauagaugcaaguuauuuuaaauaaaguuguuuuucaaauucuuuuuuuuuuuuuuuuuuuuugagacagggucucacucugucaccuaggcugaagugcagugguccaaucauggcucacuacagccucaacuucccaggcucaggugauccucuccucucacucagcuuacagaguagcugggauuacaggcaugcuccaccacgccuaguuacuguuuuauuuuuugcagcgauggggucuugccguguugcccaggcuggucccgaacuccuaagcucaagucaucugcccaccuccgccucccaaagugcugggauuacaggcgugagccaccacauccagcuaacuuuuuucuuuuuacgaucuuauuccugucuguuucuaugcuuauguuuuacacauucgagauuaugcucuagauacaauuuuauguguaucuuuuccacuuaaaauuaugucaugaacauuuuccuuuguuaggguaaacuaugagcauuuaaaaaugacagcauauuauuuuauuaguagcucugucaaaacucugcauuuuuaccauuaguagauaggcugcuucuaaauuuuuaguucuauuaguaauauuguuuggcaucuuguauguaaugcuucucugguauuuagauuauuuucuucagauccuaagaauuaaauuacugcaucagaggguaugaccuuuccugaacauuauccauguaucuucccaaauuguugccccagaaagcugcaccaauauagauccuuuuggacuuugugaauuuugcuuaugggcuucuccucuuccuggcugguggcuuuauacacccuucgccuggugcgggguccccagcccagcaacucgugucacuguagggccccugccccaggagaggcacaugcccagggccuuguccuguguacaucucugccucuucccuuggccacgucuucagccuccuuuugaggugggagaugcaauuccaggccccaggugggcagccagccccugaugcuguguccucagcaguccucaccgccugucucuguuucacuucugcucuguguagacuuaaucuggugugugagcgggccugagaccuuuuaagugcuugaggcccuucccugucccgucucucugcuuuggaggcuagcagaugugccuucacuuaacauuccuccuguuugucaugacgcacucauaucuuaacuccuugucauauuugccaaaaucaaauuucucuauuugucuuugaauuuugauugucaccuuuuaacagaaauuuuauguugaaaaaauauauucucaaauacugaucuuguguggguguguaugugauuuucccccucauuuucaggcauaacuaugccuggcccaagguaugccacaugggcauccugucucggcuucaugucucuagguggaccacgcagcagcugugaaagaguacagucgguccucggcggaucaggaggagccccugccccacgagcugcggcccuugccagugcucagcaggaccauggacuaccuggugacccagaucauggaccagaaggagggcagccugcgggauugguaugacuucguguggaaccgcacgcguggcauacggaagguauuggcugccuccaaccuggaugcuaaaaaauccacgcaaauuccaaagucaaacugauauuuuuauuacucuguuauauauuuuaucuguaacaaaaauguacuuuugugggccaggugcaguggcucaggccuguaaucccagcacucugggaggccgagguggguggaucaccugaggucaggaguuugagaccagccuggccaacaugguuaaaccccaucucuacugaaaauacaaaaauuagcuuggcgugguggcacacgccuguagucccagcuacucgagcggcugaagcagaauugcuugaaccugggaggcggagguuguggugagccaagaugacaccacugcacuccagccuggcuucugucucaaaaaaaaaaacaaaccccaggacuuuuauuuaagucacuacaaaguccuauuaaaaugugcaucaugggcuuuguuucaaauugaaaagugagaaauugaggucguagcaugauccuucucacgguugccucuuugcaugggaaugugugugugauccucccccucgccuguggccaggauaucacgcagcagcaccucugugacccccugacggugucccugauugagaagugcacccgguuucacauccacugugcccacuucaugugugaggagcccauguccuccuuugaugccaagaucaauaaugagaacaugaccaagugccugcagagccugaaggagauguaccaggaccugagaaacaagggugucuucugugccagcgaagcggaguuccagggcuacaauguucugcucagucucaacaagggagacauccuaaggugaauuuucacauccaaaaguuguccuaagguggcugaaaaggcaggcuuuaaacaggagaagagcuuucaggaguggcaguagccaauagugcagcauucugucugguagcagauguugggaugauaguagaggaccuuggucuggcuuugcagucggcugagcugagcugggggaagagcgaugggggugugcccugggaccagcacaucugacguaggccccacauguucauuucugaaaauaguuucuccucaccagugagaaaaugaggaaggaauccuccucaugagacaggugagugaaccaggagagggaguuccaggugcccugcaagguuguuagcaguucccuguucccagauaguuuugucaaagaucucagaauaagagaggaaaaaauuauguaaaacaaaaaugcgaagaaugggguagugagaaugaaugaauguaaaacccuggucugauccauaauuagucacuuacaugcgaagucuggcgagcucucuggcccucugcuugugguggacccucugcuugugguuaagcuggacuuaugguggacaguguccccuuuaguucuaagaauccccuaucaauggugaaccucuuuuuuuuuucuuuguauuuuccucaagaacugugugacagaauaucuagaugugugguugauuuuaauuuuuuauuucauuuuauuuuugagaccgaguccugcucuguugcccaggccggaguacaguagugcgaucuuggcucacugcaaccuccaccuccuggguucaagcgauucucuugccucagucuccugaguagcugggauuacaggcacauaccaccaugcccgccucauuuuuuuguauuuuuaguagagacaggguuucaccauguuggccaggcuuguccggaacuccugaccucaggugauccaccugccucggccucccaaagugcugggauuacaguuagagucuccaugcccggcugauuuuaaauuuuaaaauuaagccuuguauagccugggcaacauggugagacccuuccacaaaaaugaauaaauaaauaaaauuaaccagguguggugaugugugccuguaguuccagcgacuggggaggcugaggugggaggaucccuugagcccaggaggucaaggcugcaguaagcugugaucaugccacuguccuccagucugggugacaaagcaagacccuaucucuuaaaaaaaaaaaaaaaaaacccaggugugguggcccauggccuguuaucacagcacuuugggaggccgagaugagaggguugcuugaggccaggagguugaagcugcaaugaacugugauugugccagugcacuccagccugggugauagagcaaguacucugucucaaaaaaaaaaaaaauuaaacugguuaugaaagauugcuguauugucuuuuucuacgugacaagcauuuguucuccaucacgaauaauucagucaaaaucaauucauuucuaaacaaaaagaguuaaguuuucuguuuuuuagacuuuaccauccagcacagcugacaguccauuggcauuacuuuaaaguaacuuuuugauaacugauuccuaaauugcuuuuugaauuuguuuauucuauucauuauuguuuugaaggaaaccuuugucaaaccaauccaagcgugguaguuaguaaacuaugaauuuaacggcacauuucaccaguaagacccuccuucucaguaugguugaaauccaguaucauuauuacuugagacagggucuugcucugucacccaggcuggaguacagugaugcgaucacagcucacugcagccucaaccuccugggcucaaacgauccucccaccuuggccuccccacguuuugggauuacaggugugagccacugcaucuggccagugaaaucuauuauuuaucagaucuaucuucaugaaaauuuugucuuauuuaaaauaacauuccaaccccuuuucucuccuuuaauuaacagagaaguacaacaguuccauccugcuguuagaaacucaucugaggugaaauuugcuguucaggcuuuugcugcauugaacaguaauaauuuugugagauuuuucaaacugguccagucagcuucuuaccugaacgcuugucuuuuacacuguuacuucagucaggugaguaaaugagcugugcuugcagaguuggaagaaagcaggugguucuugugcuguuugggugcuuucuuauuccaagcuuuucaaaggaggucucaggcugaugcugugucacccuugcagcagccccacgaagggguuaccgguguugcccuguuuuauagggguuaucacuguuggucaccauccggaaaggcugugcaauggaaaauacuguuccaugguucaaauaagaaaaaucucuuugggaaaacauagguugaauucagcacuaucaucauccaugaaagcuaacuaaaaagcaaaaaucucauaucauaugcacaaaaucucugacuuugaaaugcuucauguuuuaaaucgaaguuucuggagugaggcugauggcgcuaaguuccuuucagugggugccucagugucugugcuuugccgugugcuaggguugcagaggcaaugggaaggccagucccuccccugggguuugcgcagaguaaacugugucuugggguuuccagucgguuauuuuguuccacuuccacggaacuuggggaugaggacagagcagccccuguagcaccugcuguucuaggcccugcaugauuccguucagugcaaugugaccaggaccgcggcccaccgcacagagcgccaccucaccucgcacacacucugcugcccauucuggcagcggcuccaaggaggcugccaggauuccuugccacaagcccguaguggccacagcguggggaggaugcugccugggagauccugggaccugccuugguugaucuguggcuccaggucauuucuuuggucacacaucagggccuccuguaaacagugacuaaacccacagucaugucacagucagaaggucuuuugcagguuugcuccuugucagaucugcagguugccaaacagaacugauauucuggaguaaaugaaaagguuuuccacaacuugccacuuguaguuaauauuggcugggugcuuuggcucacaccuguuauccuggcaccuuggcaaacuugggaggugggaaaauugcuugagcucaggaguucaaggccagccugggcaacauagggaggcccugucucuacuaaaaauaaaaaaaaagccaggcagguguggugggaugcuccuguagucccagcuacucaggaggcugaggugggaggaucgcuugagcccaggaaguugaggcugcagugagccaagaucugcacucuccagccugggcaacagaggcccucucaaaaaaaauaaacaaaaauaaaacauaguuaauguuguauacacgaugauugagcguuaguagaauguugaccauuuuuaauaacuuuauuuauuuauuuauuuagagauggagucucgcucuguugcccaggcuggagugcaguggcaugaucucugcucaccgcaacuucugccuccuggguucaagugauucuccugccugagccucccuccccaguagcugggacuacaggagcccgccaccacgcccagcuaacuuaguagagaugggauuucgccaugcuggccaggcugaucucgaacuccuagccucaggugauccacccaccucggccucccaaagugcugggauuacaggcaugaaccaccuugccuggccguuuuuaauaacuuuaaacaaaagagauauucggguauuuuucuuuagaaaagcucuucaccggcaguggcgcacagaggcagccuccuguccccgcagcccugugcacuccugcucagaggcuuugugcuugcuguuuccacugcuguuccacacucgcagagccgcacggcgcugucuccaccucccugaggccaggcgaggcuuggcugccgcccucagcagggcccccaccagcgcucccugcucucccugcccaucugccgcacuaaaucaccauucuguguguuugauguguuuguuuucuguggcauuggucucuccccuggcaugucagcuauguggggacagggauuguguuuuuguucacuguuguacucucagcauuaaaaacggugccaggcacagagcaaaugcuugaucaguguugguugaauuaaagaacaucggaagaggacuaacagcuuagguaccaaagucccagcacucaagcagaauuuuuguucggauuuucauguuuuuccuuugucuauuuuuacuuuuauuuuuauuuauuuauuuuuuugagauggagucucacuuugucacccaggcuggagugcaguggcaugaucucggcucacugaaaccuccaccucccggguugaagugauucuccugccucagccucccuaguagcugguauuacaggugcgugccaccacacccagcuaauuuuuguauuuuuaguagagaugggguuucaccauguuggccaggcuggucucaaacuccuggcuucaagugacccgccugccuuggccucccaaagugcugggauuacaggcgugagccaccacacccagccccauugucuuuuuuuuaagacacugguucucacucugucaccuaggcuggagugcaguggugugaucaaggcuuacugcagccucaaccucuugggcucaagcaguccucccacuuuagccucccauguugcugggaccacaggugcaugccaccaagccccacuaauuaaaacaaauuuuuuuuuauagagaauaggauguagcuauguugcccaggcuggucuugaauuccugggcucaagugauccucccaccuuggccucccaaagugcugggauuacagguaugagcuacugcaccuggucucugucuucuuuuuuuuuuuuuaaggcucuuguuagaaugccgugaacaguugucuccaacuauuauaugucauuccacgggauugguuuccugcuggcauuccauggucuccgggguccucugcagcaccuuccuggccuuuugucauguggaugcugcacagcugacuucaccuggucuuguugauggacaguuuguuucaugauuucucuuaugaauaaaaccuucacaagccauccuucucuaugagaguguuugcuuggcacgcauuccugagcacugccccugagcagaccgccuaugaucucuaagcuuggguuccguguugccaaagcgccuucugguggacucagcccaggaggagcccaugugccccacgcuggccauggcuguggucaugggcugacugcaugugucugacugggccuucgucugagacugcagugauuucgcuccuccucucagauccgcaaggaugcucuccgggcgcucaacuuugcguacacggugagcacacagcgaucuaccaucuuuccccuggaugguguggugcgcaugcugcuguucagagacugugaagaggccaccgacuuccucaccugccacggccucaccguuuccgacggguaagagcugagaauggaacuguggggccccugucuccuuuuuucuuguuaauucugaugaagggcugugaagggcuggcugcuugccugacuugaagaaggugcauucccucugccaugcaggugaacacacgagacucagaauggcuggggguguucccaaggucacauccuggcugucagcacauugagggcucagaccaaguucuuugugacuccaaaaucaguccuuuucaugacuugcugacaaaccuaaagauaaaaguuagggccuucuuuauucuuucccuugacugccuuugccagccaaugacggacaaccucugacggcugggauggaggcacccgcaggccagccggagucuucuccgguacuuaccagucagaguggugagacucacagacgcucucucagaaacuggcagcuuacacucaacacccggugccuaguuccccacccugucuccucuaacuccucaccugccuccugccugucuccuccuuccaguucugucuccuucuaguucugucuccuccuuccaguucuguccucagaaaauuagacgguuuugggugagccagcaaggaggcaggagugagucagcgugcgucuguuaacacgcugggcuuagugguucuagggaccuacagaggcuccagggugggcggcagugggaccuggcgccugugcuuucuguuauuuacacauggcuguggugacacccaaggggcuugcaguacucggcagggcacugagggcgaagcugucuucuccccuggugacaccccucgggggucuuuuguggucuggguagcuguguggagcugaaccggucugcauuccuggaaccagagggauuauccaagaccaggaagucgguguuuauuacuaggaagcugacggugucagucggggaaauugugaacggagggccauugccccccgucccucgucauaccccugugugcagcuucaacucccagaacaaguacaucggggagagccuggccgcggagcugcccgucagcacccagagacccggcuccgacacagugggugagugaagcugcagucguagugaggggacuagcugcauuuucccaccagaacgccucccaggagccugggcaucugcauuuucucgccaggacgccucccaggagccugagcaccugucuugucuuggggcccagggguguggcucuuccucaugcucagaugguucucacugggaguggacugagggcuuugaagcccuccuccuggcucccugacauccuggggcuuguuuuucaugcaaagcguauguugucccacguagcuggucuccuggagggcaggccaguccucagggucacuguggguggccuggggcugucccugcacagaccucgguccccguggugccaggcacccugugucugcagcuauguuuuguccuguauguuuccuuccaggcggagggagaggagaggagugugguguagagccggaugcaccccuguccagucucccacagucucuaccagccccugcgcccucaccagugccucugccuccuguccuggcacugaccccgucuguggcgcccagccucuuccagcugucugugcagccugaaccaccgccuccagagcccgugcccauguacucugacgagguagggacucuuuuuuucuaggucuggacucugggaagcccauugugcgcaaacguccuuagucaucaccccaugagguggggcuguggcgccuggucucucaggagaguccagagagggguccugccuagagucacucagccucagguagggcccaccuauucaggcucauucuggaguccgucuucaucucaggagcuuccugucacagcaccggccugagcccgugugucugaacucaacacccgucuauuccugacgggaucauuggcagcauugugcgcccccugaugggugugaccugggguggcguguccgccugguggguguggccuggguggguguguccccuuggguguggccuggagugggcaugucccccugaugggaccccaauaugcauggacugaguguggguguguccccugaagggcauguccugggguuggguguccccacugaugggugugaccugggaugggcguguccccuggcgggugugcccccugaugggcauggcugggguggcugugcccccugauaggcguggccucgggguggucguguccccucugguguguguggucucuggcugugcacccugaugggcauggccugggggugggugagccccuugaccagccuggccuggggguggaugugccccuugaugguuguggccucagggugggcauggucccgacaggugccuugauauugaguagagccugucgacuccaugguugugagacuggauugugccacucuggcugcuucggggcaggcacugggcaccagcccaucuggggaucagggagugcuuagggggagcauagaguggucacagaaacagaggcugcuugacguagacuggagauggcuaggccagggcgcuguguggccauccgcagggcgccuuccucuccagauggcaccuuuccauucgcuaggggacaccuuuccugcaacagccuagccgaccccgugucagggguugugcuucugucacgagacgccugcagacuguccggugacaacauguuacccagcauuucugcccugggugggacguuccauuacaccccaugcuggucucuccacaggaccuggcgcaggugguggacgagcucauccaggaggcccugcagagggacugugaggaaguuggcucugcgggugcugccuacgcagcugccgcccuggggugaguggcaucucgugcuccccuccugcuacgugcugcggggagcugcacccaguccuccagaaguuuccucucauaaaguugccugcguuuuuggagucauaauccaauaaguuauugccagauacagugucaggaagauuuuccccuacauucuucuuuuucaagaugguuuugcuauuuggggucuccugagauaccaugcgaauuuuaggaugaguuuuucuguuucugcagaaagugcuguugggauuuugauagggauugcguugaaucuguagauuguucugggugguacugucaucuuuuuuuuuuuuuuuuuuuuuuuuuuuuuuugagauggagucuugcucuguugcucaggcuggagugcaguggcuccaucucagccucacuguaaccuccaccuccuggguucaagcaauucuucugccucagcuucccgaguagcugagauuacaggugggcaccagccuggcuaauuuuuuuauuuuuuguggagaugcuuuucgccauguuguccagggauggucucgaacuccuggccucaagugauccaccugccucagccuccuaaaguacugggauuacaggcaugagccacugcaccuggccaguauugucaucuuaacaauauuaaaucuucuaaucugagaaugugggaugucuuuccauuuauuuaggucauucuuaauuucuuucgacaaugcuuuguaguuuucaacguauaaaguuuuugccuccuagguuaaauuguuuuuuuguuuguuuguuuuguuuuguuuuugagacggagucucgcucugucgcccaggcuggagugcaguggcacaaucuuggcucacugcaacccccaccucccggauucaagcgauuccccugccucagccucccgaguagcugggauuacaggcaccugucaccaagccuggcuaauuuuuuguauuuuuaguagagacaggguuucaccauuauuagccaggauggucucgaucuccugaccucgugauccgcccgccuuggccuccuaaacugcugggauuacaggugugagccaccgcaccuggccuuguugaggauuuuuauauccauauucaugagggauauuggucuguaguuuuccauuucuuuuuuuuuuuuuuuuuuuuuuugagacggagucucccugucgcccaggcuggagugcaguggcgugaucucggcucacugcaggcuccgccccccgggguucacgccauucuccugccucagccucccgaguagcugggacuacaggugcccgcuaccucgcccggcuaauuuuuuguauuuuuaguagagacaggguuucacuguguuagccaggauggucucaaucuccugaccuccugauccacccgccucggccucccaaagugcugggauuacaggcgugagccaccgcgcccggccuccuuuuuauuucuuuauuccuuuuuuuuuucuuuuuugagacagggucuuacuuugucaccuagacccgagugcagaagcacaaucacagcuaaccacagccuugaucuucuaggcucaagccauccucucaccucagccucccaaguagcuaggaccacaggcgcaugcuaccauacccggcuaauuuuuuaauuuuuuguagagauggggucucucuauguugcccagguuagucuugaacuccugggcucaagcagugcucccaccucagccuccugaaaugcugggaugacaggcaugagccacugugccugcucagucuguaguuuuccuauagugucuuuggucugucuuugguauuagagcaaugcuagccucauaaaaugaguuaguaaauauucccuccucuucaguuuuuugaaaggauuugaaaaagauuggugguuaguuuuucguuaguguuuaauagaauuuaccagugaaaccuucuggucucauaccuuucuuuguuuggaagucuccuuacuaguuauaggucuacucacauuuuucuguuucuucaugagucaguuuugguagaugguguguuucuaacagugggcuuaauuuuucugcuggcagccaaacaaguacagguugcauaucccuucuucaaaacgcuuggaaccacaaggguuuuagaugacagauauuuuuggauuuuggaauauuuguauuauauguaccaguugaguaucucuuaccuaaaaaucugaaaaucugaauucuaaaaugcuccaaugagcauuuccuuugaaaagcaugacauguugugcucaaaaaguuugagauuuuggagcauuuuggauuucagauuuuuggauuagggacacucaaccuguguguuuuuuuucccuugucaaugacuuggcuuuuuucugauauuuuucuuucuuuuuuuuuuuuuuuuugagacagagucucgcugugucgcccaggcuggaguacagugacgcaaucuuggcucacugcagucucccgcucccagguccgagcaauucuucugccucagccuccugaguagcuggggcuacaggcgugugcugccgcgccuggcuaauuuuuguauuuuuaguagagaugggguuucacuguguuggccagaauggucuugaucuucugaccuugugauccgcccaccucagccucccaaagugcugggauuacaggcgugagccaccgcacccggccuugacucugauuuugaaugcuauccccuuugcuccguuuaguguuucuaaugcugcuauggaggauuuguuaacagcugcaaccacgggcauuuugaggcacauugcagcugaagaagugucuaaggaaagagagcgaagggagcaggagaggcagcgggcugaagaggaaagguaagugugucuuguccaugcagccgaauaaggagcucaguguggacacaggcaagaacugacccuagccacgaugcuccugcuauuguccacugugcuaccauuccaccccugcugacccacucaugcccuccuaugcuucagcccaggggguggauggagcuccucaggccacaccuacccgugagcaguggcccuucccagccaggaaaggcaggggaagggagguggugucaggggagcuggaguagggguggccuaccgacucaggcagcacaccucaaucccugucugcguggccagggaguaaaacaaacagcacuuauuuuuauucuuaaacauuacccuuguguauuuuuucucuucccuguagguugaaacaagagagagagcugguguuaagugagcugagccagggccuggccguggagcugauggaacgcgugaugauggaguuugugagggaaaccugcucccaggaguugaaguaagugaaacgcuggugucuugcugugccaggagagugagcuuuggcucugcccuaggcugugucuugcaccacugaggaugggcuauuggaaauggaucuugccugucuaagcuacuuugauuuugugaccaaauguauuugaugcaguccucugugcucccuuggcuaauagaauuuuauuauaaaaaauucucuuuuauaugagggcugccaccacaugaucauagucagccauccuuauuagccacuggcauuuaucauauauuugagacacuuccaauugauugcacaagucagauguugcugaugagaagauuuugugguugucugcaugguaauuuacaaauucuacgccaggcaccuguagucccagcaacucaagagacugaggugcaaagaucacuuaagcucagaaguuccagguagugugcuaugacugcaccugugguggccacuguacuccagccugggcaacauagugagacccugucucuaaaauaauuaaaaauucugacuauuuuauuaagauaaagguuuauuucuuaacuguuacgagggccccuauggaccuauaauuuggcacccuguuccacuuaauucuuuuuacccugucuuucuaggugucuguaguuuaaguauuaaagcuucuuuuacaaugaagauagaauuacauuuuaauacugaggaugcagacucuugcacuuuuuuuuuuuaaagacggagucuugcucugucgcccacacuggagugcaguggcgugaucuggguucacugcaaccucugccuccuggguucaagcgauucuccuagcucagccucccaaguagcuggaauuacaggcaugcaccgccaugcccagcuaauuuuuuuuuuuuuuuuuuuuuugaaauggaguuuuacucuguuacccaagcuggagugcaguggugccaucucggcucacugcaagcuccgccucccggguucacgccauucucagccuccugaguagcugggacuacaggagccugccaauaugccuggcuaauuuuucauauuuuuaguagagacgggguuucaccguguuagccaggauagucucgaucuccugaccucgugauccgccugcccuggccucccaaagugcugggauuacaggcaugagccaccgugccuggccgccagcuaauuuuuuguauuuuuaguagagacgggguucuaccaugauggccaagcugguuucgaacuccugaccugaagugauuugccugcuuuggccucgcaaagagcuaggauuacagguguaagccacugugccuggccgacucuugcacuuuucuuuuuuuuuuuuuuuugagacggagucucgcucugucguccaggcuggagugcaguggcgcgaucucugcucacugcaagcucugccucccggcuucacgucauucuccugcuucagccucccgaguagcugggacuacaggcgcccgccaccacaccaggcuaauuuuuuuguauuuuuaguagagacaggguuucaccauguuagccaggauggucuggaucucuugaccucaugauccacccgcuucggccuuccaaagugcugggauuacaggcgugagccaccgcgccugacugacucuugcacuuuucaagcaagcccucagugucugugggccccaagugcagugucuuccaugcugauugcccuguuucuaggaaugcaguagagacagaccagaggguccguguggcccguugcugugaggaugucugugcccacuuaguggacuuguuucucguggaggaaaucuuccagacugcaaaggagacccuccaggagcuucagugcuucugcaaguaucuacagcggugaguccuguguuccuacaggcaaaauccacacacacggggaagagucuuuuaacaaauucaaaauauaugagcuauuaguuucuguauucagugguaaaaggaugagggaaaauguuauagcaaugaauaccuaaaauagacuaauuggauuauacugcauuucagaaauacuugauuacacacacacacacacacacauacaauauaaggggaaaagucaggaguuagauugggacgugguggcuacucuguaugucaacugauauuuauagggugccugccauuugcccacugcacuaggugcugggagacagcuaugaacaagccagauuauggcugcaugcaccaauaagggugaauucucaaaauauaaguaguggagaaaaagcaauuaauagggaauauacaaauaguguauauucaaacuaaauagguuguuucagauuuauauauagugguauaacccuaaagaaaagaaggaaaauaaugaucauaaucucagcauagugguuacuuuugggaaugggagguggugccucucauggccacaacuucucaacuggguguaagugcacaggugcuugaugauuuauuaaucuuauaacugggcauauauguguuacguauguuguaugauucauuucauaauaaaauuuaaaaucaguaauaguguccuugguaguuggaacaguauaaaagggaguauggggagaagugagucuuccuucuacaacagaccccuguccauugugcgagcagcagcugcuugcgaaaccauccagagacuuucuguccuuucuuguggcucuuggcacagaugggcucaugaucccugcuuugcucugagccuuccuuugcuccaucugauaugagguggaggcuuggcuguagcagcaugcugagcuguccccguugccaguggucuugaggucagugcgauaauguaccauaaaugaccuuccuggucuucuguugauggacuuucauguggcucuuuuuuuuuuuuuuuuugagauggagucucacucugucgcccaggcuggagugcaguggcgcaaucacagcucacugcaaccuccaccucccagguucaagugauucuucugccucagccuccugaguagcugggacuacaggcgugcgccaccaugcucggcuaauuuuguuuuuuuuauuuuuaguagagaugggguuucaccauauuggccaggcugcucucgaacuccugaccucgugauccgcccgccucggccucccaaagugcugggauuacaggcgugagccaccgagccuggacguagcucuuuuuagcucugguaaagacuguugcagugacuguuguuguacagacagacaucucacccguuugcacacaggcacguguguggagauaaauuccuaucagugguggcugugggucaagggauauauguaucuuuuuuuuuuuuuuuuuuuuuuuuugagacggagccuugcugguacacacagccuggagugcaguggugugaucucggcucacugcaaccuccaccuccuggguucaagggauucuccugccucagccucccaaguagcugggaccacagucgcccaccaccaugcccggcuaauuuuuuguauuuuaguagagauuggguuucacuguguugcgcaggcuggucuugaacucuugagcucaggcaguccgcccgccuuggccucccaaagugcugggauuacaggcgugagccacugcacccagcuggguauauguaucuuaaaucuguauccauauugccaagucagccuccaaagcucauucaguauuaacuguuaacguucgguaguuucauugcucaccacacucauuugauguccuuccuuccccaugccugaguucugacugcaauguguuucucaguuugaagacccugaaaacacucugugaugauacauuuucauguccccagguggagggaagcugucacagcccgcaagaaacugaggcgccaaaugcgggcuuucccugcugcgcccugcugcguggacgugagcgaccggcugagggcgcuggcgcccagcgcagagugccccauugcugaagagaaccuggccaggggccuccuggaccugggccaugcagggagauugggcaucuccugcaccaggucagcaucagcugucgccugccucgucagggcuccccugcccccacuugguuuuaccaggagcggaauuaauguguguguuuggagggugaagauaggugaagccuggaggcgaagauaggugaagccuggaggcgaggacaggcacaggguugcauuuugaagguugucucccacaguuguggacaugugacuuguuccacuggcaaagcagagcucugaguucaccuugaaagacucagcguccuggugccugagucugacucugcaucacguguucuuuuccugcucgucccaguuuaaguaccugccacuuccauccuuguuggaggagccggagguccacgcuggccugugucuuccgaucccauccccgccccaucccucuguuccucccgccgucuccuucacacacugcccccuuucuguggcagcaucuuccagacuccaccuccacccuccauuauuucccucuugaggccccuugguguggcccugguccucccugccacuccuccugguuaccccgagcagaaccggcuccucagggccaugccaggaccccccucagccugcauuccuggccaugcugggcuuggccuuuauuuagaacccauguaggugccaccucuugccuggccucagggcucccuggccucccaguggguggggacuggggaggcagccuggagggccuagcaggcacaccgcuggggccucaugucaugucuuguccuccuccuggucaucacuggauguucccucugaaaacugucuuguggguuucauuuagccccaucagguucugcgccggcagugggguggcagucccagccuguuggaggcaugcugugaggccagggcugggccuggcuccucugacccauggcugccuucacauagugaccuggccuucuccuggagucauggcuucuuguguccccccuccguagcugcccuugucagccucagucuccuugucugagcccuccacccugcccccucagcccagaccucugcccucugcccuucugcgcacccccuggugauagcccugucaccccugucugucacugacagcccccaucaugcaucuccaacugaggccucuucccugaguuccagacuugguuuccaguuggcaguucaaccucuaaaccugauuuuuccccacccugccccuuccugcucauaggaugccguccuguccuccugcgcuuagggcacaaaccugggcuugcaucucucucagacccagcaccgagggcauggcaguucucuccaccucacuggaauguugcugcagcaccugucugccagcuuccacccugggccccaaucguguccucagcaccacaacagagggauccuccaacagcucagccagguggcguugccucucggcggcgucccuagcgcuccccgagucucugcauuguggacccaaccccucccucgcugcccucacugcucuccccaaacacaccagguccagcuauggccuggcauagccaugcccucugcuguuuccagaaguugucacgcuggcucccccuguuuccuucaggucuuugcucacauaucaccugaccacccugagugagacugcaacacgcacccugccuggcuccagccccaccuggcagcauuugcccacagugccgacaccucacacaugccaggccagccacuuagagaugcuguucucuccccauuagagccuauguucucaaagggcaggauuuugucuguuuauugcugaaucucccauagccagcacacaguggauacuuaacaugauauuuguggaaugaaggaauccucuaacccguuucauuggcagaaaauguguuuuucagucuccugaguauuccccaggggacacuagccaguacuucucacuaagcuccugcggggacacugucauucugcuuuccuuugcagguuaaggcggcucagaaacaagacagcucaccagaugaagguucagcacuucuaccagcagcugcugaggucugucaugcugcacccuucugcgcacccccuggugauccccguuccccaaucugucacacuggcagcccccuucaugcaucuccaacugaggucucuucgaugagcuccagacuugguuucuaguuugcaguucaaucucugaaccugauuuuccuccaaccugccccuuccugcucauaggaugugugugcugcuccugcaagggucucacacacuggcuaauccacgguggucuguuccucccagugauguggcaugggcgucucuggaccugccaucccucguggcugagcaccucccugggaggcaggagcauguguuuuggaagcuggugcugguguugccggauguagaggagcaguccccagagaguuguggcaggucaggaaggguuuuccccugugggguuuccaagagguggagugggcagggcaggguugugggccagggccggguauuccucuuaugugugaugggaacucggaaguguagguuuauguuuuaaugcuuggauuuacagucuguuuugcucaugauuuuaaguugaaacuuuagauuugauuauuucaauuuuuauuccauaaacuugguguauuaguccguucucacacugcuuuaaagaaauaucugagacuggguacuuuauaaagagguuuaauuggcucggcuguacaggaagcauggcuggggaggccucaggaaacccacaaucaugguggaaggcuaaggggagggaggcaugucuuacauggccaaagcaggaggaagagagagagaagggggagaugccacaugcuuaaccagaucucgugagagcucacuaucaugagaacagcaaagugggaggugccacacacuucuaaacaaccagaucucgugacagcucacuguaaugagaacagcaagggggaggugcugcacacuuaaccaggucucgcgaggcucacuuucaugagaacagcaagggggaguuuccacacacuuaaccagaucuccugagagcucacuaucaugagaacagcgagggugaguugccacacacuuaaccagaucuuguugagagcucacuaucaugagaacagugagggggaguugucacacaaccacaucucgugagagcucacuaucaugacaacagcgaaggggaguugucacacacuuaaccagaucucgugagagcucacuaucaugagaacagugagggggaguugucacacacuuaaccagaucucgugagagcucacuaucaugagaacagccagggggauuccacccccaugauacaaucacuucccaccaggccccuccuccaacauuggggauuacaguucaacaugagauuuggguagggacacaaauccaaaccauauuacuuggcaacagucuuagaccaaaagcauuuaagaguugauuguuauuucaagcuguguuaagguacauugauagaccugcuucauuuuagacucuucaguaagauaguuuauagucuguuuacuauaguuccauuuuuuuccccuuaaagaaacuuuuggcauuuuaaaaaagaaaaaauugacaugaucuuauuuucuguaaccacauagcauacagaagucauauuuuuaaagcaacuacagucucuguguuuuuuugagacagggucuugcuuuguugucacccaggcuagagggcaguggugugauaacagcucaccgcagccuugaccuccugggcucaacugaucuucucaccucagccuccugaguagcuggaacuacaggcgugugccaccaugccugguuaauguuuuuuuuuuaaagaugggguuucacuauguugcccaagcuggucuugaacuccugggcucaagcaaucugcaugcuucagucuaccaaaguuuugggauuacaggcgugagccaccacacccggcuuacaguuuauuuuuaaaauagcuuuauugaaauguuauucacauaccauaaacuucacccauuuaaaguguacauuucagugauuuuuagauauauucacaggguuuugcaaccaucacuguuaauaauuccagaacaccuuuucacuuagaaagccuguauucuuuuuuuuuuuuuuagauggagucucacucugucgcccaggcuggcgugugguacacuuuguucacugcaaccuccaccucucagguucaagcaauuuuccugccucagccucccaaguagcugggauuacaggcgcacaccaccacgcccagcuuaguuuuguauauauuuuguagagacaggguuuugugauguugcccaggcuggucucaaacugggcucaagcgauccaccugccuuggccucccaaggugcugggauuacaggcgugagccacuacgcccagcuggugagucauuucuuaaaauagcugucuucucauuugcuaaguucguaugucacuuaagaauucuuaaggucucagguaugagaaauuugaucuguaaaaaacauguauuucaaacucuagggauguuuucuauugcugaaaaucuuaaugcuucagaauuuuaagucacauuagaaugagccaguuccauucuaauggaauggagugcccccuccuccugcccaauuaagaacaaguagaagccgggagcaguggcucaugccuguaaucccagcaacuggggaggcuguggagggaggauugcuugagcccaggaguuugaggccagcaugagcaacauagugagacccuuugagugacacucuacaaaaaaaauggaaagauuagcugggcaugguggcccgugccuguagucucagcuacugaggcagguuugcuugcugcggugagccaaguuugugccauugcacucuagcuugggcgacagagcgagacccuggcucaaaaaaaaaaaaaaaaaaaaaagaacgaguacagaucguugcuccauuuuaaaacaacagccuguuuugugcagaucagcuucauaguaagaugugguauuuguggaccuaggucugugugauauuuuucuuucuucuuuuccugaaagucuuuauaauucaaauauagaauuagauucuucaaguguuuuuuuuguuuuuuguuuuuuuuaaaucuguagaauucuagcaaauugguuaaaagucaaguucaugggagaugaaggcucaguggaugacacauccagcgaugcuggugggauucagacgcuuucgcuuuucaacucacuuagcagcaaaggggaucagaugauuucuguuaacguguguauaaaggugaacuauaauuacuuuguguuuacuucuguguuuucauuacuuucacuuacucccagauaucacuggaaccaugcaaauacugcuuauucccuaaugugguuuugaaagacugggaggcucagaagcaaguauuaugucuguccguacaugucguuuaaaaaauuuuuuuaagccagucaaauugaguagugggcaccaagcccagccugcuucuuuacuuuuucuguuuuaauacuauauauuggauuuccuaaauguaauauguacacaaaacuuuuaaaaaaugaggaaauguaaaagaaguauaaagaugaugauaagagccauccaugcucuugccauucugagguaacaguaacuucuuggugcaaauucuucccuuuuccugggauuacaaagucacauuucaucuacuggaaauuaguuuacugcugcuguuaccuucauuuucauuuaagaaaguaacacuuccguguacuuaaaaagaagucaaauaaugccacccacgugauuuaaaaugagacauaguagcuccuccuuccucucuuaacuccuuucuucagggcugcauuuuucuccuguuuccagaucacacacuuacacagccauuucucaguuuauccauuuaaauguucucugcugacuucccauuaauauaaauguauuaguuaccuuauuccuaaauaacuaauuacuccuaacauagcagcuuaaaauaaugucuguuaucaugguaucugugggucaggaauccagguguagcuuagcuugggucuucuggcucaagguuucucauggguggaaaugaaaauguuggcuaggauuguggccucaucugaaagcuugacugaaggguaucuacuucccagcucacucuagugagcuugugucaggauucacuuccuugcaggcuguggccaaagacuuccucaguuccugccacaugggccucuccccagcugacagcauggcagcuggcuuucaucagagugagcaagaggugagccuagauggaagucugaguguguuuauaaccuaaacuuagaagugacauccuguugcuuuuguuggcuucugucugucagaagugaguggcuaggcccagcucacggggcaggagaucacacgugggcaugaacacuagguggaaucagggggguccucuuggccacugcauaccauacuagguacagcguggccucuugugccaugguccuugcucggccuuccacgucuucccgggauagcuacacuagcacuuuguauuacuucagugaguggggucauauuuugauggcucugugacugcuauucaccucagaaccaguaguguucuauaaccacaauuauuuuuuuccugcaagaaauagaguugccuuauugucucacuuaauguaguucucuuuaucucuuuaauuuuacuggggggccguauauaucucgguagaguuuuccaaauguucugucacuucacuugauccauccauguucccucuguccuggaacucucaucugugggcuggucuccauccaggcaacaugugccuuagugccaucauugugagcauaugugucccugcuccuccacuuggaagcucugugaccuugggcaaguucccuagcgucucugccaccuguguauggguacuguuacuuauuaucccuauuuuacucagagacgguaaaauaaacugcccaagccucugcaggugcugucugguggagaugcucaucuggcucuugaggauaaaaugagugcaaacacagacugcacaggacagugccuggcacaggccaggugcuugcucaguguugccauuagcagcagcugcaguauuuuuucuugguucagccccuuguuggauguuauaugucaugcgaggggaauuuucugagucuuuuccauuaugaaaaugauuuuauuaacaaaauaccuuaagcugggggaaagaaaaagaaaaugcauuuauuucauucugacauuugcuucauaguuuagcuacguuuguaaaauuauagguagaaaauuauuuuccuggccgcgcauaguggcuuaugccuguaaucccagcacuuugggaggccgaagugagcggauuguuuugagugcaggaguucgagaccagccugggcaacgcggugaaacccugucucuauaaaaaauacaaaaauuagcugggcaugguggugugugccuguaguucuaguagcuugggaagcugaggugggaagauugcuugaaccugggaguucgaggcugcagugagccgugaucgcaccacugcacuccgguguugacagaggaagaccccgucucaaaagaaagaaaauuauuugccuuccaguuuugcuccacugucaccuagcauccauuguugcuguaccauuccuguuccuuucuguguggccugguuuucucuguggaagccuuuucucucuguucauggcguccuaaaaauucacuuuguuacacuggcacuggacuagcuucacucacugugcagggcuuagcagguccuuucaggcuagagacuccuauuucacuucugggacauuuucaugucuuuaugacacucugucuuuuuucuguucucucuugaacuucuauuagauagauguuaggccucaucaauugauccucugaguuucuuauccuauuuucuauccuauuuucaaucucaucucuuccuacuguguucugaaagaguuccuugacuuuauuuuccaauuguccuacugaauuuuuuauuccauauauauuacuuauuuccucuuucuuuuuaucaugacuuuuucauagcaucuuauuuuuuggaugcaucaucuuaucuuuccaaggaaauuaggguuuuuggggucuaaguuuucuuugguucacguauuaucugguuccucuuuuuuuuuuuuuuccucucuguuacuccaguuuaucucuuuuauguuggaggcccuccucagaugccuuacccaaggcuaucugucuauaucugagugaggcccuaaaaggcuagccaagaaguucuguguuuggggugggguggaugguagcuaaauggcaagccaggcuuuuuggagggacucccaaaugucuggaucuggauggcuguucccuagacuguucaguuuuucuggaaaggacuugugccaucugcuuucuggggagcugcugguauucucaggguaggguugggagugguuuggcgcugagucccuuccacugugccugaccauggcccugcaucuggauccucucaggacuccuguucaggggcccagggggacugguuuugcauagagguugccugcaguggugggugccgccaauagggucaggcucugaacuucaccuuuggcuccuggugucugcagcgccuggguauacagggcuuuugcaggcucagucaaccugacuccuuacacacccacaucugcagccuuuagguauggcauccucugcuucccuaacccagggauuggucacaccuauuugcugcuuucuagaaauguaucagaaucccucaucugcugcuggcuugccuucccucuuucuauuauuaugggcuuauauuuuuguuuauuuuuguagagauggggucuugcuauguugcccaggcuggucuugaauuccuggcuccuggccucaaacaguucuccugccuuggccuccccaagugcugggauuacagucaugagccacugugccuagcuuuaacuuuuuuauaccuguuuaagguuaauuaaaguuauaguaauauggucaaacacaauucuagcuggaggcuaaauuaccuguugaccuggcuguuucuugcacuaauucuguugcauuuauucucauuuuuguuucuauaaauuuaaaauaugaacaugggugggcgcgguggcucacaccuguaaucccagcacuuugggaggccgaggcaggcugaucacuugaggucaggaguucgagaccagccuggccaacauggugaaacccugucuccauuaaaaauacaaaaauuagcugggugugguggugggcaccuguaaucccagcuacuauccaggaggcagaaauugcagggagcugagaucgugccacugcaauccagccugggcgacagagugagacuccaucucaaaaaauaaauaaauaaaaauaaaauaaaauaugaacaugccuuauaucugaagggcagauauagaaauuauuuuucuagggugauuguccucugaauauaugaagaaacaauguuauuugacguuuucuuuaaaaaggaagucugaagcuaggcaugguggcuccucgaaccuguaaucucagcuacucaggaggcugaaccaggaggacugcucgagcccagcaauucaagaccagccugggcaacauaauaagacccccuucucaaaaaaaaaaaaagguugaggggagucuuugcuaacaauuggauuuagggaaagaggggccaggaauuaaaauaacuacaggaaguaagauaacuacaggguaugcccagcugugcccuuggaggccugucuggaguacagucaguauuuagugcacggagagcuuuggcugcacuugcucuggggcagaucagucacugcugaugcgucccauggugcaucucuccugaugaucuugaugcuguugcagguggcccauggcgcccucagugauggugccauugaugcuguggagacacagaaggaccuccugggagccagugggcucaugcugcugcuuccccccaaaaugaagagugaggacauggcagaggaggacguguacuggcugucggccuugcugcagcucaagcagcuccugcaggcuaagcccuuccagccugcgcuuccucuggugguucuugugccuagcccaggaggggacgccguugagaaggaaguagaagaugguuugugaaggaagucucguuuaugaagcagcauuguuuaauaaauggguggaggcccugggucugaggaugguccaguaguguuggggucaggaaucacugagacagcaaccccuguggugacuguccacugcaggacuggguggggucagcacagugagauauguuagcaggugugcugacagcagaaugcaagugaccuucaucuaugucugucuuaaaggucugaugcuacaggacuugguuucagcuaagcugauuucagauuacacuguuaccgagaucccugauaccauuaaugaucuacaagguucaacuaagguaagguuucaucauuuuuaauggucugucaagauauuuuguuuuuuccccuuuugcuguaucuugaauugaguguauauuagcguuugcauugucuuuuucuuaagagacaggguuuuauugucacccaguauaguggcaugaugauagcucccugcaaccucaaacuacagggcucaugcaaucuucccacuucagucucccaaguauaugggacuacuguggugugccacugcgccuggcagcaguuguauguuuuauacagauaacuuucuaaaaacauaagcagaaaucaaaauaaaagauaaaauuugcccacaguccugcuaucugcaaauuaaauuguucauguaaaauuuuuuaguguuuuuguuucuaugaauuuaaaauaugaacaugucuuauaucugaaggucagauacagaaguuauuuuucuaggguaauuguccucugaauauaugaagaaauaauguuauuugauguuuccuuuaaaaaggaagucugaagcugggcgugguggcuccucgcaccuguagucucugcuacucggaggcugaagcaggaggacugcuugagcucaggaguuugagaccagccuggccaacauagcaagacccccuucucaaaaacaaaaaaaauagggcagggggagucuuugcuaacaauuuagagaaagaggugccaggaauuaaaauaacuauaggaaguaagauaaccauagggugugaaggcaccuuggcacauagugaagcuguuaguccuuccaaaaaggagaagacuccauuucugugcauggugaaggggauguucagggcugguuuccugagggccugggccuuuccauggggcaaccaugcaggucacacuccuccucaggccaggugggaucugggggcucucuuuagugccccuacuggacaugucuccagagcccuagaaggcuaaacucaacugcauaggacacuucuguuccccuuccuaccacaguugagagcccaguacucugguauuaccugcugugggcaaccuugggggaucaagcccuuucagaaagcuguuuuugaaaaacagugugaauuguucaaccaagucucuucuuucuucucagguuuugcaagcagugcaguggcugguuucccacugcccccauucccuugaccucugcugccagacucucauucaguacgucgaagacgggauuggccaugaguuuaguggccgcuuuuuccaugacagaagagagaggcgucugggcggucuugcuucucaggagccuggcgccaucauugagcuguuuaacagugugcugcaguuccuggcuucugugguguccucugaacagcugugugaccuguccuggccugucacugaguuugcugaggcagggggcagccggcugcuuccucaccugcacuggaaugccccagagcaccuggccuggcugaagcaggcugugcucggguuccagcuuccgcagauggaccuuccaccccugggggguacgugcuugaccuggggaggucugguggguggcugcagccaagucucaggcuuccuucucacuguaguaaccgucuggcagguguugggcaccagugugagggcugcacguccaccuccgugugucuccaugcugugcucgccugcaccuuccuuugguccuuuggguucaugagccagaacaagcuggguuuuguggagugggggcuguuagccuuuccugaccagcaaggcaguccaugggaguucacucagcuucaggagaaaagugacaagugguacugggaggaacaccaacccugauccuguccugccugcccacagggucccuguuuucagaacagacaaggggcaaagagcauggggaccauguagcccuguccccaagccgcagccauggcacucagugcugauuuaacauucuuucuuugucaaagaggccuucuucuauggcucuggcugugccccuguuccuggcugaggucuuugggcuguuuugacacagauccgacaggccaucuggcuggcucaagcccaguauggcauggggcugcuccuuccuaugcacucagaagggaaugagcugcuuaucuggcagaaguuguggcauuagcacagacacuccccuuugggccucaggcgcccuucuaaauugugguguguggucuguaguaggucuaacucaugcucauuauugaaggaacccaaagggaagcaaaccacucagcacaagcccucggugcucugguuagguugggguuccccaaaauaagcuaagacugcuuauaccagacucaucugggugcuuguuaaaauacagauuuccuaggcacaaccacaggccuguacagucagaacuucuggguagaacuuggcuagcaacacuguuaagggggacugucugcaucccucaccuagacccugggagcaagcugcucuucccccucaacaacugugguucugcuguguuuagaaagcagacuucucaacuucacaguugccuucuccugagaaaauguuuucauguacauuuucaccuguauuuuggccaaaccuguaacuaaugaggcacuuucuccccagcccccuggcuccccgugugcuccaugguuguccaguacgccucccagauccccagcucacgccagacacagccuguccuccagucccagguggagaaccugcuccacagaaccuacuguagguggaagagcaagagucccuccccaguccauggggcaggccccucggucauggagaucccaugggaugaucuuaucgccuuguguaucaaccacaagcugagagacuggacgcccccccggcuuccuguuacaucagguaauuagagcuugaugcaaugggaucagcuccucacgagacuuuccugguccaguuucugcaaaggaagauguuuaguugauguugcugcuuuucuuuugggucucuauccuuccuuuccuuaggacuucccucuucaagugagugacuuaaaaacauugagacaggcuaggaaguuucugguagagccugaacucaccucccugaaacaggcccccuaggauggcucuuagagaggauuuuguggcuuuugaguagucauuacuggcccugccagucucgauguaagcuugucuggacuuugagugaugcauggacccugggagccuauuuaacccaaguguggaagucacauaauugugugacuuuaaucaaaggucuugcacuuaaaucagugaauuuaagcacaugccaccugucgcuguuuaaauauuauuuguaccuguuuuuguuuuuuuguguguguuuuuuuuuuuuuugagacaggguuggccaggcuggccucuuuaucuguuuuuguauuguuuucucagaggcgcugagugaagauggucagauauguguguauuuuuuuaaaaacgauuugaaaaaauaugauguuccuuugucgugggaacaagccagguugcagacgcagaaggagcuacagcugagagagggacggugagguucauguucaguauguuucuguugcuugcuaaacuguauuuuucuugcaaaguaaauagaaauuaacauccuacaugccaaauccaguccacugugggcagacugugacaaauccucaaggaacagaucauucccaugcaguagaaacuauucuagaacaaaguuaaagcaucucacuucauuuaucaggcauaccugacccugaaaucauaccuaaccaggagaguacagcugacauuucaucucacuuccaaauuugguuccaaagcacaguaccuaaaaaaguucacaaguaugcuuucucccaggauaaacaauaacagugaaaaucuauuaauguaauuuguugccauaauagaaaaauaagugguaauuuuagcaggcguugaaauacguuucuuaaaauuuauaccuguuccugauaaaauuucuuuauuuuggguacuuucuuuagcuuggguuaaaaaaaaaaaaaguccuaacuugauaaggcuaccuaacauaaaacuaccaaaauagaaaaaaaacaugcuucuugguagaauguuaggaacaguggaaucagaaccagccuguugucccgacuauuauucacuauuguccuggaaauccugaccaguacagggaugugggauagacaggcacaaauacugaaaggaaggagaaacugucauuuccagacaguacaguugucaguccaagaaaagucaaguccauagaaccauucucaguucaauaaggugaucagauagauagauccacaacauguuaaaaaaaaaaaaauucucauucacaacaauaaaccugaacagaaagggcacaggaugguggaacuuugcuguuccuucuuguuccccauagagauccuugaaguaccuucuccaacuccaugauacucuaaaaacuguucaucuucauaauaggaguggagccuaauccuuggucuccucaccuccugguuucccggaaugucuuucucauuaacauaugaguucucagggccuguaugugcaaaggaaaccugaaccauugagguucagacuagguuguugacaggauacaaugcugugaagaugucaguacugguaaguucuaaaauucaucaggauaaacaaauaugcaucaauugcugagaaaguuuuaaauaagacuaacaugguuugcuuggccugauaccaagacauacaguaaagcuccaguacuuaaaaccauguggggaugccagaguagauaaauggaucagaauaaagagucagaauaugugacaaaaguguuaggccaaauuauugaaauuaguggggaaaagacaaacauuggcauguguuuagaaaaaaaugucagaugccuucucucucaccauuuguaaacauuacuuccaaauguauccaagagcuaucuauaaaaaaccuugccaauacuagggaagaacagaaucuggaacccuagggugggaagcaagacaugaagcagagaagcuccaaaaaccuagcugccucuugagagcagaagcuuccaagaggaacaggcagucucaaugccucugugcauaagggucccuacagugcaggggcugccuucccucuuugcuccacucccugacuugauggaagcuuggaagcaggcauggggccagcaugagcuguuccaggagggcacaugugucugaggcacauguucuuacauguuaaugcacaugugcaaauguaucuacaugcuuuacaugaugcuguagaaauauuuucucuugaccauaaacauuucaaaucauguacuuacaguuuggcaauaaagccuuuucauccuucugcaaacaauuuucccauaccauugcuucacaugcaccguaacuggaagaggagcacagagugugcucaagaggggaggauucccagcacagaggaucugaugcgaggagcuucugcugaggagcucuuggcgcaguguuugucgagcagucugcugcuggagaaagaagagaacaagaggugaagcccacuuccuucuaauucauguguguuuagucugcuuuaugcugugaggggagacugguuauugcuugauuaauauaagacagccaggauggagaagggcagguggauuauuagcaacaguuuuagugauguaacuauuuaaaagcucuuugaagacagaagcagugcccuagauaguauguuucuaacuguuuauauugaagugaauuucauuuauuauuuauuauugaaagucaguguuaaguuuuucugggaaauucaugugguuaagucugcucagaagauggugagugcugaacacuauggcuggccacaggcacccugcccuugggagccugaggcauugguggaucaucccaugcugugaauggacaggagcuggggcugccccuccucuacauugcccacuucccucccucccaugcauaccuuuccuuugcuuucauuugauggccauguuuaccauuuuacugaguagaaucaggaauaagggaccuuccacagguuguccucugccuucccugcccucccagccacauccagcauccucccuauauccccuuccugacgccucuuguugcuggaaacgaaccaugcagcucguagucagucagcccuucccugggcugggaucucaucucccaccuacccaaggacauucauucaaugaguaucucucucgugcuaccaccccuccccauauuagguggugcccaucagcagcacacagacaugaaacaugccucccugucuuggucccacuucccucuuuagccaccacuucauguuucugcccucuuaaugguaaaacuccucaaaaacgcuugugauacucacuucuucagccuucuuucccauggggaugaaggcccaggguugaacaugaccgugaaucccaguccuugguagcaucccauacuugauccuccccuccuugcuccuaggauguccguggucccccuccugcccugcugguuccuccucaucccccagcugcccccuggauucauucucucaaccucuccucugcaucgucuguaccuacuccucagaaauuucauccaguuucauggauuuuuaaguaacaucacuauucugacagcuccaaauuuguaucucaaaccucugaacuccacacuugaacaugcuacugcuuccuugaaaucuucauuagacaccuauuggaugucugguagccacugcaaaguuaacauaucccaaauccaguucccggcuuucuuccaaccaaccccuuccuuugguggucaucucuguugauggcggcuccauccuuccagcugccuagaucaggugccuuggaaucauccccucacaucagcccauucacauauccuauuggcucuauugaaaauacauucagaauuggaccacuuguuaugacuuccauggccaccacguggcucaagccacuaucaucuuccuucuggauuauuacaguaggcugcaguuuagucuugguagaccuggugggugccuuucaagugaguuaagauggaggucgugucacuugcuugcuuacagccucucagugguuucccucuuucaccugcaaucaaaggcaaacuuugcagggguggccagggcccugagugaucugccccccauuuccucucugaccuccgcuccuuccuugagcaugguaggcaguucacaguugggccucugaguuugcuguuccuuuugccuaggacuguccagccccuccauucuccccagcauccccauggcugaucuuguacucacuucagaucucuacucaaaugucugcuucuguuaggcccugcuugcccaucuccgaccuucuuguuuccauggcucugcuuugucuuucucaucuucaaaccauguuucucuuguuauguguuccuugucugucucuccucacuaaaguauaaauugcuuagggcagggccucuguuuuguuucagugcaauauuccuuguaccuagaaugaugccuagcaucuggaggaggcuuaaugaauauguuuuggaagggugaaugaauguguccgauuacuaaaaucagucucuauaauuuaagugguuugggaugagauuuuuuuuuccuuuuuauuagauagagucucgcucuguugcccaggcuagagugcaguggcacaaucucgacucacugcaaccuccaccucccagguucaagcaguucuccugccccagccucccaaguagcugggacuacagguacccaucaccaugccuggcugauuuuuguauuuuuaguagagacgcaguuucaccauguuggccaggcuggucuugaacuccugaccucaggugauccaccugccuuggccucccaaagugcugggauuacaggcaugagccacugcaccuggccaagauuguuuuucuugaaaagaccgguauauggaaguagacagcucuagaguauguuagguggcagugggauauuauuuugaguuaauuuuaagcuauaagcagcaauccacucauuuggaaaaugucagaagaauuaauuauagaugcauaaaaccaaaguaaauuaaauaagauaagccaaacaagacaauuacaaguaauguuaaguaacacaucgaagcaguuguuuuuggauuaauaccaccuuuuucauuaaauauaaauuggaauuggauuuauaaauuaaagggaagugguuucucuaauuuuuuuuuuuuuuuuuuugagauggaguuuugcucuuguugcccuggcuggagugcaauggcgugaucuggcucacugcaaccuccgccucccggguucaggcaguucuccugccucagccucccaaguagcugggauuacaggcacgugucaccaugccuggcuaauuuuuguauuuuuaguagagacgggguuucaccauguugaucaggcugaucuugaacuccugaccucaggugaucugcccgccucggccucccaaaguguugggauuacaggcaugagccaccgagcccagccuaguuuuuuuuuuuaaauuaagcuuuaucauaggaaguuguuaaauuuuuaauaaguacauuucugcuucucaguugaugucauaacuuaguuauauucuuaguaaaaagcaaaggcuuaaggcuggguguggugacucaugccuauaaucccagcacuuugggaggcugaggugugcacaucacuugaguucaggaguuguagacuagccugacaauacagcaaaaucccguuucuacaaaaaaauacaaaaauuagcuggguggcaugcgccucuagucccagguauuugggaggcugaggugagaucauuugagcuugggaggucaagguugcagugagccaagauuguaacacugcacuccggccuggccaacagagcgagaccuugucaaaaaaaaauaauaauaaaauuggccaagcacaguggcucacuccuguaaucccagcacuuugggaggccgagguggguggaucaccugaggucaggaguucaagaccagcuugggcaauauggugaaaccccaucucuacuaaaaguacaaaaaauuagcugggcacaguggcacuugccuauaaucccagcuacucaggaggcugacgcaggagaaucacuugaaccugggaggcagagguugcacugacccgagauuaugccacugcacuccagccugggcaacagagugagacucugucucaaaaaaaaaaaaaaaaaaauuauauaaaauuuuaaaaaagcaaaggcuuaaaaaguuuuuaaguauauauagaagauuaaugaacaauaguuaacuuccuaaugcucaaauauuuuugaauuuauuacauauuguuucagguuugaagaucagcuucagcaaugguugucugaagacucaggagcauuuacggauuuaacuucccuuccccucuaucuuccucagacucuagugucucuuucucacacuauugaaccugugaugaaaacaucuguaacuacuagcccacaggugagaagaacguauacauuuggcauuuacauaagaauuaaagauugagagaauggcuggggaaaaaaguaauaucacgauuuauccuaugauguuuugaugaccgacaaauuauuagcucaaauuagaccuuuucuuaaacuuuauccauaucauuguuaaagagacccaacugauuuugaguuucugccuacgaaauaaaugaagaauagaauugaaauauucuuaagaacugaauaagaccuguaacugugugcugauguguaauuaagggcauuaaggugaugacagcagcuucuguuggagcacauauugucugagcuuuggcauuacccagaccucucuucugggauuaauuuuuccugaggaaaacuaaugaaugaggaagguaagcucccagaagucaagagccucacccaagaguguucaaguagugaguggucagguugcuuuucaaagccagauccaacuggcuccaaagccuaaggucuuuuuaccuuaccauucuuccuucagugguuaaagaugcaaaaacagaguuucaaucacagauaugugccacugaacagguaaaaacugugcuccuggacuggcuuuaggaaguccuucaauagaggagaaaagcaaauuaaaaugauguacuguuuccauucaucaguuuggcaaauacuuuaaaaauauucauacccuuugaauuaccaauucuaaccuaaagaauucugaccuaccagauauuccccaaaaauuaauguauaaaaauguuuacuguagcauuauuguaugaaagucgaaacagaauaaauauccgaagaugggagucugauuaaacaauuauaacacauucaugugauagaauaauucacagcccuugacgaugauauuuucuaaaaaugacuggcugggcgugguggcucaugccuguaaucccagcacuuugggaggcugaugagggaggaucgcuuaaguccaggagcuugaguccagccugggcaacauaaagagaucucaucucuacaguacauaauuagccaggcauggugcuacaugccuguugucccagcuacucaggaggcugagcugguaggaucacuugagcccaggaguuugaggcugcaguaagcuccgaucauaccacugcguuccagccugggugaaaaaugacugacacuggaaauuguucaugauagaauacaaaggcaaacagucuauauacagauaccagcugaauguacgagcuaaaugaggcuggaaggauauacaaaggauaauuuuuuucccucuguaaaaauaaaugacuacucagaugagguuucuaacaugauccagaucuaguaccuucccagagauaggucgugguuuauugacaucccaaaacuguucaguuucuuuuuuauucaaauagagugacaugaugagggagcaacugcagcugucagaggcgacaggaacgugucuaggcgaacgacuaaagcaccuggaaaggcugauccggaguucaagggaagaggaaguugccucugagcuccaucucucugcgcugcuagacaugguggacauuugagcagccugaccuguggggagggggucucucccgaagaguuucuguuuuuacucaaaauaauguuauucucagaugcuugaugcacuguuggaaaugugauuaauuuaaucaugcagauaaaccauuuaaauguc

SEQ ID NO: 192154 - RNA, 34731 nt, Homo sapiens
auggguucaaagccuuuauugggucagggcuugcuccagagcucaggggccagguaggucaggagccuugggauggcugcagggggagggaggccgggcagccugcggagggccuggggagaccuggggcugggcgggggccggggcuacggggaccccgugggaggagcuggagaggugcaggcccagggcgucguccgagugagcagcggugcuggccgugugggacccgggcccgcuuagcaccauggacggggugggcucacgacccucgacugcggggcccgggcggcggcgcuagcagauccagcggaugaagcggucgaagaagccggguugcgccaggcugucauaguccuucucguggaacacggcggcgcggucacccaggcugagcguggugagcacguccauguccacgucgcugcccaaggccagcacgguggguaccacguucugcuugcgcauggagugcgccgacucgugcagacugucguugcccgugacgccguccgugaggaacacgaaggacagcucugcgugccuccgggccccgccacgcgggcugcgcacgauggcauugauggcgugcaccacgccugcgcccacgugcgagaaggaguucagguauuguguggucuccagcgccucguggauggccgugagguuguggcucagcgggaaggccaccugcugcucgccggggccaccaaacugcagcagcgccacgcgugcguugagagggucgucgucccuccgggccagcgucagccgccgcgccaccugcuccacgaagcgccgggccuuguggaaguucugcucacccagccgcucggagccguccagcaggaagacgauguccacgggccgcugcgugcacugugccacggacagcucuguggggagacgcaggugcgggcugggcggaggggaggugggcaggaccgggcaggugccagccccgcaccugugcccuuccauucgcacccugccugcaaccucacagaccacugggcucugcgggggcguuucugcagggcagcccuggguguggguccuuagcccaagacacuuucaggcggcacugcugggagccgccaucuccucugcuggugcucccaggccugagacccugacacaggccccaggcccuguccaccugcugagcaccaucccugcacaggcugcccuccugggagggaaggggcccaaagcauccuuucauggcucaagaauuugcugcccacaaaagggccacugucuguguagugugggagguacuuaaggaggacccuggcucugacacccccagccugaccccucaaucgcugggucccagagcugcucagaacaccuagagcuggcugggccacgucccucccggaaagaccaggagccccugacucuucugauuggccaugguggggagcagugggcacaggggcagccagaccuucuguggcagcccagguggguucugcccuaugacucuguuaccaaguggggcccccaccugccuggguggucaccagcccugggcaucggggacagcuugggggccuggccauagccacaacccaggccaggcugccuaccacacgugugggugucacguggggccagagaccacaggacaggacacggacaguccuugcguggaccuggcccuguggccucaccaagaccucagcuccugggaugggggaggggagggacagagccaguuuccccaagggugucugcuucucagcccaaccccuggacgucgucacagcugguacauggacccccaggaaugcacacagaggacccugacccgaaacucgguuucugggggcccuggaggugcaacgguccagccccgcaggcagugagcaaagcucugaacacagcagggugaccucacgcugcaccgcagccuucacagaacgcuugagacauggacgccgucugagcacgcacgagcuggcagaugggguucccucagugagcuuaugagugacgcagcucauucagugaaaggaagggcagccucccuguuaaggccacaccuaggaaccggcuuaaauguccagaaacuccucagguaccgcugggcuucccaaacccccucaaaacuaauaacauuuucacugcugucaccaaacauauggagacagacaugcaaggggcagcugguuuugggggucucuguccauucaucagugucuguggggccuggaggagacggggaagcugugggggccggccaggcacagggaggcugaggcuguugggaugucuguggacucugcucuccuccuccuguggaggauccuucauccccacagugggaagaccagccuggccugcccugugcaguggguguggggacgagaaccuggcccugagaaauggucacagccgugcccggcaggagcccagccuggaugagggcuccugcagucagaacgucggggucagcucgccgugggggccgcucccuuuggauggugaucccugccgcuccccaacauuguggacccugggauucucugcucaguccucugaggaccgcagagguugugccugguggaugcucccccgacugugcuuuuggagacccagagguugggcuggaagggugcagacaccccgggaucagggcugcuggcaggcagcuguggccauucgcccuacugugcaugacaccagcccagauacgucauggugccaggacugccagcuucccccaggacuaucugcugcccaaccggaagccuucaccugccaccaggugggccgugagcgcccacgagucaccaugcacgggauuagugcccacacccagcgaggcucaccagccucuggggccuguuuccgaggcuccgcuggaaccuggugcuggaacauccuccagcaccugggcagcacccucccucagccccaucccagacgcacggcagcccagcugggccgcuaaguaagggccuccaaagacuuccacacccaaacccuggagccugugagggugaccugaugcagcaaagaaggacucugcagacgggagugaguuaagggucuugcgaggucauucuggacuuggggugggccuuaaauucaaugaccaggguucuuauaaagagagcggccacaggaagacggaggagagacuggaagaugcagccgcagcaagggacacgguggccaccagcaugggaagaggcugggagcugccccagagccccuggaaggacuguagccccgcugaccccgauuccagaucucuggccuccacugagagccagccugucgggggcagcccugggaagcuaguguggcagggagggcccagcccggcugggcgggugcccgggcuuuagcagagggccagcgcggucucggggucccccacgaugucccugugcaccagcuuaaaggugucaaugaacagcuccauccaguccugccgcucuaccccgguggcgaacuuggcccgcucggcgguguagaccagcacggccaccagcugggaguaggcggccggguccugcgugagcuccguggcguuuagcaacuguuggaucaggggaaugguccuggggaagguggcguccggccccucuuccgugcggaggaaggugaccgggggcucgccgccaggccacggugcaucugcaagggagcguccagagaagacuguaaggccugcggugggcgucggccuagagcuccuccucgggcagccgcucagcgaggccagagugaagagcggcauuugggcuggcgagucgguagaggaaaugcagguggagcggguguguggcucggccuuggcaggaggcgugggggcagugagcacagggacaggaagcuggcagggagcuaggagacccgcacgguggcaccuuugggggacaccacggaccccgagaaaaccuuucagcacaaaacagcuccguccaaaccugugccggagacaggccaaacuccaguagggcuuccagugccgcaggcccgucgccaggaagaccccagccaccccucaagagcccgccugagaaagcuugcggugguaaacccuuccucagccucucugggaugugaguccucuacacccagaacugucuuccccugagcagaccuggccucugcaacgucucugccuuuucuuuccaccgacuggagcucagguuacgcuguggccccuaugcagcucuuaucgcugauugcgcccugcccugacugccuucagcugcgucugguuuguuucuccagcacccucugguccccacgcaacugagaacuccacaggccugcugcaggcccaggguggcugggcuuugggguggacagggcugucuggagaaggccagggccaggccacagccagugguguccacccagugcccaggagggccgaggaggaugccuggccgugugggcuggugaaagccgauuuaacacugucccugcugcaucuccuggagccacaaggucgaguucacuuugaaauuggaaacagcugggaaggaggaugagcucugagugucggggaugaggugucagggcggccgagaggaggggagggguucugccagggcugcucccacucacugucagguccuggaggccucagaagaggccagagcuucaagggccuccguguccucccuggcugcuuucccuguggugcucugguggccugagugacccacucccaggagggagaaugggcucacuccaugucaccgucuggggaggagccaccacaggacccuacgaggcccacgucacccugaggccagaaccagagagaucacgagaaaagaaaagugcaggcugaugucgccgauaagcgcaaacccucaggcaggcaucagcgaaucagggcccacgugcauaaacagggccacacaccacggccagguggguuuaucccgggcacgcagggcuggcucaacacuggaaauucaaugacgcucaacgggcuaacuaacucccaacuacaaugauaggcuaaagaggaaaggucacgugacauccacagacgcagcacccacccacucacgauagaaccuggaguggaggggaagccauagcggccacucacacuggacccagaguggagaggaaggccccccaccugauagcaaagcacccacagugaccaucgccaugucgcccaucauggggucccgagacuucccugccccaucaggaacgaggggguggguggaggagccaaggucugguuccugcccucaggguccaggugccccugcugcugauguggacccugggggaggacgccugcaccuuggcggcagaagcacagcccacuguuguggggccagaggcugcccgccugcugaagggcagccagacccaggugcaagcccuagguucucugucgcagcacguauggggaaccucggcucugaguccacggcuccuccccuggggcagccucagggccugugaaugugcucaguggcccagcucacccaccgggagcuccccauggaacgcccgaacgcacaccgcgacccgcgugcugaggaagcgcugacuucguaccgcagacccugagguuuccucccugugguccuccaggucggacccucccacccugucuccauggcaucccuacccucacacuccuggaggggacggcucacugagggggacucagcuccuaacgcccccggggaccuccugugggcccagguacggugcagcagugcaccaugggggcagcaccacguccagcagagccuggacggcacccccagcuccagcuucacacccacgugggccacauccgggacaugggcucccccacucccagagaugugagagccgcagcugcagcuccgaggcaggccaggguuggagcaagaccugcuggugcuggggggugucagugcuuccaccccgggaugguuucacucacugaauccagggcuuccuccgaguggcacaugcacggccagcccaugggagcugggcggcagcugagggagacugcaaggcccauggugggccuucaagaccaguggccacaugccgagcacagcgccaggcuagcagcacccaccucauggccucgugaugcuguuccugcguuccugggagccugccuuccccaagccccuccuccccugugcugccauccuggggccaucucccuaaggagcagccuccgcaguggcuccgccgccccccgggucccugcacggccccucccccagcccggcccucgaggaggaaggacaccagggcugcuuugcuagucuggggugguggcucagggugcccugcauuaccuguuuggcagggaaggucugggcacacgaucugagggucuggaagagaggagagaggccgggccaggccagggucagucccuagcgaacccucagcggccguucacugaucugccuagacaggcucagggugcagcuggccucugcccugcagccccgagagggcccgaccccuucccacccacagcccaagauccugggcugcacauucaucccucaggugaggggugucccuggggcucacgcuagacagcggcuggggccugcugcuccucggccgacugccccgcgcccacacgcucacccgggcagaggacguccuccaugucaucgaugaacuucucagcgaccaggucggagaacagcgucauguugcgcaccugcuguggcuugucgcaggcgauggaguagagguuuucacucucgugcuucucguggaacauguccccgaugccgauggccgucacugugacgucgcggucgcacagcgcccgcaaguugaggucaucgucccgagggucguggcgcccguccgugaugaccaccgcaaacacacgugucuucuggcgccggcucuccuugaugaggcggucguaggcaaacuugagggcugaggguguccaggugccgcccgcaauccacucgagguucuugacagccuccuugaagcucgacagggagucgauacguucgucguccagcuggauggccucaaaggugcccucguggcuguacugcaccacgcccacacgcgucccugcaagccgcacgcgugaggucguugccagaggccucggggucuggggcauccccagccaugcagaggcccucguuggagggacgcgucuggacuucucccaucucaucgccucccacgccccgcccggccccccgcaaugcugcacccgccccugccccgcugaccugucucggacuugggguccuuagcgauggcacccagccuguugaccacguugaugacgaaguucuucuccagugugaaguugguguacccaaugcucucggagcugucgaugacgaagaccacguccagggcgccacagcgcuucucacagucuggggggguggcagggucaucgggggguaccggggagaccucagacccuagggucacgugcacaugcaggacccagcgaugacccagcccugcugcacucccgcccuccacccggugcaugggccccgacccugccgugggcagugccucaccgcagcacccgcaggucucccucacguaggucaugacgucacacuccugcaaugcacacggcaggcaggguaguccccccggggccccagaagaguuuccacagcaagguccuggccugggggucccgggacauuccagcccacguguggaggcagccaugcggggaggcuggcggguccugucccuaccaaccucgcugccacccuccuccccccaccaaccuugcccugugaccuuccccaaccaagcuugcucucugaccuugcccucugaccuccuccacugaucuugcucucugaccgugccagcugaccuucccccaccccugcugcucuuggugucuaguuuuggcaggagaaggacacugguucugccccaugugacaccuaccgugagaccggggucuccaggggggccgggcucacccuggggaaggaaggaugaggcugagacucuggggccaaggcuggguggcugagucucucccaggccacugcccacugauacguggguccaccgugggcagaaccacgaggcuuggguguguguuggccuggcagguuggggggagggcauggggacuggccaccaaccuaccucggguccugggacuccucuuggcccccgagggccuggcucaccagggggaccaggauccgccugagaaggaacaagaacaggugggcuucaguggccccagggacagucccugcacacagcagggcccccugugcuguccccaaccacggguccucccuuggcgggggggggggcuaacaggugcaaggaguaagacaaggcugugccuccuccuucccuaugcuggcaccagagcuagaaaggccaugaguggccaccgucagagccuggcccaccagagggguaggggccuggcagagcugggugucccagaaauagcagccaaaacagcucauuccaauccauggguauuccaccccauuaucauguacccaccaacuccacgcccacccauccacccauucgcccauucgcccaaucacccauccaucuauccacccagccacccacuaacccauccauccauccacccagucacccauccaucauccauccacccagccacccacuaacccauccauucauccacccauccucuguccacccacccaucuaucuauccacucacuuacccaucuauccauccacccacccacucaccuguccguccauccucuacccacccacccauucauccaucgguccauccguucacucauccauccacccacuguccgucuguccauccacucauucaccuaaccauccauccacccaccuacccauccccccacucacucacauacccaucuauccacucauccacccaucaccuacccaaccauccauccucuauccacccacccauccaucuauccacugacucacccauccauccaucugccaacccacuaacucauucauccauccauccuuuaugcacccauccauucauccacccacccacuaacccauccauacauacacccacucacccauccauccccccacucauccauucagccauccaucaucuaaccacacacucgcccacccacccauccaucuacccaccuacccaccuacucacccauacaucuacucauucacccauguauccacuuauccauccacccacccacucauccagcaauccauccauucauccaucuucuauccacccacucuucuauucacucauccauccaucacccauccucccauccauccauuugcccacccccauccacuugcccauccauccaucguuauccaucccuuguuuugugcucaguuccagaccaaccugcagcccugguuaaacccuuggccaggcuagggauuuggaggcacagagcaccuucugggggauaacuguggggaggacauuggggagggaacccuuggggaaugcuguguguaggaacucugagggggaugcuauguggaggcaucuuuugggggaggggacucuggaggggaugcuauguuggggucgcuggggaggggacccuggugggggaugcuguaguggggaugcugggaggggacucuggggggauguuguggaggggucacuagggaggggacccuugugggggaugcugugggggggauguuggggggucacuggggaggggacgcuggaagggaggcuggguugagggagggggccccugagccagccguucccuuuaggaagguggggguggugcucauggcuggggccaagcugccuggcguucuccuguacucauagaugcacacgcucagccucagggccccucccugccucugcccagcugcugugggcuucgggacggugacacucacaggcucuccuuucucuccuuuccucccagguucuccuuucaagccaaagucgccucggccucccugugacagggaacacauguuagccugggacagaggagcugucucuaccagggacaccagugagauuuuuauguggaaaaaucgaucuggcauuuugggguccuuuaaacgggagcaucuaugugguuuuuuugcaaagccugaacuuugguugaaaagggaccagccaguggcugacagcucccccagagcucagcauaggugacauggcugggccuuggggagccaggaccaucucaagacaggggugguccugucagugacggugggcauuguguucccagcaauugggcgugcagacccccacccugggugggcacagguggccaggacccacacauaccucggggccgcgugggccgggcucgccuuuuucucccugugaagcaaacagaagccagggugacucagccucagaucccagugcuccuuccucccucugggcagcuuucugcagccccguuucccucccucgcucauucacacucugggugaggccacugugcugcguucugagcugugcucuuuuccugaugcugggcuggaccuauccuucacugagucacccgaagccuucucaccacucugucccgcaggagggaccucacacuuucuucugcacagaggaggccuugagggaacuacuaggaaucuucagggcccuugggacaauguccacccacuccugggagcugccaucccaggcugugacucacgggugcuccucgggguccuggguagcugaauccaggccugccggggucucccuggaggaggacguugagucggucagcauggucauaggacgggguggggcuggggggcugugcucaacagggcgcaaggugcacacugggguggaagugggcuaggggugccgucgaguucuggcugugagcagaggccuggcagggccaaccucgcccuguccaccuccagugggggcuggacgugccuagagacccgaagccugcccacacgcggggaggacccuacucaggccacguagcugcccucaggcccugccucaggaaggaugugccaugcacacccaagggucacugcugaagaggagagccaggggggcuuccuggaccccggaggcauccccucacuccagagcugagaacaggaggcacaggcccguccugaggcacgucugccggcaacagggucccccaggccggcccccuguccugcuccucaggcagcugccccgaaccccuaauacguccugcugggggaggggcacguaccuuggggccuggcuguccugagucuccacgggguccugcaucaccggggucuccccgagaucccugagggcaggagagaaauucagaagucagcacaggcagggacuggccaugcccaggggucaccugacaugccccguccagcccugaccaccaggccacauggccgcagcuccuccugcugccugugggggccguggaccucugucuugagggucccagcuccuccuuucccuguggcccauccaggaccucaggcccacugccuugccccugacuccacaaccuggguccuucagggcaggauggggggcuggggcugaggguggguaugagguacucggggucuaggggagcagguccuggcuucugaggccaggcucugcugccuggguuugcuauggggacaguggcuagcuccaggcuguccccacauggauaggggagacccacccguggggucagagggcaccggccuccugcacugacacugaccugcuuuccgggcuccccaagagcucccugggggccucuggguccaggcaagccucggucucccuggaagaaaggggaggaauuugggguucucuugacugacagcagcacccuggaguccccaguaucaauccuguggacacugcagggccucggggguaagacgggucuggccccggccccuaugacccuccccggaggcuguggcuccacuugaccuucagcccugagcacacugaguggaguaggcuggguucuggguguagccccugccuaagcaccccuaucuuggguugcagcccucaccuggguccccuacuuuggggugcagcccuugccuuggucccuuaccuuggggugcagcacccgccuggguccccuaccuugagguauagcccucaccugggccccccuuaccuuggggugcagcacccacccggguccccuaccuuggggugcagucccggccacccuaccuuggggugcagccccccugcacccccucagauccccuaccuuggggugcggcccacccugcuccccuaccuuggcuccuuuguugccaaccucuccagccaggccgcggggccccucagggccagggucccccugugggaagggaagggaggccccacgggucucagcugaggccuccggccugggucccaugugagaggcggguguggccggggguuggggaagggggccugggaggaagaaccccgucugucccgggggaccugcaacagucgccuguuucacccauagcuccuucccggugccuguagcugccgcucugagcacggugucucucggucccccugaggccacccacacguggguaggaccucguccacuuccugggaggaagccccuucaccugaugucaaggggagcugguggccgggguuuuaccacacagcccuucagcaucaccccugaggucacgugggugagcaaugccucagugggcuggggguaagaggugccucagugggggccggggggugugaguggugccucagugggccgggggugaauggugccugcacagcugugcggggugugccuggguggguaguggagcuuccucagcagagaaugggguguggggaucucagggcugcauucccagacucugcagagagugaacucuggagagugaggcccugggguucuguuguucucugggaggaaugggguuggggcccucgucagcagggcccaugggcaccacagugagacccugggcugccuccacacgaggacucaccuucucccccuuggggccaucgcugccugggcugcccuuggugccggggucuccccugcgccccugcagagaacaggcgugugggugagggagggggcugaguccaagcccagagccuguggagggugggggcugugccggggccgaugcuccuucucuacaggagggcucuggcuuugggaccugggaccucgauccccaggcuccuucccaacagccucagccugcgccaguggcucugcugccagcccucgucccucugcugcgucggucccgcccaugccgaggauuuaggaaugaucuggggaggcuccagguggaguuggaugucuggugaguggcguuuuaggugaugggcuggggccugguggggaccuggugcuguccagucacugcggucacucccaggcaggccccaugcucagacagaguccccuuggaguggucagcacugggacgggcccugcucagcccucacaggaugcccugggcagcuggugcuggguuuagggaacaccauggaggaccugccugggcuuuaccucuaaguccagcucuggggggucccguggggugguccggguccacuucuugggaggaugggggccuggcugugccuugccagcaggggauccugccuacagcccaggugcccuucccccaugguccuccucaagcugcaaggaggaugcccagagcggggcccugaggcaggggcaggagggacucaccggcucgccuuuggguccgcggggcccaggcccgcccuuggcuccuuucacaccaggacuuccuggggcuccacuguugccuugauaccccugaagaaggagaggacagcacagucacccagaggcaggggcccugaggcauggucacgccugugcggugugugguguggagccccuauuaucuuccagcggaaucugcuugccaggcacaugggggcccugcaggguccccuggaacuuguucagccucgugaggagggcacaggucagaggggcugguggcucagggcacauggccuguucuuccugucccuccccguguccccagagcccaaugcggcaccauggugacagcagagaugguggccagcgugacuguucaucugggccaugggcgugaguguggccagcucagcugcaggcgaagaggcagaggggcucaccuugcuucccuuggccccgauuucucccgggggcccucugcguccugggcggccagggucccccuggaaggguuugcagaaucagccucacgucuuuuggcaggggaaggggggugcaggaugcccgcugcgggggcaggacccacggucgggcuugggacugcaccucccugauguccacggggcaccugggaugccagaugcuggcugggggcugcuggaaccuccgugccagcugagggcagagugugugucacgggcaggacgccugugcaucugcucagaggacucagccagacuugggcuugggcugagggaagguggacagaaagugggaagcccuaaguccaagcucccagaaaaaagcccuuggggauccuggggccgccaggggcggggcgacacugcaggcggcccaggagggcagagccccuggggcaccaacguucccauggggagcuccaggagguguggguggggcucccuggggcuccaccugggaggagguggguuuguugccgaggccucggugagcagcggcggggccgcccaagcccugguuagaagcugaugaagcaacgggcagggcacccuccaccacaucccacggccauuggcuccucacugaccaguguuuccagaaaggcccucucugcucagcuucucagcuggggcugccuccaggaggccccuggaagcuggugaccccgccugccccguacccugacaaggccacuuaccuugccgccuuggucuccucgcuccccuggacucccugcuucccccggguaaccgucggggcccugagagaggagugagagguggagcucggcacacggcgggugggguucuccccaugagccagggcccaagugcuccauugucccagcccgggacgcaccucccacccucacugugaggcccaggcucagugaccaagaggccaggccuggaucugcugcucagggaaauggagcuguccagugacaccgaaguuugggaugcaucaggucuccaggccacggggauccgccaggagcucccagggggaguuccucacaugacuccgacccggcagaaugcugggcuggggcugcugggcuggggcugcugggcugccgggagaacccacgcucccacugcagcagcaacuacccucccacccggucaggcacccacacccccugggccgaggcugaaggaggggugcaaacggcccuuacccgguuuccagggucucccuugcagccaggagguccgaugcgccccagcuugcccugaaggagaagggggcaggaggagucucagggcgggguucugggguccaugugugccaacgaccaagacacagcccacccgguucugccccgcagggcugcagcgcucuccuccuggcacacgggugcccacaugaggccacggcugcuguggagcugucuccggggaggcagaguggccguugugcaggaacaggccaucccuggcugccucccagaggcccugagggcagagcucccugggcacagaggauguucccacggggagccauggaaggaguggguggggcuguccugugguuugaccugggaguggguaggcuuguugcuggccucugugugcagcuguggagcugccccaagccgggaugugcagccaugaauuagaugcaggcuggugaagcccuggguggggcagugggauguggcaggagcugaaguucguguguguguguguguguguguguguguguaugcguguguacacauguguaagcugacagaucaggcuggaucugggggcccugcagaggcugggaugccucugugagaccaguccagcugugagcccgaggcucccucuaccuucuguccaucggucccguucuugccagccaggccaggggcccccugaagagagaaggaagagggaacuccauuagccccgguccuucugcccugagcagcaggaaggaggggcucugccuacccagccagccuaccuugcgaccgucggcuccaaauucacccuguguaggaggaaagccggcgcagugagcucggugccucaaagcaucaugggcacugcugccucuggggggcaaagcccuugggccaaacucaaggccacaggaccccccaggagcccccaaagccaccacugagaaaagaccaggccggugccccaggagcagugacaggcugcggcggacgccaagaggugggucugggccgaggcuggcgcaggucugaggucugucagggcaagagccucaccuucucuccuuugaagccaggaacgcccugggggcaggaggagagaggggcauuagugaggagcucugcagagacacaggcagggaagggccagcccugcaggcugaggggagugcucggugggccgcuggcaucuaguguucucgacaaacagucugcggaggaggcugagcccugggucgggcuggaggcuggguuuugggacggccaucaaguuaucgaggugcuucuguuccuugguaacuggggggagggucguagaggcugaggccgaggcugggcuggggggagccugccuggcagugcuggggccucaggguggagccaagccccuggccgaggucacucaccuuggguccugggaauccaauggggccuucgaugcccgggucucccugugaaggacaacgcagcagugugagcccagcccuggggcgcugggcugcaggcggggcgggcguggggcaaggacacucaccugucuucccuucuggccaggcucucccggcucacccauguugcccuuggcacccuaaaagcagagaaaagaguacaucgaggcaggguagggugggcgguaggcagcuggggacccugccacagcuccucugagaggugacacagcagagguuacugauuccccugcccaaguggagaagucuuggugucagcugcuccccaaagggccagccucugucagacaaggguuugcuuugacccauuucucccagcucugagggaagcuucccacaaagccaccugcaaaauggagccagaagagaccccuggggugggggugccuggcccgugggggucccuucugcacccaguagcugugacuguggccaacacugggcucugauucuccagcgaugccugggucaccgucacuacaaagauuaauuccuuuaucuaaguaacuuuagacagaucaggacuucagaacaccacauaaagguuacacucucuuggaauuaaaauuuuaaccuaugauacagaacuuuauuaaauaaauucaucuauuuauugauaugcucccaauuuaagugcaaagaggagcagaggaaaggggaagaauuaagaggucaaaaggaagaaaagggaggaaacucagggcaggggaugaggugggcagaggcuucuggaacaucacagcugugcccuguccugggcuccgcuuggcaccuugccaccccucaaacucuaaccacagugaucccuguggcagcuuccaguggcccccccaacagaacgggucacugcacugcugugugcagccaaggcugccccaaguggcaaauucauucccagcuguaguagggucggcauugccaccaggacuggagaagccagggagggagauggcaggauuugaccugcagccucgagaugucucauccuggagaaaguacauccagauaccuacuggucuagacagcuguuauccaaauuuagaaaaacacgaagcuacguagcaguaacauccucuaugauggucaauuccuuauuucaucuccuuagaagcuacuuucuccuccuaugcuuuucuuuauaauuuuuaacagaugugaauuguuggaguuucacauacucuguuagugaguuuuggaaggacuuuauuugaugcaccucuguuaggaaaaugcaggggauguucaaaccagaaaaugcaggggacauucaaaccaggcucccuaaaacugcuuauuuaguaagccacaaaagagguuccuucauauuaaugagcaaucauauuauuaaguguagugcaucucacauuuuacuuacuugaauaugcuugcuuaccaaaguauuuuaauggcauaucucauuuuuuacaagcuucugcuuuucucaauauacuauuuaaaaggaauuagacauauagaguuuuaguuucuccagggacagaaguguugagacaauuugagauacagcuggccuuaaauguggcuuucuuuucuuuuuuuuuuuuuuuugagacagagucuuacucuguugcccaggcuggagugcaguggcgugaucucugcucacugcaaccuccgcuucccagguucaagcgauucuccugccucagccucccgaguagcugggacuacaggcgcaugccacuacgcccggcuaauuuuuguauuuuuaguagagacaggguuucaccauguuagccaggauggucucgaucuccugacguugugauccgcccgccucggccucccaaagugcugggauuacagguaugagccaccacgcccggccaaguguggauuucaaaacaaaucaggggcuuccugguagcgcagacccugcagguaaucugggcaucuuaccuucuguccacgguagcccuuggggccagagggcccagggauuuccaggcagcucaccuuguagcacugaaacgaggaagcagagacagaagguugcaugggugggacauuccucagguggcagggcagggucucagaacguguagcccacgacucucagcaggggccaaggagaugcugaaaugcccugagaaccugggcgggcgugagggagcugugagacauggggugcugugaggcucugcccccaucagggacaagccaaagaguuuggcucucggucagguguucuaggcaaguuuaaaaaaccaagccuggcuuaagccaugacagaaaauagaagggaagaaaggccgggugcagcucacgccuggaaucccaacauuuugguaggccgaggcagggaggacugcuugaggccaggaguuagagaccaggcugggcaacauagugagaucccaucucuacaaaaaaacaauacgaaagcgauccucccaccucagccucccaaguagcuggaacuacaugcgcacaccagguaugguggcaggugccuguagucccagcuacuugggaggcugaggugggaggauggcuugagccucagaguucaaggcugcagugagccgugaucguaccacugcacuccagccuaggugacagagaaagacccugucucuaaaaaaacaaauauaaaagaauaaauuuuacaaaaggauggaagagcaaggggcacuggugagggaggcaccauuuguacacggcaaugaaaccacuguuacugagcagcgauucugaggcagggcacguuuuugcaggaagccucacgggggagaucucagaugccugcuccccuuccugagagcuggagcugggacacacagggagguggggaugucauggaccccgaugaugucaguuccuucuccccugaccugcugggcugggcucgggccucgaguccaggguggauggaucccaccugcccggaggccagacccucgaccucuccuuguaacacgugcucugugggugacccuaacgcugacccucacgggaucuaaacagccuagcuuuggcugggagcccuuucuccagacuccaaggccucagguccaacauggagcaggugacucccucuccucucaucuguuccagccuggaggcgccaggagucggcagccuggcgcggucaucucugcugggucagcugccggccagcacuggcaggaagggaagcgccacucaccucuccguaggcuucguguuucugcagaaaagacagacaugcugguuagccgugugccucgagaccuggggcggcugcaccucgagucuggguggggauggagggacaccugaguggcccaggcccugcccggagcuuccuccuucggccuccgcacucacagagggguaaagugaggcccggaguggguggacggcccaccguggccaccccuggcgcguggacggugcucccgcccgcggcucaccaugaccuugaugaugcgguugaugguguccuggucgaucucgguggagucgggcagcaugguggcguagucguugcgguagagcucgugcggcgugcuggcgaugucccgcaggcccugcuccuucagguucugguugggggccacggcgaagagccggaugcccuccucgcgggcccgcucggccugcagcuugaugcccccgcaggggcugccggugacguggccgucggugaugaccacggcgaaguggacggugcccuugcugcgguccugccggaucugcuccgucauguuggccagcgcgcagucggugaaggugccgcggcggaaggagcugaugcccugcagguucuugaugaaggaggcccggucgcugcccggugggcugaacaccuccaccuggucagagaagugcaggccgccguagcgccagcucagcgccaccugguccagguagaacucguucugcagcuggcugaugaacugcggcacgaacugcuucauguggaagagcaggauguccgugggggacugcauggugacgcucuccgagguguccagcacgaaguacacguggauggggcagucggucuucucuguggggcacaggaccugucacgagccagccucaggagggacugcuguuggagccccguuuccuggccccgugccuguuuguggguuugaccucacugcccccgaaugccagagcccccggcccccaaccccuggcaccuggguacuggucccaacugccccccaaaugcccagagcccccggcccccgaccccuggcaccuggguacuggucccaacugccccccaaaugcccagagcccccggcccccgaccccuggcaccuggguacuggucccaacugccccccaaaugcccagagcccccggcccccgaccccuggcaccuggguacuggucccaacugccccccaaaugcccagagcccccggcccccgaccccuggcaccugggcaguuguuguuucucucgguaguguccggcgagaugaccuccugcugcugggccuggauggcccccaggauuccccagagcaggagcacggagcaggugcccuggagcaucuuggcagcaccuguggcccugaaguccugcaacaggggugggggucgcucagacacccccagugccucuccccuggcacccucccccauggcaggcgcacgcacagcaggucagcgggauugggggcacugcccucagucuucaaggaagcggggucugcgcccagcacacaccgucaccagcaucuggacuggggggcuugcgcccucuugccccacccuggguggggucacagauguuuagugggugccucugggcucaguuuugggugggauuuggaugguugaggcccuuccauguccuccagggcuggguggaguggguagcugggcgcgucggcauggaagggaauggagcaccacugucuggcgccccccacugccuggggcugcccuggaaacagugcagaggggagggcgggagagagaucccagcuuccccagaccggcuccccugcagagcuaggcacucucucuccagccuggcuccauucccuuuaaacaggacuuugauaaggagggagggaggacucugucaaguguagggacacagccgucauuagccuggcuuuccuuucuguugggugccaggacccuggggcaaacagauccagcccuugaacguccauccucccugaugcccuguggcuuggccuaagcuccagcuccaggaggccaucaggacgggccucacugugcugcuggcuccgcagaguggggcuggcagcagccgggcagcugggcagaaagggcaccgggccugguucagagcgugcaguuccagggguaaugcagggauuggagugccgcccucuccucggugcagaugggaggaguguccaagcaccgggacuaggggaggcgcugccaggagagggcccugaaggguugcugugauuuugcggcgucuggaguggaugaggugacccaggccagaccugcucagccuggggcccagggaggaaugaaguccguucccaaaggugccagcucaggcaguuugugggugaguuucacagcuucaaggacaagcacuucaugcuauuuaacuuguuuuagaacauaaaaagauaaacuuuuucccaauucauuuuuaaauguugcauaaccugugaccaaagcuugauaaaaaaaaaagucccuaaaaguaacucuacagauaaauaucacuauaaauauuacugauggcagcggcagcccaucugguguggccgcugccaucacacuggcugcucagggagggcccauggaagaggcagacaggcccccaaccccgcagacugccucccugggggccgcugccauggggccgggccggguggugugcugggugaaggggagcucacggcgguguugccccugucugggaugcuggcccaggucuggagacccugccccaggcugcgagaggacauggccagguaccaugcuccacggagccagcaggagccggggauaagugggaucccugccccuugcaguuuggcgaggugagaguuccccagguacaacugcccaagucguggcuguggaucugggccuucugcuccauggaggaggcaggagccagcccccacuccuggugcaguuucagcugccccaacuggggcugcugacccaggcaucgcugcacucuuggggagccagggaaggccccucuuucccuuguaggccuggaggugccuguucccgcugcccagcuucuucccgcucccaccacccacuccaaucucagagcagaguuggggcugagccugggcacugucacagccuggccgggugggugcaugcuuguggcagugcugacaugccagcccccugcugacuuggcccccuccaaacugugggcacugagaagugcaggaggggaggcuugggggggugcugaggguggcugggcaccggugccccuugguaccagcagccugggcaccauggauggcugcaggaggcagauaggcuccugggcagaagaggauggguccccagugaagccccaccuucaggcuggggcaggccugaagccugggggccggguugcccguccuacggaccagaggggaacucaaggugcuuucuucugggccugcacauggcugcacauggaccaaucagcaugcacuuccccucucugaggccuuuaaaagccccaggcucagucagagcagggcagagcauggcacgaccagcugcagagaggaggugcucucucugcugagagcuucaggaccugaagggaugucaggacgaccagcugcagagaggagcuacccucuccagggcuuucucucugcugagagcugaacacuaguugagaugcccuguuugcagagaggagacacgcucucgagggccuccucucugcuaagagcugcagagacaaugggaugaccugccugcagagaggagccacccacuccagggccuucucucugcugagagcugaacauuugacaagacaacccgccgacaagacaacccgccuacagagaggggcugcccccugcgggucuccugugagcuccccuaacacucaauaaagcuucucugucuugcacacccuccacuugucuguguaccucauucuuccuggacacaggacaagaacuugggcaaaggcgccacuggccauagagguuucaggccagaaaagugacacccuaaaaaucccauaacauuaucacaaaaauucuagccaauauuaaaaacuaaaauccaauagcauauuaaggaccacuauaccagaacuauaauaugaaguuaaaguacaguguugccacaaacacuagggaauacauuaauguaagucacauuaacauaaaaugggaaaaaauaugcaauugcuucaauagaucccugaaacaucaauuucuaacuaagaaacaacaacagccagacaagguaaaaccuaguaagaaauuuaggaguagaauuaacucuauaaaggauauacauuucaaaucaagagcucacaucauauuuuacacaaaaagcuaaaauagugguucuuaucuuuguggucauggacccuuuuaagagucuacacaauuucaccuuacacaaaugcauagaugcucauauacagaaaucauguccaggaauucagggauuccauucguagaucuaacccuggguuaaaaaauccugcauuagaagaaugcuuacuacaguacaaaaaaaauggggugggggcaaacagugcagaucuuacgcuaccauucaguguuguguuggaagccaaugcaauaagacaguaaaaauaaaaguauaacuguuggaaaagaagagacaaaacuguccuuauuaaagauaggauugucuacccagaaaaucaucugaacaaaguuuuuuuaaaaaagagaaaaaaaaauauauauauauauagacagagagaaagagagaaagaaagagaaaggaggggagauuagggagagaaaauuuagugagccacuuagaaaaauauaucauugaugaaaagagucaaacucuguaaaauauuuuaagagauuuauucugagccaaauaugaguggccaugacccaugacacagcccuuaggagguccugagaacauguacccaagguggcuggggugcagcucgguuuuauucauuuuagggaggcaugagacaucaaucaaauacauuuaagaaauacauugguuuaauccagaaaggcaggaaaauucaaagcggggagagauggcuuccaggcuacagguaaauuuaaacauuuucugguugacaauugguugaguuugucuaaagaccugggaucauagaaaggaaaugcucagguuaagauaaaagacuguggagaccaagguucuucugaagucucauaguggcugcccuuagagacaaucaaugacaaguguuuccuacugagaccuuuaaaagcugcuagacucucgguuaaucucuucagaauugggagggccuggaagaaaaagagcuagcuauguuaacagagauuccuuacagaugcaaauuuuccccaguaaaggacagcuuugcagggccauuucaaaauguggcaaagaaacauguuuugggguaaaauauuuuuauuuucuucuuggucguguagugucaugccagagucagauggaaaguaagucacagcauauaggguuagauaaaaccaucugaugagaauuuaugguuuguagggcaugacuccccagaccccuuagauaagaauauaggcaagauaaaaaaaucagagcuuaguccucaacauacaaaaaguuauugauuuucuucuaucaguuagaagaaacauuuucuaacaaccaguuagaaaauguugcagaaaaaugcuauuuacacuaguaagaaaaacaacauaaacccaaggaaucaacugaauaaaaaugugcaggacuuaugaaaaaaacucaaaaaaauuuuugagaaauauauuggaaagacaaaccuuguuuuuggauaagaaaucaucccacuaucuuaaacugauuuaaaaauaucaguuauuccuaacugaaucuauaauagaaugcaauuuuaauuaaaguuuccaagaaaauuuuuugcauuuuuguagauaggaguuugcaaaaugaauccaaguuuuacuugguagaaaaagcaagaagaguugagcaaaauaaaaaauagagugaugagaaagcuugugcuaucaaaugaaacgauaaaauuacaguuuugguuuuggugcuggaacaggccaacacuccacacaaccaugggcauaacaacacacgagaacuuaggcuaugacaugguggccuuucagagugguggaagcaggcugggaugagggcucacccugugacuagaaauaaagguacuaccucacauggugcucccaaauaaacuccaggaaaaggaaguaucugagugcaaaacaggaaccaaaaagucuuugaagaaaacagaauguauaaaaugucaaugaaaaaucuauaauaauuguguaccagauacuguccuauaucccuucauucaacauucacaauuggacuuauggccuuggacauagguacuauuaccauccccacuccaacagaugaggaaaccaaggcccagugagguaacuugcccagggcacucagcuaauagcugaggucugaagccuggcagugugggcucaagucugcccucuugacacugagcucccacauaugaccaucauuacaacaaaagcaauaugagcagacuggaagcagacugagagccagcaacaaucuucccaguguaagauauaaauauuuugauggacuguuauuaggugcauaaauauuuauaauuauuauaucuugcuguauugagccuuuuauuaauauaugauguccuucuuucccucuuguaaccuuuuuugauuuaaagccuaucuugucugguauuaguauagccacucuugcucucuuuugguuacuauuuguguggcaugucauugcccauccuuucacugucaaucuauuuauguuucuggaucuaaagugcaucucuuguagagagcauauaguuggauuuggcuuucuaaauccauucugccaaucucugucuuuuaacagagagaguuuggagaguuuaauccauuuacaucuaaaguaauuacugauaaagagggacuucuuucauuuugcauuuuuuuucuguauaccuuauggauuuuuuuguccuuaauuuccaguaucacugucuuguguuuaauuaauuuuuuugauggugaaacauuuaaaucccuuccucauucccuuuuguauuuauucuuuaguuauuuucuuuguuguuaccauggggauugcauuuuaacauccuaaaauuauaacagucuacacugaauuuauaccaguuuagcuucaauggcauaaacaaaacucugcucccugaauggcucuguccccaacccuuuuaguuauugaugucacaaaauuacaccuuuauauauuauguguccaaaagcauaauguuauuuuuaaaucagucucuuaaauuauguagaaaacaaaaagcagcauuacacaccauuguuacagcaauauuagcuuuuauaauugucuauauauuuaccuuuacugagauauuuauuuauuuauuuauuuugagauaaggucuugcucuguugcccaggcuggagugcagugguguggugacagcucacugcagcuucaaccucccaggcccaaaugauucucccaccucagccuccccaguaguugggaccacaggugugcaccaccaugcuuggucgauuuuuaaaaauauuuuuauuuuauagagauagggucucccuauauugcucaggcuggucuugaacuccugggcucaaguuauccuccugccucggccucccaaagugaugggguuacaagcaugagccacuaugccuggcugagaucuuuacuucuucacuugaauuacugucuaucacccuuuauuucaacccgcaggacucccuuuggcguuuccuauagggcaggucuagugguaaggaacauucucagcuuuuguugaucuaagaauguguuaauuucucccuuacuuuuaaaggacaguuuugcuggaugugggcuucuugguagacaguuuuuauucuuuuagcacuuuggauauauuggcccacugccuuguggccuucaaaguuucugaucagaaaucugcuaauaguuuuauugaggauuccuuacaugugaugaaucauucuuucuugcuguuuucaaaaucuuugucuuuggguuuugacaauuugauuagaauguuucagugugggucucuuugaguucauccugcuuggagcuuuuugggcuucuuggaugguuauauucaugucauucaucauauuuuagaaguuuucagccauuauuucuucaaauagucucucugcucccuuugcucucucuucuucuggggcuccuacaauguuuauguugguuugcuugaugguaucccacagaccccuuaggcucugaucaccuuuauucaaucuuuuuauuucugcuccucagacucaauaauuuccauuuuuguaucuucaaguucccugauucuuuauucugccugcugaaaucugccuuugcauuucucuagugaauuuuaaauuucaguuauuguacuuuucagcuccagaauuucccuuugguuucuuuuuaaaauuucuagcuuuuuauugauauuuucauuuguuccuacauuuucuuucacuuucuccacauuuucccuuaguuauuugaguaucuuuaagauaguucuuucaaagccuuugucuaguagaucuaccaccaagucuuuuucagugacaguuucuguuguuuuuuuuuccuuugaaauaggaaaguuucuuuguaugccuugugaaaucaaaaucucuuucuuccccagaguuugcugguuuuucuuguuuuuauaauuuugauuguugcugucucugugcuaaggaucagcauaaaguauaaacuuaaggucuucuuaggucuuuucuaagcccgugacuuccccugagcaugugcaaugacuuuuuuauuuucuccacauauaugguugcuuuugaaugugcuagucuucaaugucuacgucucaaaagaggaaaaagagaaaaaugaagggagaaaagggugccagcccuuuaaaucuccuggaagucacuucaaccagacggagaagggcuugcaaugacgggguuaguugcaacaacaaagucugugucaauagauuuugaaagaucuacaucauacaagauaucuuuucagaccacaaaggaguaaaguuaaaaaucagcaacaaggacauuuaaaaaaucacgaaauuaaacaacacccuguuaaauaaccaaggaucagagaagaaaucacaagggaaauuauaaaauacuuagagaugagugaaaaugaaaacacaaauuuaaaaacuuguucgacagugaaagcagugcuaagggggaaacugauggcuauacaugcuuauauuaaaaaagacaggucucaaauaggagcuuaaccuuacaauguaaggaacuagaaaaagaacaagcuagcagaaagaaggaaaaaauaaagaucagagcaaagauaaacaaaauggagaacagacagauaauagagaaaaucaaugacaacaaaaguugguucuuugaaaagauaacagaauugaccagccuuaagcuagauucuagacuaagaaaaaaagaagaaacucaaauuacuaaaauuauaagugaaaguggcaacauugcuacuaauucuacagaaauaaaaaagauuauaagaguguacuauaagcaacuauaugucaacaauuugaauaacacagauggaauggaaaaauuuccagacagacaaaaccuaucaagacaaaaucaaaucaugaagaaauagaaaaucugaauagacauaacuaguaaggagauugaaucaauacucaaaaaucuccugacaaacaaccucuggaccugauggcugcacuggugaauucuaccaaacacauaaagaacuaacaccaaacccucccaaaauuuucaaaaaacuugaagagaagggaacacuauuuaacucauucuuaugaggccagcauuacucugauaccaauaccagacaaagauauugcaagaaaagaaaacuacaauccagucuuccuuaugaacauugaugcaaaaauccuaaacaaaauacuauuaauaguaaacuaaauuugguauaauuugaugcaauuaaauggaauuuaaugaauugaccaaguaggauuuauuucuggagugcaaggauaguucaacauacaaaaaaaaaaaaaucaaucaauguaauacacauuaacagaaugaaggaggaaaaaaaacucacacaugaucauugcaguugaugcagagaaaccauaugacaaaauucaauacccuuucaugauaaaaacacucaacaaauuaggaauagaaggaaacaaccuuaacauaauaaaagccauauuauacgaaaaagccacagugaacaucauacucaguggugaaagacugaaagcuuuuccucuaaggucagaaauaaaggaaggaugccugcuuucacuacuucuauuuaacacuguacuggaaguucuggccagagcaauugggcaagaaaaagaaauuaaaggcauucaaauuggaaagaaauaaguaaauuaucucugaucacugaugauaugaucuuguauguagaaaacccuaaaaauuccacaaaaacuguuacaacuaauaaacaaauucagcaaaauagcagaauacauaguaaacacauaaaaaucacuuguauuucuauucacuaacaaugaacaauccaaaggaaauuaagaaaacaauucuauuuacuauaguaucaaaaauaauaaaauacuuaaaaauugacuuaggaggugaaagaccuguacaaugagaacuacaaaacauuucugaaagaaauugaagaggacauuuaaaaaaagacauucauguucauagauuggaagacuuacuauauuaagaugucaauaccacccaaauugaucuagagguuuaauguaaucccuauaaaaaucccagugauuguuuuuuuuuucagaaauagugaauaaauccuaaaauuuagauggaaucucaagggaccucgaauagccaaaaaaaaaaaaaaaaaaaaaaaaaaaaucgugaaagauaagaacaaagcugggggacucacauguccuaauuucaaaacuuacuacaaagcugcagucaucaacaguguggcacuggcauaaagacagacauacagaccaacagaauaaaacagagaguccagaaagaaacccuugcauauaugacuuucaaucaagccgucaagaccauucgauaaagacagucuuuucaacaaacggugcagagacaacuagauauccacaugcaaaagaaugaaguuagacccuuaccuaauaccauauacaaaaauuaacucaaaauggaucuuuacguuuuaagaccuaaaacuuuaaaacccuuagaagaaaacauaagguaacaccuucgugacaugggacugagcaaugauuucuuggguaugacaauaagaaaaaauagauaaaucagauuacaccaaaauuuaaaaacauuuuuugcaucuaucuagugaaaggacaucauuaacagaguaaaaagaacccagagaaugagagaaaauaucuguaaacuguguaucuaauaagggauuaauauccagaauauacagagaacuccuaaaauucaacaacaaaaaacaaucaacuugauucaaaaauaggucaaggacuuaaacagauauuucucccaagagauauauaaauggccaacaagcacaugaaaagaugcucaacgucacuaaucaugagggaaaugcaagucaaaaccacagugagauaccaccucacacccauuaggaugguuaacauuuaaaaaaaaccaagcgaacccggaaaaugacaccuguuggugcagauguggagaaacuggacccuugugcacuguuggcaggaaagcaaaauggugcagccaccgugggaaacagugaggcaauuaauucucaaaaaaaugaaaaaaucaaaugauccacauuuccacuucugggaacauacucaaaagaagugaaagugggaucuccaagagguaucugugugguguguucauggccacaucauucacaguagcucaaacguggaagcaacacaaguguccagcaacagacgaauggguaaacaaaaugcagggcaugcaugcaguggaauacugcucagccuuacaaaggaagggaaugcugacauacguuacaguguggaucaaucuggaggacauuaagccacgugaaauaagccagucacaaaaggagacauuucauacgauuucacucauaugagucaccuaaauggccaaauuccuggaaacauaaaguaggaugguggcugccaggggagggaaggggugaugcgaguuggugcuccaugggcuucaguuugacaagaggaaaagaguuccggagauggaccuuggugauggcuacacaacacuaugaauguacuuacugucgcugaacuagcugcacacuuaaaaaugguuaagacaguacauuuuauauuguauaccacaauaaaaaauucgggaaaauaaagcuuuuucaaaucaauaaaaaaagaaaaaaccccccaaacaccccaaacaaacaaacaaacaaacacauccauggccugggcaacauagugagaccccgucucuuaaaagaaaauuagcugggcacaguggugcaugccuguaguccccgcuacucggaggcugagguggaggcucgcuugagccagggaugugcagauugcagugagcagugauagcaccaccacacuccagccugggugacagagcaagacccugucucaaaaaacaaacaaacaaacaaaaaaccaaaaaaacccaaaaagcgaacauccauuaggaacauggggacaucacaaccaggcaaugcacaucacuacacacggucagugaucaaacagcccaaauagccuuguacugcacaaaaaccaaagacaugcagaacaaaccccccaacaaggcaucauuccuuaucuaugaaaugagaaaaaaaaaaaaaaaaaaaaaaagacagugcugcuauccauuguggagacagguuccccgccacuucugggaugggcaucugacguuucugaccucuggacccagaugccgcccuucuaagagcaggcgcccugugagcugggauucccaccaccccugcccauuacagccuccacugcaggccaggaagggccgcugggcggggcuggguguuuggauccugggcggaccugggcagccccgucccagccagugccccgcgggcuggguagggccccuuccaugagcagcaccaggaccccugcuuguggcgggugagccccgcaucaggcgcccgacuuugcauaaacgugaaauaggccacaggaggcagcaacucaacgugcagggccguguuuaagagaaagcaucucaccgggccuuucuuuccuuuuuuuuuuuuuuuuuuuuuuuuuuugagacagucucgcucccucacccaggcuggagugcaguggcgcgaucucagcucacugcagccuccgccucccagguucaagugauuuucuccugccucagccucccgauuagcugggauuacaggugccugccaccacgcccggcuaauuuuuuuuuguauuuuuaguagagacgggguuucacccuguuggccaggcuggucucgaacuccugaccucaggugaucugcccgccucggccuccccaaguguugggauuacaggcgugagccaccgugcccggucuggccuuucuugaaauaaucaccagagucgaagugcaagggggccuccaagccagagcuguguuaucccaagaacaaggagcuccgcggaucgcaggccccuccuuucuggguuccgaccccaaagggaaggucccuucuccaggggcguccuaggcgcgggcaccgggguucugcuggcacagcccggaugggcgccgcucgcccgcacaccugcggcuccacagagggccgauccguucgguugccagcaguggagacccaggcccagcgguuccaccagcgccccggcggagucccagggcgggugugggcggcccggcaggggcugcgggucgcugucagcccgggucccgccgcccuggggagccgccuccgucugcagcuucuccugggccuggcggggcccuggugggcuccaggccgggaggggcgcagcgauggggcgucggggccacccgcguccccuccccgcccagucccgcccucgggcaccgaaagccccuccuccccccgccccgccgccccuuccguccggcccggggagaggcccugcgcccccggaggucccagccagccggggcgucuuccccgcgggccggagccggacccgaaccgcucgcagacgcggggccuggcggggcgugcggugccggggucgucucgggagcgggggucccagcaccgagcucgggcgcagacagggacccccccaccccgcccaggccggcuccgccccagaggaggccgcggggagguggccccaagucgcgcgcccgagggucggacccagagacgcggagccacaggggcaggcgcggccccagccccgcgaggaggagccccgaacccgccgagccccccgccgucccuggggcuggagucccccuucccggggacccgagggacggagccgccgccgccgccuucccaggacucggggucaccccccgcgggccgagcggcuuccagggugcgggguccgggaggcgcucaccuggucccgaggaggcuccgcucccgacggcccgaggcgcgggcgccgaguaagc

SEQ ID NO: 192155 - RNA, 34731 nt, Homo sapiens
gcuuacucggcgcccgcgccucgggccgucgggagcggagccuccucgggaccaggugagcgccucccggaccccgcacccuggaagccgcucggcccgcggggggugaccccgaguccugggaaggcggcggcggcggcuccgucccucggguccccgggaagggggacuccagccccagggacggcggggggcucggcggguucggggcuccuccucgcggggcuggggccgcgccugccccuguggcuccgcgucucuggguccgacccucgggcgcgcgacuuggggccaccuccccgcggccuccucuggggcggagccggccugggcggggugggggggucccugucugcgcccgagcucggugcugggacccccgcucccgagacgaccccggcaccgcacgccccgccaggccccgcgucugcgagcgguucggguccggcuccggcccgcggggaagacgccccggcuggcugggaccuccgggggcgcagggccucuccccgggccggacggaaggggcggcggggcggggggaggaggggcuuucggugcccgagggcgggacugggcggggaggggacgcggguggccccgacgccccaucgcugcgccccucccggccuggagcccaccagggccccgccaggcccaggagaagcugcagacggaggcggcuccccagggcggcgggacccgggcugacagcgacccgcagccccugccgggccgcccacacccgcccugggacuccgccggggcgcugguggaaccgcugggccugggucuccacugcuggcaaccgaacggaucggcccucuguggagccgcaggugugcgggcgagcggcgcccauccgggcugugccagcagaaccccggugcccgcgccuaggacgccccuggagaagggaccuucccuuuggggucggaacccagaaaggaggggccugcgauccgcggagcuccuuguucuugggauaacacagcucuggcuuggaggcccccuugcacuucgacucuggugauuauuucaagaaaggccagaccgggcacgguggcucacgccuguaaucccaacacuuggggaggccgaggcgggcagaucaccugaggucaggaguucgagaccagccuggccaacagggugaaaccccgucucuacuaaaaauacaaaaaaaaauuagccgggcgugguggcaggcaccuguaaucccagcuaaucgggaggcugaggcaggagaaaaucacuugaaccugggaggcggaggcugcagugagcugagaucgcgccacugcacuccagccugggugagggagcgagacugucucaaaaaaaaaaaaaaaaaaaaaaaaaaaggaaagaaaggcccggugagaugcuuucucuuaaacacggcccugcacguugaguugcugccuccuguggccuauuucacguuuaugcaaagucgggcgccugaugcggggcucacccgccacaagcagggguccuggugcugcucauggaaggggcccuacccagcccgcggggcacuggcugggacggggcugcccagguccgcccaggauccaaacacccagccccgcccagcggcccuuccuggccugcaguggaggcuguaaugggcagggguggugggaaucccagcucacagggcgccugcucuuagaagggcggcaucuggguccagaggucagaaacgucagaugcccaucccagaaguggcggggaaccugucuccacaauggauagcagcacugucuuuuuuuuuuuuuuuuuuuuuuucucauuucauagauaaggaaugaugccuuguugggggguuuguucugcaugucuuugguuuuugugcaguacaaggcuauuugggcuguuugaucacugaccguguguagugaugugcauugccugguugugauguccccauguuccuaauggauguucgcuuuuuggguuuuuuugguuuuuuguuuguuuguuuguuuuuugagacagggucuugcucugucacccaggcuggagugugguggugcuaucacugcucacugcaaucugcacaucccuggcucaagcgagccuccaccucagccuccgaguagcggggacuacaggcaugcaccacugugcccagcuaauuuucuuuuaagagacggggucucacuauguugcccaggccauggauguguuuguuuguuuguuuguuugggguguuugggggguuuuuucuuuuuuuauugauuugaaaaagcuuuauuuucccgaauuuuuuauugugguauacaauauaaaauguacugucuuaaccauuuuuaagugugcagcuaguucagcgacaguaaguacauucauaguguuguguagccaucaccaagguccaucuccggaacucuuuuccucuugucaaacugaagcccauggagcaccaacucgcaucaccccuucccuccccuggcagccaccauccuacuuuauguuuccaggaauuuggccauuuaggugacucauaugagugaaaucguaugaaaugucuccuuuugugacuggcuuauuucacguggcuuaauguccuccagauugauccacacuguaacguaugucagcauucccuuccuuuguaaggcugagcaguauuccacugcaugcaugcccugcauuuuguuuacccauucgucuguugcuggacacuuguguugcuuccacguuugagcuacugugaaugauguggccaugaacacaccacacagauaccucuuggagaucccacuuucacuucuuuugaguauguucccagaaguggaaauguggaucauuugauuuuuucauuuuuuugagaauuaauugccucacuguuucccacgguggcugcaccauuuugcuuuccugccaacagugcacaaggguccaguuucuccacaucugcaccaacaggugucauuuuccggguucgcuugguuuuuuuuaaauguuaaccauccuaaugggugugaggugguaucucacugugguuuugacuugcauuucccucaugauuagugacguugagcaucuuuucaugugcuuguuggccauuuauauaucucuugggagaaauaucuguuuaaguccuugaccuauuuuugaaucaaguugauuguuuuuuguuguugaauuuuaggaguucucuguauauucuggauauuaaucccuuauuagauacacaguuuacagauauuuucucucauucucuggguucuuuuuacucuguuaaugauguccuuucacuagauagaugcaaaaaauguuuuuaaauuuugguguaaucugauuuaucuauuuuuucuuauugucauacccaagaaaucauugcucagucccaugucacgaagguguuaccuuauguuuucuucuaaggguuuuaaaguuuuaggucuuaaaacguaaagauccauuuugaguuaauuuuuguauaugguauuagguaagggucuaacuucauucuuuugcauguggauaucuaguugucucugcaccguuuguugaaaagacugucuuuaucgaauggucuugacggcuugauugaaagucauauaugcaaggguuucuuucuggacucucuguuuuauucuguuggucuguaugucugucuuuaugccagugccacacuguugaugacugcagcuuuguaguaaguuuugaaauuaggacaugugagucccccagcuuuguucuuaucuuucacgauuuuuuuuuuuuuuuuuuuuuuuuuuuuggcuauucgaggucccuugagauuccaucuaaauuuuaggauuuauucacuauuucugaaaaaaaaaacaaucacugggauuuuuauagggauuacauuaaaccucuagaucaauuugggugguauugacaucuuaauauaguaagucuuccaaucuaugaacaugaaugucuuuuuuuaaauguccucuucaauuucuuucagaaauguuuuguaguucucauuguacaggucuuucaccuccuaagucaauuuuuaaguauuuuauuauuuuugauacuauaguaaauagaauuguuuucuuaauuuccuuuggauuguucauuguuagugaauagaaauacaagugauuuuuauguguuuacuauguauucugcuauuuugcugaauuuguuuauuaguuguaacaguuuuuguggaauuuuuaggguuuucuacauacaagaucauaucaucagugaucagagauaauuuacuuauuucuuuccaauuugaaugccuuuaauuucuuuuucuugcccaauugcucuggccagaacuuccaguacaguguuaaauagaaguagugaaagcaggcauccuuccuuuauuucugaccuuagaggaaaagcuuucagucuuucaccacugaguaugauguucacuguggcuuuuucguauaauauggcuuuuauuauguuaagguuguuuccuucuauuccuaauuuguugaguguuuuuaucaugaaaggguauugaauuuugucauaugguuucucugcaucaacugcaaugaucaugugugaguuuuuuuuccuccuucauucuguuaauguguauuacauugauugauuuuuuuuuuuuuguauguugaacuauccuugcacuccagaaauaaauccuacuuggucaauucauuaaauuccauuuaauugcaucaaauuauaccaaauuuaguuuacuauuaauaguauuuuguuuaggauuuuugcaucaauguucauaaggaagacuggauuguaguuuucuuuucuugcaauaucuuugucugguauugguaucagaguaaugcuggccucauaagaaugaguuaaauaguguucccuucucuucaaguuuuuugaaaauuuugggaggguuugguguuaguucuuuauguguuugguagaauucaccagugcagccaucagguccagagguuguuugucaggagauuuuugaguauugauucaaucuccuuacuaguuaugucuauucagauuuucuauuucuucaugauuugauuuugucuugauagguuuugucugucuggaaauuuuuccauuccaucuguguuauucaaauuguugacauauaguugcuuauaguacacucuuauaaucuuuuuuauuucuguagaauuaguagcaauguugccacuuucacuuauaauuuuaguaauuugaguuucuucuuuuuuucuuagucuagaaucuagcuuaaggcuggucaauucuguuaucuuuucaaagaaccaacuuuuguugucauugauuuucucuauuaucugucuguucuccauuuuguuuaucuuugcucugaucuuuauuuuuuccuucuuucugcuagcuuguucuuuuucuaguuccuuacauuguaagguuaagcuccuauuugagaccugucuuuuuuaauauaagcauguauagccaucaguuucccccuuagcacugcuuucacugucgaacaaguuuuuaaauuuguguuuucauuuucacucaucucuaaguauuuuauaauuucccuugugauuucuucucugauccuugguuauuuaacaggguguuguuuaauuucgugauuuuuuaaauguccuuguugcugauuuuuaacuuuacuccuuuguggucugaaaagauaucuuguaugauguagaucuuucaaaaucuauugacacagacuuuguuguugcaacuaaccccgucauugcaagcccuucuccgucugguugaagugacuuccaggagauuuaaagggcuggcacccuuuucucccuucauuuuucucuuuuuccucuuuugagacguagacauugaagacuagcacauucaaaagcaaccauauauguggagaaaauaaaaaagucauugcacaugcucaggggaagucacgggcuuagaaaagaccuaagaagaccuuaaguuuauacuuuaugcugauccuuagcacagagacagcaacaaucaaaauuauaaaaacaagaaaaaccagcaaacucuggggaagaaagagauuuugauuucacaaggcauacaaagaaacuuuccuauuucaaaggaaaaaaaaacaacagaaacugucacugaaaaagacuuggugguagaucuacuagacaaaggcuuugaaagaacuaucuuaaagauacucaaauaacuaagggaaaauguggagaaagugaaagaaaauguaggaacaaaugaaaauaucaauaaaaagcuagaaauuuuaaaaagaaaccaaagggaaauucuggagcugaaaaguacaauaacugaaauuuaaaauucacuagagaaaugcaaaggcagauuucagcaggcagaauaaagaaucagggaacuugaagauacaaaaauggaaauuauugagucugaggagcagaaauaaaaagauugaauaaaggugaucagagccuaaggggucugugggauaccaucaagcaaaccaacauaaacauuguaggagccccagaagaagagagagcaaagggagcagagagacuauuugaagaaauaauggcugaaaacuucuaaaauaugaugaaugacaugaauauaaccauccaagaagcccaaaaagcuccaagcaggaugaacucaaagagacccacacugaaacauucuaaucaaauugucaaaacccaaagacaaagauuuugaaaacagcaagaaagaaugauucaucacauguaaggaauccucaauaaaacuauuagcagauuucugaucagaaacuuugaaggccacaaggcagugggccaauauauccaaagugcuaaaagaauaaaaacugucuaccaagaagcccacauccagcaaaacuguccuuuaaaaguaagggagaaauuaacacauucuuagaucaacaaaagcugagaauguuccuuaccacuagaccugcccuauaggaaacgccaaagggaguccugcggguugaaauaaagggugauagacaguaauucaagugaagaaguaaagaucucagccaggcauaguggcucaugcuuguaaccccaucacuuugggaggccgaggcaggaggauaacuugagcccaggaguucaagaccagccugagcaauauagggagacccuaucucuauaaaauaaaaauauuuuuaaaaaucgaccaagcaugguggugcacaccuguggucccaacuacuggggaggcugaggugggagaaucauuugggccugggagguugaagcugcagugagcugucaccacaccacugcacuccagccugggcaacagagcaagaccuuaucucaaaauaaauaaauaaauaaauaucucaguaaagguaaauauauagacaauuauaaaagcuaauauugcuguaacaaugguguguaaugcugcuuuuuguuuucuacauaauuuaagagacugauuuaaaaauaacauuaugcuuuuggacacauaauauauaaagguguaauuuugugacaucaauaacuaaaaggguuggggacagagccauucagggagcagaguuuuguuuaugccauugaagcuaaacugguauaaauucaguguagacuguuauaauuuuaggauguuaaaaugcaauccccaugguaacaacaaagaaaauaacuaaagaauaaauacaaaagggaaugaggaagggauuuaaauguuucaccaucaaaaaaauuaauuaaacacaagacagugauacuggaaauuaaggacaaaaaaauccauaagguauacagaaaaaaaaugcaaaaugaaagaagucccucuuuaucaguaauuacuuuagauguaaauggauuaaacucuccaaacucucucuguuaaaagacagagauuggcagaauggauuuagaaagccaaauccaacuauaugcucucuacaagagaugcacuuuagauccagaaacauaaauagauugacagugaaaggaugggcaaugacaugccacacaaauaguaaccaaaagagagcaagaguggcuauacuaauaccagacaagauaggcuuuaaaucaaaaaagguuacaagagggaaagaaggacaucauauauuaauaaaaggcucaauacagcaagauauaauaauuauaaauauuuaugcaccuaauaacaguccaucaaaauauuuauaucuuacacugggaagauuguugcuggcucucagucugcuuccagucugcucauauugcuuuuguuguaaugauggucauaugugggagcucagugucaagagggcagacuugagcccacacugccaggcuucagaccucagcuauuagcugagugcccugggcaaguuaccucacugggccuugguuuccucaucuguuggaguggggaugguaauaguaccuauguccaaggccauaaguccaauugugaauguugaaugaagggauauaggacaguaucugguacacaauuauuauagauuuuucauugacauuuuauacauucuguuuucuucaaagacuuuuugguuccuguuuugcacucagauacuuccuuuuccuggaguuuauuugggagcaccaugugagguaguaccuuuauuucuagucacagggugagcccucaucccagccugcuuccaccacucugaaaggccaccaugucauagccuaaguucucguguguuguuaugcccaugguuguguggaguguuggccuguuccagcaccaaaaccaaaacuguaauuuuaucguuucauuugauagcacaagcuuucucaucacucuauuuuuuauuuugcucaacucuucuugcuuuuucuaccaaguaaaacuuggauucauuuugcaaacuccuaucuacaaaaaugcaaaaaauuuucuuggaaacuuuaauuaaaauugcauucuauuauagauucaguuaggaauaacugauauuuuuaaaucaguuuaagauagugggaugauuucuuauccaaaaacaagguuugucuuuccaauauauuucucaaaaauuuuuuugaguuuuuuucauaaguccugcacauuuuuauucaguugauuccuuggguuuauguuguuuuucuuacuaguguaaauagcauuuuucugcaacauuuucuaacugguuguuagaaaauguuucuucuaacugauagaagaaaaucaauaacuuuuuguauguugaggacuaagcucugauuuuuuuaucuugccuauauucuuaucuaaggggucuggggagucaugcccuacaaaccauaaauucucaucagaugguuuuaucuaacccuauaugcugugacuuacuuuccaucugacucuggcaugacacuacacgaccaagaagaaaauaaaaauauuuuaccccaaaacauguuucuuugccacauuuugaaauggcccugcaaagcuguccuuuacuggggaaaauuugcaucuguaaggaaucucuguuaacauagcuagcucuuuuucuuccaggcccucccaauucugaagagauuaaccgagagucuagcagcuuuuaaaggucucaguaggaaacacuugucauugauugucucuaagggcagccacuaugagacuucagaagaaccuuggucuccacagucuuuuaucuuaaccugagcauuuccuuucuaugaucccaggucuuuagacaaacucaaccaauugucaaccagaaaauguuuaaauuuaccuguagccuggaagccaucucuccccgcuuugaauuuuccugccuuucuggauuaaaccaauguauuucuuaaauguauuugauugaugucucaugccucccuaaaaugaauaaaaccgagcugcaccccagccaccuuggguacauguucucaggaccuccuaagggcugugucaugggucauggccacucauauuuggcucagaauaaaucucuuaaaauauuuuacagaguuugacucuuuucaucaaugauauauuuuucuaaguggcucacuaaauuuucucucccuaaucuccccuccuuucucuuucuuucucucuuucucucugucuauauauauauauauuuuuuuuucucuuuuuuaaaaaaacuuuguucagaugauuuucuggguagacaauccuaucuuuaauaaggacaguuuugucucuucuuuuccaacaguuauacuuuuauuuuuacugucuuauugcauuggcuuccaacacaacacugaaugguagcguaagaucugcacuguuugcccccaccccauuuuuuuuguacuguaguaagcauucuucuaaugcaggauuuuuuaacccaggguuagaucuacgaauggaaucccugaauuccuggacaugauuucuguauaugagcaucuaugcauuuguguaaggugaaauuguguagacucuuaaaaggguccaugaccacaaagauaagaaccacuauuuuagcuuuuuguguaaaauaugaugugagcucuugauuugaaauguauauccuuuauagaguuaauucuacuccuaaauuucuuacuagguuuuaccuugucuggcuguuguuguuucuuaguuagaaauugauguuucagggaucuauugaagcaauugcauauuuuuucccauuuuauguuaaugugacuuacauuaauguauucccuaguguuuguggcaacacuguacuuuaacuucauauuauaguucugguauagugguccuuaauaugcuauuggauuuuaguuuuuaauauuggcuagaauuuuugugauaauguuaugggauuuuuagggugucacuuuucuggccugaaaccucuauggccaguggcgccuuugcccaaguucuuguccuguguccaggaagaaugagguacacagacaaguggagggugugcaagacagagaagcuuuauugaguguuaggggagcucacaggagacccgcagggggcagccccucucuguaggcggguugucuugucggcggguugucuugucaaauguucagcucucagcagagagaaggcccuggaguggguggcuccucucugcaggcaggucaucccauugucucugcagcucuuagcagagaggaggcccucgagagcgugucuccucucugcaaacagggcaucucaacuaguguucagcucucagcagagagaaagcccuggagaggguagcuccucucugcagcuggucguccugacaucccuucagguccugaagcucucagcagagagagcaccuccucucugcagcuggucgugccaugcucugcccugcucugacugagccuggggcuuuuaaaggccucagagaggggaagugcaugcugauugguccaugugcagccaugugcaggcccagaagaaagcaccuugaguuccccucugguccguaggacgggcaacccggcccccaggcuucaggccugccccagccugaagguggggcuucacuggggacccauccucuucugcccaggagccuaucugccuccugcagccauccauggugcccaggcugcugguaccaaggggcaccggugcccagccacccucagcacccccccaagccuccccuccugcacuucucagugcccacaguuuggagggggccaagucagcagggggcuggcaugucagcacugccacaagcaugcacccacccggccaggcugugacagugcccaggcucagccccaacucugcucugagauuggaguggguggugggagcgggaagaagcugggcagcgggaacaggcaccuccaggccuacaagggaaagaggggccuucccuggcuccccaagagugcagcgaugccugggucagcagccccaguuggggcagcugaaacugcaccaggagugggggcuggcuccugccuccuccauggagcagaaggcccagauccacagccacgacuugggcaguuguaccuggggaacucucaccucgccaaacugcaaggggcagggaucccacuuauccccggcuccugcuggcuccguggagcaugguaccuggccauguccucucgcagccuggggcagggucuccagaccugggccagcaucccagacaggggcaacaccgccgugagcuccccuucacccagcacaccacccggcccggccccauggcagcggcccccagggaggcagucugcgggguugggggccugucugccucuuccaugggcccucccugagcagccagugugauggcagcggccacaccagaugggcugccgcugccaucaguaauauuuauagugauauuuaucuguagaguuacuuuuagggacuuuuuuuuuuaucaagcuuuggucacagguuaugcaacauuuaaaaaugaauugggaaaaaguuuaucuuuuuauguucuaaaacaaguuaaauagcaugaagugcuuguccuugaagcugugaaacucacccacaaacugccugagcuggcaccuuugggaacggacuucauuccucccugggccccaggcugagcaggucuggccugggucaccucauccacuccagacgccgcaaaaucacagcaacccuucagggcccucuccuggcagcgccuccccuagucccggugcuuggacacuccucccaucugcaccgaggagagggcggcacuccaaucccugcauuaccccuggaacugcacgcucugaaccaggcccggugcccuuucugcccagcugcccggcugcugccagccccacucugcggagccagcagcacagugaggcccguccugauggccuccuggagcuggagcuuaggccaagccacagggcaucagggaggauggacguucaagggcuggaucuguuugccccaggguccuggcacccaacagaaaggaaagccaggcuaaugacggcugugucccuacacuugacagaguccucccucccuccuuaucaaaguccuguuuaaagggaauggagccaggcuggagagagagugccuagcucugcaggggagccggucuggggaagcugggaucucucucccgcccuccccucugcacuguuuccagggcagccccaggcaguggggggcgccagacaguggugcuccauucccuuccaugccgacgcgcccagcuacccacuccacccagcccuggaggacauggaagggccucaaccauccaaaucccacccaaaacugagcccagaggcacccacuaaacaucugugaccccacccaggguggggcaagagggcgcaagccccccaguccagaugcuggugacggugugugcugggcgcagaccccgcuuccuugaagacugagggcagugcccccaaucccgcugaccugcugugcgugcgccugccaugggggagggugccaggggagaggcacugggggugucugagcgacccccaccccuguugcaggacuucagggccacaggugcugccaagaugcuccagggcaccugcuccgugcuccugcucuggggaauccugggggccauccaggcccagcagcaggaggucaucucgccggacacuaccgagagaaacaacaacugcccaggugccaggggucgggggccgggggcucugggcauuuggggggcaguugggaccaguacccaggugccaggggucgggggccgggggcucugggcauuuggggggcaguugggaccaguacccaggugccaggggucgggggccgggggcucugggcauuuggggggcaguugggaccaguacccaggugccaggggucgggggccgggggcucugggcauuuggggggcaguugggaccaguacccaggugccagggguugggggccgggggcucuggcauucgggggcagugaggucaaacccacaaacaggcacggggccaggaaacggggcuccaacagcagucccuccugaggcuggcucgugacagguccugugccccacagagaagaccgacugccccauccacguguacuucgugcuggacaccucggagagcgucaccaugcagucccccacggacauccugcucuuccacaugaagcaguucgugccgcaguucaucagccagcugcagaacgaguucuaccuggaccagguggcgcugagcuggcgcuacggcggccugcacuucucugaccagguggagguguucagcccaccgggcagcgaccgggccuccuucaucaagaaccugcagggcaucagcuccuuccgccgcggcaccuucaccgacugcgcgcuggccaacaugacggagcagauccggcaggaccgcagcaagggcaccguccacuucgccguggucaucaccgacggccacgucaccggcagccccugcgggggcaucaagcugcaggccgagcgggcccgcgaggagggcauccggcucuucgccguggcccccaaccagaaccugaaggagcagggccugcgggacaucgccagcacgccgcacgagcucuaccgcaacgacuacgccaccaugcugcccgacuccaccgagaucgaccaggacaccaucaaccgcaucaucaaggucauggugagccgcgggcgggagcaccguccacgcgccagggguggccacggugggccguccacccacuccgggccucacuuuaccccucugugagugcggaggccgaaggaggaagcuccgggcagggccugggccacucaggugucccuccauccccacccagacucgaggugcagccgccccaggucucgaggcacacggcuaaccagcaugucugucuuuucugcagaaacacgaagccuacggagaggugaguggcgcuucccuuccugccagugcuggccggcagcugacccagcagagaugaccgcgccaggcugccgacuccuggcgccuccaggcuggaacagaugagaggagagggagucaccugcuccauguuggaccugaggccuuggagucuggagaaagggcucccagccaaagcuaggcuguuuagaucccgugagggucagcguuagggucacccacagagcacguguuacaaggagaggucgagggucuggccuccgggcaggugggauccauccacccuggacucgaggcccgagcccagcccagcaggucaggggagaaggaacugacaucaucgggguccaugacauccccaccucccugugugucccagcuccagcucucaggaaggggagcaggcaucugagaucucccccgugaggcuuccugcaaaaacgugcccugccucagaaucgcugcucaguaacagugguuucauugccguguacaaauggugccucccucaccagugccccuugcucuuccauccuuuuguaaaauuuauucuuuuauauuuguuuuuuuagagacagggucuuucucugucaccuaggcuggagugcagugguacgaucacggcucacugcagccuugaacucugaggcucaagccauccucccaccucagccucccaaguagcugggacuacaggcaccugccaccauaccuggugugcgcauguaguuccagcuacuugggaggcugaggugggaggaucgcuuucguauuguuuuuuuguagagaugggaucucacuauguugcccagccuggucucuaacuccuggccucaagcaguccucccugccucggccuaccaaaauguugggauuccaggcgugagcugcacccggccuuucuucccuucuauuuucugucauggcuuaagccaggcuugguuuuuuaaacuugccuagaacaccugaccgagagccaaacucuuuggcuugucccugaugggggcagagccucacagcaccccaugucucacagcucccucacgcccgcccagguucucagggcauuucagcaucuccuuggccccugcugagagucgugggcuacacguucugagacccugcccugccaccugaggaaugucccacccaugcaaccuucugucucugcuuccucguuucagugcuacaaggugagcugccuggaaaucccugggcccucuggccccaagggcuaccguggacagaagguaagaugcccagauuaccugcagggucugcgcuaccaggaagccccugauuuguuuugaaauccacacuuggccgggcgugguggcucauaccuguaaucccagcacuuugggaggccgaggcgggcggaucacaacgucaggagaucgagaccauccuggcuaacauggugaaacccugucucuacuaaaaauacaaaaauuagccgggcguaguggcaugcgccuguagucccagcuacucgggaggcugaggcaggagaaucgcuugaaccugggaagcggagguugcagugagcagagaucacgccacugcacuccagccugggcaacagaguaagacucugucucaaaaaaaaaaaaaaaagaaaagaaagccacauuuaaggccagcuguaucucaaauugucucaacacuucugucccuggagaaacuaaaacucuauaugucuaauuccuuuuaaauaguauauugagaaaagcagaagcuuguaaaaaaugagauaugccauuaaaauacuuugguaagcaagcauauucaaguaaguaaaaugugagaugcacuacacuuaauaauaugauugcucauuaauaugaaggaaccucuuuuguggcuuacuaaauaagcaguuuuagggagccugguuugaauguccccugcauuuucugguuugaacauccccugcauuuuccuaacagaggugcaucaaauaaaguccuuccaaaacucacuaacagaguaugugaaacuccaacaauucacaucuguuaaaaauuauaaagaaaagcauaggaggagaaaguagcuucuaaggagaugaaauaaggaauugaccaucauagaggauguuacugcuacguagcuucguguuuuucuaaauuuggauaacagcugucuagaccaguagguaucuggauguacuuucuccaggaugagacaucucgaggcugcaggucaaauccugccaucucccucccuggcuucuccaguccugguggcaaugccgacccuacuacagcugggaaugaauuugccacuuggggcagccuuggcugcacacagcagugcagugacccguucuguugggggggccacuggaagcugccacagggaucacugugguuagaguuugagggguggcaaggugccaagcggagcccaggacagggcacagcugugauguuccagaagccucugcccaccucauccccugcccugaguuuccucccuuuucuuccuuuugaccucuuaauucuuccccuuuccucugcuccucuuugcacuuaaauugggagcauaucaauaaauagaugaauuuauuuaauaaaguucuguaucauagguuaaaauuuuaauuccaagagaguguaaccuuuaugugguguucugaaguccugaucugucuaaaguuacuuagauaaaggaauuaaucuuuguagugacggugacccaggcaucgcuggagaaucagagcccaguguuggccacagucacagcuacugggugcagaagggacccccacgggccaggcacccccaccccaggggucucuucuggcuccauuuugcagguggcuuugugggaagcuucccucagagcugggagaaaugggucaaagcaaacccuugucugacagaggcuggcccuuuggggagcagcugacaccaagacuucuccacuugggcaggggaaucaguaaccucugcugugucaccucucagaggagcuguggcaggguccccagcugccuaccgcccacccuacccugccucgauguacucuuuucucugcuuuuagggugccaagggcaacaugggugagccgggagagccuggccagaagggaagacaggugaguguccuugccccacgcccgccccgccugcagcccagcgccccagggcugggcucacacugcugcguuguccuucacagggagacccgggcaucgaaggccccauuggauucccaggacccaaggugagugaccucggccaggggcuuggcuccacccugaggccccagcacugccaggcaggcuccccccagcccagccucggccucagccucuacgacccuccccccaguuaccaaggaacagaagcaccucgauaacuugauggccgucccaaaacccagccuccagcccgacccagggcucagccuccuccgcagacuguuugucgagaacacuagaugccagcggcccaccgagcacuccccucagccugcagggcuggcccuucccugccugugucucugcagagcuccucacuaaugccccucucuccuccugcccccagggcguuccuggcuucaaaggagagaaggugaggcucuugcccugacagaccucagaccugcgccagccucggcccagacccaccucuuggcguccgccgcagccugucacugcuccuggggcaccggccuggucuuuucucagugguggcuuugggggcuccugggggguccuguggccuugaguuuggcccaagggcuuugccccccagaggcagcagugcccaugaugcuuugaggcaccgagcucacugcgccggcuuuccuccuacacagggugaauuuggagccgacggucgcaagguaggcuggcuggguaggcagagccccuccuuccugcugcucagggcagaaggaccggggcuaauggaguucccucuuccuucucucuucagggggccccuggccuggcuggcaagaacgggaccgauggacagaagguagagggagccucgggcucacagcuggacuggucucacagaggcaucccagccucugcagggcccccagauccagccugaucugucagcuuacacauguguacacacgcauacacacacacacacacacacacacacacacgaacuucagcuccugccacaucccacugccccacccagggcuucaccagccugcaucuaauucauggcugcacaucccggcuuggggcagcuccacagcugcacacagaggccagcaacaagccuacccacucccaggucaaaccacaggacagccccacccacuccuuccauggcuccccgugggaacauccucugugcccagggagcucugcccucagggccucugggaggcagccagggauggccuguuccugcacaacggccacucugccuccccggagacagcuccacagcagccguggccucaugugggcacccgugugccaggaggagagcgcugcagcccugcggggcagaaccgggugggcugugucuuggucguuggcacacauggaccccagaaccccgcccugagacuccuccugcccccuucuccuucagggcaagcuggggcgcaucggaccuccuggcugcaagggagacccuggaaaccggguaagggccguuugcaccccuccuucagccucggcccagggggugugggugccugaccgggugggaggguaguugcugcugcagugggagcguggguucucccggcagcccagcagccccagcccagcagccccagcccagcauucugccgggucggagucaugugaggaacucccccugggagcuccuggcggauccccguggccuggagaccugaugcaucccaaacuucggugucacuggacagcuccauuucccugagcagcagauccaggccuggccucuuggucacugagccugggccucacagugagggugggaggugcgucccgggcugggacaauggagcacuugggcccuggcucauggggagaaccccacccgccgugugccgagcuccaccucucacuccucucucagggccccgacgguuacccgggggaagcagggaguccaggggagcgaggagaccaaggcggcaagguaaguggccuugucaggguacggggcaggcggggucaccagcuuccaggggccuccuggaggcagccccagcugagaagcugagcagagagggccuuucuggaaacacuggucagugaggagccaauggccgugggaugugguggagggugcccugcccguugcuucaucagcuucuaaccagggcuugggcggccccgccgcugcucaccgaggccucggcaacaaacccaccuccucccagguggagccccagggagccccacccacaccuccuggagcuccccaugggaacguuggugccccaggggcucugcccuccugggccgccugcagugucgccccgccccuggcggccccaggauccccaagggcuuuuuucugggagcuuggacuuagggcuucccacuuucuguccaccuucccucagcccaagcccaagucuggcugaguccucugagcagaugcacaggcguccugcccgugacacacacucugcccucagcuggcacggagguuccagcagcccccagccagcaucuggcaucccaggugccccguggacaucagggaggugcagucccaagcccgaccguggguccugcccccgcagcgggcauccugcaccccccuuccccugccaaaagacgugaggcugauucugcaaacccuuccagggggacccuggccgcccaggacgcagagggcccccgggagaaaucggggccaagggaagcaaggugagccccucugccucuucgccugcagcugagcuggccacacucacgcccauggcccagaugaacagucacgcuggccaccaucucugcugucaccauggugccgcauugggcucuggggacacggggagggacaggaagaacaggccaugugcccugagccaccagccccucugaccugugcccuccucacgaggcugaacaaguuccaggggacccugcagggcccccaugugccuggcaagcagauuccgcuggaagauaauaggggcuccacaccacacaccgcacaggcgugaccaugccucagggccccugccucugggugacugugcuguccucuccuucuucagggguaucaaggcaacaguggagccccaggaaguccuggugugaaaggagccaagggcgggccugggccccgcggacccaaaggcgagccggugagucccuccugccccugccucagggccccgcucugggcauccuccuugcagcuugaggaggaccaugggggaagggcaccugggcuguaggcaggauccccugcuggcaaggcacagccaggcccccauccucccaagaaguggacccggaccaccccacgggaccccccagagcuggacuuagagguaaagcccaggcagguccuccaugguguucccuaaacccagcaccagcugcccagggcauccugugagggcugagcagggcccgucccagugcugaccacuccaaggggacucugucugagcauggggccugccugggagugaccgcagugacuggacagcaccagguccccaccaggccccagcccaucaccuaaaacgccacucaccagacauccaacuccaccuggagccuccccagaucauuccuaaauccucggcaugggcgggaccgacgcagcagagggacgagggcuggcagcagagccacuggcgcaggcugaggcuguugggaaggagccuggggaucgaggucccaggucccaaagccagagcccuccuguagagaaggagcaucggccccggcacagcccccacccuccacaggcucugggcuuggacucagcccccucccucacccacacgccuguucucugcaggggcgcaggggagaccccggcaccaagggcagcccaggcagcgauggccccaagggggagaaggugaguccucguguggaggcagcccagggucucacuguggugcccaugggcccugcugacgagggccccaaccccauuccucccagagaacaacagaaccccagggccucacucuccagaguucacucucugcagagucugggaaugcagcccugagauccccacaccccauucucugcugaggaagcuccacuacccacccaggcacaccccgcacagcugugcaggcaccauucacccccggcccacugaggcaccacucacaccccccggcccccacugaggcaccucuuacccccagcccacugaggcauugcucacccacgugaccucaggggugaugcugaagggcugugugguaaaaccccggccaccagcuccccuugacaucaggugaaggggcuuccucccaggaaguggacgagguccuacccacguguggguggccucagggggaccgagagacaccgugcucagagcggcagcuacaggcaccgggaaggagcuaugggugaaacaggcgacuguugcaggucccccgggacagacgggguucuuccucccaggcccccuuccccaacccccggccacacccgccucucacaugggacccaggccggaggccucagcugagacccguggggccucccuucccuucccacagggggacccuggcccugaggggccccgcggccuggcuggagagguuggcaacaaaggagccaagguaggggagcagggugggccgcaccccaagguaggggaucugagggggugcaggggggcugcaccccaagguaggguggccgggacugcaccccaagguaggggacccgggugggugcugcaccccaagguaaggggggcccaggugagggcuauaccucaagguaggggacccaggcgggugcugcaccccaagguaagggaccaaggcaagggcugcaccccaaaguaggggacccaggugagggcugcaacccaagauaggggugcuuaggcaggggcuacacccagaacccagccuacuccacucagugugcucagggcugaaggucaaguggagccacagccuccggggagggucauaggggccggggccagacccgucuuacccccgaggcccugcaguguccacaggauugauacuggggacuccagggugcugcugucagucaagagaaccccaaauuccuccccuuucuuccagggagaccgaggcuugccuggacccagaggcccccagggagcucuuggggagcccggaaagcaggucagugucagugcaggaggccggugcccucugaccccacgggugggucuccccuauccauguggggacagccuggagcuagccacuguccccauagcaaacccaggcagcagagccuggccucagaagccaggaccugcuccccuagaccccgaguaccucauacccacccucagccccagccccccauccugcccugaaggacccagguuguggagucaggggcaaggcagugggccugagguccuggaugggccacagggaaaggaggagcugggacccucaagacagagguccacggcccccacaggcagcaggaggagcugcggccauguggccugguggucagggcuggacggggcaugucaggugaccccugggcauggccagucccugccugugcugacuucugaauuucucuccugcccucagggaucucggggagaccccggugaugcaggaccccguggagacucaggacagccaggccccaagguacgugccccucccccagcaggacguauuagggguucggggcagcugccugaggagcaggacagggggccggccugggggacccuguugccggcagacgugccucaggacgggccugugccuccuguucucagcucuggagugaggggaugccuccgggguccaggaagccccccuggcucuccucuucagcagugacccuugggugugcauggcacauccuuccugaggcagggccugagggcagcuacguggccugaguaggguccuccccgcgugugggcaggcuucgggucucuaggcacguccagcccccacuggagguggacagggcgagguuggcccugccaggccucugcucacagccagaacucgacggcaccccuagcccacuuccaccccagugugcaccuugcgcccuguugagcacagccccccagccccaccccguccuaugaccaugcugaccgacucaacguccuccuccagggagaccccggcaggccuggauucagcuacccaggaccccgaggagcacccgugagucacagccugggauggcagcucccaggaguggguggacauugucccaagggcccugaagauuccuaguaguucccucaaggccuccucugugcagaagaaagugugaggucccuccugcgggacagaguggugagaaggcuucgggugacucagugaaggauagguccagcccagcaucaggaaaagagcacagcucagaacgcagcacaguggccucacccagagugugaaugagcgagggagggaaacggggcugcagaaagcugcccagagggaggaaggagcacugggaucugaggcugagucacccuggcuucuguuugcuucacagggagaaaaaggcgagcccggcccacgcggccccgagguauguguggguccuggccaccugugcccacccagggugggggucugcacgcccaauugcugggaacacaaugcccaccgucacugacaggaccaccccugucuugagaugguccuggcuccccaaggcccagccaugucaccuaugcugagcucugggggagcugucagccacuggcuggucccuuuucaaccaaaguucaggcuuugcaaaaaaaccacauagaugcucccguuuaaaggaccccaaaaugccagaucgauuuuuccacauaaaaaucucacuggugucccugguagagacagcuccucugucccaggcuaacauguguucccugucacagggaggccgaggcgacuuuggcuugaaaggagaaccugggaggaaaggagagaaaggagagccugugagugucaccgucccgaagcccacagcagcugggcagaggcagggaggggcccugaggcugagcgugugcaucuaugaguacaggagaacgccaggcagcuuggccccagccaugagcaccacccccaccuuccuaaagggaacggcuggcucaggggcccccucccucaacccagccucccuuccagcguccccuccccagugaccccccaacaucccccccacagcaucccccacaaggguccccucccuagugaccccuccacaacauccccccagaguccccucccagcauccccacuacagcaucccccaccaggguccccuccccagcgaccccaacauagcauccccuccagaguccccucccccaaaagaugccuccacauagcaucccccucagaguuccuacacacagcauuccccaaggguucccuccccaauguccuccccacaguuaucccccagaaggugcucugugccuccaaaucccuagccuggccaaggguuuaaccagggcugcagguuggucuggaacugagcacaaaacaagggauggauaacgauggauggaugggcaaguggaugggggugggcaaauggauggaugggaggaugggugauggauggaugagugaauagaagaguggguggauagaagauggaugaauggauggauugcuggaugaguggguggguggauggauaaguggauacaugggugaaugaguagauguaugggugaguagguggguagguggguagauggaugggugggugggcgagugugugguuagaugauggauggcugaauggaugaguggggggauggaugggugaguggguguauguauggauggguuaguggguggguggaugaauggaugggugcauaaaggauggauggaugaaugaguuaguggguuggcagauggauggaugggugagucaguggauagauggauggguggguggauagaggauggaugguuggguaggugauggguggaugaguggauagauggguaugugagugaguggggggauggguagguggguggauggaugguuaggugaaugaguggauggacagacggacaguggguggauggaugagugaacggauggaccgauggaugaauggguggguggguagaggauggacggacaggugaguggguggguggauggauagauggguaagugaguggauagauagauggguggguggacagaggauggguggaugaauggauggguuaguggguggcuggguggauggaugauggaugggugacuggguggauggauggauggguuaguggguggcuggguggauagauggaugggugauugggcgaaugggcgaauggguggaugggugggcguggaguugguggguacaugauaaugggguggaauacccauggauuggaaugagcuguuuuggcugcuauuucugggacacccagcucugccaggccccuaccccucuggugggccaggcucugacgguggccacucauggccuuucuagcucuggugccagcauagggaaggaggaggcacagccuugucuuacuccuugcaccuguuagcccccccccccgccaagggaggacccgugguuggggacagcacagggggcccugcugugugcagggacugucccuggggccacugaagcccaccuguucuuguuccuucucaggcggauccuggucccccuggugagccaggcccucgggggccaagaggagucccaggacccgagguagguugguggccaguccccaugcccuccccccaaccugccaggccaacacacacccaagccucgugguucugcccacgguggacccacguaucagugggcaguggccugggagagacucagccacccagccuuggccccagagucucagccucauccuuccuuccccagggugagcccggccccccuggagaccccggucucacgguaggugucacauggggcagaaccaguguccuucuccugccaaaacuagacaccaagagcagcaggggugggggaaggucagcuggcacggucagagagcaagaucaguggaggaggucagagggcaaggucagagagcaagcuugguuggggaaggucacagggcaagguugguggggggaggaggguggcagcgagguugguagggacaggacccgccagccuccccgcauggcugccuccacacgugggcuggaaugucccgggacccccaggccaggaccuugcuguggaaacucuucuggggccccggggggacuacccugccugccgugugcauugcaggagugugacgucaugaccuacgugagggagaccugcgggugcugcggugaggcacugcccacggcagggucggggcccaugcaccggguggagggcgggagugcagcagggcugggucaucgcuggguccugcaugugcacgugacccuagggucugaggucuccccgguaccccccgaugacccugccacccccccagacugugagaagcgcuguggcgcccuggacguggucuucgucaucgacagcuccgagagcauuggguacaccaacuucacacuggagaagaacuucgucaucaacguggucaacaggcugggugccaucgcuaaggaccccaaguccgagacaggucagcggggcaggggcgggugcagcauugcggggggccgggcggggcgugggaggcgaugagaugggagaaguccagacgcgucccuccaacgagggccucugcauggcuggggaugccccagaccccgaggccucuggcaacgaccucacgcgugcggcuugcagggacgcgugugggcguggugcaguacagccacgagggcaccuuugaggccauccagcuggacgacgaacguaucgacucccugucgagcuucaaggaggcugucaagaaccucgaguggauugcgggcggcaccuggacacccucagcccucaaguuugccuacgaccgccucaucaaggagagccggcgccagaagacacguguguuugcgguggucaucacggacgggcgccacgacccucgggacgaugaccucaacuugcgggcgcugugcgaccgcgacgucacagugacggccaucggcaucggggacauguuccacgagaagcacgagagugaaaaccucuacuccaucgccugcgacaagccacagcaggugcgcaacaugacgcuguucuccgaccuggucgcugagaaguucaucgaugacauggaggacguccucugcccgggugagcgugugggcgcggggcagucggccgaggagcagcaggccccagccgcugucuagcgugagccccagggacaccccucaccugagggaugaaugugcagcccaggaucuugggcugugggugggaaggggucgggcccucucggggcugcagggcagaggccagcugcacccugagccugucuaggcagaucagugaacggccgcugaggguucgcuagggacugacccuggccuggcccggccucucuccucucuuccagacccucagaucgugugcccagaccuucccugccaaacagguaaugcagggcacccugagccaccaccccagacuagcaaagcagcccugguguccuuccuccucgagggccgggcugggggaggggccgugcagggacccggggggcggcggagccacugcggaggcugcuccuuagggagauggccccaggauggcagcacaggggaggaggggcuuggggaaggcaggcucccaggaacgcaggaacagcaucacgaggccaugaggugggugcugcuagccuggcgcugugcucggcauguggccacuggucuugaaggcccaccaugggccuugcagucucccucagcugccgcccagcucccaugggcuggccgugcaugugccacucggaggaagcccuggauucagugagugaaaccaucccgggguggaagcacugacaccccccagcaccagcaggucuugcuccaacccuggccugccucggagcugcagcugcggcucucacaucucugggagugggggagcccaugucccggauguggcccacgugggugugaagcuggagcugggggugccguccaggcucugcuggacguggugcugcccccauggugcacugcugcaccguaccugggcccacaggagguccccgggggcguuaggagcugagucccccucagugagccguccccuccaggagugugaggguagggaugccauggagacagggugggaggguccgaccuggaggaccacagggaggaaaccucagggucugcgguacgaagucagcgcuuccucagcacgcgggucgcggugugcguucgggcguuccauggggagcucccggugggugagcugggccacugagcacauucacaggcccugaggcugccccaggggaggagccguggacucagagccgagguuccccauacgugcugcgacagagaaccuagggcuugcaccugggucuggcugcccuucagcaggcgggcagccucuggccccacaacagugggcugugcuucugccgccaaggugcaggcguccucccccaggguccacaucagcagcaggggcaccuggacccugagggcaggaaccagaccuuggcuccuccacccacccccucguuccugauggggcagggaagucucgggaccccaugaugggcgacauggcgauggucacugugggugcuuugcuaucagguggggggccuuccucuccacucuggguccagugugaguggccgcuauggcuuccccuccacuccagguucuaucgugagugggugggugcugcgucuguggaugucacgugaccuuuccucuuuagccuaucauuguaguugggaguuaguuagcccguugagcgucauugaauuuccaguguugagccagcccugcgugcccgggauaaacccaccuggccgugguguguggcccuguuuaugcacgugggcccugauucgcugaugccugccugaggguuugcgcuuaucggcgacaucagccugcacuuuucuuuucucgugaucucucugguucuggccucagggugacgugggccucguaggguccugugguggcuccuccccagacggugacauggagugagcccauucucccuccugggagugggucacucaggccaccagagcaccacagggaaagcagccagggaggacacggaggcccuugaagcucuggccucuucugaggccuccaggaccugacagugagugggagcagcccuggcagaaccccuccccuccucucggccgcccugacaccucauccccgacacucagagcucauccuccuucccagcuguuuccaauuucaaagugaacucgaccuuguggcuccaggagaugcagcagggacaguguuaaaucggcuuucaccagcccacacggccaggcauccuccucggcccuccugggcacuggguggacaccacuggcuguggccuggcccuggccuucuccagacagcccuguccaccccaaagcccagccacccugggccugcagcaggccuguggaguucucaguugcguggggaccagagggugcuggagaaacaaaccagacgcagcugaaggcagucagggcagggcgcaaucagcgauaagagcugcauaggggccacagcguaaccugagcuccagucgguggaaagaaaaggcagagacguugcagaggccaggucugcucaggggaagacaguucuggguguagaggacucacaucccagagaggcugaggaaggguuuaccaccgcaagcuuucucaggcgggcucuugagggguggcuggggucuuccuggcgacgggccugcggcacuggaagcccuacuggaguuuggccugucuccggcacagguuuggacggagcuguuuugugcugaaagguuuucucgggguccguggugucccccaaaggugccaccgugcgggucuccuagcucccugccagcuuccugucccugugcucacugcccccacgccuccugccaaggccgagccacacacccgcuccaccugcauuuccucuaccgacucgccagcccaaaugccgcucuucacucuggccucgcugagcggcugcccgaggaggagcucuaggccgacgcccaccgcaggccuuacagucuucucuggacgcucccuugcagaugcaccguggccuggcggcgagcccccggucaccuuccuccgcacggaagaggggccggacgccaccuuccccaggaccauuccccugauccaacaguugcuaaacgccacggagcucacgcaggacccggccgccuacucccagcugguggccgugcuggucuacaccgccgagcgggccaaguucgccaccgggguagagcggcaggacuggauggagcuguucauugacaccuuuaagcuggugcacagggacaucgugggggaccccgagaccgcgcuggcccucugcuaaagcccgggcacccgcccagccgggcugggcccucccugccacacuagcuucccagggcugcccccgacaggcuggcucucaguggaggccagagaucuggaaucggggucagcggggcuacaguccuuccaggggcucuggggcagcucccagccucuucccaugcugguggccaccgugucccuugcugcggcugcaucuuccagucucuccuccgucuuccuguggccgcucucuuuauaagaacccuggucauugaauuuaaggcccaccccaaguccagaaugaccucgcaagacccuuaacucacucccgucugcagaguccuucuuugcugcaucaggucacccucacaggcuccaggguuuggguguggaagucuuuggaggcccuuacuuagcggcccagcugggcugccgugcgucugggauggggcugagggagggugcugcccaggugcuggaggauguuccagcaccagguuccagcggagccucggaaacaggccccagaggcuggugagccucgcugggugugggcacuaaucccgugcauggugacucgugggcgcucacggcccaccugguggcaggugaaggcuuccgguugggcagcagauaguccugggggaagcuggcaguccuggcaccaugacguaucugggcuggugucaugcacaguagggcgaauggccacagcugccugccagcagcccugaucccggggugucugcacccuuccagcccaaccucugggucuccaaaagcacagucgggggagcauccaccaggcacaaccucugcgguccucagaggacugagcagagaaucccaggguccacaauguuggggagcggcagggaucaccauccaaagggagcggcccccacggcgagcugaccccgacguucugacugcaggagcccucauccaggcugggcuccugccgggcacggcugugaccauuucucagggccagguucucguccccacacccacugcacagggcaggccaggcuggucuucccacuguggggaugaaggauccuccacaggaggaggagagcagaguccacagacaucccaacagccucagccucccugugccuggccggcccccacagcuuccccgucuccuccaggccccacagacacugaugaauggacagagacccccaaaaccagcugccccuugcaugucugucuccauauguuuggugacagcagugaaaauguuauuaguuuugaggggguuugggaagcccagcgguaccugaggaguuucuggacauuuaagccgguuccuagguguggccuuaacagggaggcugcccuuccuuucacugaaugagcugcgucacucauaagcucacugagggaaccccaucugccagcucgugcgugcucagacggcguccaugucucaagcguucugugaaggcugcggugcagcgugaggucacccugcuguguucagagcuuugcucacugccugcggggcuggaccguugcaccuccagggcccccagaaaccgaguuucgggucaggguccucugugugcauuccuggggguccauguaccagcugugacgacguccagggguugggcugagaagcagacacccuuggggaaacuggcucugucccuccccucccccaucccaggagcugaggucuuggugaggccacagggccagguccacgcaaggacuguccguguccuguccuguggucucuggccccacgugacacccacacgugugguaggcagccuggccuggguuguggcuauggccaggcccccaagcuguccccgaugcccagggcuggugaccacccaggcaggugggggccccacuugguaacagagucauagggcagaacccaccugggcugccacagaaggucuggcugccccugugcccacugcuccccaccauggccaaucagaagagucaggggcuccuggucuuuccgggagggacguggcccagccagcucuagguguucugagcagcucugggacccagcgauugaggggucaggcugggggugucagagccaggguccuccuuaaguaccucccacacuacacagacaguggcccuuuugugggcagcaaauucuugagccaugaaaggaugcuuugggccccuucccucccaggagggcagccugugcagggauggugcucagcagguggacagggccuggggccugugucagggucucaggccugggagcaccagcagaggagauggcggcucccagcagugccgccugaaagugucuugggcuaaggacccacacccagggcugcccugcagaaacgcccccgcagagcccaguggucugugagguugcaggcagggugcgaauggaagggcacaggugcggggcuggcaccugcccgguccugcccaccuccccuccgcccagcccgcaccugcgucuccccacagagcuguccguggcacagugcacgcagcggcccguggacaucgucuuccugcuggacggcuccgagcggcugggugagcagaacuuccacaaggcccggcgcuucguggagcagguggcgcggcggcugacgcuggcccggagggacgacgacccucucaacgcacgcguggcgcugcugcaguuugguggccccggcgagcagcagguggccuucccgcugagccacaaccucacggccauccacgaggcgcuggagaccacacaauaccugaacuccuucucgcacgugggcgcaggcguggugcacgccaucaaugccaucgugcgcagcccgcguggcggggcccggaggcacgcagagcuguccuucguguuccucacggacggcgucacgggcaacgacagucugcacgagucggcgcacuccaugcgcaagcagaacgugguacccaccgugcuggccuugggcagcgacguggacauggacgugcucaccacgcucagccugggugaccgcgccgccguguuccacgagaaggacuaugacagccuggcgcaacccggcuucuucgaccgcuucauccgcuggaucugcuagcgccgccgcccgggccccgcagucgagggucgugagcccaccccguccauggugcuaagcgggcccgggucccacacggccagcaccgcugcucacucggacgacgcccugggccugcaccucuccagcuccucccacgggguccccguagccccggcccccgcccagccccaggucuccccaggcccuccgcaggcugcccggccucccucccccugcagccaucccaaggcuccugaccuaccuggccccugagcucuggagcaagcccugacccaauaaaggcuuugaacccau

SEQ ID NO: 192156 - RNA, 23969 nt, Homo sapiens
cggaagugcguggccgcccggggccauggcgacacucagcuucgucuuccugcugcugggggcaguguccuggccuccggcuucugccuccggccaggaguucuggcccggacaaucggcggccgauauucugucgggggcggcuucccgcagacgguaaacgcgcguccacggugccaacgcugggguuccaggaccgggcagggucagaggaugggaugggggcggggcggggucaggggccagggagaugggauggggucaggggcaggcccacgggauggagggugguccggggccagggagauggaauggagcggaguuauggggcaggggccagggggaugggauggagcggggucagggggcaggggucaggggaaugggauggggucaggguucuggggcaaggaauguggcggaguaaggggccagggugaugguauaggggcagggggcaggggccaggagggaugggaugggggcggggcagggaucagggcgaugggaugggaugggggcggggcaggggccagggugaugggaugggaugggggcggggcaggggcuagggccaggaggggugggaugggaugggggcaggaacgggggcccgagggaugggaugggggcggggcgggagccggggccaagaaggaugggacggggacgggacaggggcaggggcaggggcaggggccggggccgggcuggagucugggggaugggauggggcgggggcugggggcagggucgggccagcggguuggcuguagucgaggcugcgucacugcggcccgggucugcaggcggggucgucugcgaggcccggggcgcagccucgggagcccaggaagggggccggguugcucaggcugagcgugggcuggcuccggaggccccugcaagugacacggguccaggccugggugugcggagccgggagucagugccgggcgggcgcuccgcagugaauucucagggccaagacgagcuucgcggccgcccuguggcugugggaucuccaagcggaccccgggaggggccuggacgcagaggugugcacggccccucguggcguucgcaggccugggcgcugcacgcagcuucacucgcgacgaugggaguauggaaaaccagcgcagagcagggaaaggagagcgccagggacaggguuucuguagcccuuggggacuugucugugccuuggggacuugucugugccuuggggcgcuuuguguccuuccucuagggcagugaucuuaaaguguguccuggaucucugagcuuuuguagccguuuuaauaguaguaccagaguauuauacgccuuuuucacuucucaugaaugcacuguggaguuuuccuagaaaccacuugaucugugaugucacaacagauugaaugcagaaacggguaugggaauccagcugucaccaaacccaaaagagauuugcaaaaauuaagaacaucaucacaguucuucuaauucauuuuuuaaaauacacuuauuuuuuauuuaaauaugugguuuuuguuaacauguaauggcuucuuauuuuuagcugaauuaaauacuuguagcuuuaacgucuaacauaggacguaucaauagacauagugcacauaaccagccgucagucauuguuuccaguguaaaggggucuuuaaaccaaacaguuugagaaccauguggguacugauucuuggguuccagucacugggauuccucugccuuaguguugaacuauugcuaauuguuaaaacgauguuagcaugucugcugcuucugcuuacaggcuccguaaguaacuggucauagagaaacaggccacucacugccuucacaaacuaggaaccauuguuaagugccuagagucgggccacgcgcugagacuugugagcagucggguuuuccgugcagaaaccucagcauuugagaccugugguccuccuucucccugcucagguaucuucuguaugacgucaaccccccggaaggcuucaaccugcgcagggaugucuauauccgaaucgccucucuccugaagacucugcugaagacggaggagugggugcuuguccugccuccauggggccgccucuaucacuggcagaguccugacauccaccagguccggauucccuggucugaguuuuuugaucuuccaagucucaauaaaaacauccccgucaucgaguaugagcaguucaucgcaggugaggccgagcggcacgcugggaggccgugguugcuuaacuggggccaggcagucauuucuaagguagacaucagguugggcuuacgauugcauccagccucaccagcauccuccagugcccagugcugcugccugaggccuguggcagcaccuccuccguucaggagcacagucccuuucccacgcugcagugagcuucccaaaauguuucucggaaauggaccugaaguggaugagcuuugugcccccucaguuagagccgcccuuacacccuaagaaagcggccaccccuggguguuauagugacaggacucggcucccugugcgaaaggcuguuuuacguucaggaagacgcacugcguguggaguaugcuucguggugucucagugcagcgccagggauaaaggucugucucguuuaauuuuguguugcuuaaucuuuucaguuaauuuuaagagaagaauuaaagcucuucuuagaaugaagguauuuagagcuuuuuguguugcguuguuuggaagagauaaagguaagugaugcuuugcugcugcacuugagaggccuugaagacgaaugaguuaguuuugagucaggcuccugcuuuccagcaucuguugaguucuuacucgacagccacucucggggcuuagagaccuuugcucccugccaaggaguguggcucccgugucaucauuuuucaaggaugugguucucguugcacccuagaucuugucacucugaaauguuuucugugucaaggucagucuugugagugcuaggggcaugcaacaacaggcgguaaccuccaacauccuuguugauaccaagucagaaagucugcugcuuguaaaaagcauuccuggagugcguccuuuccugaguugacuuuaaaauuugcuugugaguccuggaagaugaaagcugugguuggguauugggucuaacuagcagccagcccucggucugaacauuggguuauaggaacccagagaugcuauccuuaccucccuuugguaccaguggguuuccugacagggaagcggacaggucugggccuugggcauccaagugcuugggaaggucugggaagacagaugcuguguaaugagcuucugaggcacauaugcuggucucacgcuuaccugccauccaccagccuggggcuuugcugagcuguuuccucgccugugagguggggaaggaacugggugccuguccuagggcgaggcugccaagagacugcacacggugagcuccugauguggcugacauagcgcccagcgugcaggaucuucaccaccucccacuagccuaaaagaagcccccgcagcuguggccucaggcccuuaggccacgcagcccuuagcccccagucaugagugagcaaaaaggauaccagaacuucaccuucgcgaugcucccucccgcuuuguuccugccccagaacuucaccugcgcgaugcucccucccgcuuuguuccugccccagaauuucaccugcgcggugcucccucccgcuuuguuccugccccagaacuucaccugcgcggugcucccucccgcuuuauuccugcugccuuugagcagaucuuaauugcugaccucuugggcgucacagugccaccuucuuggugcgggucgggccguggguaagaggcacgacuccugcucaccugagccucuguccccgggggaggcaggacaccagugcaguagaugguggccgagggggugaggagcgcugugggaaaccagggggguaggggacaguggccucacagagggccggagggcgagcccccaaggggagugguccuggcagggaacagccuggaccacggcgugagggccggaugggcucacacgggccccugugaggauggggccugcugcagccaggcagggguagggccggggaaucggguaccagcuccacaccaccccccgccagcugcaguugcacgcugauggcccugugcccucauggcaugugcucugcccugucucugcuuuugugagccuccuacacucccuuugggaauagggugguguacaguaguaagagucagcugcuggugacugaugcaugcccguaagugagcuucugaucgcugucacacugccuggcuuuucuuggugucuuucagaaucuggugggcccuuuauugaccagguuuacguccugcaaaguuacgcagagggguggaaagaagggaccugggaagagaagguggacgagcggccguguauugaucagcuccuguacucccaggacaagcacgaguacuacaggugccugcugaggcugcucccccugccgcaggugcccccccaccucccccugccgcaugcguccccccccccccgccucaggcgccccccgcccacuccuccccaccaccgugggugccccccgcccccccugcagcaccccgccuccccccgccacggugucuucaccccccacuccccccggccgcaaccgccucccccgcagugcccucgcugcccaugcugguugcugaugcaggguucugggcguccccuccugggcauccugacaguguugcggcggcccuuguggugguagcgcuuguggcugcccacaccguuccucguccuugacaggcgguuccccuuugugcugaggccuggagaaugggccgugaugaacaucuggcugagaccccgugccucuuucccugugucuuuucaugcauuuggauguugccacagggauggaggucuugucagucccaagugucgauugccauuaaaggcucugacacuaccaggccuccuguggaaaagcugucaguuaacagccuccauguguccagugccagggcagcuggcucuaaagcauggcaggugagcucuugggaagggcgcgguugacuuggcugacggucacagccaggcuggcccugaaggugcacagggcugccucuguccggcucccucugccuccccggccaucccgccagccccuaucauggggaaagccucagugguccaucagccugagagacacucaugggcuucuuuuaaaauuuuacuagaaugucacgaucugcagucacgaucaguaaguuuuccuaaagcagccgcguuucaucaggagcaagccacagugugugcgugucuagacuugauuuguuuuccuugugaaagcaaaauaaacugauagagcugcuguggguuuuguuuuccagaggaugguuuugggguuaugaggagaccaggggucuaaacgucuccugucuguccguccagggcucagccuccaucguggcgccccugcugcugagaaacacaucagcccggugagugccccaggccccccgggagcagccuggaggcuguggcgucugcuccgugcaugcugggcugggggcucuccgcccauacucccgcaucccuggcccacccaccucacagacagcggacccugggggcccugggggguggugguuagggaagugcuugcaugugucucugcgaaacagcccagugggugcagugggugacguggacagcgggugaggggcacagaggugagggcucggcccggccaggugcacagggaggggcugagcugggcugggggcggcggggagcucaccaugagacuguucucgauuuguagcacuugggcagcuuuuaccaguaccuccccccuccccacacccaacacccacuguuugaucuguuuucugccucacgggucuggggaggaucaugcagccaccuuuggccaugcgucugccucaaguggucgccggccuggugagcugggccucgaggguccacccaggaggcugggguugcagacaagucaguaccugaugaugucguaaacucuggagggaauuguugauggccacguucuuagaacuugcugcagacugggacccucuccgucaccucccuugggucuucugaaucccccagcaggcacugugagcgucucccauagaccaggcauagcagggcacgggugccccucgcacuugcccacguugaggcugccuugucugcugucgugcccugugugugccucuagaggccaucagccacgauccuguugcacaucacagcuggcucgguaucacccuggucaguaacagcugccgcuggccccagcgggccgggaccacauggucucagcugcucugggccuuugugaaggcagguggcuccaucacaggcccgcgugucugcugcucagccagcccggcuguugcagacagaacucagagguuguggagggagcuaggcugaauuguuuugguuguugagaugcagcuuuaauguuguccugggacuggguucauuucaugacaauauucggguuuuggaagccagucugccuacguuuggggccuguggaacagucuugccagucaguuuuuuugacucacauuuacagguuagaauggagcugagcccagagggggcuuccaacuagaugguccugauuuaggagaaacgcuucugccggggagcagggggaaaaggcgcaguggaaaaggaggcugaugaugggcggugaggucaucugcccccagcacccagggaaagucucuuccggggguuaaagcccuaaugggaaggugaagcuaucaagccgucaggagaggagccucaccaccguggggcagaaagcuuucuucaacaagaugggaaaagcauggaccaaaaaagaaagauugguaaagccaguuacuuuaaaaucaagaacuuuuguccauuagaaaaauggagacaggccucagagagggagguccugcagcacauuugauaaacuaaggacucucugggauacaggagacgaaacucagcgagugagggacgggcagccuggggugaggcgaguccaagacgggauccgugcaauugagacgaaacccagcgagugagggacaggcagccuggggugaggcgaguccaagacgggauccgugcaauugagacgaaacucagcgagugagggacgggcagccuggggugaggugaguccaacacaggauccaugcgauucaggaguaaggacagcugcuguuaaugcgagcaggugcccccauugcugucaugcucgggaaaccaaccgcugucgggaggacaggccugcaggggcucaaaggcugcuccuggagcaagaaucugguaaaacccugggaacccagugcacccugaaugcgggacaugcacccgcagaccccugcccaggaacguucauagccuccccggaccaggaaaacacgugcaccccucagccacgcacuggauagagugugguagauccacagcugaagaugggcaaccugcugccguguucaacaaagagaaaucaagauauaaugcccaguaaaaaaaaagaaaaagauaaauguagucauguuccaugugcaugaaggucaaagacagucccgugcaucggagggagagaugggaggaugccggggaggccccugaggacggggcagagcaagugugugaagcgcuuucuuccuccuuguuccuccacccgggugggggcugcaccguguucauuuuggagcaguuugucuaccugugcccgugcggaauguccucuacccgcgcccguguggaaugugcgucuugaagugcaguauugcauuucauaaaaagcccuuaaaacggcauuagaagcagggccggaggcacccacugaauccagcuacacccaucucuccagaaaucgccucacauggccgccugugcaugcagccaucuuuugaaacacacguggaaucaccacacgugcccucuccaugcgguuuucaguuugcccuuucuucccacccagccauucaccuggguauuacgacacauggacaucaccucguucuuuugcaguugucuguguacagauggaagaaaauguggcuuuugguuguuuccagguuucuguagaagagucuuugugugaaccaugagggcguaaaacuguaggaugccacccagaagaggauggcugggugugcccuuggugcaguccucagaguccccgcaguggccgugcacggcugguucccaggcagccacgagggccgagagcuuccaucuguguggauccaguagcaaaauguggaauccuugcucuguucguguguguuucuuugauuucagaguaaaacuacacuuuaaaagccuuuugaaauguuauucuauaaaaugccaacuuagauauguugcucauuuuuucucuguagagauuacauuuuuuuguuuguuuguuuuuuguauuuuuuuugagacugagucuugcucuguugcccaggcuggagugcaguggcgcgaucucggcucacugcaaccucagucuccuggguucaagcgauucuccugucucagccucccaaguagcuggggcuacuuguggcaugcaccaccgcgcccggcuaauuuuuuuguauuuuuaguagagacgggguuucaccgucuuagccaggauggucucgaucuccugaccucgugauccgcccaccuuggccucccaaagugcugggauuagaggcgugagccacugcgccuggccaaaauuaaaauuuuuauuuuuccuuaaaaauuucugcguuuuuguauuccagccuuuaccaccccaauauucaggucuauuugcucacgguccauuuuguguguuucguuuuuauuuugcaucaagagcccuggggggaguuuggugagacgguuggcucaauggcuggaauaggagaggcacuucccacguggaauuagguaacgugacagucacaggcaccaggaugacuugucagacccaaacuggagcaaggaaggcacugaggaggaggcaccugccugcgagucugagauaaaggccagcuggagggcucucugaaauaaccccaggacguuccucacgugcuucacgcaccucaccuuucacagccgcugcuucagucgugugcccguguuccugggacuagguuugccaccggacaaggguugcaguaauucggacgagacgcuguggaaagaaugccugcccaggaauggcgucucuaccacggaacagaugcagcuccggcuuugagcucgagucagugaauuuguuuccaggcagcuuaugugaaccucuccuuuuugucaaagaaaaccuucccccacccuccccuccucaggcacgccugcagcuugccauagccgucgguggauccuggauuccaagccuuuugcccacugucaaauacacuccucaaauuaggagauacuuuucucugaugucauucuguucguugacaguaggcauuaaagcccucucagaaccgugguguggaggccagacagcagccugccugugucucagccauaaccacccaacgcgcccugguuagugucccucggagacuuggucucugcuuccucggcccgggguucucccaguuugugcucugagagugugaaugucaucauccuuaacucuuauaacuguuuauucuucuguuguuuaaaaacagguccgugauguuagacagagccgagaaccuacuucacgaccacuauggagggaaagaauacugggaugugaguguuuccucgggagcguuuuucucaguuaguguauguugcccauuauuuagcuuuugaaaauuuaaaacagucgacagcucuuuuugaaccuugcugauuaaaaccaucauuuuaagccauggauuugggcaacugcggugacugugccacccccaagccucacguggcugcagagccagguccucgggagcccgcagggccacccagcucuccccucugaugccacaggcccugaaugcgguggcagcgcccuggagucagccccggagucagugacuccgucaguggcuggaacguagaccccuccuuucuccucucuuuagcuuugaaaggugggacuauucucugcagcgggucuuuuccguuggcguugauuuccgcauugauggggugacuucccauagccaccccugguucugugagugagugggagcagagggcgggaaguggcugcccccucccguggacacagcaggccugcugacguguucaccagggcagcagcuuguaaagccggaaccugccugcaggagacacagucccugcucacgugggacuuugugcaggucagucccaccccguuuggcaaagcaggaugugcuaaccgccuaagcuagaagucgaguuggggagagacugaggggaaggagcugcacacaguugugccagccaggggcaacggccagcugagcccagugugugccgcagcuucccacggcaggggcuggcagagccggcaggggugggcggcuugcccugcguuggcuucaugcaggagacccuccaagagccuccaccguggauggcgcugcuucucaggcgaccguggaugacgugucugaggggcuuguuccagcugcgggggugggugguggcagcgacaggagaacccgcuccgggagggcugcguggcgggcgggcguguucucagccgagccgucgccguuuccacagacccgucgcagcaugguguuugccaggcaccugcgggaggugggagacgaguucaggagcagacaucucaacuccacggacgacgcagacaggauccccuuccaggaggacuggaugaagaugaagguagccccccucccuuuuguuaauuagagaaaagguaaagucucucuggagaugccccacacucaggccuuccauguaaagucacagcaggguuggcgugucugugggcguggaugccucggcgccucucuggaaugugagucacaguaaugaccugcucucgggaggcgccgggacccuggggcccucgucaugugcagacucagggagucacucggccuggcuuuaccuuuaguaacacgggcagucauggcaggcccagcggacucaaagguguucucagagcgcggcaaggccaggagcgcggaagcaggagcucgagguggucagaggcacguucggccuuuuucccucuugacuugauugauaaagagaaaaaagcagcguucaccuggacucacccaaaagcaccaucagugcuguuuuggucuagaaucauccuuuucuuauucuuuguauauauuuuuaaguguuuucugaaaguuugaguuuuucugugauguaauuucaacaaauguguugcuuuuucaacuugauauuguuuuuaagcauuuucagugucuguuuuuagcguuuuuuaaacaaaacuuucauagaagugccauuuuacucgcuuguucuuuaugggguauuugagcuauuuccaaguggaauagcauucauuguuccagcaauaauuaaguuacuuggacaguuuuuacuggggaaaaaauauagaagauuuuuuuucauuuuuaucccacuuguguuucuuuucaguguuuuuuuuuuauucuuuuuaauuuuauuuuuaauuuuauuuaauuaauuuguuuuuguuuucguuuugagacagagucucacucugucgcccaggccggagugcagugacacgaucucagcucacugcaaccucugccucccggguucaagcaauucuccugccucagccucccgaguagcugggaucacaggcgcgugccaccgcacccggcuaauuuuuguauuuugaguacagacaggauuuucccauguuggccaggcuggucucaaacuccugaccucaaguaauccacccgccuuggccucccagagugcugggauuacaggcgugagccacugugccuggcuuauuuuaucauuuuuuuuuuuuagccuuaaucauuuuuggggagcaggugguguuugguuacauggauaaagugguaguuucugagauuuugguacacccaucacccgagcaguguacacuguccccaauguguagucuuuuaucccucacccccuccacucuuccccucgaguccccaaaguccauugugucauucuuaugccuuuacauccucauagcuuaguucccgugagaacauacaauauuugguuuuccauuccugaguuacuucacuuagaauaauggucuccagcuccauccagguugcugcaaaugcauucauuucguuccuuguuauggcugauguaccacauuuucuuuauccacucauuggucaaugggcauucaggccgguuccauguuuuugcagcuguggauugugcugcuauaaacaugcauaugcaagugucuuuuucauauaguggcuucuuuuccucuggguagauacccagcagugggauugcuggaucaaaugguaguucuacuuuuagcucuuuaaggaaucuccacacuguuuuccacaaugguuguacuaguugacauucccaccaggagugucgcaguaucccuuucacugcauccgugccgacauccauuauuuuuggguuuuuaaauuauggccauucuugcaggaguaagguaguauccuguugugguuuucauuugcauuucccugaucauuagugaaguuaagcauuuuuucauacguuuguuggccauuuguguaucuugagaauugucuauuccugucccuagccuauguuuugaugggauuauuuguuuuuucaugcugaucuguuucauuuccuuguagauucuggauauuaguccuuggucggaugcaaagugugcaaguauuuccucccacucugggagcuguucgcugauuguuucuuuugccgugcagaagcuuuuuaguuuaauuaugcccuaucuauuaauguuuguuuuuguugcauuugcuuuggguucuuggucaggaacucuuugccuaagccagugucuagaagaguuuuucugauguuaucgucuagaauuuuuaugauuucaggucuuagauuuaagucuuuaauccaccuugaguugaugauccaguuucauucuucuacaugugggcugccaauauccccacaccauuuuugaauagaauguccuuuccccacuuuauguuuuuguuugcuuugucgaagaucaguuggcuguaaguauuuggcuuuauuucuggguucucuucugcuccacuggucuagguaccuauuuuuauagcgguaccaugcuguuuugguaacuauagccuuguaggauaguuugaaguugaguauuguguacuuccagauuuguacuuuuugcuuaguaguuuugcuuuggcuauguaggcucuguuuugguuccauaugaauuuuagguuuuuguuuuuucuaguucugugaagaaugaugauggcauuuugaugggaauugcacugauagauugcuuuuguaguauggucauuuucacaauauugauucuacccauccaugagcaugggauguauuuccauuaguuuuuguugucuaugaauucuuucagcaguguuuuguaauuuuccuuguagagaucaaguuuuguggguuuuuuugguuguuuuuguuuguuuguuuguuugcagcuguuguaaaaggaguugaguucuugguuugauucucagcuugguuguuguugguguguagcagugcuacugaguuguguacauugauuuuguguccugaaacuuuacugaauucauuuaucagaucugggagcuuuuuggaugagucuuuaggguuuccuagguauacaauuauaucaucagugaacagugacaguuugacuuccucuuuacugauuuggaugccguuuauuucuuucucuugucugauugcccugacuaggacuucuaguacuauguugaauagaaguggugagagugggcauccuugucuugcuccaguucucagggugaaugcuuucaacuuuucccccgucaguauaauguuggcuuuggauuugucauagaugacuuuuauuaucuugagguaugucccuucuaugccaccuuugcugaggguuuuaaucuuaaagcaaugccggauuuugucaaaugccucuucugcaucuauugaaaugaucauaugauuuuuguuuuuagugcuguuuagguggugugucacauuuguugacuuggauauguuaaaccaucccugcaucccugguaugauacccauuugaucauguuguguuaucuuuuugauauguuguuggauucgguuagcuaguauuuuguuaaggauuuuugcaucuauguucaucagggauauuggucuguugauuuauggaggauucccucuuucucugucuuuuggaauaguuucaguagaauugauaccacuucuucuuucagugucugauuucagcugugaauucauuggguccuggacuuuuuuuguuggcaauuuuuaaauuacugucucaaucucacuacuuguuauuggucuguucagaguuuauauuucuuccuggucuauaucuagaaggguuguguauuuccaggaauuuauccucuugauuuuccaguuugugcgcauaaaaguguucauaguagccuuggaugauuauuuuguguuucuaugguaucgacuguaauaucucccguuuuguuucuaauugaccuuauuuggaucuucucucuucuucauuaaucucacuaauggucuaucaauguuguuuaucuuuucagagaaccagcuuauuguuucauuuaacuuuuguauuuuuuugucuguucauuucaauuucauuuaguucugcucucaucuuggugguuuucuucugcuggguuuggguuuguccuuguuucucucauuccuugagguaugaccuuagauugucugugcucuuucagauuuuuugauguaagcauuuaaugcugugaauuuuccucuuggcaccacuuuugcugugucccagggguuuugauaaguuaugucaguguuauuguucaguucaaagaauuuuuaaauuuccaucuuaauuucauuguugacccaaagaucaggagcagauuauuuaauuuccauguguuuguauaguuuugaggguuccuuuuggauuuaauuuccaguuuuacuccacuguggucugagaggguacuugacauaauuuugauuuucuuaaauuuauugaggcuuguuuuguggccaaucauaugguuuaucuuggauaacguuccauaugcuuacgaacagaauguauauucugcagcuguugcguagaauguucuguaaauauuuuaguccacuuguuccaggguauaguuugagucuauuguuucuuuguuggcuuucugucuugaugaccuguccagugcugucaguggaguauugaaguccccacuuauguuguauugcugucuaucucauuuuuuaggucuaguaguaauuguuuuauaaauuugguagcuccaguguuaggugcauguauaauuaggauuguggcauucucccguuggacugauccuuuuaucauuauauaauguuccuccaucuuuuuuaacuguuguugcuuuaaagucuguuuugucugauauaagaauacuacuguacucgcuuuugguguccauuugcauggaguaucuuuuuccaccccuuuaccuuaaguuugugugaguccuuauguguuaggucagucucuugaagacuuuugccucacagcuuucagguggauuuuuuuccauucugccauucuguuucucuuaaguggagucucuaagccauuuacauucaacuuugguauugaggugugagguacuguauucuauucaucauacuaguugcugccugaauacucuguuuucuuucuuuuucauugcguuguuuuauaugcccugugagauuuaugcuuuaagaagguucuauuuuggcguauuuugagguuuuguuucaagauuuagaacuucuuuaacauuucuuguagagcuggcuuugggaguggugaauucucucagcauuuguuugucugaaaaagaugaucucuccuucauuuaugaagcuuaguuuugcuggauauaaaauucuuggcugauaauuacuuuguuuguggaggcugaagauaggaccccagucccuuguagcuuguagguuucugcugagaaaucugcugugaaucugauagguuuuccuuuauagguuaccuggugcuuuuggcucacagcucuuaagauucuuuccuucaucuugacuuuagauaaccugaugacugugugccuaggagaugaucuuuuugugaugaauugcccagguauucuuugagcuuccuguauuuggaugucuagaucucuagcaagaccagguaaguuuuccucaauuauucccucaaauaaguuuuccaaacuuuuagauuacucuucuuccucaggaacaccaauuauccuuagguuugguuguuuaacauaauuccaaauuucuuggaggcuuuguucauuuuuuuuacuauucuuuuuucuuguuuguuggauugggcuaauuugaaaaccuugucuucgagcucugaagcucuuucuucuccuguucuagucuauuauugaaacuuuccaguguauuucguuucuuuaagugugucuuucauuuccagaaguugcaauuguuuuuccuuuaagauaccuaguuaucuggagcauuuuucauccauauuguuguuguuguuuuuuuuuuaauuucuuuaaguugguuuucaccuuugucugguauguccuugaguagcuuaauaaugaaccuucggaauucuuuaucuggcaauugagagauuucuuccugguuuggauccauugcuggggagcuacuaugaucuuuuggggguacuauagaaccuuguuuugucauauuaucacaauugcuuuucugccugcuucucauuugggcagacuacuucaguggaaagaucuggaacucacgggcuacuguucagauucuuuuaucccacggggugcucuguggcgcucuucgccuuccccuagggauggggcucccugagagcugggcugcagugauuguuauugcucuucugggucuagccacccaguggggcuaccaggcccugggaugcugcuggggaaugucugcggagaguccugugcugugauccgucuucgggucucccagccauggguuccagcaccugcucugcuggagguggcgggggagugaaguggacucuggggggguccuugguuguaguuuuguugagugcacuggcuuucucgaaugcugguuaugcugcagugaaguugucacguggacagacucgggaccuguggacagccaggagguugcagguggugggauuagcuguugcuuucuccuuccuuggagcaggguuguugguuagaauuugcuguagccauuugcguugguggccuccagccaggagguggcacugucaagagggcagcagagcauucuggcucccggggaguuugcagcugugagcugcuuuguccacaggauccgugaacucuuuguggcacgucccugcggugguucucggaggaaaaguucacagcgugagccuccacaugcuguucucuuuuuaaauauuuuucuuuaccucagauaaaaugauuucugguaauuaauacugcuucacugucuucuuagaaagacaucuggucgcccccgagauuccaccugaaucccuuagacagcccuggagccaccccguggaggaggccacauggaaagggucaucccucugcgucucgagucccacccggugcccaggaugagccccgagcccgccugucagcuucugcauuuccuugugguucuuugcuaggucaagcugggcuccgcgcuagggggccccuaccugggaguccaccugagaagaaaagauuucaucuggggucacagacaggauguacccagucuggaaggggccgugaggaagauccgcagccucaugaagacccaccggcuggacaagguguuuguggccacagaugccgucagaaaggguauggagcuucaaugcuuucguuucuuuccuuucuuuuaauuuauuuuuuuuauugauaauucuuggguguuucucacagacggggauuuuggcagggucauggaacaauaguggagggaaggucagcagauaaacaagugaacaaaggucucugguuuuccuaggcagaggacccugcggccuuccgcaguguuugugucccugauuacuugagauuagggauuggugaugacucuuaacgagcaugcugccuucaagcgucuguuuaacaaagcacaucuuguaccgcccuuaauccauuuaacccugaguggacacagcacauguuucagagagcacaggguuggggguaaggucacagaucaacaggaucccaaggcagaagaauuuuucuuagugcagaacaaaaugaaaagucucccaugucuacuucuuucuacacagacacggcaaccauccgauuucucaaucuuuuccccaccuuucccgccuuucuauuccacaaagccgccauugucauccuggccuguucucaaugagcuguuggguaccccucccagacggggugguggccgggcagaggggcucuucacuucccaguaggggcggccgggcagaggcgccccucaccucccggacggggcggcuggccgggcggggggcugacccccccaccucccucccagacggggcggcuggccgggcagaggggcucuucacuucccaguaggggcggccgggcagaggcgccccucaccucccggacggggcggcuggccaggcggggggcugacccccccaccucccucccagacggggcggcuggccgggcagaggggcucuuugcuucccaguaggggcggccgggcagaggcgccccucaccucccggacggggcggcuggccaggcggggggcugacccccccaccucccucccggacggggcggcuggccgcccggggugcugacccccccaccucccucccggacggggcggcuggccgggcggagggcugacccccccaccucccucccggacgggguggcugccgggcggagacgcuccucacuucccagaugggguggcugccgggcggagaggcuccucacuucucagacggggcggccgggcagagacgcuccucaccucccagacggggucguggccaggcagaggcgcuccucacaucccagauggggcggcggggcagaggcgcuccccacaucucagacgaugggcggcugggcagagacgcuccucacuuccuagaugugauggcggccggaaagaggugcuccucacuuccuagaugggauggcggccgggcggagaugcuccucacuuuccagacugggcagccaggcagaggggcuccucacaucccagacgaugggcggccaggcagagacacuccucacuucccagaugggguggcggccgggcagaggcugcaaucuuggcacuuugggaggccaaggcaggcggcugggagguguagguuguagcgagccgagaucacgccacugcacuccagccugggcaccaucgagcacugagugaacgagacuccgucugcaaucccagcaccucgggaggccgaggcuggcggaucacucgcgguuaggggcuggagaccggcccggccaacacagcgaaaccccgucuccaccaaaaccagucaggcgugguggcgcgugccugcaaucgcaggcacucggcaggcugaggcaggagaaccaggcagggagguugcagugagccgagauggcagcagcacaguccagcuuuggcuccgcaugagagggagaccguggaaagagagggagaccguggggagagggagagggagaaggagagggagagggagcacguuucuuuccuuucuucuugaucccugguucuguucuggguagaccuggaacuacccagauccaugaagaucugcaugaucuucaacuguaauuccugggaggguaaagcugaguugugugucugcaccuuuggagccaguuccuaacgaauuaaccagaagccaaguacgcaugucugucugcuaaagagucacguaucuguccuuacuggaggaucccgguucaaagggucucuccuucuacuuugcagaauaugaagagcuaaaaaagcuguuacccgagauggugagguuugaacccacgugggaggagcuggagcucuacaaggacggaggcguugcgauuauugaccaguggaucugcgcacacgccaggugccugcccacgucacugucggccgagagcgggucggguggcuuucaaagguucuucugucccaaguacucggugucagagcagauggucgccuguguucacaguggucauuuccauacuguuugccuccucgucugagucuccuguagcaucugguucaguguuucccugggcugaaguuaauuguucaucuugccccuuuaguucucaugcacagaauuccuccauagcaggcuguuggcauagcuggccucgucucagaaccucuucuugugucgcauuuucccaucauucccgguuucugccccugucugcccccugcccugagaguugcccgugcccuggacuugggcauguccuuguugcuguguuguugagcauccgugagcguccccgaggccgggagcgugggcccucgugugaucauucucguggggcugccaugagcguccccaaggcugggagcaugggcccucgugugaucguucuuguggggcugccgugagcguccccgaggccgggagcgugggcccucgugugaucauucucguggggcugccgugagcgucccagaggccgggagcgugggcccugcgugcagucauuccucugggguugcugugggagguacgccugggccucuguuccuccaaagaccugccugcccaucugcauaggagaugaaggcugggguuagggugaaacgguuugaguuaaauggaaaaugaaaguagagggaaugaucuuccccgugguuagcacugugcacacgcgugcgucucuguggguuagucugucucucuccugcccgaggaaugcugagcgcccugagccggugccucuucacacaucugcuauuuccugugguguucugggcaugguguguaagacccacagaggcuccgggugaugcugucugcugggugugggucccuuucccuguuaagcagacaggaugcagcgcugacuucuuaggucagggcggaggugugcaggagcccaguuacgaacucaccccugcuucucagguguggccuugggauuuugacugcgaccuuggcggugcugucuccgcagcccaggaagccugcuguggggaggcuucgcacugagcucucagccuccugcccucagcugcgcgaagcgcucggcccagcucacugaagcugcccugccuccgggccggcgcggccugcucuggcaggccccugugugugggguggugagggucuccccaccagugcugcaccccgcagcagcauacaggccuguguggccugcuggcccuguggcucuguguacagcgcugugcauguuacauuugcucuggaaacaucucugggguuugcuuguucacgaaguucaugaagugccgcuggagagccagagaccagcugcgcaggagccggaggaacgggcaggccgcugaccugaggucuggagaaaccccuggagaaggguguccccaccagcccauacagcguguguguggagggggccuugaccuccgugaugucuacugugccucaggauaaggacccgccaugcccuggcuagacagugugugguuaguaggaaucucucauuguucaccaugugacccccaggagguauucgaccugcacuggcgugccuggccugggauuuggugacggagaggagggcucccagggggacaugcggugggacaggagcguggcggcugcugacugugggguguggauggggcugcagcaccaggcagagccccucagggcgccgaugucgagggcaccugagcgaggggugccagcaagggggcggccggcuggugggugcucgggggacggccguguugguuccauguaacuguggaacucauuucacucagcugcuccucucaguucucccugacucuggaaccucugugacgccaguucucccugacucuggaaccucugugauccuuugcagguuuuuuauuggcaccucagucucaacauuuucuuuucggauucaugaggaaagagaaauccugggguuggaccccaagacgacguacaacagguucugcggagaccaagagaaggcgugugagcaacccacccacuggaagaucaccuacugaggaggauccuccagggccgcuccccggacccgacaggcgcggguggaugcagguucugucgccguggagucaccgucuacugccagccgggagcugggcggacaggaccgucccucgcagggucccaggcccagaagaggccccacgccucuagagcugggcuccguccucggcguugccagccgccauggcugaugaagaggcuccgcugcucucggggguggcgguuguuuucaggcagcgucugugaacccacagcucgguugccagcagugcccgcguggugacccagaagcaggaguguuugucaggcucccgcucuggccuuuccagccaccuuucaugucuucauauuuuaagugcauugaggauagaugcaggcgggugagcugcccuccgucagguggacccgggcugacauuucccugggagcuggugcaaggagaagcgucauuuuaaaugucugcagagcgaccaggggccucaugaaucucuccguugcccuccgcgcagcaggaggcugccuguguguuuccuccugggaugcgugcaaggcagaccuggugcugcaaaggaaagggccugaggccucagggagccccguggagggaugacaguucaggcccuacugcuggcacgucagagcacugggaaguuuuucagugacgucucuggggcacucaguggauugucuguaggaaacuugcagcucugcuccucacaccaggcccggcuggccacccacccucgcccccacuggccaccccucccucgccccgacugccccgccccacccucaccccgacugccccgcccucgcccggcuggccgucccugcccucgccccggcuggcaggugcacauggggccuccaggucugccauucgcuauugagaacuagaaaugaggaaggacaguuacgcuaacuccaaaaggcugucuaggaugagcugcuuuaucagggagcuccuuguacccauuuuacagaaaucauuuuuaggucuuugugccaccaccacgaggggcaucugcaaagagggcaacgcuagacacagaauccguggaaggugcagcagugccucagggguccucagggucagggagccccccucacccucuuggcccguuacccuuugugacuuuccaccauggugucgugugacccucagucagguuggugggggcugaguccucacugagcagccacuuuccacaucugcuagaggaacagugacauggacaccugugacagagagaggacaguuaggagggacagacagcucuuccuuucggagccuggcuagucuaggacaucaccuugcugugucuucucaagcuuuuaaaauugacccugaacgugugacaggguccuaugguguuacucaaagcugugcaggguaaaugaugacauauuuauucuuuuuccauuuguucuagaaacagugccuuuuucaucaguugcauuuuccaggcugagagcuguauaaaacauuuuggacugugaccauguaccuuccuuuuuaagaaaaauaaacugcuuuauggaaguuggua

SEQ ID NO: 192157 - RNA, 10459 nt, Homo sapiens
accauuccaacaaagcgcuuuacugagggcacccacuccacagucccaaggaggcagacacaggccugaacuguccacccucuaugucccgaguggugacuccacuccccacugcucagagaucacaccccuucuggagagcuugcaucccuucuggagagcuugcacggaugagugacugucuucacccugggcuuccccaaguccggcgacaguggcugccccagugcugcagcuggcucuggugacgguggcacggcauggccccgagcuugggagaacagcggccugcacacacggucacgcaucaccgcucggcggaggaugggaauaucucauggagaucuggaucucaaccccacaugggacaagggcccagggaccuggcuuuccuacacaccagcuggaaggcugacuccccaucucacgugaaugcuuccuugguuuuggggggcacuaggaagguccccagggccacgggucacugcccagauuguggcauccucauaagacuugcgacucuucccagaggaaagaaaaccccucucagaugcuccaaggacuccccuagucuagcugcuuccugugccaggcccggaccccagggcgaacaggccuguucauccacaaccucacagcugagggcccuccugcaguucuucacaggagagagaaaggaaggcgcaccugcccagcccggccaagaaaacaaaacucucucccaugggugcgggaggcugcugccugccugcugagcagcucagggcagaugucgcuaugggugccagcauucucgaagucucccuugcccaacagaaaucuauccaaggaccaagggcuggaaucggcaaagccauccgugaagaccuccucauucuguggagaaacggcccuugcuuucaggaagacugucacaaccaugccuugggaaacgucaccuccagaucaaccuugggaaaaucuuuuauuagggaggacagccugcaaaauccucccuuuaagagcccaggccagccuagaaccuccagaccacagaaggggaguccuggggacaggacugguguagacaggcaucuccaccgccccgguuagccaguaccuaacacccacuccugcccucggccgauguggcaaaccggggaggcuuuuguguggggccggggcugcggccauggcagccacccuccagcucccgggggcuggggaagacgcugggguccccguggaggcuggagcggcguucagguccugcggucacucggcgugcuccugcaccucuuccccacgcagggccugcagccggcugcccacagucugcugcacggccuccagccccucugcauccagcucccgcagcagcagcaggauggcagucaggacguucugagggcagaggggugcggacuaagcccacccggcacggcgaggcugcuucccuccacaagggcuggggccuggccagcggugccccaccacggagcgacuggucccgggggugugggccguccaagugacugaccggcacacucggagaaucugagcagaggagccccgccuguggacgcguguguggcaccucuuccacgugacuccuguugcccucagcccagcagggcccgggcccacauuccacagaccaggacagcaggagaggcugaggggccaggacggcuccgugcggggcacguguuacacgugugugcgcauucacagacccgcacacgcagcucccccuggggcacagcucuucaaggcccugugaggcuccaugcucccuccccacggggcccugugaggcuccaugcucccuccccacgguuucugugcagugggugcagugggcagaggcagccgcggccccuagcggcccgccacucacccugccccuguggcugcucgaggcaucccuggcugagagggaaggaaacuggccccgggaaggcggcuucaggccacguucauccugggcgccgcugcugagagggagacaaaggcgugugagggucagggggcucguggcaccgggggggccucugcaaacccugucugcgggucgcauccaagcaaaggaggggcucauacaaaucccaccuggcacacgggggcaagagaagggaggcaacuccugggaggucaggggcuacagauggcagcuccuggagagcccggcacuuacuucaccuguggggcgcccucccggcacccuggggcuccccagcuguaacaccuuccacccagggcuucaggggcaggguggggggcacccgaacacacaaaugccgggggagagcuccugaccauggggucaggcccugugccggauggcagaugccuaacagagaucacaucccgaugcccccaccacaggcaccagcagcgggugugaucugccaagcaggagagaagugcccagcuucugucaaaugcguucgugacccgcugccaacugcccugggaggcgccggcgucucacugcagagucagcccuguggccccuccacggcccccaggcccaaggccauacgggcacugauggccgugcccacaaaccauuccagucacuguggcccuaggccaccccccccaccaggggcucccugcaccucacgagcucuggugcugugagccuucucugugccagggcacggggccuggcucacccccucuccugcucccuggcacauccgcuguugggcaaaacauggaccugccacugaaaucacuaccugggcacugagucacucccagagaauauggaugagaacagacacuccccccggauaaucccugucccucacuucccagagacgcagcucacgggaagccccauucacuccccgugggaggacccugggggacagggaugggcugcggaguccccgcugcccuccagccucacguugccuccuccucgcuguccagcgggucccggccagucucagcagcggagcugagggagcucagugugcagcauagcuuggggccgccguggccugugcccucucucucuggggccgcagugaucuccucucccucacucagugcacgggacagcuccuccuccgucacagcuuugggaugaaagacagaagacagcaugaguggccucacccacgugcaggccacaugcacugcagcucccguccucacuguggcuucaggcacagucugcuugugaaaugcaugcacguguauccaccuccagggacaacucccagaguagcagccgguuccucacugucccauccccagccuggcacaggcugacacacaacagaugguggagggcugcucaggaaucucaacaccagccuuggccagaagcaaauacuccucaaaaccucaacuaagacacaauagaaaaaggaacagaccauauugaauuuauuccauuucucucauauaucaauuucccugaaguuuauauuauuaauaucaauaaaauugucugggagaaaauaguggugucuguauaccugacaaggaugagacacuagugugcugagaaugccaaggaugaacaaacagcaugaaaccacagccuggaaaacugugucggugcuggcgcuggcuagaggaggcacgagugccuccaauagguggagcgcagcagcaggcacugcggugcugggacggccccuccccacggcaggggcgcgauggcaccgccacccuagguucacaguggcccguggagccugcccagucccuguggaccagugcgaugcugcuugccagauacugacgcccccgcucgccauggcgcauggcgauggucagagcagggcugcuacucacagaagcaaaagaaggaacccuuuugcuuugcuaccagguccugcggucguugggggauacccaaacugucagucccaggagggacccuacgcugcgcugcugcauucggguggcgggaucaagaggagacacagaagccaggggaacagccucuggaggagacuucacaggacacaucuaugucccgccagaccagguauuugcagaaaaggagaagagaaaagagggcuggggacauccccuuccagggauuguuuugggagggccggugacuccgcugcggccaccuacccugguuguccagcuucuguaggcgcggcagggugcgcagcacggucaugcgguagcggugggggcuggugccgcagcacggguucucggccagccacagcacccgcagacgcggcagccccuucagguagaagagcucagccaggcuggggaugcgguuccuccgcagguacagcucacucaggcgcuggcaccggcucacaggcuccaggguggagaugcuguugacacugcacggagaccagcacagucagcgagggacguggccagggcccccagggccaccucucaauccccacccccaguaaaaggcacucaugggaccugugucccugcccucuccugagaagccuaaaucggaugucacaagucacgugcagcaggaccugggccgaggagagagcuguaggaaggccaggcccugaacucaaaggcggacugggguggaccccaccagcaacagccccuuggcccgacgcuccacaucagcuccucagggcgcuagagugcgggaggugggggauguggcccuccuucacaggugaggaaaauuaaggccucucaggggacauaucauguugccccaaagcagggagcggccagaaaaacucauggcaaaaacuaggagccagcuccacgugacaugggagugagcacggaccuuccaaacccccacuugagggcggcaacacuggggaugggccucauuuccauucuacagaacguggacgcgucagagaagagaaacagcaggccuggagcggggaccugcaggcuuuacccugcagcgugggguccguccccuccacaagcgaacacgcggagccgcucccgcaggcccucaaaggcgcggagccagggcccccugccuggagggcugcacucgcguccggcaggcgccucagaagggcggucaccaggcccccaugggcagccugccguccugagccccccuccccaugccaucccuucacucgggguuucccaggucucaugcagcuccuagcuaugaggccgccccauuuuaccaagagcaaaacuccggcugugggacucuuuccaggauggggucugccucaggcacaggcagcagcgugauguaccgaccgcguccgcggccucgaggcuuccugcuccgcuccagugcagucaggcgugcaggcaccacgcaccugagcucggucaacaccccugggguccugucccucccgagaugugacagaaauggccccacacacgagcggccugaugcucggaggcccuguggccccugggugacucagugagcggcagggauagggcuggauccacagccccgccccaagcuuccugccaccgugggaaccacaagcuccacguuucccugucagguaagccuuucggaggcaggccugaaaucccagccucacugugucgccugacuagugaaacgagccccgcggcaggcacgcgcacccccccucaaccucugggcgggcacgcgcaccccccccccccccccgcucaaccucugggcgggcacgcgcaccccugcucaaccucuggacucgggcuccaucuccuccucaucucccuguggggugggcacuuguaauaccuccauguuacagaaaggaaacugaggcacagagagggccaugccucgcccaagguuagccagccaauagaugggagggcugagauuugacccaugagcaugccuccaagcccauuucauucauucagcaaggcucgggcaggacaggcuggugcccgcgcuggggaugccugaacaccagauggacuggccucagcccauggcgggcagcaggcugggcacgggcaucaacauggcaaugccaaccucagagggcauuacggaggaugggcaggggcuggccuaccccguggcugccugugagaucaagaagguaggucacagucagggaccaggggccugcaauacccacucucagagggcaagcccuagagacuucugagcugccagaggggugggccuuccccacaggguuuaaacccuugugagcuuuuaaaugcggaaacccacagaaggcgcccauccagcgucuggugggcaguggugagccaugagcgucugcucccuccgugggucccacaguaggcaggagggaauucagggauaaagggagcucuucucuuccccagagcccccaaauacaccccaacugccugaaaguccaguaacauuuguucauucaagcuucccuuagucugcugggagggcagugaccccagaagacgggcacaggucauggggugcagagaaacugguaggcagugguggcacuggggggcagaagaggccaggacucugggggucccagggcagauguggccaccgugggggcggccagggcgggccaccgugaauccuuaggagggcuccaccaccgacuggcccagugaacacagcaauggcuuaucggagcacacaggccaagggugggcaggcguacagcagggcaggcaggggacaggagccaucaggaggcccaggugaggcucugaggaaggagggcugaacaugggggccacaggguaggcccagcucucgcugucccggccccuccccuucuggaagccgcccucagucuguguuggagguuuccagguuaugucacagugcugggucccacuggagggacgugaggcucugccccggcuuccaggccccaggcugagcaugacagcaggagcgagguaccugagcgugaucaccuccaggcugggcaucuccuggcaaauggagaucuaggaggaaaagaacaugacuagcaagcauggcacagcagggcaucgcggccgcacugccaucagccacagagaacugucgaagccacggccaacccacuuccggggccugaggggcacggccuuacucagccagugugcccagggugaaugcccagggccugaggggagcggcccugcucagccagugugcccagggugaaugcccagggccugaggggagcggcccugcucagccagugugcccagggugaaugcccagggccugaggggagcggcccugcucagccagugugcccagggugaaugcccagggccugaggggagcggcccugcucagccagugugcccaggaugaaugcccacgaguaugccagguucuccucugacaccaccuugcagcccagacgccccgcagacugaaggagaaaugugaggcuccuccuugcacgcacucugucuuuauuaaauuuuacgacagcaucguugcugucagaugcugccagcaguggagacagagcauucauuacuuuagaugcccucaaaggacaucagguaaggggaccccaauguccccuacgcagggauagaaagcaaggaaaggauggaaaucccuucuugauaacaggucuaggccaaaaggaagacaggcuugagacuggaucucagaucacauugguacugucaauucaggggugaggugcccggggugguccacaaagccucacaaccugcaaagcucccacauaugugagagcccaccauacgccaggcauggcaccagcagcucacagccuggucagaugcgucccauguauaagugacucgugucuauggacaugguacguuuguauauucacugcuaaacaugcaguauuucaguuacagcacaaaacagauuacacccagaugccacguauccaggcuuuuuuuugucuuuaagaaaagguacaguucaaauuaaaaaaacaaaggaaaauaaagagauaaauaauugcgcuggacaugguggcucauaccuguaauuccaauacuuugcgaggcugaggcagguggaucaccugaacucaggggguuugagaccagccuggccgacacagugaaacuccaucucuacuaaaaaguacaaaaauuagccaggcaugguggugggugccuguagucccagcuacucaaaggcugaggcaggaaaauugcuugaacccgggaggcagagguugcagugagccaagaucgugccacuguacuccagccugggcaacagagagagacuccguguaaaaaaaaaaaaaaaagaaagaaacaauugguaugcgaucccuguguaaguuggggacauuuuggacugagaaagacaaugagggagagaagaaaaaaaucuuucacagacgcacacacucaaguucucccagcagggcuuauucucugccugccuuuggggcagcggcaaggggguacaaggcuagaugugaccaagaagaggggguguagaccuucaacuuccccguaacaaaguaaaacaagcccuccugggauuccuuuccaggugagagcaaguuccaaacuauugcuccccuccucugcgaccaagugacaaaggguguuucauuuauagggauguugacgggaacugcaaaauaagccuggcacuagagaauuguuuuuccauuagugguucugcagaaugaaaaccgcuaagugaacaaaguaccaagugugggacugaauugauaggugcaguuuugucaacuuaaaaauucucuugggaaagaagcuacaacauuuggguugaggcuauuuggagaugaucagugcaauacuuacaucugugaggcaauacuuacaucugugaggcggcugccccuggggagagaaaagauacauacuuuaauuuuguuaaaguugaauaaaaaacacugaagacaaaaauuccaaaaaucaccgaugacucccuacaaaccuuaagauucuaggauuuuaauggcauggcaaaaaaggaagguugcccagauaacuggcaaagguguaaacaauuguuuuagcugauuuucaacuaaacuguauguuugacguuggggugguacuuuuuagauaaggagcagcaggguugcuccauuuguaagacacaaaaagaugaacucuuccucauggucccugaguagcagaagguucauuucucucacugacagacauaaacaagggcgucuuuauaagaggucaaguucaaagggugaacaggcaacuuaugaagcaaacuuuaaaagccugaaacaggguuguuguuucucccagcuuagugggaguacugaccaccccaugcaaaacaaagaaaugcauuauugaaagcaaaugacacgggaauuguagccaaaacaccagauaugccagggcagagagaaaagcuuuuuaauuaacagggaagagcucacucugggcagucugcggacaccccugggaggaagcgucugcucucgcugacccccacacccgccugcacggugaggccaguugacacggcgcggucacucugcugaguccccagggaacccuggagaucuugcaggccucaacuccaggcucccucuucuggaagcuccuggucuuccuuggcucagugagacucagcauuaccugccuuucagccugccugggucccaccgcacccacgucccuuccugucaccugcuaggaguacccugggaacggccgcccccaguacugauuaccaacguguuuccugacucaguccuggaaagcucaguucucucuccuauucgacuuggucccagugacugcuggcaaccccagacaacagacccagcccacagggcacccggggcaaaggcgggccgggaaaugggggggggcccaggcgaccccgacccccggccuccuccccucccucacccgcggcuccuucgccgcccucgccccugccccuccccccuuccacuccgcccccgccccgccccgccccggcuccucccuccggcuccgcccucgucccgccccggcuccucccuccggcuccgcccucgucccgccccggcuccucccuccggcuccgcccucgucccgccccggcuccucccuccggcuccgcccucuccccgccccggcuccgcccucuccccgccccggcuccgcccucuccccgccccggcuccucccuccggcuccgcccucgucccgccccggcuccucccuccggcuccgcccucuccccgccccggcuccucccuccggcuccgcccucgccccgccccggcuccuccccccaccccggggcggccgcggccaggccccgccucaccagcaguugagcuugcgcacgcugugcagcuccgaggccuuggcccgggucagaaccaucuuccgcgucagcuucauggcggccgcccaggcccgaccggcgggcgcccccggccuccugaucccgggcgggugacgacugcgcggcgcgugucuccaggggcggggcccgcgucgucaggggcggauccugagccgauuggcggcucggugaggagagcggggcgacgcgagcccgcuggggccgcuugggcgccgcugacacguuggcucugcuccugcucau

SEQ ID NO: 192158 - RNA, 12112 nt, Homo sapiens
agucccgacgagcaacgcguuuguagaggggugggugcgcacgcucugucccugcgugaccuuccgaccccgcuguccucaccgcaauggcggcugugaggguccugguggccucgaggcucgcugcggcaucugcauucacgucccugucccccggcggucggacgccuucccagcgcgcagcccuucaccucuccgugccgcgccccgcggccagggucgcgcuggugaguggacggagggggugaggucagcucccgccuccagagaucagccuucgcuguucucugcccaaggucggccccucuuccuagguccgcucccgccgccccacgucggcuccuucaccccaagucagcuccugcggcccaggucggccccauuuucccgggucagcgcccgcggcccaggucggccccuuuccccccagucaacucccgccgcccaggucggccccuuucccccgggucagcucccgcuccucucgcaggugcugucuggaugcggagucuacgaugggaccgagauccacgaggccucggcguaaguccucaggggcagcugguccuccaccccgggggccucgagaaggccucuccaccagugaaguuuacucuuuuuugaacagcuuagagaaagcauguauuuuauuuuauuuuuacuuuuugucuuuugagacagcgcccagucuggagugcaauggcgcgaucuuggcucacugcggccuccgccuccuggguucaagcgauucuccugccucagccuuccgaguagcugggacuacaagcaugcaccaccacacccaacuaauuuguguauuuuugguagauacggaguuucaccauguuggccaggcuggucucaaacuccugaccucaagugauccucccgcuuuggccucccaaagugcugggauuacaggcaugagccacugcacccggccgagagagcuuguauuuuaaauacccuauucuuggcuaaaaaaaagcaaaaacgacuugcaaaacccagggagacgcuaagaaagaacaguuuuuaagugucgcuuaugcugucaccuagagccuagaaaugacuuagcauuucacuugaguguuuuucaggacacacacauuuugaaaacacugagaucacacucacccguguuuugcaaauguuucugacgcaugggaaguaauucccauucauucaguucucaacaucauuuuaacaguugcgugguauuucuggguccuagacagguuacuguuuacguaacuggucagcuguugcugagugcuugguggccugauuuccugugcuacuggaaaugacugcaggccgaaccaguagggcaggaggccaccacgcgugccagguaccuguaguucccaugugguucagggugaacuggagaggggagagcugggugguggcgaaaggggugucaggccauggagaguggccugaggcugguggcuuuguggguggcccaccuuggcugguuggaguuggcacuaggcagagugagcugggggaaagggccaggauguguuucaugauuuggccuuggugggauagaaaauagccccagaauagcuugagcccucccaggcagaacggcagggucuugugucuggggugucuggguggauuucuuauggguagcggaacccaagugccagggccaggugcugaccucucccucuggcaagucacugcacuucaugccucgguuuccuccuccacguaaggggcagugagggcuuagugugugggugggcuuagccaccuaucuccuguuggcacugggaguugcggaugccagcgugagcccccauaaugucagcuguuguccccaggaggagcuucuguugcccuugcccuuggggagauggagcugccuggccugugguguuguccuggggucucuugugucucucccaccaucugugaugggaaaguugagggagacuagaaauugaacuaaguagugaccgaaagccccgucacaccgucugugcacguggcacucugagcacacugcugcuucucacucuuggugcuugcagcaagcaacuggaggagggcagccaggcccuggguguagguagagcacucagcagccggggacccgcacgccuccaggcugugcccucaguggagucacccggcccccauaccccaguuugcaaagggagcuguugggaccagcugaucuccauagcccacuucugaggguuugucauagucguaacccaccaaccgacagugaauuggaaugggggugugggggacguuuggcuugguauggaaccaacuguaacuuuuugcagagcaaguaagauauuaauauacauuaggaauuugcuccugguacuuagcuaaaauccuguuuuuaaaaauguguuaacacaaaucugaguggggcacguuuugaagaguugucucugguuuucccccgugcaggauccuggugcaccugagccguggaggggcugaaguccagaucuuugcuccugacgucccucagaugcacgugauugaccacaccaaggggcagccguccgaaggcgagagcaggugugggggugggauuggaacuugcuucuugucuaccucccacggugcagccuuuuuuugcuggcuuagcuuaaaccaagucuugugugcaaaugaacguccuucugagcagcugugcucgggcuguuccagaaguaaugcugccaaggcucaggagugccuuccuuccaguacucacagaaggacugaaaauggcgaccggaucgcuucccacugagucaggcugcucauaccuuggucuuaagcaaagguggugguucucagcuuggucgcccaccuucuuccccugucugggcuccagaucuguuuugcugguucccagcagcaugucuguuacugcggugugugugguucuggccuguguggccugagauccccuucccuugccuguccugccugacagcccugugcaggccauuccaaggugccuuccaacuggccucggaccacgagaggucggagcuggagauucgaggaagaagccauagcugccuccuggggcugugcuucucaccaguggggaccccugugauuucuuuuccugccugggacccuggcuucugcaccuggacuugcaccuucggcccccacaccugggggcuagcagcuuccugcgguggcuggccuucggguugcuucacugguccugaguccuggcuucuuaccuuccccucugagucccaccguccugaugagugcacagaauucugucugcuuuagacacucggagagacuuccauuucccaugggccuugacugcagaagauucagagugauuuggcgcagguucugaagugcugaucggaagagcccagcauagauuuagcguugcuagaaccauguugucuuuccagguagugaccaaacaugcugaccuggaaguaaguccccguguggcugagagccacguguguggagcguguugccugugggcugugccccugccgcgcuccacaguccuucaccugcaugcugaggcuuuuugcccugugcucuuucccaggaauguuuugaccgagucugcgaggaucgcccguggcaaaaucacagaccuggccaaccucagugcagccaaccaugaugcugccaucuuuccaggaggcuuuggagcggcuaaaaaccugugcguauuugagcuccaaggucuuccgcuuuccauguggagcagaugggaagggggugcaccugucugcuguccaauguggucaguggagcggcgaugggaggggguggugauaggagcagucucuggguuuagggucugggcagggcacgugccugcccucugacuugggagcuguucuuaggguugggucuuagguagcguuguagcgagccaugcuuuuguuucugcuucucugcugccucuucucucagcauuccugguacccagcagcuugucagaguggguuuggggcucccucuuaucucaucacugugcuguaggucucgucacguugaaaucagucucugaguauuuacuccuugcaagugccaguuuuuuuucucucucucucucuuuuuuuuuuuuuuuuucuguagagaugaggucuuggucuguugcccaggcagggaugcaguggcacgauccuaguucacugcagccaugaucuccugggcucaagccauccuccagccucauccuccugaguagccgagacuauaggcgcaugucaccaugcccaugguuuuguuuuuuuuuuuuuuuggccauguauguagcccaaauuggucuggaacuucugggcucgaguaacccuccugccucccaaagugcugggauuccaggccugagccaccgcgccuggccccaauucucuuauggaaccuugcaggaucagaaauggguuuccuucuugguaguuugggcggcgguccugacaggaagaagggaggccgccuuggcguggcuguuuugguagcuggaccgugaaucauggaggccuggcuggcucccacacgguggcguccuugaguuccagauccucuuucuguucucugugucuccucucucucuuugcacauucauggagguucucugggcaccgcccccauggcccugccugagagguggagguggugccaggcugacccuccagggacagcucugccaccugcaggagcacuggccacagugcaucggagcgugcagguggcuucugugccaugguguggguggcagccccagcacggccggccccggucggcagcuccuguuucaagggcagguuggaggcuggcuggccgcuugccccacccugggcagccugcacccagagucgagggguaggcagucuccauccgaagaaugcgccccuccuuaucccgaaaccucagaggccuccuuccucagaugccagcuguuuucucagugcccuuggccgugcccucaccccucucucaccggaagccccaccccagccugucguccccggucuccugaaagccagcaagccucgucggugccgcccacaccccugaccucacgcagccccacgucaggcucgaucuuuuguccaguugucccugcgucgcugccgucuccacgaggcucugaccacugacaccguguguggcggggcgcaggggcagcuggagggugugcugggggcuccgugcccuggcauggcuccuccacauuuugccaacccagaggcacaggcgugagguguguggugguucucagggucagugggucuuggccuuggcuuucaagguguugaugggcccugggacugaugugcccgugugucugagcccacguccccugggcgaagcucccauuuucacugaccuguccagagcguucugggugagccugcccugcguguccauggugcggcgcgcucuaaugagcugcagccguggccacucugcacccucugagacagucacccauggggacggcgaacacccacugccuccagaagauucccagcacucugccagcaaagccauguggaaaaugcuggggcagaggacuggggugcgugaggguggcguagagcccagggguggguucgugggaagguguguccacuuguagauuugguggcauugccagaucacacgccccaugggcaguguggagagaccuccccugccccgcgugcccuccacagcuccugcuccucggccugagguguggaugcuggugucgcagguaaacuggcguuucuuucacggucaucgaagcaagagugcuugguaugccuggaggccgacugcguuucuuuuuuugggaacuccuggaguuuccugcugccccuuuguuuuaaggaaaaacucucacaccguguuucuccuccucccaccacaacaguuguccacacagaaggugggugugaagggucuuccccaugcaccacgcaggggucgcugcugccuucuaauucaguuccaacaguauggacccgggguagcguccgaucgcacggguugagggcuccguccccaaaacugcccucugacacauaccgguaaacugucugagccucuggaacugaccaauuggcuucaaguugggguucccacaaccccguuugcuggcguggcucacagugcucagggaaacaugacgucagcauucucccccggggagugggggacccucucaggagaggguccugagacccacagucagaaaggcggggaacauuagaguccugcuuuggggcagguaaagggcaggcgggaaggucagaggcugcccgaggcccgacacagccaacgucguaacagaaagcuaacaagcagcacgggaguuaggagccggaaaccagcgucugagucucagcaccgcagcccggguucugccagcugcuccggaagguuccagggcgugggcccucucgcccugguggccuccugcugcaccacuuccugauccuccugcuuccuaugcuuauuucuguuuaaaaaacaggaaaauauguucacaucaaacgcgcauaugugcagccaugcccaugucccuugcugcagcugacugagggucuggagcugugccuaggaagccccccaggaauagacccugguugugaggcugucugaggaggccuuuugucucccgguaggagcacguuugccguggacgggaaagauugcaaggugaauaaagaaguggagcguguccugaaggaguuccaccaggccgggaagcccaucggguguguacagccgugcaggccucggggagggagggaggagggugcgugggcccgcggccucuguucucagccaggagcugccgcugauccugaaaacucacagcugcuuuucuuguuuuaacugaggggauuucacacgaugucacuggugacuuaacaggaaggagaggcacagugcacuucccuagaggaggccuggaauucucuuggcucccagaggugucccuaggcagucccucaggaccccuauccuuuaccagaccccuucucccaagccccuuagccacaguacccccaaccccgcugacuucuggccagucacugcagcacgugcuccaucccugacgccauccacucccagcggccucccuccuggggagccacagccaaccacgccccuuugucccugcucagacaaagccuggguccugagguuggcggcacgaguagggcgcccacuccuucauccacguaagcgccuuggcuuacguggcgggucgcagccccgcagggagugugugcucuucagcgucugcugccgggaagucacucucagaugugugagggugacccagcaaggccggguuccgccucggcaggugugaugcuuccacgagccucccggcaccugcuccuuggugguccuggaacgcggcgcugugcuguccaggucucagcugcgucuggugcuggcagggcgagagccgcacuugcgugggugaacaucagugaggcgcacucgcgauggccgcucacuaccgaguucugucagccgaacaaggaugaggaucuaucggaauccucugucuccccauccacagucacucacuuaaggaccugccuggucacuguccagggaggccccuaaaguggagccucaggaagaggugcaggcucagagcuccugaaggaggucccugcugcagccgugucacagccggggugaagguuucgcccauggucuccaccucgggaucccguccuugucagagaaguguuccuuggaugagcgcccagagggaggagcccauggcccuuucuucugugacugauuaaaaaucucgaugaaacaagacagccccuggcaggugaaccacugccucugagcaugccuccccugaaaacaguguggggcgcaagcccaucuccuccccaauccagccaugaggcuccccuggaaacagcacagggcgcaagccugucuccuccccgguccagccaugaggcuccccugaaaacugcagggcacaagcccgucugcuccccgguccagccauggggcuuccgugcacggugacccacaggcuuuuuuccugaggaaaccuaaauccuuucccacuggccccacccaccccucagccuggugucagaggccugcguggccagccaggggcuguuaggcggcccagccgcucacugcugggaccccuuccuugaaugcaguagucgaggugggcgcugggcugugccaggagccacuguggcaucuguagcuggcaguugauggcugggcggcugcacgcagcgucgggagcugcugagaaccugcuuccuggacuuucugccugcgcagagggcggcagggggguuucaucucauaggcagccagaaguugcuucaggacaugcaguuuugggggcggguuuguuuugagaguaucgcucuguugcccaggcuggagugaucuuggcucacugcaaccuccgccucccggggucaagcaauucuccugccucagccucccaaguagcugggauuacaggugucugccaccaggccgaacuuuuguaauuuuaauagagacaaguuuucgccauguuagucaggcuggucucgaacucccgaccucagguguucugccugccucagcugcccaaagugcugggauuacaggcaugagccacugcaccuggcugugaaauguguuuuuaacaguguuucguuacagcucacgguagcaguuuccaccugggccugucgggaguggguaggacuguagacagcgggaggagggaugaagggugcgggguguugagggcaggguggggccugacagcugugggcuacaccacagguugccaggggauggggcugcuguuaaugaggccguacuccuuccacuguugccccuggguggccaugaggcgcuggacgacacaggucacugaaggcccugcugugggcacagugccuggcacacaggggccucuguugacuuggcagggagggguuccugaugaagcagaagcaggucccagggguggguguggcaggacccucaguuucagggcugcugcggccugugcgucagggucaggggcgugcguccaccagccugcacuuguugagaguugugcugcaggucggaggcuggcgaggcugcuccuggcccguugugccuccuguagaaggggggcuggugugaaugagaagugcagcuguguuaucuauugcugggucacagaccaccccacaacucagggcuggggcagccgcacaucauuacccucucugugaguggacuuuggcagcccgggacucucgccagucugggguguccuggggcuuggggcuuagcccauggcuguuggggguuccccucagggguccuuggccuggugcuugagugccugcagggcgugcuuggcggggaguggggcugaggacaccucacucucagccuugagucaccuggugccaccuccaucacaucccaugggccacagccuucuggcagcgcaggcucacagggggcagggucggcagggcucccguggcagggcagccuggggucauggcgaggguaauuucuguucugcaggccaugcagccugccugacccguguucuuuucgccuuucagcuugugcugcauugcaccuguccucgcggccaaggugcucagaggcgucgaggugacugugggccacgagcaggaggaagguggcaaguggccuuaugccgggaccgcagaggccaucaaggcccugggugccaagcacugcgugaaggaaguggucauauccuuccugguagccaggcccggcccgcugucgugcuugucccugagacgugcauagggacgccccucccuccgggcugucuugguggguggccucuucaccgggagcugcaccugcugcucucccuguggggccucccccagugggcaccgcagccaugugucuaagggcagagagcagauggcugugacagcccagcuggugugaggugggucacagacacgucagaagcgcagcucuggugcgugguuggcagaucuggcagauccaggucccuugccugacuguuuagucugcucagcaacacccaggcagccacacuccgggcccagcggggggagggugaggaaagagugugugcgagguguggagggagagcagccgggcgugcaggaggcgggggcuuccugagaugcugggggaaagcggccgggugugcaggagaaggggcuuccuggcuucauuugggcggaaguucucaggccaguuuggguggccaggugauucagccagccuugcggcccccagccccuccuguugagguguguacccugaguucugagaugauggaccaagaacaccagcggggcuguugcccagggagauuuggagggaggcuccuggaaggcccugccuggaucugggagaauguccaugugagcccaacugagagaacagaacacuccggggugccggaaggcacuggaaugaguagagcauggacccgguccccugcagguguuguucugaagggugcaguuccucucaauggggcagcuuuuuucucacaggcagcuucagacgucaggccccaucucccucccugcggcuuuccugcugggcaggagcgcagugcaaggcuggccccaggccucugacugcuugcaggaagauaggggcacgugucuugggugguguggaggccuggccagugguuacaugcaugguguuggggaggcucaggucuguggcuggccggccccaguugugccaccugcugcccuguugccuguugcccugccccaugaggaccggcuccuucacggccaguucuucaucugaaaagcggaggugcugccacugccucccguggugguugugagcaccccaggcaugugugcgcccccauggcggggcagcucguggccauguguggguguugggccugugugaugcuggcaugaaaggugccccguucccuggaauuucccgcugcuuucuuccucuagaaugcaugugaauugggaacagguuccuucuuauguuguucagcagcauaaaucauacagaaagcaggguccugccggcacagacugcaccaggagcgaguucuccucuuccaaguuaucugagaacaaaguuaggacacgcggugagggugggggaggggccggggcuccacaccugaaagucccucagguccgugcuggguggcuuuuuccguaacucugcacacgaagcucacguggaccagaaaaacaagguggucacgaccccagccuucaugugcgagacggcacuccacuacauccaugaugggaucggagccauggugaggaaggugcuggaacucacuggaaagugacgcgcauggacggggcccagcuaggcgccaggacuuggccucacccucuggcugaggagcugucggcugcuuuccauccagcugggagucuggcaggcccuuuuuuuuuuuucuuugccgaaaccugcaggcguucucucucuaaggaggaugugcugcagugcaugggggauguuucuuccuggguguggcugggcugcucucacauacagaggccgaggggccaauucguucucugccacagggacuugccucacugugucccaaaaacaaaucgcagccagcuuuuccagaaauagaaaauucugccgucugagguuuuauacuucagguuaguuaguuuuuggaaggaagaacauuuuuagguuugcaagccuccugaucaggaaaccagaaauaccacauuuauggaccaugaaagguugguucuugacucugaagggacuuuugaguuaaucagcguaaggggauuucuaaagcaggcaaucccuguagccgcagagaauaaacgccuucccaaaauggcaacuucccacagccacauuucagaccugcugagacugcugagugaggaauggcagugagguuucuucaauuagucucaguucucuuaauuuucaggaagaaagggaaauugcagccccucagcccccaggauugaccucuggggagugaugguagcguuggugccaggccguggguucagguguggcagaagcuugcagaugcguccgaagggaaauaaaguguguuggcguuagacuuugugcugca

SEQ ID NO: 192159 - RNA, 39217 nt, Homo sapiens
gggcuucaaaucaaguuuaauaaauaaaacagcaaagggggguucaaggcaguuaucacuucacagugugguccuugguggggugagggauggucgaguccaacucggaaaggggcucgagcacaagaggccggacgacacccggggcagggcgcgccgccgcccacggaggaccccacuccaacguguaaacagaaacagaaacgaacgagagggccagggaggagggggaccaggacuccaagccaucuugcuaggaagcuucccacagaaggaagaccugcagggcuggggaaacaggcuggagucuggccccugcguggccagcagggccggcuccuccggaggcucccugccuugguaccgggggaggacagcaaaggggauguaaaucaccugucuccucaaacccacgccugggguugcugagggaccccaccccaaccgcucaggaucggggagcagggauggagggggaagaggcagguggggguguaaagugcggcuuuuccugaaguggagacgauggggugggaaggcgaggcuggggugggggccggacagcgagguauauggcucugugccccacgggguuggcacugaguagcagcugcccacgacccccagggcuggggcagcccgcggcccugccggguguggagagacagagccaagcagggagcugagggcgccccggcggaggcugcuggugcggggcagggcguccugcccgucuccccgccggggcagugacgccuucccucgccucugcuggcuggaagggacuagguggccggcucugcccugcgucccaacggcggggucucuucuguccccggcugcccgacggaucccacgugcaggcagcggcccggacccggguggcagugccgggcgcugacggcgcuggguggggccguggguccauucuguguggacaggggcaagggcucacggcccagccaccucaccccaguccugacguguucugaagcagaaggaggugcuaccccaaggcccgggggguggggaaggggucaggaagacugacagaggcgggcccagcggcagcgcuaaguccagucugggccgcauacgccgcccgcggccaggagucagcaggucaucacguuacagcugcaggggagagaccaagagagacgcagagagugucagugcggccccacgugccugcacagcccagugcugagcgcuggacucgagacucccagccuugccucccccacagccuauggcagccgggcccggggugcccugaggggagcugguggcuggagcaggggugggacagccuggcaccugcucccauuuguggagaauguggaccacaugaauguauucuccagucaaaaaauacauacaaguaaagaauaaaccuaaagacacacugagagccugcucguggagccacacuguccucggguccuuggggcaaaugccucccacccuccucugcucagccugagggcuggggggaccugguuggaguguugcggaggcuccgggcaugggguggcacucacugugacaggggcuccgaguguagcccgggggccgggcacguggggugggcggccaggaagggguucacguccccaaugccgaugaguccaaacucggugaccgacaaagccaccugugcuggggccacagucuccuccggauccccgcugagguccacauggcuggagaugaggggcagcuccuugggcagggcgaaguccacggccagccuugggcuggcgucuggcuccggagcagugacagcuggcugguaugaggcugggucggccagggcugggggccgaugggacagggguacagcgggggacucauccagcugcuggaaggaacacggcccuggcuccgaggacgggaguccaucagaggccacuccgggcucaucgagaccaccggccgugccauccacgcucaguggaucugugaaagagaacgcaacagaggguggggccugcccacagccgcggauccugugcaggcuccugccuaacuuugcuggguccagcaaagccuguggaucccuccccagaaaagccuccacacaaauacaaaagacaccaguuacacugaaauccgcgagccccagguuaagggucucagcuuuagaaguagauuuuaguucaucagaccaacagugggucacaacccacaucuuuaaaaagagcagaauacaauagacauagguguaaacaaugccgggggcacugcagaggguaaauacagggucuguggaauacacagacuuagguguaaacaaugccgggggcgcugcgagggcuaauacagggucuuuggaaguuuuguucccacaggcagcgcaaggggccucaccacaauucuaggaaguagccgagguggacacccuuuggcaaacaaaccauggaaacaaccagacucuggaaaugggggacccucccagacucaaccaucuaaacacagagccagaaagcaaaggauccucguuugcacccuccccgugugggucuccaccuucggacgccacaucagacaccaccaucggacauggucccuacccgaggcccugcugugcuccgucauggccucaggugcaagauccuggcgacggcuccggacacccuguccuuccugaguguccuggugacgggcuaaguccccacccuggggcaggaaggcccuccccggagacugaggccugguaaauaccccaaccucaccauacggggcuccccagcaguggggccacaugcaccccuccagcaagcccagaggguaagcguaaucccugcccuccccucucccagccagguguacagagcggcauccacaucacguggcugcccuccgccacccagacgcccacuccuccuggcgaggcuggcccagcacagggcgccaggcaggagaggcuccaccgggccucacucacggcuccagacccguggccgcccccagggcaggagauacuccccaagccucaccugugcgcaucccagucagggugucuugcuccgggcgcggacggccggggccaucggggucgcugccauccagguccuggucugcgucccuguggggagagggcgccaugaggggcggcagacaggacagacgcccccacccaagaggugccgcccaggcgcccacgugcccacccccggcgggguggccgccugucguuacugcuggggagggcugcacgcacgugguuccggacgggacguacuuccuccggcccagccgcgucugcugggcgaaguagucguagcgcuccgacuucuuccacagguaguaguacucgacacacucgcccacugaccgugugcgcaccugcggggaggggucaggagccaucucuguccccggcugcccagccccagcaccugcaccacgaucccaggacguccugggaccccgggacagcacagaaggagcacagcacccaccacucucagauaacgcaagaccccccgacccaugacccuaacaggccacaggcuaugcccaccacagggaacaggggcucggagcacuguggcacugccuccuguuucaagcccccucagagcccuccagcuccuggcuugagaccccuuucccuucuguagcaucagccagacaaacguacccuccaggccucugucuacugcucacccaccccaucccagaccaugagccacgggccaguugcguccaccucaucugccugcuucucacaggcccggggugggagugggagugacaacccccggguccacagacuccuggacugagccccuuccccgggaggaagaggcacaagcccgcggcgccugcuuucccaccgaacacaucccuccagggcccagcgaaugcuucccaagugcacagaagacaccgcagaaggacacauggguucugugaacccgacaaaauucccaacguagcacauaaagggccaaacacacaugcacacaggcuucagggagacgagaagggacacacacacacacacacacaaggcuucagggagacgagaagggacacacacacgcacacaaggcuucagggagacgagaagggacacacacacacacacacacacaaggcuucagggagacgagaagggacacacacacgcacacaaggcuucagggacacgagaagggacacacacacacgcacacaaggcuucagggagacgagaagggacacacacacacacacacaaggcuucagggagacgagaagggacacacacacacacgcacacaaggcuucagggagacgagaagggacacacacgcacacaaggcuucagggacacgagaagggacacacacacacacgcacacaaggcuucagggagacgagaagagacacacacacgcacacaaggcuucagggagacgagaagggacacacacacacacgcacacaaggcuucagggagacgagaagggacacacacacacacgcacacaaggcuucagggacacgagaagggacacacagcaaguguguuccauguggcaccuggcacagagcugggcgcacaccuggcaacaccuccaacaucuccacccgggaggcucaucccacagagagcuugaggcuguggccacugcuggugauggcggaaaagacccccucaccuggacaugcucugggccaacuaacccaccgccacccagaacgaggaugccccaugcucaccgcugcgagaacaacgugggguccugccugggggcgagaccgagacaaccucccugcagggcaaaccucaaacgcacgccacgagggagcucuucugugaagggccagggugaaauacgcacuggcucaggcugaccaacgugugcuggcuacacacggccccucgcggcugggccaggaccugcccggagcuccagaaacacggccgggaguuacaaaaacgcggcccugagcuauagaaacacggcccggagcugcagaaacacggcccggagcuauagaaacacggccgggagcugcagaaacacagccgggagcuauagaaacacagcccggagcuauagaaacagcccagaguccagaaacacagcccgaagcuccagaaacacagcccagagcuauagaaacacggcccggagcuauaggaacauggcccggagcuguagaaacacagcccggagcuacagaaacacggaguccauagaaacacggcccagaguccagaaacacagccuggagcuguagaaacacggccaggaguccagaaacacggcccacaacuccagaaacacggcccggagcuacagaaacuugacaggggcuccaaguguagccugggagcaccacacuccagccacaccucgccccgcugucuccaaucaaaacaccacguggugcuggagucugacaaggacaguccaucgcugcugcgcacggcaccgcacagucaccugagcaauguccugagccguacaaccagccccgggcaggugccuccucacccaagcccuucaguggacgacaucgggccccaaauggagcacggucccaggacacgaggcagaagcaaggcucggcaacaaggccacagcccacugguccugaagggacucagugcccaaccggggcguggacagaggcggagaagccacuggucagagccaugggaagguuuucagccagagaugucugacugccaagaggcuggcuuggaaguuaccacucaagaagccacagggcagagggcacugcugcagacaugcagagacccacagaggacguggggaaggucuaaggaagggcagaaggccccggcacuuggcagcaccugccugucaugaggguuugucccggguggcaggaccugggucccuggaggagggaaccaggagaccccuggucuccaggugucagggguucugcuguggggccaaugcuggacacugagccagcaggcucugcucagaggacacagacuugaagaugaggugcccagggcccugggguggaaugugaggcagaaacaacuacuagaauucagcuuuugccacauucuuucccaaagccagagccuuguucuuguggggacaggaaaggggcccacagcagucaguagcaaaaaaugcagaagacagcaaugggcacacggugaggaggcggacacaggacacggggcuccaggccuccagucggccgugugcugugugccugcggacccugagccccuccccagaucgagaagcccccgguggagccuggcaguggaguccgcaccuuguuggccuggaucaggugaaaguucuuuccaugcacacggaagccgugcucaaaguuccugcacuccucuucacuccaagcacagagcccaucugcaaacacggccggggagaacggucaguggugcccagggcggggccgcagcggaaggaaggcccaggccggggagaacagucagcggcgcccagggcggggccgcagcggaaggaaggcccaggccggggagaacggucagcggcgcccagggcggggccgcagcggaaggaaggcccaggccggggagaacggucagcagugcccagggcggggccgcagcggaaggaaggcccagaccgcugcucaccucggaucaccuucacguugaaccgcagccuucgcagggccuccuccacauugaaguugcauuucaccaacucguacagcgccuggggagaggacauguuggcucuuccaugggcucagcgcaggagccgacagcaagaacugucuauaccauccagcgaguggcaucaggggccguccacaccacccuccugggcgaugucagagccaccuacaccucuauccagggagugacaucaggggccguccacaccacccuccugggcgaugucagggccaccuacaccucuauccagggagugacaucaggggccguccacaccacccuccugggcgaugucagggccaccuacaccucuauccagggagugacaucaggggccguccacaccacccuccugggcgaugucagagccaccuacaccucuauccagggacuggcaucaggggccguccacaccacccuccugggcgaugucagggccaccuacaccucuauccagggagugacaucaggggccguccacaccacccuccugggcgaugucagggccaccuacaccucuauccagggagugacaucaggggccguccacaccacccuccugggcgaugucagggccaccuacaccucuauccagggagugacaucaggggccguccacaccacccuccugggcaaugucagggccaccuacaccucuauccagggagugacaucaggggccguccacaccacccuccugggcgaugucagggccaccuacaccucuauccagggagugacaucaggggccguccacaccacccuccugggcgaugucagggccaccuacaccucuauccagggagugacaucaggggccguccacaccacccuccugggcgaugucagggccaccuacaccucuauccagggacuggcaucaggggccguccacaccacccuccugggcgaugucagagccaccuacaccucuauccagggacuggcaucaggggccguccacaccauccuccugggcgaugucagggccaccuacaccucuauccagggagugacaucaggggugucuacauccccuugcaggauacccggaggcgucuacaccuccucccugauacgugguuuuaauuggccccccuucugaccugaguagcuguuccagugcccuggcccccacacaccugaccccugcccuccccucugcccucccuggccccuggaggcacuggggugugagcucuggcccacgccacggcagcccucagccccucuguccccggcauggcagcccccaccugcucacugucuuucacggcuucucccucugggagcugaggcccggccaucucgugccaacgccgcuucaccgcccuguacaggaacuccuccaccucccucucagggaggacgcuggggucccagagcagcuggucuucguucucguagacugcacaagcagagggcaaaggucagcuugcaggaacccaaucugcacccacacacgccaggacaagcaaagcagccaacucagccccugacagggaggaggcacuguccguccucccuuucccaagcccugggccgccaucccugugcuccuccugggcuuggugcugcugugcucaauucaacuaccgaguggguccagagcaggcucugggcaccacacacaggccuguaucccaacgaccaagugcagggagccaugagcagucagcaggggcgccugauccagccaaggggucagaggaagcuguggacagccuagaucuggggcaggggaauucuaagcaaggacucugcagaggggguucuaaguagugagaccagugaggugaggcuggcuucaggcugcacagcuacaagggcaccugaaaugcagaggccugagggagcagcaaggacgcccccgacucugcauaaaggcagcugagacuugggcccguggacaagcgggagcccccacaguuaggcacugucgcgcucuaacccugggagcugaagagccacggccagaaggugcaucaccucuggggagacauccugcccccgguagcugguguggauggcagaugugcucacagaggggaggaaaaguccacgaccucagaugcaauuggcuuucggcaaagggagggacgcagccuccagcuguggugagggacgugacuggggacaaggcaggggagagcucagggccaggucuggcaaggcucaagugccagcaccucucaauuauccaggaaagaggcacaggaucccaaacaaagcaaaccaacaaauaaaaaacaaaaucagugcacgggaagaaaugugaaaaacgcacuggggaaaacagcuccacacgggagucuccacugccgggggcugacgcgguaacuagcucccagguuggugcugugccccaccaagcaggggccucucccgguccucauggccaugaggaaaacaggcagacaccacagccaccuuucuccaucuccacaggcgacaccugagcccugcuuggacagagguggucuccaagaaaacagcagaccaucucuggagaaaaagaacaccacauacagccuagcaugugaagggugggaaaacacgagggaaaaacauuaaccggaugugagggcucaugucuguaaucccagcacucugggaggcugaggugggaggaucgguugaggccagaguuugagacucgcacacuccaucucuacaaaaaauuucaaauguaguacaggcacgucuguagucccagcuacggugggauugaggcuaaggugggacugagcccaggaggucgagguugcaaugagccaugauugcaccacugcacuccagccugggaaacagagcaagacccugucucagaauaaaacaagaaaacaaggccaggcgugguggcucacgccugucaucccagcacuuugggaggcugaggcgggcgggucaccugaggucaggaguucgagaccagccuggcaaacauggcgaaaccccagcucuacuaaaaauacaaaaauuagccgggcguggucaugggcgccuguaaucuccgcuacucgggaggcugagggaggagaaucacuugaacccgggaggcagagguugcagugagccaagaucgcgccacugcacuccagccugggcgagaagagcgagacuccgucucaaacaaacaaacaaaacaagaacacaucagacaacaaagcaggucuacacacagccgauguuaagagucagcacacgaagacuucaaucuaacgaggauuaauacguuaaggaaauggacaaaacgccggagagucucagcagagacuugaaauuuauagaaaagaaucucaaggaccuuccaggacuggauaauacaauacccgaauggacccacugaacagcuuuuuuaccagcagccugaacacagcacaaaacacaauuaguggaaucaaaaggaaaccaauguuuacaagaccaaaaccaaaguguaaaaggaaagaacaccguuuaggguaguacaagacagugaggcaaccucuaagauacguguaaaugagugacagagaaagcaaagaaggaggcagcacaaaaucugaagagguaacagccaagaauucuucaaaacugacgacugauaccaacccacagagccaggaaacucaggacgaauacaaggacacacgaagacgugugcacaggcacaggagagccaaacuggugaaaaacaaacaaauaaaggaaaggaaacaacucuuaggagagaaaagggcacaaugacuucagaagaaagaguaagaccguccucugacuucucaacagaaacgaugacagccaaaacgcaauggagugaaauuuuucaaguguugaaagaaaacacccugcaaaccuggaaaaacaugccaugaaaauaugcuuuaaagaaugaaagcaaaaauccaggcuuuucagacaaaaaaaugcugaaagaaagcacaaggccuauuacaaaggaaguucuuccggcugaaggaaaugauuccaaauggaagcuggaggaaauauguggauaggauaaauacaaagaauguucacuguuuaaaacaacaauguuaucaucuugugauauguagauuuuuuuuuuuuggagauggagucuugcucugucccccaggcuggagugcaguggugcgaucuuggcucacugcaaccuccaucuccgggguucaagcgauucuccugccucagccucccgaguagcugggacuacaggugcccaccacgccuggcuaauuuuuguauuuuuaguagacacaggguuucaccauguuggccaggcuggucucaaauuccugaccucaggcaaucugccugccucggccucccaaagugcucggauuauaggcaugagccaccacagccggcucauauguaaaauuaacgauagcacaaaaggcagggggcagguaaauugaguuaaacuguuucuugcauuguaggggaacuagaauguacuuauuucaagcugugaggcccggugugguggcucacuccuguaaugucagcacuuugggaggcugaggucacuggaggucaggaguucaagaccagcauagccaacacagugacaccucaucccuacuaaaaauacaaaaauuagcuggggaugguggcgugugccuguagucccaccuacuugggaggcugaggcaggagaaucgcuugagcccaggaggcggagguugcaaugagccgagaucacaccacuguacuccagccugggcgacagaacaagacucuaucucaaaaaaaauguagacugugauaagucaauaauucauguuguaaccucuaaagcgcuaaaacuaaaacuuauaagcugaaacagaaggacaaaauaaaccuauuaauccaaaagaagauauaaaaaaauuaaaaaacaaacaacaggccagguccaguggcucacgccuguaaucccagcacuuugggaggccgacgugggcggaucacgaggucaggagaucgagaccauccuggccaacauggagacaacccaucucuacuaaaaauacaaaauuaggccgggcgcgguggcgggcaccuguaaucccagcacuuugggaggcugaggcgggcggaucacgaggucaggagaucgagaccacccgggcuaacacggugaaaccucgucucuacuaaaaauacaaaacauuagccgggagucauggcgggugccuguagucccagcuacucaggaggcugaagcaggagaauggcgugaacccgggaggcggagcuugcagugagcugagaucgcgccacugcacuccaaccugggugacaaagcgagacucugucucagaaaaaauaaauaaauaaauaaauaaauaaauaaauaaaauaaaaauacaaaauuagccaggcaugguggcggaugcguguaaucccagcuacuugggaggcuaagguaggagaaucacuugaacccgggagguggagguugccgugaaguaagaucgcaucacugcacuccagccugggcaaugagagugagacucugucucaaaaaaaaaaaaaaaaacaaacaaacaaaaaacaaagaacagauggaacacacagaaagcaaagagcaagaugguggcauuacacaauuguuuuauaauuacaugacauacaagugauuuaaaaaauguacauggacuaaaaagucuauuaaaagacaaugguuuucucagacaauuaaaaauaagaucuaggucggacacaguggcucacaccuauaaucccagcacauugggaggccgaagugggcaggucacuugaggucuagagauugagaccagccuggccaacauggugaaaccccaucucuacuaaaaauacaaaacuuagcugggcaugguggcggacgccuguaauugcagcuacuugggaggcagagggggaagaauugcuugaacccgggaggcggaggcugcagugaguggauauuaugccaaugcacuccagagacuccgucucaaaaaacaagaucuaaacaugugccauuuacagaaaauacacuucaaauauaggaaucuagaauggaaaaaagaaugggaaaaaaccaugcaaacacuaaacaaaucaacaaaaagcugcuguggucacacugauggcagauuaaguacuuauuuacgguaagaaguguuacuacagagagacacgucacaaugguaaaagaaacaauucaacacaaagacaaagcaaucuuaacguguaugcacuuaacacaaugugaaguaaaaauggacagcauuaaaaaggggaaauagacaauccacaaucagaggaggucauuaacaaucuuucaguaaauagaacaagcagccaaaaaaauuaagugagaauacagaugaugugaacaacaauuauccagcggauccaagggaauacacggaaaauuccacccaacaacagcacagcacacucucuucaaacacguacaacauuuaccaaaacagaucaaauaauggacauaaagcgaggugcaacuaauuacaaagaacugaaaucacggaguauguuuucugaccacaguguaauucaauuaaaaaucaguaaaaggaggcugggcgcgguggcucacaccuguaaucccaacacuuugggaggccgaggcgggcagaucaugaggucaggagauccagaccauccuggcuaacacagugaaaccccgucucuacuaaaaaauacaaaaaacuagccgggcgugguggugggcgccuauagucccagcuacuugggaggcugagacaggagaauggcgugaacccaggaggcggagcuugcagugaacagaguucacgccacugcacuccagccugggccacaggugagacucugucucaaaaaaaaaaaaaaaaucaguaaaaaggcugggugcugguucaugccuguaaucccagcucuuugggaggccaagguggguggaucaccugaggucaggaguuugagaccagccuggccaacauggugaaaccccaucucuacuaacaauacaaaaauuagcuaggcgugguggcgggcgccuguagucccagcuacucaggaggcugcggcaggagaaucguuugaaccuuggaggcgaaguuuccagugagucaauauugcaccacugaacuccagccugggcaauagagcgagacccugucacacacacacacaaaaaguaaaaaacagaaauccagcaacagggagacaugaacaaggcuaaaguuaguccuuuguaaagaguaauacaauugauaaaacuuuuuguuuuuguuuuugagacggagucucgcucugucacccaggcuggagugcaauggcgaaaucuuggcucacugcaaccgcugccucccggguucaagugauucuccugccucagccucuccaguagcugggacuacaguugcgugccaccacgcucagcuaauuuuuguauuuuuaguagcgacaggguuucaccauguuggucaggcuguucucaaacuccuggccucgugauccgcccaccccagccucccaaagugcugggauuaaaggcaugagcccccacuccuggccucucacaucuuaaagaauaauuccuccagagguuaggaaaaaggcacacuuccaaacacauucacgaaagcagcauaacucugguaccaaaaccagacacggacaaauaaaaauaaaaggacaggccaguaccuccaugaacauacaugcaaaaaucauaaaugugagcacaucaaacugaggagggaagggauuaaauacguauauguugauuuucauuaauccaggugcucacagcgagcauguaaucacugcaccaggggauacacagcauuuucaucaagcaaucaauacauaaacuuguuucagguguccacuuaaagacgccuuacugcaggccgggugcaguggcucaugaguguaaucccggcacucuggggggcugaggcggacagaucacuugaggccaggaguuugagaccagccugggcaacaagaugaagccuggucucuacaaaauaaacaaaaaaaaaauuagccggcgugcaguggcgcacaucuguagucccagcuacucgggagacugcagcacgagaaucacuugagcccgggagcagagguugcagugagccaagauugcgccacggcacuccagccugagcgacagagcaagacuuuguccaaaaaacuaaauagauagauagauaaauaaauaaaauuuaaauuuaaaaaauagauacguaaauaaaauuuaaauuaaaaauaaauaaauaaaauuuaaauuuuaaaaaaugugucauugcagggguucccaacccccaggccacagcuggccgcacagcaggaggugagcggcaggagagccagcaucacugccugacuccgccuccugucagaucagugguggcauuagauucucauaggagcgcaaaucccacugugaacugcacacaccagggaggcaggcagcacacuccuuaugagaaucuaaugccugaugaucugagguggaacgguuuccuccugaaaccacgcccccuacuccaacauccguggaaaaauugucuuccacgaaaccagucccuggugccaaaaaagguugggagccacugucucacuggaucugccuuguggauucacuaacacugaacucacggccagcagccccagagcuugcgccugaguggagcuucucgaauuuucucugaaagggacaucauagccuucuuccaccuaagaacaccagacagaacgucggcacuacauuuaggggccacuuuaauccgucaaguagccgacacaaggcacaaggaugugaaaaacggcauucaguacacggcaggaaaggcacgugcucacaguaaaagaucugagagccaagacagagcagcagcuugucccaccucagcuggaacuguacgucagguaacucgccuucacugacacucuacacacaucugcuggcgccugaccguaaagguguugcgaguuuugauuugcgguuucaaauaaauuuuaccaaguaggcaauucaccagcacagaacccacaaauaaugaggacugagugcaugagauacauacacacaagagagaacacuucauggccaggaagcacguuuauuccaccgugcaccguuaacuuaacguuugaaaaucaauuuaugggccgggcgcaggggcucacaccuguaaucccggcacuuugggaggccaaggcaggcggaucaccugagguugggaguucgagaucagcuuggccaacauggugaaaccccaucuccgcuaaaaauacaaaaaugagccaggcgugguggcgggugccuguacucccaguuacuugggaggcugagugggagaacugcuugaauccaggaggcggagguuguggugagcugagauuaugccacugcacuccagccugggcaacagagcaagacuccaucucaaaaaaaaaagauuaaaacuugucaguugcugaaaaaaauaaguuuuaaucuuaaaacuuacauagauaugcaaugaaaacuuacaaaguuagaagacuugcaccaccucagacuuccuuguaaccuguaauaacugagacaguggcgaugacuccgggugagacaagacacaccuuacaggcaccugauuuaccacaaaggcgucacugcagcucagugggggagacaauggacuuuuguuguuuuuauuuuuauuuuuauuuuuauuuuuuauuuuugagacagagucucgcucugucacccaggcuggagugcaguggcgcgaucucggcucacugcaagcuccgccucccggguucacgccauucuccugccucagccucccaaguagcugggacuacaggugcccgccaccacaccuggcucauuuuuguauuuuuaguagagacgggguuucaccguguuagccaggauggucucaaucucccgaccucaaguuauccucccaccucggccucccaaagugcugggauuacaggugugagccaccacgcccagccaccauacaccaaaauguaaacuaaguuggaucacagccuuaaaugugaaaggaaaaacaauaaaucuucuagaaagaaacguggaagaauaucuccaagagccugagguaagcaaacacuccuuaaguagaacacacacacacauuauuauucaaauaaugauugauaaguuggacuuuauuaaaauuaaagacaucacuaagagagucaaugggcaaaccacaaacuggagaaaacagcagcagugcacaaagcccagaaagacuuguuuccacaaaaugugaaugacuacaaaucagaaagggaaagacaacaaaaugggagaaagcuuggagcacgcaaagagagaauauccaaauggccaguacaccugcgaaaggugcucaccagggaaaugccaauuaaaaccacaaugggacaggaguccauauccaccagacgggcuaaaauucaggcaaauucacccucaguggcaaacaccgagaauguggagcaacucccacaaaucauuagugagaaacucaagcaguaugcgucacccuaagcacacaccucccacacgacuccccgcuguccaucaagugccgagugccuauguccacuaacgacgcacacgagggcauucacagcccacagcugaaccaaccaugaccgcagcccauggcagaaaggguggguaaauguggcauccaaaccaaggaccacgaugcaacacacaagacacacacaaccacggcauccaaaccaaggaccacaauggaacacacaagagacucaaaaaccauggcauccaaaccaaggaccacaacgcaauacacaagacacacacaaccacacagacaacucaaaugacagacgucaucacaaugcaauacacacgacacacacaaccacgcagacgacucgaaugacacaggcgucaucacaaugcaauacacaggacacaaccacacagaugacucaaaugacacagacgucaucacaaugcaauauacaagacacacacaaccacgcagacaacucgaaugauacagucgucaucauaaugcaauacacaagacacacacaaccacggcauccaaaccaaggaccacaacgcaauacacaagacacauacaaccacgcagacgacucgaaugacacagacaucaucacaaugcaguaaagacacacacaaccacacagaugacucaaagaacagacaucaucacaaugcaauacacaggacacacacacacaaccaugcagacgacucgaaugacacaggcaucaucacaaugcaauacacaggauacaaccacacagacgacucaaaugacacagacgucaucacaaugcaauacacacacaaccaugcagaugacucaaaugacagacaucaucaccaugcaauacacaagacacacacaaccauggcauccaaaccaaggaccacaauggaacacacaagacucaaaaaccacagcauccaaaccaaggaccacaaugcaauacacaagacacacgcaaccacacagacaacucaaacgacacagacgucaucacaaugcaauacacaggacacacacaaccacagacaacucgaaugacacagacgucaucacaaugcaauacacaagacacacaaaaccacacagacaacucgaaugacacaggcgucaucacaaugcaauacacaagacacacacaaccacacagacgacucgaaggacauaggcgucaucacaaugcaauaaagacacacacaaccacacagacgacucgaaugacacagacgucaucaccaugcaacacacaggacacacacaaccacgcagacgacucgaaggacacaggcgucaucacaaugcaauacacaagacacacacaaccacgcagacgacucaaaggacauaggcgucaucacaaugcaauaaagacacaaccacacagacgacucgaaugacacaggcgucaucacaaugcaauacacaggacacacacaaccacgcagacgacucgaaugacacagacgucaucacaaugcaauacacaagacacacacaaccacgcagacaacucgaaugacacaggugucaucacaaugcaauacacaagacacacacaaccacgcagacaacucgaaugacacagacgucaucacaaugcaauacacaggacacacacaaccacacagacgacucgaaugacacaggcgucaucacaaugcaauaaagacacacacaaccacgcagacgacucgaaugacacagacgucaucacaaugcaauacacaagacacacacaaccacgcagaugacucgaaggacacagacgucaucacaaugcaauaaagacacacacaaccacacagacgacucgaaugacacagacgucaucacaaugcaauacacaagacacacacaaccacgcagacgacucgaaugacacagacgucaucacaaugcaauacacaggacacacacaaccacgcagacgacucgaaugacacaggugucauaccgagugggaggggccagcuggcaucccaugggacgaagaaguccuggcugcuccagacagggcacccucauggggggugagucaggguggggaaagggcccugaugacagacuccaaagccaggguuucugggugagggucccaaguguccccuccgacccugccuucuggaugucccagcagcuuggcugcaccuuccuggcuccguccucuucucacacggggcacccccgaccagccccaggaggacgacuucucuucacggagggucccugucucccuggacucaguacuucugcugcaccugucccuucccaccacgcaucucagccacugaaucaccuuggagaaggcuccugagcuaggagcacuggcccagggccugcaagggcuccagggcaacacaaaugagacccaagucaaugggcacgugacuccacgccucaaaggggcaagagagggucgauuuugaacucuagugggaaagagacgaaggucaagcccaggaaagggagcacccugaagaggagcggagcaaggccgggggugcagcgcagcauccggcgggucucuggagaaccaucuaacccggcacagagccaucgaaugcagcggcccaggcuguggggaggcggcuggagucaagggcagggcagggcugggucagaggcaggacgggcugcugagggucuggcugcacaggcugaccagagcagaccccaagggagggacagagcugggcaggggcaggcagcaauaggcccacugcagccacgagagccucccaccuccuccagccacaggcucagcugccccagugagcgaugcggggcggggaccugaccagacuguccaaggaucugacguccagccaggccacuccccuugcagaaguggguuucgccuccucuccccaggcccuacuuacucuucucacagugccgguucaagugcagguugcugaggucagcuuggaacugaggucccaccaugaucuccugcaaagcaagcaccugggaaucaggacacugaggagcaucuaggccgggcgggaggcuggcugcagcgugcuguggcaggcuuacggggaggggccacuguccagaccccagacccaucugugccgucuaccugcugaugcccaguucuggggucugaaggugggaggcagaggccugggugugugaggggugaggcuguguccugacgccuggccuggcagaggcccagacaggaugucggaggacaaacacucugggucagcagcaggggcccaggcuccgguccaaagcaccuguggccggucccagcccacccuggggucgagcagcacgucccuccucugagaaggggcacaaacccagggagagggcucagcaggacccggcugcgguuacugaggccgagauaccagguuggggagagggcagagccaugggagggaugccagguuggggacacggcagaaccacggcugggaugccagguuggagacacagcagagccacggucgggaugccagguuggggacacagcagagccacgguugggaugccaguuuggggagacggcagaaccacaguccggaugccagguuggggacacggcagagccacggccgggaugccagguuggggacacggcagagccacggccgggaugccagguuggggacacggcagagccacggccgggaugccaggcuggggagacggcagagccacggucgggaugccagguuggggagacggcagaaccacggccgggaugccagguuggggagauggcagaaccacguaccuucuuacauuuguuggcaggaagagaguccuccucggugucggaggaggcagaagagccaggcucucugucuucaucagccaggaaacgagcuuugggaaaacagaggcaggucccccagggucuccacugccugcagccuauacaaccccuucucuccacucccauucuccauccaccugauccccaggccauaacccucucucuggccagacauuggguaaacagaugggcacaggacccaggaccagggaugcaccuuugaagaaagaggccuucccuucuaugcagcugcugcaccucugggccccgagcccucaguucccaggaaagccagcacagaggcuugugaaggaggccgguucugggaaugcugucccuggaucugcuaggggaaccaacauguucccuacuuguuuaaaccaaaucgcucugagaguccaggcucacuggccagcguggaggagaacaaagcacccccagggcuacugacgcuucccgccaggcagacgcccucaucugugaugaguucuuggccugcaucagcccaaggacccuucaucaagcaucacgacugccuggcagggggccuggcugcgguggaguauggggacagagucaccuacauccacuccgguuagggaagaggucggaggccucgugggaggucacggacggggugaggucgucagcagaugauugcgucucuuccucuucuuccccugaaagcaaauccuucgcuauuuguuccuuuaaaaaaaaaaaaaaaaguaaagaacauuuuacaguuuaacaaucucgcaauaccacuaaugauaacaacaguaaagacacugggagugcccugaggcucacauggggcugcuauucccauucugcaaagggugcacagcguggggggagcggggaugggaaggagacacgugggagcccacacccagccaccagagcuggagacaguuagagcugccacugggcacacgcccggagugcauggcucuuucucugacugugcauuugguuuuaaccuucuacaaugcagcccgccccugcucccaacacccaagccuugaccugugaccucuggguacggaauggcagagagaccaguccuggggaggccccgaugugccccuccacccaccaaagccagaaugacauguggccugggguuaaggcuaggguccagccccaugcccauggccauuccaaccccaggguaguggucacagguacauucuacuuauucugggggccuuugugccuccucucacugaacacuccccucugcagagaggcagcgccaggcccccccaccuucagcugugagccaguuccaggaagggcccucacuuacuuuguccagggucaugucugggagguucggggccacgucaccacccucacucucccggucugaaauggggucugacgccucguagccauagagcgcaagcagcucaucaaagggcaugucguugcucugaguuggggaagggaacaaggccccaucaggagggacggcucuggggguuccugucccuguccucuugccugagccucacuggccacaaccagggccacucugucacacccauagcaacuccccacauggcagcacuccccagccagaccucaggcccaguccuucauccaagagcuccuuuacaaucccucagaggcaccagagccuaggggucaccggccagggaagagggcaccacccugcccacaaugccuccuugcacagggugaauuacaggaauacaaggauggugugacacagggugaauuacaggaauacaaggauggugcgacaccuggcaauuuacuauuguaacucaacaucaauauauuaaaggggaaaaaaguuaucugaaaaaggcauuugguaaaauccgacaucuauuccugauuugaaaaaaaaaaaaaaggaacucucagaaaacuacauaaacaggccagacacaguaguucacaccuguaaucccagcauuuuggaaggcuacagcaggcagaucacuugaggccaggaguucgagaccagccugggcaacauggcgaaaucccgucuccacuaaaaauacaaaaauuagcugugcuugguggcauccaccuguagucucagcuacucaagaggcugaagcacgagaaucacuuguacucgggagauggagguugcagugagccaagaucacaccacugcacuccagccuggguggcagagugagaaucugucucaaaauaaaaaaaaagaagaaaacuauguaaacggaugcuucaucaauauaauggagaagcugucaauucacacucagucaaaaauggguaaccagagcagcccccaucacgaucuggaacaagagcacugugauuaacgaacacuguuuugaugcucugagccaauguaauaugacaagaaguauaaauaaggcacguaauuccugggaaggaagagaugcgaacuaucaacaucaugcucuccagugcugcuuucaaauccuucuguccucccuugugugagccucuauuccacagaggcuaguccugucugcucagacuccacgcugaucccugugggucacuuucagcuuccaacuuccggaacacucccucucauucucucaagauguuagcacuggccuccccuccaccccagcuccugcccagacucaaccugggggcuucaaguccacauagaaaccucccagccuagucccagcccuucuccagguggaauaucuacacugagucccccuuuuguucucucacaggaccccguggaaagaacagauucuguauguccauuaccuucaggauuaugaaggugggaagguugacacagugguccagaggcccuuggguugccugaaccucuccauaguagcccaaggugaagacccuuuccuaagagcacucagccgugacuuccauuuuuggcuucauugaggcuugcacugauagugcagcauuggcagccggcaagagcccagugcccguggaagcugcagccagugcaucccugcccacaagucacugcugucacauuccucacagaccaaaagcaaacaccccagcuucacuucagaagaugcuggacagccgggcaggauggcucaugccuguaaucccagcacuuugggaggcugaggcaggcggaucacgagaucaggaguuugagaccagccuaacuaacauggagaaacccugucucuacuaaaauacaaaaauuagcuggggauggugguggguuccuguaaucccagggagaaucgcuugaaccuaggaggcagagguugcagugagccgacauugugcuacugcacuccagccuaggugacgagagcaauacuccgucucaaaaaaaaaaaaaaaaaaaaagaagaugcuggacaaagugagcauuuuguuaagucucacccugagcagauguuuccaugugcugugagggcgugggaagcaugcagaaugcaccugcugcauaccaaagugaggugguuccuucaaggaaccacaugcauggaacgaguggugagacgaagaggcuguuccuggucguuucaccugaaagaaugcuggccaacuauagccacucagaaaggcaccuggcaggcgcugccuuguaugcaagccaggggggcuguuacugcaaaggaaacagcugaccauaacugcugcaaugguaaaacucaagauuuugaaaaacuuggguuugacaacaugaacuugccgaauuucuaauauuuaaaaaacuuacaggccaggcacgguggcucacgccuguaaucccagcacuuuggaaggccgaggcgggcggaucacgaggucaggagauugagaccauccuggcgaacaugaugaaaccccgucucuacuaaaaaaaauacaaaaaauuagccaggcaagguggcaggugccuguagucccaguuacucgggaggcugagggaggagaauggcaugaaccugggaggcggagcuugcagugagccaagaucgcgccacugcacuccagccugggcgacagcgagacccugucucaaaaaaaagaaaaaaaaaaaaaaaaaacuuaugauaaggcugguggugauaucaacuguuacagucaacccuaagccccaacaugacuauauuuggagacggggcauuuacagagguaauuaagguucaaggaggccgugaggguggggcccugauccaacaggauuaguguccuuucaagaaaaacaccagaaggcucccucuuguucucuauccaccaugugaggacacagcaagccaagaagagagccggcaccagaacccacucugcuggaccuugaucauggaccuuucugccucuugaccugugagguucacugauacggucucagauuccacuccacaacuacucucuacaaaacuaucacuugauggguuuugcuguagcaucaaagaagaauacccacaauuauccgaaaagcugugaaauacuccuaccuuuuucaaccacagaucuggcugaggcuguauuuuaacuucagccauaagagccuaucacaacagaucaaugucucccuuaaaagacagaaacugaccaggcguggcucaugccuguaauccaagcauuuugggaggcugagauggcaggaucaacuugaggucaggaguucgagaccagccuggccaacaugguaaaaccucgucucuacuaaaaauacaaguuagccaggcaugguggugggcaccuguagucccagcuacucaggaggcuaaggcacgagaaucacuugaacccaagagguagagguuccagugagcccagauugcaccacugaacuccagucugggcaacagagugagacucuguccccagaaaaaaaaaaaaaagacagaaacugggucagguacaguggcucacaccuauacucccaacacuuugggagaccuagguagaaaaauugcuugaggccaacaguuugagaccaacccuagcaacauagcaagaacuccacaaagaaauaaaauaaaaacguuggugaggugugguggcgugcgacuauagucccaguuauucaggaggcugaggcaggagcaucccuugagcccaggaguucgaggcugcaguaaacuaugauugcaccacugcacuccagccuaggcaaaagugagauccagucucaaaaaaauaaauaaauguuuuaaagacagaagcuuggccaggcgugguggcucaugccuguaauccagcacuuugggaggccgaggugggcagaucacaaggucaagaguuugagaccagccuguccaacaugaugaaaccccgucucugcuaaaaauacaaaaauuugccgggcgugguggcaugcaccuguggucccagcuacucgggaggcugagguaggagaaucacuugagcccaggaggcggaggaugcagugagccaagaucacaccacugcacuccagccugggaaacagagcaagacuccaucucaaaaaaauaaaaagacagaagcuggauuuucauauuugcuucuacauucaaagagauauggaaaacuaaaaauucagucuucuaauuuuuuuucuuuugggacaguucuuuuuauuuucauaaaaauauuuauauuaacaugucacugauuuauucagccuccugaguagcuaggacuacagacgugcaccaccacgccuggcaauuuucguauucuuuuuuuuucuugagauggaguuucacugugucacucaggcuggacugcaguggcacaucucagcucauuuuaaaaugaguuagcgaauaaguauuuuuacaugucaauuuuuuuuguuuuuuugagacacagucuugcucugucccccaggcuagagugcaauggccugaucucggcucacugcaaccuccgccuccuggguucaagcgauucuccugccucagcccuuugagugcugggauuacaggcgccugcuaccacgcccggcuaauuuuuguauuuuuaguagagacgggguuucaccauguuggccagccugaucuagaacuccugaccucaggugauccaccugccucagccucccaaagugcugggauuacaagcaugagccaccgcgcccaacaauuuuuguauuuuuaguacagacaggguuucacuacguuggccaggcuaggcucaaacuccugaccucaugauccgccuaccucggccucccaaagugcugggauuacaggcaugagccacugcauccggccaauuuacaugucaguuuuaacuuuucauguaauaaaaaagcaauagauaaagcacauuaacaaagcuccuugaaacucuaauuuuuuuuaauuuuuuuuuuugagacagggucucacucugucgcccaggcuggagugcaauggcgugaucucggcucaccgcaaccuccgccucccagguucaagggauucuccugccucagccucccgaguagcugggacuauagacgugcaccaccacgccuggcuaauuuuguauucuuuuuuuucuuuuuuggagacggagucucgcugugucacccaggcuggagugcaguggcacgaucucagcucacugcaagcuccgucucccggguucacgucauucucccgccucagccucccgaguagcugggacuacagucacccgccacuaugcccggcuaauuuuguuuuuguauuuuuaguagagacgggguuucaccauguuggccagccugaucuagaacuccugaccucaggugauccaccugccucagccucccaaagugcugggauuacaagcaugagccaccgcgcccaacaauuuuuguauuuuuaguacagacaggguuucacuacguuggccaggcuaggcucaaacuccugaccucaugauccgccuaccucggccucccaaagugcugggauuacaggcaugagccacugcauccggccaauuuacaugucaguuuuaacuuuucauguaauaaaaaagcaauagauaaagcacauuaacaaagcuccuugaaacucuaauuuuuuuuaauuuuuuuuuuugagacagggucucacucugucgcccaggcuggagugcaauggcgugaucucggcucaccgcaaccuccgccucccagguucaagggauucuccugccucagccucccgaguagcugggacuauagacgugcaccaccacgccuggcuaauuuuguauucuuuuuuuucuuuuuuggagacggagucucgcugugucacccaggcuggagugcaguggcacgaucucagcucacugcaagcuccgucucccggguucacgucauucucccgccucagccucccgaguagcugggacuacagucacccgccacuaugcccggcuaauuuuguuuuuguauuuuuaguagagacaggguuucaccguguuagccaggacggucucgaucuccugaccuugugauccgcgcaccucggccucccaaagugcugggauuacaggugugagccaccgcgcccgacaauuuuguauucuuaguagagaugggguuucaccauguuggccaagcuggucucgaacuccugaucucaagugauccacccgccucagccucccaaagugcugggauuacaagcgugagccacugcacccagccugaaacucucaauaauuuuuaagaguacaaagcagguucugagaccagaagauuugagagcagcuggcuuaauccuugaccaccgugcugcucagagagccccaugaaagaccuggucuccacugaauuucagcuacuaggacagcaucuggcacuuugcaaaaagauguacaauuuagcacuuaccaauguggaaucugagcugcacaaaacucaugaggcuuaccccggagggcuccacccaacacaggggcaggaucaccuuggccaaguaccugggagaugaaguccuucuccagcuccuccuugggcuugucugggcaccucgaggccuccucgcacuccccccuaacacuguaguucugugacaggaucucugcgagguugaacugauggucuccagagcccauggacaccacuggggagaagagagcagcccaggugagcaccgugccucgccugucccaaccauccugccgagacuacugacgccuggugaagcccuaaggaugaggcccucugcaugcugccaggaucagccucaugagggaacccaacaggacaccccacgacuaaugcacacaggagcacggcuggugagcugcacauacaaauuccaaggauuuuuuuggggggugggugugucucuuucugagagacugcuugucuuccugaacacagagaagccugcgaggauuuggggagcaaguggacuagaaagagaccaacacccaucucguuaggguagaaggagcagcaggacucagucgagguggguucacaccggacuccaugacuccugaaacgggggugacgcugaacccucaccugcacaggucaguacagcaucaaggagcaugcagggacaaaccaaugggggcucgacaacaccagucccuuaagcuccgucugcagggccacaugaagaagacaugcgauguacauggcccaacaguugacggcugucaucagauccaggguuuccccgaaagaacugggaugugucaccauuccucugcauguuuacucuccaauuggucaaauuuuuaaacaaacaaaggaaauagcuagggcucaaucaauccagacagagagcaguguaggccaaggcugggggccugagggccugggaguccagggcacgaggccucuagggcagccacacagccuguagggcugggcacacaggugugcaccacacacagcccaugcacagaacaugcagcugcagggcacagaggacccccagcggcaggcaccucguuagagugagggaaugaccuggagcugaaugggugcgcccggacccucaguggccaccgcacccuuggaggagccacgugagggaaaacagggauggcaccgccuucucuggggacucggguggugacuaguuugauacggaaagagacgcagcccuacaccuggcagaaggagcccagccaggggaagaacagucauagagacccuugcccuacagcgucagcuccuccccgcaggcccaacgcagguggcuggcaggcgggcaugggaccuugaugcccacugggcaagcagcagcgcagggaggugcagggaacccggggugcugccugucucgccgcccuccaccuucucagccccggcucccucagcaagccaccccuucccaacacccuggcaagaugaggcagcccucagcucggugcaggcgugugcccggguccucugcugggggugcugggcucugaggauggucuugggucgccugggcucccugccccugcuaaagaacaggaagacgggaguccugaccacucugccccacagcuccaucugaacgggugggagcugggacacccuggacucuggaagccagugugccgguccacagcucagccaggcccagcaggcauucugucucucacagccacaaaggccuuggcggaccugagcaggggaaggagggaggaagguaccugcuguugucugcaagcccggcuccccugggcacaggcugugcucgaggcaggagaccacgcgaggacucugccuccccagcgaggaggccugcgaaggaagagaggcaggguuagcucggccggcccaaaaccugcugcuggacaucacaguguggcagccaagagcaagcgcuggucagagcccaguccccagugaccagggaaggggcuuugucuccgccucugagggcuggggggcacuaggagcagcacacgcauguggccgccacucgccccgccucccaccaaggaccgcucacaggguggaggcguucucgcccagggcaggacaugcaucaugugacacugaaaacugcccacacacaggccuacaguccugacccaugcugcaaccuggaugaagcucaacaacagcaugcacugggagggaagccagacaccaacggccacagcguaggguccacugauaccaaacauccagaacaggccaguccacagacagaaugggggcucgugggggccaggagccagggagagagacagugggagagugacugcuaacggggacagggcuucuuuuggggaugacagaauguuuuagaaucagauagaggugaugguugcauggucgugaauacacuaaaaaucaaugaauuauaaacuuuaaaaugggcauauuuuaugguuugucaauuacaauuuuuuuuuauaaaaaggcaaacaaaaccauuauaaguuaccauuaucacaauguucaauaucucucuuuuuuuuugagacagagccuugcucugucgcccaggcuggagugcaguggcgcaaucuuggcucacugcaaccucugccacccagguucaagugauucuccugccuuagccucccgaguagcuaggacuacaggugcgcaccaccacgcccagcuaauuucuguauuuuuacuagagaugaggguuucaccauguugcccaggcuggucucaaacucuugaccucaagugauccgcccgccucggccucccaaagugcuggcauuaugggugugagcuaccgcaagccacgauaucucucauguacauaaacacaaaacccucaacaaaauacuagcaaacugaauccagcaacacauaaagaugauuauaagccacgaccaaguaagauuuaccgcagggaugcaaggucgauuuaauauccaaaagucaauuaauauaauacaucacaucaauaaaauaaaaaaacaaaacacaggaucaucucaacauacccaauccaacaaaauccaacauacuuucauaaggaaaaauacccaacaaacucagaacagaagggagcuuccuucuuggaaaaacccauacuuaucauugcccucaauggggaaaggcugcuuucuccuucacaccaugagcaccacaacguguacucucaccucucaugcuaaauggagggcuggaugguguagucagcguaaaagcaucaaauaaaaagaaucaagaucgguaaggaagccgggcacgguggcucacgccuguaaucccagcacuuugggaggcucaggcaggcggaucccuugaggucaggaguucaagacuagccuggccaacauggugaaacccugucucuaccaaaaauacaaaaaaauuagccaggcauuguggcaugugccuguaaucccagcuacucaggaggcugaggcaggagaauugcuugaaccagggaggcggaggcugcagugagccgagaucgugccacugcacuccagccugggcaacagagcaagacuccaucucacaaaaaaaaaaaaaaaaaaaaaggcugggcgcaguggcucacgccuguaaucccagcacuuugggaggccgaggugggcagaucacgaggucagcagauggagaucauccuggccaacaaggugaaacccugucucuacuaaaaauguaaaaauuagcugggugugguggcgggcaccuguagucccaguuacucgggaggcugaggcaggaggaucgcuugaacccaggaggcagagguugcagugagccgagaucgugccacugcacuccagccuggcaauacagcaagacuccaucucaaaaaaaaaaaaaaaaaaaaaaaaaaaagauugguaaggaagaaguaaaacuaucucugugcuggugcuggugacaugaucuaaaaaacuauucaaacuacagugaguucagcaagguugcaguacacaaaaucaauacauaaaaaucaauuuuauuucuauauaaaagcaacaaauacaaaaagaacaauuccauuuacaauagcaucaagggaagugugaaauguguacaguacucugagugaacaaagcaguguugaaaggaagauccaagggaauguaaaggcaucccacguucauggcugagaagacaacauuaagacggcaacaccccccacugauugacaaauucaacaccaugucuaucagaaccccaguuggcuucuuuguagaaacccacgagccgauuucaaaagcauauggaagcucaagguaccccaaacagcccaaacaaucuugaaacaauacuuccugauuucaaaauucaccacagagccacagcaaucaaaacagugugguacugccauaaggacagcacaaagaucaacgaacuagaacugagaauccagaaauacagucacacauucauagucaacuggauuuccacaaagguaucaaaacaguuccaugaaggaaugaacagucuuuaacaaaugguacugggacaguugaauauccaugugcaaaagaaugaaguuggaccccuaucucauaccauaugcaaaaauuaccucaaaauggaucaaaggccuuaaauauaagagccaaaaccacacaacuuuucggagaaaauauauggauaaauauuuguaaccuuuugauugaaucuaaaaauguggugggaaaaaaguuugugaccuuggauuuggcaaugguuucuuagauaagacaccaaaaucacaagugaccaaaaaaaaaaaaaaaaaccaaauggauaaacaacuucaccaaaauuaaaaacuuuugugcuucaaaggacgcccccaagaaagugaaaggacaacugagagaauaggagaaaauaucugaaaaauaaucuaucugauaaggaacuucuucucaguauaaagaacguuuaaaacucaauaaggaagagagaaucccauugaaaaauaggcaaaggaucugaacagacauuucuccaaagaggacagacaaauggccaauaagcacaggaaaagauacucaauguaauaucaggcaaaagcaagcaaaguccacacuacgauaccacuuccuaaucagagaauaaaaacugugcucaaaaagacaguaacaaguguugacaagaacguggacaaaguggaacucuccugugcccugccggugggaaugucaaaauagugcagccacuuuggaaaauaguccagcaauuccuccaaaaguuaaauaguauuuaaccaugugacccaggucaggguccuaauauccaucagcugacaaaaacaaaacaaagcacuagcaacggggcaaagaaggacgcacugacacacuaccacauggacgcaccucgaaagacucaugcuccugaaacagccagacacaaaaggccacgugucguaugacucauuuaaucucaaaugucuagagcaggcaaauucguagagacagaaaauggauuccugguggaaaggggcugggaguugaucugggguuuggggagugaccacuaaggggugugggguuccuuuuggggugaugaaaauguuuuaaaauugacugugaugguggcugcacaacugggugaauacacuaacaaccacugaacuggacacauuaaaacggugaacugcaugguaaaugaauuauaccucgggaaagcugcugccaaaaaggguagauuaaaauauuuaaugaaguuuaaaaacuuguguaguaagaauuucaauacuucuucacggguccucaagaaaaaaccucacaggugguauaaucauuccccucacaaaaaaacaaggaaacaagcucaaagagauagagucaguuacccaagcucacacagcagguucaguggugcaguuacaaaguggagcucaggccagcggcuugcaaacaccuuccagcccaucacacuacuggggaacacaacggcuaguacaguugacccuugaacaacgcagggguuacgggugccaacccuccacacaggugaaaacccaugcaugacuucugacuccccgacacuugauuaauagccuccugcuggucgggagcacugccgauaacaucaacaguugauaaacacauauuuuauauauuguauuauguacuguauucucacaaaaaaaguaaacuacagaaaaaguuauuaagaaaauuguaagaaagagaaaguguauuuacuauucauuaaguggaaguggaucauccuaaaggucuucguccucaucaucuucacguugaguaggcugaggaggaagaggagggguuggucuuccugucucgggguggcagagauggaaggaaauccauguauaagugacccaugcaguucaaacccgugagguucaagggccaacuguacagcaacguacagcaaagccacggaagggagcuggggcagccacuggcccuggagugacucuggcaacaaggcugccaaggaccaaggagcaccucaagcucuaaguggagacugacaggacccauccagcuuuagaaaguuuagcuccgugguggcagagggcaaacagaagacagagggaaggaagagccagcagggcccccagggggaaggggccacgggacuggaagcaagcagcacagagugcauggcagcugcaggggcaucucacgccuccugcccugggguuggccugggucuggcagagauggccucaccucuuuccaggacacagcagguggccaccagcccacaaccacucuacacagccacacgcggugugaagccacagggaaagcauccuaagugaccucugaaaucacccucagcccccucuaggacccucuggguaggggucgaggacagguucucugggcaacgguuccugccucagucaggggcuggcuuucuacucccgcaaccaggagccugacuaacaaggggauggcaggcgaccacaucaaaugaggccccagucuggacggcaaguugacaacagucccgcaggcuugagauccacaccgaguaacagggaguuaacauauggccccaggagagguggucugcagggucugaggaggaucuggcccuuauaugacgugccauuuaacaggagagcuaaggcagaggggggcaaagagggaagcggcugggaacggcagaaagggccgcuaacagggaggcccugagcagccugggauccccaaguucauuuccaggcgacucugaguuccuggaacuuaccacggaauacagacuucauggaucuucuuccucccgcugccccugccugguguccaggugcaagucuacucucaaagcagguucccagggacucuacuucacucacucagaacacucugcauguuucccucugaguucacucccaggaaagacaaaguccucuguuuugucaaaguggaagcaggaaaaagagggggagcaggccaacgguauuccaggcaacaaaaaaagcaaaggaagcguaaacagcauucuagaaacaagguccagaggacaacaggccacagacccaggcguccaccagggucuucaggcaguagaagcggcagccagcuacucaacauaaagacugcaccagaggacugggugcagagcacagaccagcccuucccccagggcagcccccacagguauagagugcaccaaaaacacaagaggccacccugcaaagcuuaacccaaaaugacaggguggcagguuccauucgccaagauggcugcaccuaccucucccaugccccaagcccucuccccagugugacugaaacaaccuccuccuaagagccaugcuugacccuccucccacccacaccaacucaagugccaggcgcuuguuggacuacccagcaccccacuccuccgucugaccaauguucccugggcgcccacucugggcucagcaaggcaguggcguggugguuaaccugagaaacaaguuccaccugccuccacccacauggaguugcuaguuuuggacacagacaacaaacaaguggacauguaugguaccgagaagagaaaacagggcgcacgggcucugcaacugcgggucagggaaggccuggggggccucagucgagguggaaccaucguuggcagcccccaaauggguagagugcaccagcaaacaggagcccagggcccuagaguagggggcagauccguggggaccaccucacagggcugugggacucagcaaggaggagcauuuuaucccagggaccaugaaaagccauggaggguuuuagguaggagcaaaagauggugcucuuagguuuuuaaaagaucaaucuaguaugccugagaaaaguaugaagcauucccgucugccacuguggugcuuaugauuauucugggauacugauacagaauaaaguagcuaguacugaucacgugcuauaaaguuacaaauugccacuuuuacggguuaaaaacaguggaauaucgucaacuucacaagauucaacuuccauguacaagccguuguggcaggaccucaucagaccuccuagcucugaagggugaccauuaaacuucccauuucagagaugaggaaaaggaaguucugagucacugggcaaccugcccaagaccacacagaacaaguccgguggucagacagcuugccauggcuccucacgcucagcaccucauacuuguugguccuaacccacccacgucucucucugaccagacucugcaucccuguaggagaggcccugucugcuccauucacucccagauccucaggccgaggacagagcgggaccuccuuagaaaaucaaaucaaauucacucaacagggcaccaccccaaaguguaaaacaggguuaacaggagcagccggaccacaagcugcugugcacauuuacggagcucagccuagagcagggcagaacagccacauggcagcucugggggaggcuggcuugggagucugacuugugccaucccagacacagagcuaccugucaggccacguguguugcccagauuccaggagcacaacucauucgaccaccacgucgcugcagggccacugggagacgcggcuucugccuccgacccuggaggacagccaccaucugcauggggacucagucucccuaagcgucucaagaagaacuaauucucgaugaaggaacuggccgguggucuggccuaguaucgagacaccuacaccgucuuuggcauaaacacagggccuguuacugccccugaggucgucaccagggggagagaauggccaguccugccucccacaacgcccaagacauaaacacgcaacguggcaccacggccaggccgcaguuccaaucccggcuucccacgaggcggcugugccuggcugggugggcaccuuuuccuuugggcucuaucccagagauaggaucagcucuugagucugcccgccugucguaacuucugcgcacagaagucaugcacugagucccacugacugagcaccucgcagccgccgcaccuucaccuacauuaucucuuuccaucuucaccagggcccuccaaggugaaagcaaguccacacaggcucauccaccacuccaaaaucaaaaaaagcuucaaaagcgaaaguuucuuccuuccugguuugaccugacacgaagcuaucuguugucuuauccuagacaguccuagguggguuugaucaaacaucacaguccaaaaucccacagauccucaaauuggaaaaauucuggauuccaaaauauagcuggucccaaacauuucagauaaagggucccgggcuuguuuccuggacgagggaggaggcuccagaaguaacuucgugcccgggagaggcugguccaacucuucugagaucagccccgacgcucucuaggccccggcagacccacccacccugcgcccaguucgcgccaggcggguccgcgucgggaguucaaaucccgcccggggucugacccagccccgccggggggcucgcgggcggcggaggcgcgguggguccaccgggaucccgauggggagcgcggggcgccuggcggccccagcacucggcaaaguuggcaaaggcgcgggaggggaggccugcgcgccgcggggcccgggccggggccgggaaccggagccggacccuggaacggagccgcgcgcccaccggacccccgacaccagccccgccccgcgucccuccccucccccaccccggcccccgcccgccccgcgccgccgcgcaugcgcacugcagcccgcgauguggcagccgggggaguuggggggugggggccggccgggggcggccgccgauggagccccgcgccccuccggccccggacgggccaggcgccccggccggccucagagcuccagagcggggcucuccgucccuggggcccacgacgaggccgagccacggcggcggggggcgcggacgcgcgggggcggggggccggcucccccggcccgcucacucaccuccgccauggccgugug

SEQ ID NO: 192160 - RNA, 10957 nt, Homo sapiens
ugaggguggaggugggggcgaucuuuauuguggcggugggugggagggggguucccacgugagcccuggugcuauagagagccggccguccuccaggggugagcuggggaggcuucugcgguucuggagucccggcgauggcgccaguuccccagcaaacccccuccagagcugcccccggaugcacagacaaggagggggcuugggagugacuugaggcugugacggggucgcccucggugugggcaagugaguccucuguggccaagaggucagagucgucccugaggcugagucgaacacagacccguggcccucauaaaauuaaacauaaaagcacaaaaauggcgcaaccagacagcauuggcuucagacaggcaggacacggggccccucgugugaccugugacuuuccacaaagggcaaggaccuggcacugacuccggccaguggagaaggcugugccgcccacccggccaugacucagacccagaggcugaaagccacagacggggccgcagggcagcagcucccgggcucucgugaaacacuucagaaggaaaaaaaccuaaggaacagaauccugaauggagaaaacccaacuuuuuuaaaaaagaaggaaguguaugaugggaaucuacgggguggguuuucuuuaagaggugagaacuuggaaucuugcaagcacugggaguggacuccggcggcggcgcagacguggagcagggagcguccucgggccaccuguggacagggaggggcgcucagacuggacccaccucccagcgacccacaggcgggacccaggagcccacaccuggcuagcagaucccgcccaccacaccuggcucaggaguucccgcccacccacccaccacaccuggcucaggaggagcucccgcccaccgcaccugccucaggaagaguuccucuggcggacguucuugccuuugucauucuggugcugcccgcugcucuuccuggggcacgaggggccgggugagagggugucccccgcaagucacucucuccaagucaccccugcccaccccggcccccaggacccccgaauacugaagcccaggggcucugccuuuguguuuuaaaggccuggggcagcaggccgcuccuugggacccccgacccccacagcuggaacuuacaggggugcagagccggcgucgucaucugaagaaggaccgccgccaugaaaaagaggacgagaggacagccugucagcacuggccccacucaggccccgagcaggggcaucugugcugccagcccugcccucagugacccccagggguggcucggggcagcucaucagccccggccacgugcaucuucugagugcuguggggaaaggcagcccuccccaccugcaggugugcuccccauggugagcuguccccauggccucgugggccucaccccugccccacagcguuuuccaggagcugccaucacaggccccacacaggccucgccccggcacacgcagcccaaggggcagaagggcuccgcgaggaggcaggcaggggcugccggagcacagcauggcugaccucagguucccgagccugaucaugcagagcagcaagggccggcucaccacggaggacacuggcuugcagccaagugagcgggagggaagggccgggugaggcuguggggcggaggugccgccuccuccucccggggucccgcugcccacugagccgcagcugcccggggcuagacccuccaucccacacuuucuuucggggucccaucaacucccugccuggggcuccucaguuccaagcucugggucagcgguggggcuggcagggacggaccaggaguggcccugggccaccccgagagcagggcaugugggcaggagggcagacggcucaccauccaggacguccucgggcuuccggcgcuucucguagaugaagaugauggugaccagcaccagcaccucagccacgaugcccaggaagggccagagggcggccagguggcugcgcacgcggagcgugaugauggccuggucggagcccuuggagcuggugccguugcaccgguacuggccggggucggccuccauguucagguucucaauguguagcucugaccggcccugcgaggaacucacgaagaaccugcucucggagccguucaugagggccuaggggaccaaaggcaagggcugaguccaggacccccagucuaggccccucacccaguccugagggcugaguccgggacccccagucuaggccccucacccaguccggagggcugaguccgggacccccagucuaggccccucacccaguccggagggcuggguccgggacccccagucuaggccccucacccaguccugagggcuggguccgggacccccagucuaggccccucacccagucuggagggcugcaguccagagggcuggguccgggacccccagucuaggccccucacccaguccggagggcuggguccgggacccccagucuaggccccucacccaguccggagggcuggguccgggacccccagucuaggccccucacccaguccugagggcuggguccgggacccccagucuaggccccucacccaguccugagggcuggguccgggacccccagucuaggccucucacccaguccugagggcuggguccaggacccccagccuccuuggcuucucaccuuguccucagagucagugaucuuguaccaggcccagucagugacagguggcacggacucugacuugcagaccagcauggccgucucccccucguugauguguucugacgacuucacagccuucacucugggaggcccugacaggagggugagagagaggagccuggaaccgcaggcccgcccccauccccggccucccgcaggagggcuguuccccuccagggagcagggggccagggcucugggaugugccgggugccucaggccaacaacuucucccgacagucgguggugcccgguaccccuggcugcaggacucaccguggagcuggauguuggccgugcccaugggcucggggaggaagacgcaggaguacucuccccacuggucgucggaguccacccugcaaccacagcaggcaggugagccgcguaccagcucugcaggacgccuccaaggacccaggguucuccaggggcccaaccacggcacagugaaaaagcaaaacugucccagucaagucugaaccucaaaagaacuccugggguccccgugcggccccaaggacagagccaggcuggcaagaccccacaggugagagaaccaacagacccccuucuccccgacugaugaaccccacaccucuggucccugcucugcaccccacacccugugaccgucuucccagucagccugaaaacaaaaggcucugugcucccagggccgucccagccccaguuaugacaaagcuccggccaugacagcgucugggguccgagcagggcaugccucaguguggugcccucuugugccaggagcacagagccugggaggcccgcacacgugcccgggaccuggcaguguggcgcccuuucgugcccgggaccuagugaggagcaagcaauggggacuccugccagggcugcuggagcccccugccucacaaggacgccccucagaccccucccugggguuucccucugggggucugcgcggagcuggucccuaacuuccgccuggaucaagccugccgaccggucuuuuguucucacggaccacaggccgcuggcggcaagagagccgugagaaggggcagguggcggcauggcguggucaggcacucacuugaacuccguuuucuggccgggcagcgcguccuccuucagcaccacgccccccuucagccagcggugcccugugaccucuguggcgcugucauucaaggagcaggugaggaguaucuuggagccaaggucuucuacgguagugaagacugugccggcugcaaggcccggcgagacgcggucagcagaguggaggagcacggcccgcgcugccugccugacccccaggaaccugcggcuccuccccgggaaggacugguuuucaucccaaaaauacaccguggcccuuacgccccgaggaccggaggcccaaggggaacuucuggccacgccuccgggaagggaagagcccagcgccugcugaggaggccccuucgggaaggcacccccuucgggaaggcacccuucgcuggcagcuggcgggcccugggcuaaggcgcugggaacccagaggccccgccuggcgauguuccugcccagagacacacgaggcugggaccaggguguggggacagacaaggcacccacccacgucccugagcagggaccagggcaucgagcucuuguagcagccccagcacaaacuggaaauucuuuucuaaaaacguagccagcugggcgcggugguggccgggcgcggaggcucacgccuguaaucccagcacuuugggaggccaaggcggguggaucucgaggucgggagaucgagaccauccuggcuaacacggugaaaccccgucucuucuaaaaauacaaaaaauuagcugggcauguuggcucaugccuguaaucccagcuacucaggaggcugaggcagaagaaucgcuugaacccgggaggcggaaguugcagugagccgagauugugccaccacacuccaccugggaacagcaagacuccaucuccaggaaaaaaaaaaaaaauagccacagcacccccggccaaggcucccgugcccuucucuaggaggcacucagguggccccacauccccccagccccaggcugacggcacuccagcagugcugggagcaccccgguucuucugccaauccccaaccaagcaaaucucuugguucuugguuaguuuacaauauucccgcuaggaauugaaauuugaaaaucccuuagaacgagaugcugcgaaggacacagaagguucugagaccugcaagccugggcugagcuuggagggccccucaggcuugcaguauggacgcucagggagggagccgggcaggcgcccggggaagcagaaacgacggaacggauggcacgagggucgaggggaggacgaggacccaccugcuggagggcagagcccugccugccccgagccaggccgcccagcgcugguggucaggcggcgagcccacccccuucagguccgggccccuccguccaggcggugggcccaacggggcacagcgggacggagaggggaggaggcgucuggguucuacugagcaggagccgggaggcgagcggcacaggagggaaacugagggaggcggggagggaggugcccgccacucacguuccaggacuagcacgacugccugggcgcggacccacuugacccugggcgcccgggucaggugguugcgauccgggucguugcuggcccggcacucguaagugcccguguccuccuccacgagcgugucgauggagauggugcuggccgcgugcuggugguagguggcguggauguggacgcgguccagccgggcgccgucccagagcugggagcaggugucguugggacccugcccuucaaaccaccacuggaucucgggcaccgggcugcccacggccucgcagugcagcuccacacugccccccacccaccucugcugggacagcggcgccuggacgaagccggcuguggggagagcacgcguggggucuuguuagugccuggggcacuugggagggcagcuccuggggaaggccucgcccacaggacucccagccagggcugguggagaagccacuuccuuucagcuugugggagagugauggggcccggcuggaaacagcauggcaugggaaagaccgugggcgucccguccacugcuaccucacggcagccacggcggcuucugagggcacaacugugggaccacacgugguuucaaaacacaaaacacaugaaacugggcagaagagccaggaguccugagccccgagggcugcccagagcucaggucccaagcgcaccguccucugacuucugcccgauacccugaccccagagacccgggugagcugcugagaaaaacaaaccccaaagcccaaaggggcaggcggccucuguccagaagccccuagcccggcuccguuaggacagcccguggguggaaagcucguguccucagcaaucucugagggcggcgacccagagagaggcggauuugggaagcugggagccaggcagggccucagggccucucaccuccagccacacgccuccccuuccuucgaaaugcaagggaaggcccccagagcugccaaggagcacagcagaauccacacagaaccucacacugugccuagcacucgccugccaggaacagcccagcccaaggggaagcguggggagugccuccucccgccaggaccuugcagcccuccccacagcaccuucugaggucagacuccccaggcaccgcuacaacacacacacacacacaaggacacacgucugcaaacacacacaacacauacacacgugcauaugcgugcacacggcuccgaggcugcguggcagugcacaggucacggcccccaaggccacggggacaggaauguucacgucugagcaccucaggugagcucugggcaggcgcaguugacaaguuuuggcagcgccauuuucuuucuccucuucuucuuuuuuuuuuuuuugagacagagucucacucuguucagcagugguguaaucucagcucaccgcaaccucugccucccggguucaagcaauucuccugccucagccucccaaguagcugggauuacaggugccugccaccacacucagcuaauauuuuguauuuuuaguagagacgggguuucaccauuuuggccaggcugguauugaaccccugaccucgugauccacccucuugggccucccaaagugcugggauuacaggcgugagccaccgcgccuggcuggcagugccauuuucacaaagggaucuccuccugguaaccuacauuucuugggaguuaagauuucccagacugcaacacuggcagcuaugugcagagcugggcgaggugagucagggcaggaagcacagccagaggcugcccagcuggcaagcuccuuccugcccugcagcagccccucuccucauccuccagaccugcagggcugggcuccacauccuccucacccaggggugcuaggagagggcuggccccugacucaccucaccccaccuccaggcagggcagggcacacaggaaagugaggaggaccagguggggcccgcagccgagcugcccccagccaccuuuccaggagucccgggcucccaggcgccaucugcaccggucccggugcucccgcuggguccgccagcuucucagcgggcagcaucgcucccaaagggaccaaaaggcuuuggauggaacaacccugugucccuccggaugcugaugaugcuggugucuguguauugacgugucacugggggugggggggcguccggaagagaaagccuccauagaggcuccucggggacaaugcagagcgcccccaccccacggaccaccccaucucgcccgccgcaccaggagccuccacccaugagcagcaggaggagggacggcgccugacccucggccacagccccagaaagguuagaauucgauucuggccacaugagacguaacccauguucucaaguaaagucaccuucaucuaaaaacagccuccgccuccuugcccagggcucagggccaggcaggccgcgugguacuuguacacaagcagccccgcaggauaaggcugcccgcccccacccgcccuccuccccacccaccccagugcucagacagcagccagcgagaacagcucugggaagcagccucgggcaccucccccacccacccccaccggccgcagccaggcacucccacuccucucaucugaggcucgggggugaagcccuccacccucgggacccagcuagcacaccccggcccuccgguccccgacaagcccacaggagacgcggacggccaaccuugggcacucaccccacccggcugugccccaccaacccgcagacgccccugaagcaaguuucaggagaggcaaacacagucacgaauucacagagcaaacagcaguguccaccccacacgggccaaggcuguguugcccagaccuuguggucuucacgagucaguccccagcaaaagugggguuucucaccacacacacacacgcgcacacacggcuacaccgcugcacggcggcgcugccagcacugcagacuccaccugcuucccaggcugcaggcagcucuggccaguaagccccaggcuaagcuuucugcucagaagaaacccuucucagucuccugcacaaaugcacaaaaggaacaaaacugugaaccacccuacccagcagggagagaccaaaggucuuucacccacuuggcuguccaaauuagcucaaugugggaaccucgugcugugcuugaaacccagucaggccuggcuggguuuccacagggcuggcgggggcggcuuaucuuccgcgcucaccucacccaugggcuccuaucugugucuccccagagagcuggccgcagugcuggggccaggcccuugcccaggagacauucgauaaagggccacuuugguuaccaggaagacgaaaucucagacguaggucaggaguuagcuggcaaagccucuggaagaaggagcccccuccccagccucugcccaaggcccccuacggcucaaugcccaggacagaggcucgaagcccuugcucuugacccuucaggaggccagacccuccagcucugcaccuuguucccaacacaucggucacaauaaauuuuuuuuuuguuuuuuuuugagacggggucucgcucugucgcccaggcuggagugcaauggcgcgaucucggcucacugcaagcuccgccucccugguucacaccauucuccugccucagacucccuagcagcugggacuacaggcgcccgccaccacgccaggcuaauuuuuuguauuuuuaguagagacgggguuucaccguguuagccacgauggucuugaucucuugaccucgugauccgcccgccucggccucccaaagugcugggauuacaggcgugagccaccaugcccgaccucuuuuuuuuuuuuuuuuaaagacagagucucccuguuacccaggcuggagugcaguggcaugauaucagcucacugcaaccuucaccucccagguucaagcgauucucuugccucagcuuccugaguggcugggauuacaggcgugcgccaacacgcccagcuaauuuuuguauuuuuaguagagaugggguuucaccauguuggccaggcuggucuugaacuccugaccucaggugauccacccgccucagccucccaaagugcugggauuacaggugugagccaccacgcccggccucacuauaaaucuuuaacccagaaccaaaugggggucucaacaaaggaagaaauuuucuaugaagcaagaaaggaugucaugcuuuucucccggaaaaacacaccucaauccauuucccaaaugcgcucuccaaaccacguuugcccacccucaacacacggcccuccuaagacagcacuggaaaccgaaugcgggucagagucggcuaaaaacgacuuucucacuauuuccugcgcugaaucggguggccagggcccccucacugugaccuuggaaccucgacuucccacagggcuguuuccucgccuguaaaggaggaggggcguucagagaccaccucauucugggugcugaauccaggcagaaucagagggagauuccgccuucccuuccacgcagggccccucgagggagccugcgaggucuuaagagucugggagaacacccgggggcaggugcacgcccuaggcaagacgccagggcuaaaucccgugaagaacgguaaucccuucccgauccggagggcugacccacucagagccuccaugugcucuuggaggacaaaagccccuuuuccagaagggagcgccaagaugaucgcuccaggccgcacgggcccuugcgggggccccagagagucucaggggagggucucugacccuaacacucgcaggcaggguggacccgucuccagauuccacgcccaggccgcuuuccccagguccugcggaguccagccccagcaggacggguugggcaggcaccaaccagccccugaccccuggcuccaggccaaaggggacgcucacccaggcuuugggucucccuucuccuggccgaugggaccggcgggcgggccaccuccaaccgccuucgcagacgcccucacccaggaagcaggucacccccaaccccaggugaccgaaaagcaagacgcccaccuccccugaccaagaccggccuggccaggacccccuggcucccgccuccaagcagggagcuucacgcccacacacagaggccgggcucgaggccggagcgcccgggggagcccggcaggccgcgccgggaggaaccucuaguccccccucaaacccugggacuucacccccaagcuccaugcuggcgcgggaagcccccggggccggccuuucgcaccccaggccgccccgcgccgaggccccaggcucccgucggcuucgggucggcaccgcggccuccauucccggccccugcaggaccgcacccccgcccccuacccgcuccucaccagccccggaggcuccgugggugcccagcagcgcgaaucccagcagcacgaacagcgcagccgccaugauuccuauuccucgccgguccuacaaccuccaaccgcugccgccgccgcccgcggccgcuauaaaaagcggcggaggcgcggaccgggcgcgcgcac

SEQ ID NO: 192161 - RNA, 10242 nt, Homo sapiens
acguccggggcgguggggaaggcaagauggcggcgcccauggagguggccguguguacggacucggcggccccgauguggagcugcaucgugugggaacuucacucgggcgccaaccugcucaccuaccgcggcggccaggcgggaccccgcggccuggcgcugcucaauggcgaguaucugcuggcggcgcagcugggcaagaauuacaucagcgccugggagcuccagcggaaggugcggcggugcggucucgcugcuggggucauggggcgcccgaggcugaagucgggggauggguuggugggggccgcgugcacccuuagucggaauuggcguggggaggggagguggucuccguucgggcgcucugcgcaugcgcgggucugggggcuuuggggagauacgugcgaccuguuaggccgcucugcgcacgcgcggggcucaggccugagcugcuaugggggcagugggggaaaaugggagacgcuccggggggucccuuggggcaauugcgcaugcacgaguucuuggagcgcgaaauuugauuaaaaggggccuaugagcucuguggauguugugguucuggaggaaaagggagaaggaccaaggucugggggagucucccaugaagggguggcgcaggaaacucauguuuauuccuccaauaaagcaacagauacucaccgucgcccacaguuuccccucuacucccaagcccaaaugcagccagucccugaagcuacucgcuucccccgugugcccgcugagaucucuugggacuggcucugugcuccagcauugccugauggagucuacacacaacucauaaauuucucccauuuuauuuuaguuuugagacagggucucacucugucgcugaggcuggagugcaguggugcgaucucggcucacugcagccucugccucuaggguucaagcgauucucgggccucagccuccugaguagcugcaacuacaggcccgcaccaaccaccacacccggcccacauuuguauuuuuuguagaggcaggguuucaccauguuggccaggcuggucucgaacuccugaccucaagugaucugcccaccucagccucccaaagugcugggauuacagccgugagccaccacgcccggcugaguuuucccauuuuagagaggaggaagcugaggcuuggggucuuagguuggacauuauggauagaaggauuggggcacaagccuacugggcucuugggccccaguguccuucuggauccucuuuguucuguuccuguacuccucccacccagggccccucugacccucagaggaagcaccaaccucacaucuaccaccuccagccucgaagccucuugcaggggcgaacacuuccuugcuggaccaugcauuugcucaaaccacccugcucccgacuccucuuccugguucucugacuuagccauugcccaggcguccccuccccucgcccuccacugcuguaguagcucccguguccugcauggggcucacgaggcugacugugcauccuuaggaccagcuccagcagaagaucaugugccccgggccugucaccugucugacugcaucacccaauggucucuacguccuggcaggaguugcagaaagcauccaccugugggagguaagaggagcaaagcgugagcguuucccacaggacaucucagcccaucugagcuuugccugcagggcaccagggaacaaccaugcggccuggggcccugggaugggugacugcucagggguuauagccuaagcuucacccugcugccuccuuucuccagguccccucgagacuugcgaaucccagaccagcccuaauccugccuugagugcuuggauagagcccggugcagcccaguccccggcacucacacaccgcagcaucuuccagggcuagcgggcaucucuuccacgcaggcggcagcgccuggcacuugugacuugaaaguuauaaagggcggccgggcgcaguggcucaugccgguagucaaugcaaccucugccucccagguucaagcaauccuccugucucagucuccugaguagcugggauuccaggcgcccaccaccacaccuggcuaauuuguuuguauuuaguagagaagggcuucacaauguuggucaggcuggucuccaacuccugaccucaggugauccacccgccucggccccccagaguagugggauuacaggcgugagccaccgcgcccggccagugccuccuuuuucuuaccgcuggaccaaccaggugacagcaacuccuagacacacucacagcccggauccugccaugcucucacugcgagacagagugaacuguucaggcuuugcauuuaggccagcuucucagcucugcccuggugaggggaagcagcccuggaugaugugugagugagugggcacagagaugugccagggagacuucauucacaaagucaggccucuuggaguuuggcccauaccguagcuguggcguuagaucaccggcuguguugucacaaaugguccauuauauuucgggggagaccugcccucaaccccacauagagcagggcagacaguacaagaucuggggccagaagacccaaagguaaccauguuucugcccuuccugaccuuguccuugcuucccucagugggcugcucagagaacugagagggcugggugggcaugagcauucucggagagauaaaaaagccaccaggggaugggcauggcggcucaugccuggaaucccagcacuuugggaggcugagacgggcagaucacuugaggccaggaguucaagacuagccuggguaacauggugaaaacccaugucugcaaaaaauagaaaaauuagcugggcaugguggcauacaccuauagucccagcuuuuugggaggcugaggcaugagaaucacuugaauccgagaggcggaaguugcagugagaugagauuguaccacugcacuccagccugggugacagagcaagaccuugucuccaaagaaaaggggggucgggacaggcagcacaggaaugacaggaggcaucauuaucucacccucaggacacguguguauguauuuaauuuuuaaacuuauuuuugagauggggucucacuacauugccguagcugcucuugaacuccugggcucaagcgauccucccagguagcugggauuauaggcaugugccaccaugccugggaucccaaggcuuuuacaucucacuccaugauuuugaaacuaggaugcaguugcugagagggaaacugaggcagggaagcaguagcucacgagucaccccuaacaguagaccuccuagcccugguugcugucagucuggugcagaggggcauguggguaggaauuaaaugugucaucgccccaugggggaugucuuaggcgggaccccuuccuguucuuggcucgggacagugugcuggguggcacccacugccagaccccugcuccccuagccgccuccaguuuuuuuuuuuuuuuuuuuuuuucagaugaagucucgcucuguugcccgggcuggagugcaguggcucaaucucagaucacugcaaccucaggcucccagguucaagcgauucuccugccucagccucccaaguagcugggaggcgcccgccaccaugccuggcuaauuuuuguauuuuuauuagagacggaguuuugccagguuggccaggcugguuucgaacuccuggucucaggugauccgcccuucucagccucccaaagugcugggaugacaggcgugagccacugcagcuggcccuccuggagaguuucugacccgugagcugugaccaugaaggggugucccacauagccagagcucaggccgggacugccuccacuguaccccccugccacggucgaaauccuccuccuguucucuguguaggcgacgggugugugagcggugagucaggagugggcuggaaaccugagagccagggcuguggggcgggagcugguccgccccucccacgccacagggacagggaccucccgggaggcacugauguucugaagcugcccggucugucccggcccugggcagugguggucaccagagcugcccucugugguuuggggcugaccuggauccugcuuccucuggugccauuuaacccuccccagccacccuggguuuugcaugcgaggaaagcgaggcccagagagggcauggcugucagaucugggcccagcaggcucugccugccccaacaaagcacgacgcacagggacuuucgacaacagaaacucggcccccauccuugaggccagacguccuaaaucaagaugucuguggggccacgcugccccuggaggcccugggaggagccuucccaccucuccggugguggccggcaccccuuggcacccuuggcuugugggugacuguccccugccucugcugccaccacugccgcguggagccccuguguguuugcacuucucucagcuuacaacaaccgggacacauggauggaugcccccgcuccagaaccaccucaucuuaacuuaugauaugugcagagacacugcgucuaaaugaggccauucacaggucccaggucgggacuuuuaacaugcuuuuggggggaaacacgauucaauccacaacccccaccagagcaucucagcucucgaauccacaaccccccacagagcaucucaggccucgaacccacaacccccaccagagcuucucagcccucgaacccacaaccccccagagcaucucagcccucgaacccacaaacccccccaagagcaucucaguccucgaacccacaacccccuccagagcaucucaguccucgaacccacaaccccccccagagcaucucagcccucgaacccacaacccccaccagagcaucucagcccuccccagguguccuggaaggggcucccuguccucuuccucagauggagcugccuggcuuccugccggagcuuaagcugccaccacccugggucaggccaccacagccugcccagaagcgacuuccuguugaauggugggagccgccugcagguccugagugcagccguuccuacggggcccacacaggacgccuggggucaggcucacaggggaccagcaccucccugaggcagcagggaagggcaggaaacuugccccuuccugggccaucaugcagguggggacgaggcgggaacaggugcccacccagcccaggcaggggcgcgacgaggccccgcuguaccugcuggccgcugcccugacagggucaccccgcaguccuggggcagggcaggcagggggcgacaguguggccauggccgugcagugguggguuccuggggcugcagccccccuuuccuccccuggggcuuuccuccccugaccuggauacccucugccccucacaggucuccaccgggaaccuucuggucauccugagucgacacuaccaggacgucuccugccuucaguucacaggggacagcagccacuucaucucagggggcaaggacugccuggugcugguuuggagccucugcagguagcgccuugcgcacucaggccugcaccuggaacugcacccgggcucaggcggggagaggaggcgccaaggccccuggcgggaaggggcuucucucuugggggcuggagugcagaggacggagugaucaucccagggguccuggcugcccacacuggggucugguuuguucugggggccgugggggcccagccuugaguuuacucaggugaggcaggccaggcugcugaguggaggcaggugugugcgugaggugggugcuggaggcguggacugcccuguucccuccgcuccccgccugcugagcaccugccccaccccgcucagcgugcugcaggccgaccccuccaggauuccggcgcccaggcacgucuggucucaccacgcgcuccccaucacggaccugcacugcggcuuugggggcccccuggcccggguggccaccuccucacuggaccagacggugaagguacgccgcccccaccccaccacgguccaugagcggagcccagcagccgcagguccucagccaggaaugcaggaaucgccuccucccgcucccugcugucaggacuccagacggcuuuuaauccccuggugcucugagcccaaggacguccagggaggucugccagccuggaaauuccuacucauucaccguuucuggcccggcucccuggccaagccuggggaaucggaggucaucacuaugcuugagucgugaccggugguccugggagggagaaccaggggucaucagccggagaccaagcuccauuucagcacaggccauguccccuggcccccaagacccacauggugacggcuuucacccaaagucgcaagcccuagggccagaggacagccgacgccugaccucccuggugccccuguucccaugggguccucggguucccccugccgggccgagccccacgcccuuugcccacccgcagcuaugggaggucuccucgggggagcugcugcucuccguccucuuugacguguccaucauggcagugaccauggaccuggcugagcaccauauguucugcgggggcagugagggcuccaucuuccaggucgaccucuucaccugggugagugccgcggucugcgggcugcacccugcccuggggcugagggcaucgggccugcggcucacacacgucucggccuucgcagcccggacagagggagaggagcuuccacccagagcaggacgccgggaaggucuucaaagggcacagguggggacgugggaacggggcgggggcucccaggcacguccugucuggcacgucccaggugaccccugucugucuguccaggaaccaggugacuugccugucaguguccacugacggcagcgugcugcucucaggcucccacgacgagaccgugcgccucugggacgugcagagcaagcagugcauccggacgguggcccucaaaggugggcgcgccucugcucggcccgcggccagcgcgcaggggaaaaagccagcaggagcuccgggcuuggcuugggugggggcggggacugguuugcuguggggcggggccgggcugggggcguggacuggcuguggggcggggccuggcugggggaguggacuggcuguggggcgugggcuggcuuugcuguggggcggggccuggcugggacggggcggggccuggcugggagcgugaacuggguuugcugugggguggggccuggcugggggcguggacuggcugggggcguggacuggcuguggggcggggccuggcugggggcguggacugacuguggggcggggccuggcugggacggggcggggccuggcugggacggggcggggccuggcugggggcgugaacuggcuuugcugugggguggggccuggcugggggcguggacuggucguggggcggggccuggcugggggcguggacuggcuguggggcggggacuggcugggggcggggacugcccuggauggggcggaacuuggcuugcugugggguggggccuggcugggauggggcggggccugaccuccgcgccccccaggcccagucaccaaugccgccauccugcuggcgcccgucagcaugcugagcucagacuucaggcccagccugccgcugccccacuucaacaagcaccugcugggcgccgagcacggggacgagccgcgccacgggggccucacucugcgccugggccuccaccagcagguacggcccccagcagggaacccccacugcccuuuugucccggaagaccccgcgggcccugggcuccuucgcucccuugguccuggcgcccgugcggcgguuccccacaagcccggcacuggagggcgcguccugugagugggauggugaugcucgguggggccucugcccacucucaguauggacccagaggcucugagaaguuaaccaccccucuucccccggccagcagggccgagcugcacgccccacacaccagccuuccugcggcuggauaucugacagucaguuaggucuuucugcaaaaggccgaugccccauacuucgggcugugagagccaaaagguucacgucugggcugccgaaggugcaggagcagccgugagggcagggagcggguggggcccugguggcugcagguggcucccacgugggcugggggcagccucucggccuggccacagucacgcccucacucccugcagcucagcaccgacccccgcucugugcagguacuagggugggcucccuuaccuucugaggguagagugacuuccggaacacuucccaccccagccccaagacccucauagaagccagugugguuggcugggcugggcuggggugggggcuggggguuccuugggccuggggaggcuucccaguguguuuccgccucacuccccgaccuucgaugagcugccugcguccuuggugucucacgucacugucugugucccucgcugggcucuggcgcuuggcacuucuccccacgcgcccucuucuuaccugaguacagauugauuuuuuuaucuggagggugcccgacagccugauggccugacaggcccugcaccaggagaugccguuaucucccuuguccgugcuuccucauggagugacacucuguuuucccacaucuaccagugggcuuggggcgggcaggcaggggaccgccaccgucugggcauccgcaaggccccucagacugcaaggaggccaggagcacaggcuggacugacugcuaacagcgugggcgcaaggaggggcgagcuuuuuguucagaaagugccggaacuuucggagugaaaacaggccuccagcggcagagccagcuccacgcuagggcgccugcccggccacugccuccuccuagggcagcagcgguucccacgauuccugcccagccaagcgcucucccuagaaccccaccuaguuggccacagugggauuccggagggggccaggccaugccuccgguaaugccgccaccuuucccuagccgccccaccuggcucccuuccucccgugacggcugcuaguccucugugacccuuguuccaauccagcugacacuggaauguuggccugucccacagacaggcgcugcuggggcccaaggcgcuucguccaggaggcggguucccgaccucugaucccccagcaacgucccuccauguaacugguuccucuguacagggcaguggccuugcugggccggccaggcucuccccauggcuggaggugcucacugucugugaggcccucgccaggcccugugucccagagccuucccugggcuugcggguccuuccaggucuggcccaggccccugucugugguguggccaucugcacccccauccccagccacauccuugggcgcagucguggaggaucugaggcgcuggguaaugacugcauggccagggucaggguugucaucugcaggcucgacggaggugaacgcccccgucucagucuucccuucugucugugggcgucacgguggccccucccuggcugaguggcugcccacgcuggcgggggugggaugggcaaagcguguggugugugacaggacgcgccccgaggucacguggcucccuguguuacagggcucggagcccagcuaccuggaccgcacggagcagcugcaggccguccugugcagcaccauggagaaggugggcggggccucgggaggggcggggccugaggcuggggucaguccuggccagugggggugaguggccccccuccagcacaccccaggccacuucugcccucugaccccgacuucucccgcagagcgugcucggcggccaggaccagcugcgcguccgugugacggagcuggaggacgaggugcgcaaccugcgcaagaucaaucgggaccuguucgacuucuccacgcgcuucaucacgcggccggccaagugaggcccggagaccccggcccgaggcgcccaggccugagccccaugccucccagcaaccagggcccgcggguguggcccccaccagcccaggccuggacucuccucaguucugugucguguucggguuuuuccucugugacugggccgucuuggugucucguggcacgcgucacaguggugcuagucuguuuuuaacaaaagaggaugaaaagccccuccucuccggc

SEQ ID NO: 192162 - RNA, 2852 nt, Homo sapiens
uccagcaggcuaauuugucuguuuauucccacaagguagccaggggugggggcgccgagccaagcccagcaggccaugggaccuuccuccggcggggugcacgcuggauuuucgggucugccccaccagcagguuugcaggcaggccgucaugagugccgguggaaggcuccaagggcgugggcaggggcucgggcggggccacacacuuguggagcuagaaauaguggggcagguccuucucuaucaccugucggggaggaaagcuggguuagggcagcuaccucccaagcccccgagccucaagcgggcucccuagagaggaccuaccaggggcuccuccauggguccguagcgcuucaccacgcagccguucuugucgaugaggaacuguggagagacgguguccaaacuguggggccaccccugcaaggggcugaggcugcccuuccuguccgcugcccaucugggccacggcuguggccaggggaagcugguccccuaccccccacagcccccuuaccuuggugaaguuccacuugauggcacuggaaaagaagcacauggacgugagcguccccagcagccccccacaguccccaagcuguccugucuccaggaggccacaagggugugagcuuccccggcugccuccacagccacagugcccccaagcccccccagagccaucuuaccccaggaggccaugcagugugagagucccaacagccccccacaggcccccgagccauccuguccccaggaggccacaaaggugugggcaucccuggcugccuccacagcccucuaugucccccugagccaucuuacccccaggaggccacgcgaugugagagucccagcaccuccccgcaaccgccccccgagccaugagccauucugccccagggaggugugagcaucccagcagcccccccacccccaccccagcagccguacuguccccagaggucacgcacuuucccaggaugcccuugcccuuggguuggaucuucauccacuuccacagcgggugggcgucguccccguucacgcagaucuugcugaacauaucgaauuugacguuguagcccgcggcgaacucuuugaucucuucguuacucccuggcuccuguggcggccaaggugugugagugagucgggggcuggcacccccucaguccgggcccccugcacacucccaggcccucuccaggcuggagcccaccccgacccccacccacccgccucugcgggccccggggacgcagcagcccaccugcuucccgaacugguuacacgggaaggccaggauccgcaaaccacacucagcguaucgggcgugcaggucgacgagcugaguguaguuuacuucggucuugccucacugggaggccacguuggugacgaugcacacgaagccccugcgaggaucggcggcgucagcgcagaagaacacggcccccucccagggcccgaccccgcgccccaccccaggcgagcgcccaccgguacuuguccagguuaaccaugugcccgucgauguccuuggcggaaaacucgugcauggagcgcgcacagcgccagucgucccgggacgcgcacugcaaggcaaaggaagcugagcagggagcguggacgggaggcugagcccgggacccugaggcaggaagggaucgggagcgggucgguggcggggacaccgaggcccugcggcccugaagaccugaacgcuccuccuccuuaaacgcacacgcccccuuguacuucugguccgguuuuaccggagacccggaggccgggagaggguuccaaccccaaaaugugccacauuagccggugugggggccccgcgcgcaccggguccugggacuugggacauucguggaucuccggucgcaagcugcggggacagggcuucuuccgccggcgccgcgcccuccugcgccugcacgcuggggccuuccgccgccgaggggcucgcggccgccgccugccccggcucuggcaccgcugccugcggcgcccgggggagccugcgcccgcgcggcccauacccgcccgucucccgccccuccuggcucccccaccccgagcgccgcuagcggggacaaagggcccggaggccguagucaggacugcgcgacugugacgccaccgcgcuaggccaaggugcgggggcggggcggcgcccgggggcgcgugauccgggauuuccagcccuccgcgcccccaaccgcucgggcgcagcagccccgcucggcccggagacgccccgccguggcccucaacgguccagcuccgccccagccgucccggaccccgcccccugcaagccuggacccccgaccccggccccggcacgcgcgccugcaacggccuggacggccccuuccccgaccacgacccgcgcgcguggaacaaccccuuccccuuccccgaccccagcccgcgcgccuacaacggccuggagggccgcggagcgcgucgcaguacggucacccgcguccgugcccggccggggguggggagggggagcccccagacgccccccaccaaggucacuggagccugaggguuccccacgccggcgagcggaggcagggaucgcgcgcccgccccaacggucaccgggccggcaacggccgcggcgcuagcucaccauggucccggccaggccaggcgcggccagagccccacagagcagcgccggcuucaguaggcggcaaaggcggccgaggcucaucgcggcggggcugggagccagcggcuccuccccucguccagccgaccaauggacgcgcgucggcuuuccgcgccuccuuucccacggccacgcccuccagagcgcuc

SEQ ID NO: 192163 - RNA, 22637 nt, Homo sapiens
gcgugucgggcgcggaagggggaggcggcccggggcgcccgcgagugaggcgcggggcggcgaagggagcgcggguggcggcacuugcugccgcggccuuggaugggcugggccccccucgccgcuccgccuccuccacacgcgcggcggccgcggcgagggggacgcgccgcccggggcccggcaccuucgggaaccccccggcccggagccugcggccugcgccgccucggccgccgggagccccguggagcccccgccgccgcgccgccccgcggaccggacgcugagggcacucggggcggggcgcgcgcucgggcagacguuugcggggaggggggcgccugccgggccccggcgaccaccuugggggucgcgggccggcucggggggcgcccagugcgggcccucgcgggcgccgggcagcgaccagcccugagcggagcuguuggccgcggcgggaggccucccggacgcccccagccccccgaacgcucgcccgggccggcgggagucggcgccccccgggagguccgcucggucguccgcggcggagcguuugcuccugggacaggcggugggaccggggcgucgccggagacgcccccagcgaaguugggcucuccaggugugggggucccgggggguagcgacgucgcggacccggccugugggaugggcggcccggagaagacugcgcucggccguguucauacuuguccgugggccugagguccccggaggaugaccuagcacugaaaagccccggccggccuccccaggguccccgaggacgaaguugacccugaccgggccgucucccaguucugaggcccgggucccacuggaacucgcgucugagccgccgucccggacccccggugcccgccgguccgcagacccugcaccgggcuuggacucgcagccgggacugacguguagaacaaucguuucuguuggaagaaggguuuuucccuuccuuuugggguuuuuguugccuuuuuuuuuucuuuuuucuuuguaaaauuuuggagaagggaagucggaacacaaggaaggaccgcucacccgcggacucagggcuggcggcgggacuccaggacccuggguccagcauggaggugguggacccgcagcagcugggcauguucacggagggcgagcugaugucgguggguauggacacguucauccaccgcaucgacuccaccgaggucaucuaccagccgcgccgcaagcgggccaagcucaucggcaaguaccugaugggggaccugcugggggaaggcucuuacggcaaggugaaggaggugcuggacucggagacgcugugcaggagggccgucaagauccucaagaagaagaaguugcgaaggauccccaacggggaggccaacgugaagaaguaaguauggcuugcuggggucggggccgggccgggccagucacggugcugaugguucugucuuccuuccuucucuccucccucccucccuuacuuccucuuaacacccugagcuggacccgucuggcgccuguguccuccgugccagggagagcgugguugggggccugcguuacggacuuucacucaggcaaggccaguugucgcagcggggcgugcguuugcaugggcucuuggacuccaguuaaaaugcccugguagcgaaacccuccugagaagggagcggcccccaauccccuaagacuagccccuuggcucccccagcuguccaaggagcagaggcgcccaguggaaucagccuguguuuguuugggccccgagaguuugugugcggccgccaacacguuuucugcgcaguguguggccguuaccggggccaggcgaaaugugauuuguuuauccugucagaggggaacccugggcugccaaaaauaacuguuugcaccggcuuaucagucagcaggagggaaacguagccuuuccucauuugccagggaugugacgcuggaagcaucccuggcccccggggcuggaagcccugcccgagggggacugugccucccucccgaauugcauccggaagaccuuacuuuuccaacugacuucuucaggcacggggcugccgcugggcaucccggacgccucugcaucugugcgcggagaagcuccuaccuagggcagcacuggccggccugagccucucccagcugguggggguggccgggggugucccugccuuaucgcagccagacacgcugcaccugccgccgccuggcgggcccugcccaggcccugcuccuuucccagccuucuuaacuuucaaaacuuugccuccuguuuccaagaaaggaccuuaucugcugggcuaggccucgagggacuggcaaggacacccugcgcagggcaccaugaccuuggaaggagguccggggaggggcugcugcggugucugcucucaccuuccuccugcucaggggcccuggggcuccugccgugucugcucucaccucucuccugcucaggggcccuggggcucacguacauuuuuuuuuuuuuuuuuuugagacggagucucgcucuguuccccaggcuggagugcaguggcgcgaacugggcucacugcaagcuccgccucccggguucaugccauucuccugccucagccucccgaguagcugggacuacaggcacccgccaccacgcccggccaauuuuuuguauuuuucaguagagacgggguuucaccguguuagccaggauggucucaaucuccugaccucgugauccgcccgccucggccucccaaagugcugguacuacaggcgugagucaacgcgugcggccuuuuuuuuuuuuuuuuuuuuuuuuuuugagacggaguuucacucuuguugcucaggcuggagugcaguggaguggucuuggcucacugcaaucuccgcccccuggguucaagugauucucgugccucagccucccgaguagcugggauuacaggugccugccacagugcccagcuaauuuuuuuuuuuuuuuuuuaguagagacgggguuucaccaucuuggccagguuggucuugaacuucugaccucgugauccaccugccucagccucccaaagugcugggauuaaaggcgugagccaccgcgcccggccagcacgcuucuuaaucagcaugcaggcugugacaugcggaaaccaggggcacaggcucugaaguuuguacucuggagcuggagcagucaggguuaaaugggagcggcugggaaggguguguuuccacgaggccuuucugaugucucagugcccagucuggacccggguagaagguguggccagugccuugagucaguggagcaguugccugugccuggucucugugagauggguuggucaggggcuaggcagagccugugccuggucucugugagauggguuggucaggggcuaggcagagccugugcuggggguagcaggugcccucuaaaggggccagugacagucucucucccagcagugagaaacccacgcuuaggggccgggcgcgguggcucacgccuguaaucccagcacuuugggaggcugagguggguggaucgccugaggucaggaguucgagaccagccuggccaacauggugaaaccccaucucuacuaaaaauacaaaaguuagccgagugugguggcgugugccuguaaucccagcuacucgggaggcugaggcagaacauugcuggagccugggaggcggagcuugcggugacccgagaucgcaccauugcgcuccagccugggcgacacagcgagacucugucucaaaaauaaauaaauaaauaaauaaauaaauaaauaaauaaauaaaucuggcuugaguuuugacaaauguauaugcagggucaaugggaagacagacgcuggaggguggaagccugacugugagagugagcccccugcuuuccugaacagucaguggaggagguccugggagcucaggugagcaccugaacgguagggcagagccugagggucuugguggagacaggcaagaagguugcaggaaccuagucuggcccagugccugggagaacgggagggaacacggaggcagggaggcagagggguuggcaggaccuggacuggacugugcgucgcagcuacccacagcuugaccccacugccuugaagugagugaugcacccucacuaguguucagcguccaauuucauccuggcccugaguguguaacggcuuugcccuugcggggcccccugggaugaggggugagcccugucccuuccuggucacugucugccaucaggagcugccccgcuuacagcugugauucaggagccacugcauuuccuccagcccccugggugcugccaggggguccuccuauucugggagcugguguguucugacuggaggcugccaugugcagagugcugucaaggagaagggguguccacugcccagcccugaggcccaaggccuuggccagccuugcugccagcgcugcagggaaaaagccuccuuugugugugggaaguuuaauaaacuccgcucagauugugucucgcagcgagugucuggaaccuuccagacaagccucaggcguccgguccuccaguugguguggaaagcgugggcgaucaccaagggggguggguuggggcagauggagccggcgugagucccgucucuucccuuccuucccagaaaggcagcccuggaguccaugccuugucccgcucucaccggcaaaaaguauaaucuuauuagaaauaggaaaguuccaaaaagcaucaaugaguuaaaaagagggcugggcauguucggucaugccuguaaucccagcacuuugggaggccaaggcggguggaucacccgagguugggaguuagccugaccaacauggugaaacccugucucuacuaaaaauacaaaauuagcugagugugguggcgcacgccuguaaucccagcuacucuggaggcugaggcaggagaaucacuugaacccgggaagcagagguugcggugagccaagaccaugccauugcacuccagccuggguaacaagagugaaacuccgucucgaaaaaaaaaagggcuggggccgggcgugguggcucacgccuguaaucccagcacuuugggaggccgaggcgguuugaucacaaggucagaaguuugagaccagcguggccaacauggugaaacccucucucuacuaaaaauagaaaaacuagccaggugugguggcacaugccaauaaucccagcuacuucaucugaggucaggaguucaagaccagccuggccaauauggcgaaacuccgucucuacuacaaauacaaaaauuagccaggcgugguggcgcgcgccuguaguccagcuacuggggaagcugaagcaaggagaaucgcuugaaccugggaggcggagguugcggugagccgagaucgcaucauugcauuccaggcugggcaagccuaggagagaagagcgaaauugugucucaaaaaaacaauuaauuaaaauaaaaucagugccauaggcuguuucugguaggcaguggguuccuaggguggagcagggaagggcuggaaagggucgccugugcccagcccgacuccccgugcuucucgggggacagcacggcuagcugcugcugcggagcccacagugggguucugggggggggggugcaggcagaaggccgccaugccucccucccccuuuccaccccagugagagugggcucgaaggcagggagucugcccgccuuguggagccuccgcagaggcacccagggcugccgugagcgcacagccuggcggugucccacggcccugcccuuuccugucacuuccaccuguugcaaaacacugugcuuucguaucuuuucuuucuaccuguuuggaaaugugaaaaucacugcugccguaggaaacgggcccagauccgggcuguggcucucccauccgcaccgcccccgcgguguccagccaggaggugggaggugggcggcacucagugugccugguugcggcgaugauuggcagaugcuuggaccuaugguaaagaggauuuucgcgagcugggagucaguccuggacuuuguaggucuuuacaucccaggcggccuuuaugggguuccagcaucugcugaggccccugcgccagccaugugaggccuggguguccucgaggccucuguuugugccccucucugggcagcgggagggagagcucugagacccagagggagcucaggggcugggcagccgcagaacagcggggguaauggguccacuggggguucugggcugugcacacagugggcuuccggugcccagccagcuggggcaggccuggaauguugguuccucucucaggaucuggggcgcugcuguagcugucggggaaucagugaggcggcuggacggcccguauaucccacaaacgccaccguauugcucaaacuggacucaauuuucuuaacaccuuuuuuuuuuuuuuuuuuuuuuuuuuuggagacagggucucacuguaucgccgaggcuggagugcaguggcgcaaucauagcucugggcucaggugacccuccugcccccaagguagcugggacugcagaugugcaccaccacacccgacuaguuuuuuguagagaugggguuucgccauguuguccaggcuggucucaaacuccuagacucaagcuauccgccugccugggccucccagagugcugggauuacagguaugagccacugcuucgccacguucaccuuuauuuacuuauuuauuuauuuuugagacggagucucgcucugucccccaggcuggagugcuguggcacgaucuuggcucacugcaagcuccgcuucagccucccaaguaagcuggaacuacaggugccugccaccaagccuggcuaauuuuguuuuuguauuuuuaguagagacgggguuucaccguguuagccaguauggucucgaucuccugaccuugugauccgcccgccucggccucccaaaguccugggauuacaggcuugagucacugugcccggcccaccuuuuuauuuuuuauuuuauagagacaagggcuugcuguguugcccaggcuggucuugaaccccugaccuuaaguaauccucucuggccucccaaagugcugggauuacagguguaagccauaguacugggccuaaaguucaccuuuuuuuuuuuuuuuuuuuuuuuugagauggagucucgcucugucacccaggcuggagugcaguggcgugaucuuggcucacugcaagcucugccucccggguucacaccauucuccugccucagccucccgaauagcugggacuacaggcgccugccaccaugcccggcuaauuuuuuuguauuuuuaguagagaugggguuucacuguguuagccaggauggucucgaucuccugaccucgugaucugccugccucggccucccaaagugcugggguuacaggugugagccaccgcacccggcaaaguucaccuuuuuaaaguguguaauucaguggcauauaguacauugacagaguugcacaacuaucaccucuaucagcuuccagaacauucuuguuaccccagaaggaaaccccgucucugucagccaucacuccccauucccuccccagucccggcacccacgcauucccuuccugccucuggauuggccuguccugaacauuucacacgaguggugucacacaccgcguggccuuuugcguccggcuugucucacggagugugcuguccucaaggggcauccgcgccguggccuggguccgaaccucucugcuguucacggcugcgucacuuuccaguguguggagggccacgcugcguuugacugcucaucuguggcuggacacuugggcugcucccgccucugccugugaauuguggcugcuuuggugcacgugugcucagccggcgucccucuagaauccuugagggccuuguuucagccacaucaggagggauucagggaccagggcacgcgggucuggagcuggguguuccugggucuccaugugccucccaguccugcucugagccgugggaggccggggcgagggccaggcccaucucuucccuguaugaucuguuucuaggcagacggaggcuccuagccccaccucucugugagcuugaguggcguuuaugacucuccuuccuauuuccuguccugcuaaucaacaagucagcuaaacaguccaugcugccugggcaagcccaguaggccccuaacguggcaccucggagcggcuggcgaugccccaagagccgggcuucccccuccuggaggcucuuccuguuccucgccaagcucuuagguuucgcugggccuccucuucugcucuuuuucuggcuggagacgucagaggaagccuggcgaucuagagaagcugaugugcacccaucaucccggaggugacugccaccaggcggggguggcuccacccccacuccuccccuggcauaaaucgggggacgcacgugccugcgcagaaugccuuggucccuuuuaauuaaacagacaacccagugucccuuggucuaugcugaccugcucaggagugccugggcucuuccacguuucagcugcuguguguccugcugcugugaaguguccccguugagguggaggcagggcagggcgccuucggugagggcgaguccuccugugcccguuuccccaucuguagaaugauggcucauggaggagacauggugucggcaggugguggccggcgcagggagguuuccaggagggaguccuccacccucauuugcuuuuagggccgugcagccucccgagcggcccccacgaggcucugaggcugcaugcagguugagcuccuggccucacugccccuccucaggguuaggacugugcuggagccugggugggugugggguggucccugcacaggcagcaggaggugggccagagcggugcuggaccugaaggcccguggcucccucagcuccacugaggaggcuggaauaguguccugggccaccuucccugccgguagccggcuccugcugagggagggggugcuuucgccuccugguggagcaucaggcucuuggggccugugcguccgagcaucuggccucugcugucugaaaacagcaccuuccccgccccccggccaccgcaucuccucugaauagaaggcaagucuugccucccaggaauggccugugaccuucaucagcgggggagguuaggggcacacagagcccuggggaacaaggggaucuggggcugagccgggccucucgggcccaccccgagcucuccugagcagccuggcaggcaggaaggcgcugggccccggggccuuugccgagcccagccucacccucagcgucccccucaaugcccugggugccugccaggcuguggacacaggcccuggccaguucuauaaauaaccuugccgggcccugcugggaauuggugccaccaccacauagcccagagagaacggaaacacagggcuucucagcgagcagaccaggccugcggugaccaguggaagugggggacgcuuucagggcugggcagcccgacagggcaccgggcacagccaggggccggaaccaguugcucacuggcuccgcuucugggggacugugucccucugugccccguccccaucacaccuugcuuucccuucauccugcucuccuagccccuccccagacuggcggccccuuguccaggcccagccccagcacagccugcagcccuggcagagcucaggccuuggccuucugagguugcccugagggcagugagcaaugagcccugggacuggugcacugggagggaaaggugagccaaggcuuccugcaagaggcagcccugagcuggggguggggaaggcugggucgugggauaccccugacaccccaaguuuuuuuuuugagauggagucuugcucugucacccaggcuggagugcaguggugagaucucgacucucugcaaccuccgccucccagguucaagcgauucuccugccucagccuccugaguagcugggauuacaggcgcccaucaccacgcccggcuaauuuuuguauuuuuaguagagacaagguuucaccauguuggccaggcugguuucgaacuccugaccucaggugauccaccucggccucccauagugucgggauuacaggcgugagucaccgcgccuggccccccagcuguuuuuuaugcuccaugcuugggcuuccuguuaagaauuaaaaaagaaaaaaaaaacuauggagauggaauuuacauacuguacaacucauucguucacaguguacaauucaguggcauuaaguacauucacacggcugugcaaccacuacuucuaauuccagaacguucggucaccccaaaagcaagccccauucccauugugucacucuccauccccuccaccagcuccuggccacucugaauccacuuccuggcucuggauuggcuuguccuggauauugcauagaaaugggauccugucggccgggcgcggugacucacgagagcaagagauccagaccauccuggccaacauggugaaaccccaucucuacuaaaaauacaaaaauuagcugggcgugguugcgggcaccuguagucccagcgacucaggggcugagucaggagaaaucgcuugaacccgggaggcagagguugcagugagcugagaucaugccauugcacucuggccuggcgacagagugagacuccgucuccaaaaaaaaaaaaacaagaaaugggauccugucaucccagcguuuuccgaggccgaggugggcagaugacuugagccuaguaguucaaacgagaccagccugggcagcacggugaaacugucucuacuaaaauacaaaaauuagcugggcaugguagcacacgucuguagucccagcuacuugcggggcugagaugggaggaucgcuugagccugggaggugcacuccagccugggcgacagggaaacccugucucaaaaaaaaaaaaaaaagugcaucacacacuguguguccuuuagugucucacugugacauccucaaggugcagcuaggcuguggcucgagucagagccucacugguuuuuguggcugagucuuguugagugcguggaugggcugugcugauccucgucuguggaagggccccugggugguuccacaucucggcugcugugcguccugcugcugugagcaucucgugcuccguuucugcguggcguguacuguuccucaggguguguaccugggaguggagcugcuggcucacaggguaacagaccuuuggagaagcugcagacgcuuccacgcccacccacugggugugaggaccuugcuccucgucauuuuuguuuuuguuuaauuuuuucuuuuaugagacagggucuuauucuguuguccaggcuggagugcaguagcacgaucacagguaacuacaggcucaagugauccucccaccugagccucccgaguagcuaggacuugaggcacguaccuccacaccuggcuaauuuuuguauuuuuaguagagacaggguuucgccguguugcucaggcuggucucgaacuccugagcucaggugauccacccgccucggccuccuauagugcugggagaaaugaagugucugcgacagggcggcagcugcagagggggcugugcucucuggccuguugugccccacccuugugacaggcaggugggcguggccaacugggcggcagcugcagagggggcagugacaggcggguggguguggcaggaccccacaaugucucuuucuguggcgucuccuucuucgccugccccuuccuaugggccauccuuccagcucaccugcggcccacccuccaaggagugggacccucggaguugggagcccuuggcugcgugggacuguacugugugacggagccaucaccagggcuccaacucacccuggcuccugccacagucugggcuccaucugugcuaccauugcaguagucugguuucuaggaagcaaaacuguuacugaguuacaaagcucaauuaagaguguccuuugggaggccgaggcgggcggaucacaaggucaggagaucgagaccauccuggccaacauggugaaacccugucuguacuaaaauacaaaaaaauuagccggcuguggugacacgugccuguagucccagcuacucgggaggcugaggcagggaaaucacuugaaccugggaggcagagguugcagugagcugagaucgggccaccgugcuccagccuagggacagagcaagacucugucucagaaaaaaaaaaaaguguccuaacuguguccuccaaagcccucgccggccgaugacagacuagagggcgcugugcucccacccccuaccgcccugagccuggacgcguggccccugcagggcccuuucccacagcacugugaacucacagcuucucucuagggaagggaggagguacgccacuuccacagggagauggggaggccgacuccagggauccaggccaucauccugacguugggucggcugauacaccccuguccucucugucccagggaaauucaacuacugaggagguuacggcacaaaaaugucauccagcugguggauguguuauacaacgaagagaagcagaaaauauauccuuuccgguguugggaccgcggggccuccgugggaggggcuggggcccuggguccgccugccucgaggccugcuccucuucccgucuccuugaaggagacuggcacacgagggccguggccuucccugguuccccggaagucagccauuguggcaauggcugcgcagcuugcugaaaggggcccugagcccuggccccugugucuugggcccguggggugucaagucccuuuuuucucagagucuccucccaggcuaaccagggguguagccacggucugccugagacaggccacgcgggcugaccguugugggccauuuuggucguggcugggcguguccucgugucaucuguggacacccccaugggucuuacgggcacagccucccuacggggacuuugcuuccuaaggcccugugcccagagcaagagccagaagugguccugaggcuggggcuguguucccugagccacgcggucaggggcccugggaccguccugcaugggcccgagccugcuugggggggcguccaggaggcaccaucccccgcccaugggcagggugggggacgugagccccgcaggaacgcugccccaagagucagcccuguccuccccuuccccguaggcuccuuccuccugggacgcuggggccccugggccuuuucagagggguggcugagggcagggugggcccuggucccgaggaggggcaaggugggugcagagggucccuccagagccccuuuucuggcccccgugcucccugggccugugaguggggccgcccccugagcuguguguccuuagcgccccacguauauggugauggaguacugcguguguggcaugcaggaaaugcuggacagcgugccggagaagcguuucccagugugccaggcccacgggugcgugcgcggggcaggggccaggguggggcgggggccgggggccaggcagggcaggcuccuuuccgugaggccacacugcuuguccugauauucauugacaugaaggcccaaguuuuuuuguuuuuuuguuuuuuuguguuuuuuuucgagauggagucucacucugucgcccaggcuggagugcaauggugcgaucucggcucacugcaagcuccgccuccgagguucacgccauucuucugccucagcuucccgaguagcugggauuacaggcgcccgccaccacgcccggcuaauuuuuuguauuuuuaguagagacgggguuucaccguguuagccaggauggucucaaacuccugaccucgugauccgccugccucagccucccaaagugcugggauuacaggcaugagcuaccacgcccggccuuguaaaggcccaaguuuuuaaaaacaguuuuggggucccccauguguggcauccacaggcagggcugcugccaaccucccgccuccaucuuugcugggccugcugccugaggccaguggccugcuuccagcccaucgcuggcagccgccugcccugaccagaucuccuggaugcaggucuguggccucagagucagggccccuugcugcugcaggaccacaggggcagggaggggccugcuguuccagcaagacuuuggggugcagccggccuguggcccacaggaaaaugagaccuguggacauccggggcccugccagacguggcucggccggacgaggguggccacugcaggcgcagguguggcucccugcuggaccuagccuuuccucuguccugugugccuggacuucugugacuucccagcugggccugugguguuugggaggcucccaggcagcugcaaaggggaccccugugaggggcagggaggccucggccccaggacgggugugugcugcccgcagguacuucugucagcugauugacggccuggaguaccugcauagccagggcauugugcacaaggacaucaagccggggaaccugcugcucaccaccgguggcacccucaaaaucuccgaccugggcguggccgagguaggcacgugcuagggggggcccuggggcgcccccucccgggcacucccugagggcugcacggcaccgccacaggcacugcacccguucgcggcggacgacaccugccggaccagccagggcuccccggcuuuccagccgcccgagauugccaacggccuggacaccuucuccggcuucaagguggacaucuggucggcuggggucacccuguaagugccccgcccccccgggcacucaccacacgcacacuccgaggggccucugcgucuugggcagcugccggccugugggcgcagggcguggccaccggcccagacccucucuggccacagccgcuagggggugcuuacuuuauggaaauguaacucauacggcagauggugguucacccgugugaagugcagccuggcccgucagggaucuucacagaguggcacggccgacccuccucccagagccccacagggaagcugggcgggugacagcagcuccaggccccuuccccggguggguccagaggacacuccccuccuaccccguagccuccacuaguggaagguggugaagacagagguguccuugaguccacagggccucugguccagcagccacgggacgccucugucccugggguagagcuggggcuccuagggcgucaaccaccuugacugaccacgccuuucuucccuccccucgaaaugaagcuacaacaucaccacgggucuguaccccuucgaaggggacaacaucuacaaguuguuugagaacaucgggaaggggagcuacgccaucccgggcgacuguggccccccgcucucugaccugcugaaaggugggagccucaucccucugcccgcagccccagggaggcggggcuuuugugcagaaauguaggguugggggugucagguggggggcuauuggccccgagaccccagcaggcauugagaggacugaguggagaggccgaccuccccgcagggccugguuugccaggucccucagcuccacccugcuucugggcccuguucacccuccgaacucccaccccagagggcagugcugcccugcgccucccccagccccacccucgggggcucccuggcuugcagggucugucaggguuguccugcugcacuuccuacgcauggcagcagguggcacuggccguccguccaucugcccaguggccuugggagaacggaaccgcccuggccguccagcccagcccugucucccugccagccgcgcacaggcuguccccggcaugucccaggaguggaguggccucugucagggagaccgccugugcgcggggucccccuuaggagcguccagguaucacccagggccugacaacagaggcugggcaggcggggacgguugguggggucucaggccugugcccagcugacaggcuccucgccggcuucuccucagggaugcuugaguacgaaccggccaagagguucuccauccggcagauccggcagcacaggugagcggccccugggggcaguggggccgaggcugcagggaggccggccaugugggcagcugguugagcgggcgcuagagcagggcguggugggggugccaggcugggcuggggccagaccccgugcagcgcccgcaguucucggggcccgaguggggucucugggcaguguccuguuaccggccagacccaggcgccuuguccgaacuggggucugagugaggacaugcguccgucccugcccuaggcauggagaugcgccaggaagggcacagcuggucccaaacacuggcgagagccucucuuuuuccccuccuccuggggcucccagcagcaggguguggcugggauccagcccagggcccccagcuccaugacagggaagacagagcagcggacggggucagcaggccccacagugccgccucccucacuucgugggcucugcuccucugcaccagccccuggaggcccuugagccgucugcuggagccccuccgagccccgaggccacccacugagaccggcucugggagugggaguguccggaccccugaggcgcuggugcugauugugccuugggggucucugcacagcucgggucaucugggcgccuggcggggacuggggcugccccccgauagccuccugggcugggaugugcucagggccccccagacccccuucuggccuuugcuggcuuugcagccagcauccaucuggugggugcuggcuucugagugccaccugggacacaggccucaggguggaggggacaucugucaggcuuggagucaggucagccugccugcuccuagaggacauggcugagcuucuguggucacagccaccccuugcacggccuggucccagcuccugaguguguggcagguacccugggcccagaggagcugggucggaaaacuggaccgcccuggugccagccugacaggcgccacugcuucugggcguuugcagcugguuccggaagaaacauccuccggcugaagcaccagugcccaucccaccgagcccagacaccaaggaccgguggcgcagcaugacuguggugccguacuuggaggaccugcacggcgcggacgaggacgaggaccucuucgacaucgaggaugacaucaucuacacucaggacuucacggugcccggugagucuggcgggggccccugcccggcucugcugacucggccaggaugucccacgggagcagggugccugccugucugcaacaaggacagcuucugcccucugguggccaaucccacguccccaaagccuccagcccaccugcaggcugccuccgcccugcgggccgcugggacauggcugaaagguguggggucagcgggggcaccagcccaggccugucuggccaggaggguuccucaggcgucucuccgggugcugcccagccaggcaccacccaccggccuuggccugagucccagcaggagcaggcgggggagccccagggucgggggaggguaggugagagucagggugcaggguggccccucagacagcuggcaugagagaggguccaguggcccucccucccgucgucccugaggccugcccgcuggcccugaugccggccgcccuucuucccuagguggcgaggaggcgucugaggcagggcuuagagcggagcgcggcuugcagaagagcgagggcucagaccuuucaggagaggaagccucucggccggcgccgcaguagugccugaggaggagcucagggccuuagcguaggggcggcccacauuggcagccagccccuccccgccaugcucccggcuuggcuguguucggcccagggcugggccgugucauaaagaguuuugcaguguaucugcaggguggaugcuugcugcgcucgggcuggagccugagggggcuuucugcuuuacuguuucagcgggaaguggugggcaggggccggccugagaagggggguacgccaggcagguugggaugugaggacccagugcacaggguccacccccgggcccgagggucccagaauagugggggcccugcagagagccccccauuaggucccucagcacuccugggccccucaucaaaccccuaggcucagcucaguagcugguccccaggagaguacagugugggggcccccgagagcacaguguauggggguccccgggggguacagugucugggggccccccaggaggaugcagcaugugggggccccccaggaggguacagcguguguggggcccccaggaucacagggucucagcuccugggcucuuggauuugcagcaccacgaccaucgcgucuggucuguuggaacgggaggugcugcuggguacccuggucacuagggugugcugggaggugggggccccucauggugcccauccuuggggccuggcugcaauuugaccccaggcccagggucuucugccuuucagagcccuggugcccugagacgggcagccaggcaaaucccaggcaggagggccaguuagggcagggccagcccaggcagguugcgagagucccuacugggacguggaccacacgcugacccccacggccgccccugcaggccaggaucccugagccaggacccggcacuggcuucccuccuggggacccucaggccugugugagaccugggcugcccuggggugaggugccugggaggagagcaggggcugggccaccuuuuucaugacccugcuaagcccacuguggguggugaggaggaguacccagcagggggaagggccgccagaccacucggcauggcugaggccucaguacucaguacuggguacucagguggacgccccucccacugcucagaugcuggggacaggcucaacuucaggcuucagcgugagccccgucccugaccugcagagcccccuugcguuggggcaggacagcccggcgcccucgggucaggccauccucugcgcucugccggggcugcugcaucggccucugcgugccuccacuuuggccucacgugucccuacccaggaugcggguccugcugccaacacccagaucccagggaaggggcuugggcuagauccugggcaccagugcagacaggagugugggguggggcaagggcccaguggcggcugugcccgcugaugcagagcuggggcaccuuguccacagggucugccccaccagagacgggcugggcccaagcucagaccuaugggugcaauuggugccuccucaccaaggucuuuuuuaucuuuuuuuuuuuuuggagacagagucuugcucugucgcccaggcuggagugcuguggugcgaucucggcucacugcaaccuccaccucccggauucaagcaauucugccucagccuccugaguagcugggauuacaagugcgcgccagcaugcccggcuaauuuuuguauguuuaguagagacggggguuucaccauguuggucaggcuggucucaaacuccuaaccucaugaucugcccaccucggccucccaaagugcugggauuacaagcgugagccaccgcgaccggcccaaggugcuuuuuuaaagcuagugacuuccugugcacaugggguggguguguggcaaguucuggaagcugcugagucagccacugguccauucucggagcuggggcucugcacugggcacaugagcucuggggcagcccggggcggccucccacugacuucgcccgggaggggccucggggauggcucggcagccaguguguucgcggaguccucgccaaccaccacggcuccucgcagggacaguacgugggcagcuuccugcacuuuccccugccauugugagaacaguguccaccugggcagggugggcagccccaggccuguggguuucaccagggugcuggugaugguugguggcuagcagggacugggggcagcugggggcccuggcaggcugagcucugcuccccgcgugguucugugcuggcauuucgcgugccuggccugagccuggcccgagccuggcccuccuguguccucacagaugagcauguggcggcuccugggccucuagaaccaaccaugggccagggugccccaggggagcacgggaggguccugccuugucagcuugccuccuacucgugagguuccugcagucaguaccuggguggggucccaccugcggccauggcaggugcaacagacgugguggaggggacacuccugcccaggccaucugcgggaggcucagccccggggggugccucccagagcugcuggggggcagcauuucaggcuggauacaccugggccugacccgggggcgggcauggccugggcagcagcuguaagugcguccccguggugggggccagccaggucccuguggcucugggguugcgccccucagcucaggccacacuugccgucucccucccaggacaggucccagaagaggaggccagucacaauggacagcgccggggccuccccaaggccguguguaugaacggcacagaggcggcgcagcugagcaccaaauccagggcggagggccgggcccccaacccugcccgcaaggccugcuccgccagcagcaagauccgccggcugucggccugcaagcagcagugaggcuggccgccugcagguggggcgcggcggggcccggguggggcauguggggacaacgccuggaugccacagccagccgugagcauagcccgcgcuagucagucauggugaccgucacguggcugcgcgugguugccauguggccuuuggguggcuuggccacguagcgauccccguggagggugccgucucggggccuggugucuggccagcgugcuggucauggaggccuacguguggcggggcucugggggggcgugccguccucacagccaccucucagagugggugcauuccgaggacccugcccugggccuggcgcccccuccccaugcccgcgccgcuuccaggaaaggcuuaugcugggcucagcccagaggcuuuugagcaccaguggguggugggugguggggaggggccgcggccuccauggcucugccggggugccgcaggcucugagccagcugccaaguauggcugaggcugagucgugccggacgcugcccugucucucccugugugccugccuccucucccagccccagccccagccccgggugggagacggagucccagaggugucagagacccuuaagucaccugccgaggaugcgggguggaugggggcccgaggcugaagccccugccuugccacagccccucucccagguuuugggggccaccgccugaguuacaugucugucccccaaaugggugcccacagcccauccaccagcgucagagcccgccaggccccacugcaaaaggccacacaauguaccccgggagugacucaaggguggccuucccuggccuccccugcugccccccaggaguccgguagccccaugacuguaccucagcuucuccauccucccaggggcccgcgggaggcggagaaccggugcccaggcugaccucuuccgucuuccuuccacccugcagcccguguccaggagccccgccaggugcccgcgccaggcccucagucuuccugccgguuccgcccgcccucccggagagguggccgccaugcuucugugccgaccacgccccaggaccuccggagcgcccugcagggccgggcagggggacagcagggaccgggcgcagcccuccccccucggccgcccggcagugcacgcggcuuguugacuucgcagccccgggcggagccuucccgggcgggcgugggaggagggaggcggccuccaugcacuuuauguggagacuacuggccccgcccguggccucgugcuccgcagggcgcccagcgccguccggcggccccgccgcagaccagcuggcggguguggagaccaggcuccugaccccgccaugcaugcagcgccaccuggaagccgcgcggccgcuuugguuuuuuguuugguugguuccauuuucuuuuuuucuuuuuuuuuuuaagaaaaaauaaaagguggauuugagcuguggcugugagggguguuugggagcugcuggguggcaggggggcuguggggucgggcucacgucgcggccgccuuugcgcucucgggucacccugcuuuggcggcccggccggagggcaggacccucaccucucccccaaggccacugcgcucuugggaccccagagaaaacccggagcaagcaggagugugcggucaauauuuauaucauccagaaaagaaaaacacgagaaacgccaucgcgggauggugcagacgcggcggggacucggagggugccgugcgggcgaggccgcccaaauuuggcaauaaauaaagcuugggaagcuuggaccug

SEQ ID NO: 192164 - RNA, 3076 nt, Homo sapiens
cagacgucccugcgcgucguccuccucgcccuccaggccgcccgcgccgcgccggaguccgcuguccgccagcuacccgcuuccugccgcccgccgcugccaugcugcccgccgcgcugcuccgccgcccgggacuuggccgccucguccgccacgcccgugccuaugccgaggccgccgccgccccggcugccgccucuggccccaaccagauguccuucaccuucgccucucccacgcagguucgggcgcugcgggucgggacccuccguggccgccgcccccggaguccaggguccccacccccagggcgcgacccccgcuuccgggcccccggacccgcgcgccccggaagccgaggcuacucagcccuggacccucggcccugccucugcugcccgagcccugcgcugcccucgucccgggcaccuccccgagauaagcgucuccugggugcccuccccgaucucccuggccaaagccugggugucgccggaucguugcauucccauuucgcggaucaguagaaugaggcgcaacuguugaggaccaaagcugcaacuucggaucccugcgcuggguugucucagugccucacaucagcgccagguccugcccugacccauuacuuagcaggacaggccgagugcccggugggcgcggggccggccugccccgccaucauuccccacgcuguugucugcagguguucuucaacggugccaacguccggcagguggacgugcccacgcugaccggagccuucggcauccuggcggcccacgugcccacgcugcagguccugcggccggggcuggucguggugcaugcagaggacggcaccaccuccaaauacuuuggugaguccgguggagggcugcagggccaggccaggcuggggcuccacaucccaggucagucuccgucucaguugaggcugcgagaaaaaauaguuuuaggccgggcacgguggcucaagccuguaaucccagcacuuugggaggccgaggcagguggaucaccugaggucagaaguucggagaccagccuggccaacaugauguaaccccgucucuucuaaaaauacagaaaacuggccgggugcgguggcucccgccuguaaucccagcacuuugggaggccgaggcggggggaucacgaggucaggagaucgagaccauccuggcuaacacggugaaaccccgucucuacuaaaaauacaaaaaauuagccaggcgugguggcgggugccuguagucccagcuagucaggaggcugaggagauugugccacugcacuccagccugggcaacaagagugaaacuccaucucaaauaagaaaaauacaguuuuagcagguuuguccacugaggagccugggcuggccggugaugaaagcgaaccagaggggacccugcucucagccgguuuaugacuggcucuggaccaaccaauguaggauggucgaagcaagagauguaaaaccacccaggcccagugguucaugccuguaaucucagcacuuugggagacugaagugggagaaucgcuuaagcccaggaguuugagacuagccuuggcaacauagugagacccugucucuacaaaaaauaaaaagaaacugaccaggcgaggcugggugcgguggcucacaccuguaauccuagcacuuuggaaggccggggugggagggucucuugagcccaggaguuugagaccagccugggcaacauagugaaaucccauacuacaaaaaauuagcugguuguaguggugcacaccuguagucccagcuacucgggaggcugaagcaagaggaccgcuucagccggggaagucaaggcugcagugagccaagaucaugccacugcacuucagccugagcaacaagagugagacccugugccaaaaaaaccccucaaaaaaccauguugggagggcugaucagauuaggggaggaaggucauuugugcaggaaaaaaagcaguucuaagccucacugguuuccagugguggccagauuugaacucagcuugccuuuggcccugaccccagcucaacccauggguggugggucagagggagggccucuguccccaggcagugcuuuuggggguuccuccagcuucuaguccuuucuugcggccccuguuuuguucuucucuagcaguugcccgccauguugggcccagggccaguccugugggucuguuugcacacucaggacacagacuuggauguuuguggagcuccugguucacagggggcucuggacuugaccaggggagucccugaggcugugcagcccuuuggggucucacgccuuccccccgccccauucccccagugagcagcgguuccaucgcagugaacgccgacucuucggugcaguuguuggccgaagaggccgugacgcuggacauguuggaccugggggugagugucagaggggaccugaggcucagcagguuggagcuguccaggcugcgggggagggagcgcugggggaccaggagccgggcuggggucgcugcuggccccucaccgccccucaaccccuugcaggcagccaaggcaaacuuggagaaggcccaggcggagcugguggggacagcugacgaggccacgcgggcagagauccagauccgaaucgaggccaacgaggcccuggugaaggcccuggaguaggcggugcguacccggugucccgaggcccggccaggggcugggcagggaugccaggugggcccagccagcuccuggggucccggccaccuggggaagccgcgccugccaaggaggccaccagagggcagugcaggcuucugccugggccccaggcccugccuguguugaaagcucuggggacugggccagggaagcuccuccucagcuuugagcuguggcugccacccauggggcucuccuuccgccucucaagauccccccagccugacgggccgcuuaccauccccucugcccugcagagccagccgccaagguugaccucagcuucggagccaccucuggaugaacugcccccagcccccgccccauuaaagacccggaagccuga

SEQ ID NO: 192165 - RNA, 11706 nt, Homo sapiens
aaggagaacggaccucagagguugucugaaggccgaggccaagauggcggugcugucaggugagcgcggcaccggcggcggguguggggccgcgcgggucuggggccgugggagccucgggugucgugguggcgucgggggucggugccggcgucguggccgcgguccucuccgggcuucuccgagccggccgcuccucgggcuccccgcccggcuugcgaugaacggucgccguuauugcguccagaguacagucggggaaaccgaggcccgguaggucaugacgcaagccuccagccucaggaaggcgcucgggguggaggcuggaggggccccauucacguccccgagaccagggcacggcccgcgaggcugcucuugagaugcccuggagagagcggggccugccugacaggcugggaaacugaggcccauugagggucuucgaggucacagggccgggccugggaaggaacaggacccaggacauccacgccacccugcuggacccuccaccucccuccccaccccugggagguaagggccucucgcagagccuguccugcuccagggacuuuuuugggaucagcugaagccugcggaccucugcucagauaaaguuauuaaaugcauggaauaaaauccauagaauugcaaggaaaucaguuacacggagaggcaguuauuaaaagauugucuugaaaccugauuggcgacuuaguaaucuaagugcuucccuuaugaacgcgaucuagcggcaggucuaauugcgacugugauuuggaaggagugaggaguggaaaugaggcuuugaugauacggaaacgucugcagccccugcaccauagcuaggaaacaucugugauuccgcuuggugaaaaguuacagguccugcuaauacugccguauuuuguugucuaugcuaagaauuuuuuauuuauuuauuaagacagggucugccucugucgcucagacuggagugcaguggugccaucuuggcucaucacugcaaccugugccucccaggcucaagcgauucuggcacuucaguguccuguguagcugggaccacaggugugcgccaccaugccuggcuaguuuuuguauuuuuaguagagaugggggucuugcccuguugcccaggcuggucucgaacuucugaguucaagcaauccucccaccugagccucccaaagugcugggagccacggcacccagccuacgcuaagaauugaaugaagggcuaauuuuccauaagaugcuggugacaacaaagacauauauauuuuuuuauuccaagcaaauucacaguucugaauccucaccaggccccuuguuaagaaugccuggcccacgcgcgguggcucacgccuguaaucccagcacuuuggaaggccaaggugggcggaucaccugagguccggaguucgagaccagccuggccaacauggagaaaccccgucucuacuaaaaauacaaaaucagcugggugugguggcgcaugccuguaaucgcagcuacuggggggcuggggcaagagaaucgcuugaacccgggaggcggagguugcagugagcuaagauugcaccauugcacuccauccugggcaacaagagugaaacuccgucucaaaaacaaaaacaaaaacaaaccagcugggcgugguggcucaggccuguaaucccagcacuuugggaggccgaggugggcggauccccugaguucgggaguucaagaccagccugaucaacauggagaaacccugucucuacuaaaaaaugcaaaauuagcugagcgugguagcaggcgccuguaaucccagcuacucgggaggcugaggcaggagaauagcuugaaccugggagguggagguugcagugagccaagauugugccguugcacuccagccugggugacaagagcgaaacuccgucucaaaacaacaacaacaacaacaaaaacccugacccagaggcacagaaucccaucaccucagagguucucagaagaguaucuccucugcuaggagcucauccaaaguccugcauuuucagcuugggaaacugacaccuggaguggggcagcucccaccagagccuggggcugggcaguuagccugucugcugugcccagccucaggcaugccaagaaguaggucacaggcuuguguccuucagagaguuguggccuggacggggccaugggaaacagcaaccccggaugaggcuaaggcuggggugagggaggggcucagaggcaggagaaggccccauggaucgcugcauucaggggcaucaaacccuggcccuggccccuggaggcugcccacagccucuccaucgggccucaccucacccacagcgacaaaguaccaucaccugggcagcuucaacagaagcugauuguucucacaguucugggggcuggaaggccaagauugggggucagcaggguugguuccugcugaggccucuguccuuggcuugcccguggccaucuucucccugcgucuuuccucuguacauguuuguguccugaucgccuuuucuuacaaggacauaagucauaucggaugagggcccacccucgugaccucacuguccuuuauaaugacccuuuauuuuauuuuuugagauggagucucccucugucacccaagcuggagugcaguggcgcagccucugcucacugcaaccucuaccucccggguucaagugauucuccugccucagccucucgaguagcugggauuacagguaccugcuacuacacccagcuaauuuuuguauuuuuaguagagacgggguuucaccauguugcccaggcuggucucgaacuccugaccucaggugauccaccugccucggccuccugaagugcuggaauuacaggcaugagccaccacgcccaggcauuaaugaucccuuuaaagaccccaucuccaaaagcagucacauucugagguccugggguuagggcuucagaugcaggucggguggagggucacaguucagccgucaccagcaccaagccugccuuucuggauucuuccuugugagccaggauuccuggcaccuccagguuuccucccgcugagugccccgggcguggcaaggcccugcucuggccuuagucuucgccucgggaaggcucucccaggagacuucgugcaggcgcguucccuccucugcgcuuccuuugaggcuggcuccucuaggggugcuuuucuguguagauugacgugggcagcgcccuccccgcuuagcggacugcagauuccugcaggauggggccugugcucagcugcgugggaaacgcccgagcagcagccagggccuggagcacccagcacacgcuugucaggcacagcugaggccaggacgagcacugggugcccagggaggccccagcauugcuggaguggcaggcaccccacaagcacgcauagauggagauagaaccgggugccggcaaccggaggaccugggguccugguguaggcgggacgccccggguaucugaacugaaaccugccucaugagaaggggccagcagugugcaagugugaggcggggugucccccgcagggcagcagccagugugcaagugugaggcggggugucccccacagggcagcagccagugcgggggcccuggcgcaggaaagcggcaggugccagugaagaucgccagggcggggagacggggcagcguuuggguuccuuccggggccaugcagucucaagcaggggacuaagacucucucguguucugaaaacccccucguuaccuaacguuuguuaaguggcacucgaguugggaucagagcuaggcugugcgggcaggagccugauggggaagcgccuggaggccggcccugcgugcugcccgcagcucacuguucccaccccgugguccucucugcagcuccuggccugcgcggcuuccggauccuuggucugcggugagugccugagucuccagcccucagcugggaggggccuucagcagcgacagacgaacggggcggggggggugggggguggggggagcgccuuguugaaggucacgugucauguuagggacaggaugcaggugacggucugcacgcugcccgugaugugccgggacccucccugggacaguccacgcaguggcaaaggcuggacagucaggaggaaaacccugugggcccggcucagugccgucagagcucaccgccaccuggggugggaaggcauucucugagcccugugcagauggcagcuggggcaggccuccugcagacccaggugacugacagggcggugagggcgcaugcccagggaucuuaccuuggucauguguggagggccugcugccaguuuccuucuguggaugauccugggaccguccuugcuuggacacuguugaccugcuggguacgucacaaaagaaguuccauucaagucugggccaucauugggggucggggcgauggccgcauggcuccagcggcucuggccaguggcccaaguguugacaggcagaggugagaacagucucgcagcagggaggggagaggcaggacaacagugagugcggcugggggagcuggaggggccugggacagccacugacccgcguuccaucucccggcagcuccagcgugggcccggcugugcaggcacgagguguccaucagagcguggccaccgauggcccaagcaggugaagcuggccuucugggggaggucguacccccucgccccacccccaucccuuccuuauuuucugcaucagugccgcagccacugaggugcauggauggggcagggagggggucacacaucccagucccugaccucauguggguccaggccucuggcagcggccgugggggcucgcauccgccucugggaagcaccugcguggcugacgccuccugugcccgugugucucugugccagcacccagccugcccugccaaaggccagagccguggcucccaaacccagcagccggggcgaguaugugguggccaagcuggaugaccucgucaacugggcccgccgggugaguacuaugagcuguaggcccuccucgagcgccagggccucucugcacacucacaggcacacacauacacacaccaacgugcagacacguacacacacaacacaugcaugcacacucacaugcgcacaugugcaugcaagcucacauguauggacagauguguacacggaccacacgcacacucacgcacacaaugcacauaugcacacucgcacacaugcacacuugcacacacaugcacacacaagcacaugugcacacacgcuugcacacauacacacaugcacacuugcacucaugcacacucaugcgcacauauacacaugcacacgcacacucgcacacacgugcacauauaugcacagucaugcacacacaugcacacucacacacaugcacacacguccuuguguggacacaugcaugugugccuguuggcaugcaugcacacaggcacacucacugaugcacacacaccccugcggccguggagcagggcggacccucccggaggccccugugcuggccugguggccugugguuccaucugaggauucggacccugcuggagaugaccccuccguuuccgucauucucuuucuggcguccguguguuccucuuguuucucuuuuaaggugaaagcaguguuuuaaguuaaaaggagcgcgugugaaggcaguagauccuucucgguacccguuuaaagccuccccugccuguggcgccagcccccacgcagccccugccaucccccugcagcgugagcacgugcagcucccuccagcuccugcggcacuugcugcgacagcccggguucaacaaucccccauugauggacguucacuguuuccuuuuguuuuuuguuuccuaaacaaugccacggcgaacguccugccagggccgcaguggucgagacaaggauaguuuuuaaugcaggauaguucuuuucuuuuucuuuucuuuucuuuuuuuuuuuuuugagacggaggcucgcucugucgcccaggcuggagugcaguggugcgaucucggcucacugcaugcuccgcuugccggguucuccugccucagccuccuaaguagcugggacuacaggugcccgccaccacgcccggcuaauuuuuuguauuuuuauuuuuaguagagaugggguuucaccguguuggccaggauggucucgaucuccugaccucgugauccgcccaccucggccucccaaagugcugggauuacaggcgugagccaccacgcccggcuaaugcaggauaguuucuaauggagggaaccugagacauggccagcggccgucccaacacaggcuucuggcgggcagguggaccuggccauuucugcccgggcagcccugccucacucuguagccugacccugucacccgccaacacaugcagcagggccccugccaggucucagagccgcgugcagggagagcgggaacggugggggaaaugagaagccacagggauggaggagaggggagggaguggccaaggagaucugagagggcuuccuggaggcgucgcacuugguauguggacccagaucuaguuaacgcagagaguucccgguuagaccugcgcuacuacucgccuguagcccacgcgcucagagaguggcuggagcccccuguugaaauggugggacuuaggauacacuggguucgaggaacuaugugaugaggacagaucucacccguuucucucuauuuuauguauuugaauguggcugguggggcgcgcuuuacaacucuuggggcccggaggccaccugcaggagccgcugugccucucaccucugccggcugccgccccgggacaugagucggggguucugggugcuccacguggagucucacgcugggccacgcggggcuccggggguggcgucugacccgagcccggccuccgcagaguucucuguggcccaugaccuucggccuggccugcugcgccguggagaugaugcacauggcagcaccccgcuacgacauggaccgcuuuggcguggucuuccgcgccagcccgcgccaguccgacgucaugaucguggccggcacacucaccaacaagauggccccagcgcuucgcaagguaggccucgucccagccgcccagccgcccccagagugagcugcgcacggaccccgccucucuuccaggucuacgaccagaugccggagccgcgcuacguggucuccauggggaggugagugcagggcggggggucuccagggacagacguagcgugagugcuggccuggccgugcccugauggcgcuuaucaaaagugucaucuacauucagugaaaucccacguggucccggcgcugcccuucagccgucucggugccuccacccuaggcagaugcgcuggugggccucuccccagaacgauuccucccauccacccccacgcagcagaccccacauuccgcccaguucucugcuuuacucacacauaagugaugacaggugcuguagauaguuuuauaaucucagccuucucacuugccauuaguuuuuuuucuuuuuuuuuuuuuuuuugagacagagucuugcucugucaacccaggcuggagugcgguggaaccaucucggcucacugcaaccuccgccucccagguucaagcaauuuuccugccucagccucccaaguagcugggauuacaggcaugcaccaccacacccagcuaauuuuuguauuuuuaguagagacgggguuuuaccauguuggccaggcuggucuugaacucccucaggugauccgccugccucggccucccaaagugcugggauuauaggcauaagccaccacgccuggccuugcccucauuuuuuagucauuuccccguaacauugaaagguauuuagucucuuaacauuuuaaaauauuuauuuauuuacuuaaagauggagucuagcucugucgcccaggcuggagugcaguggcacgaucucagcccacuacaaccuccgccucccagguucaagcgauucuccugccucagccucccgaguagcugggauuacaggcaccugccaccacaccuggccaauuuuuguauuuuuaguaaagaagagguuucaccauguuggcuaggauggucucgaucuccugaucucgugauccacccaccucagccucccaaaguucugggauuacaggcaugagccaccaugccuggccaauauuuauuauuuuuauuuuuuagagacagagucucacugaguugcccaggcuggagugcaguggugcagucauagcucacugcagccuugaccuccugggcucaagcggucccccaaccuuagccucucagagugcugggauuacagauguacuccacugugccuacuuuuuaaaauuucuguagagaucaggucuugauaaguuuacccuuuuaaagcgagcaguucagugguuuuuaggccaccaccucuaauuccagaacauucucaucacccccaaaugaaaugcuguccccaucagcagucacucugcauccccuuccgagccccggugcccacaccuccccucccugucucuguggaugggcccguccuggacauuucacagaaacaggaucacacgccgcauggccuucuguguccggcgucucucacugagcgcgacguccucaaggugcauccgugcuguggccuguguccgagccucgugccuuuucuuggcugaauaauaucccacuguguggacauauuacuaaucuaauucuaaacaguuaauuagaauauuccagaguuuucauaaccgucucccacugcugggcauucaggguauguccauuuuuacggcugugggaagcagugcugggaguggagucuguguggucuccugggguuuccagcucccugccccggguggaccccagcgccucacugacagagccggaaucaggcgagggugaggcucagccgccccauagacaggggcuggguguuggcacuguggcugucugaaguggcuuuuuguugacacaugugaucugacacaucccagccccgggaaucgguggucaggagcccccucgggaggggagcacuuuuccccgaguuaucagccacgugugagcuugcgccccacuggucccacagaggcucugggagccugugcguguuugcucauugcuucuccgugacaaguuccagccucguaggugccuggccugcaguugaaggcggguggggauggggcgaggccucguggagggagggugggcaggcgggucuucggcacacuccccucacggugccuccccaacagcugcgccaacggaggaggcuacuaccacuauuccuacucgguggugaggggcugcgaccgcaucgugcccguggacaucuacaucccagguagggccgggaccgcaccgcccacgagggagcuggagacagggccagcgccacacggagcccggcggccccugugagggagucccacacccccagcagacggcgggcucccccauccuauggaugggccgacucggagcgcugccucuuaguggagccuguccccugugagaagucggcgauguauucaggcaucagagggaucagagggagcaggggaagcugaguggaauuccugacacacgccugguuuacagcaguuucauaugguccuaccuggcacaaaccaaagaccugcaguuagaaauaccaagcgagaagguuccugggggccaaggacacugucccgcgcccucagccuuacagaagggcacgcaggacucccugggacccgggguggccggauuuggcaaaugaaaacgugggaggcuuaguuugacugugagguuagggugaauuugaccaucaggaaaacuguuaguaguaauuguuuaguacgaguauaucccaacaauauuugggcuauacugacacuaaaaagagcauuggcugcauaccugaaauucacaucgcaccgggaacauucuuuauaucuggugaucccgugggacucuugcaccucacguggucccacgagggccauccccccgggcguucaccuugacagugguccacgguaggcaggcuuggagguggcgcucaugugggacaggggacagaguccuguucuuggccacccugugcugcgugcggcauuagcucaugcgcagagagcccagcccugagucccgagucuggggguuugggcaagcgagaggcacauccuggugccucucaaaaguggaggaacaggcucugacuuuggauuccgcuucccuggaaagggcguugauuuguucagcguucugcacgguucaggucaccccgggggcaguggagagggcagccugggccucccugugacuugacagcacagagagguccauccuggggucaggagcucugcccaugccccuggcgucuuccccugcagugcagaccaauggggcaaguugcgaguguggacuguacuccucccuccuugcagacugagcuccucccucccuggggaccgcgcuccucccucccugcggacugugcucccugucuggggacugcgcuccucccuccuuggggaccgugcuccucccucccucccugcggaccgcgcuccucccucccuggggaccgcgcuccucccucccugcggaccgcgcucggcccucccuggggaccgcgccccucccucccagcggaccgcgcuccucccucccuggggaccucgcuccucccucccucccugcggacugugcugcucccucccugcggacugugcuucucccucccuuggagcagccuggacuugccagagcucugccagguggggccuggccgcccuuucccaggcccugcaguggccuuguccuuucucaccuguuuccacuccugcuguccccguugggcccugggcuucguccucuugcucaagcccuuuguucugaaccugcguggcagccgggacugggggauccccagcaaagagcucuggcuuggggcucagaaagagggucaucggguccucgugggaugcccgggcucugggccaccuccccucccuccgcccagccucccugccuccaucuccguccagggcagccccgggcccugcuccccacugcuaagugugucugcugagcgcuggcccccauugaguccugagggcuggggccgggggccggguuagugaggucagcgucuuguccgagaggucccugugacagcccgggaugagccacggguggagggcaguggggccuugcccaggggaggaccccacucuuccugcagggaccuccccugcgccggcucccagucccuggcacugcgcccacccagggcugucagccuccaccuucagaggccggcccgggaaacccuuccaaagccgagccggcugcgcugugcacgcggucacgcgggcuccggcugcgggaagcgagacugaggcaaggucccugcaggcugcccaccuacggccgaggcccugcucuacggcauccugcagcugcagaggaagaucaagcgggagcggaggcugcagaucugguaccgcagguagcgccgccgccgccgccgccggagccugucgccguccuguccccagccugcuugugucccgugagguugucaauaaaccugcccucgggcugccgccuccca

SEQ ID NO: 192166 - RNA, 11706 nt, Homo sapiens
ugggaggcggcagcccgagggcagguuuauugacaaccucacgggacacaagcaggcuggggacaggacggcgacaggcuccggcggcggcggcggcggcgcuaccugcgguaccagaucugcagccuccgcucccgcuugaucuuccucugcagcugcaggaugccguagagcagggccucggccguaggugggcagccugcagggaccuugccucagucucgcuucccgcagccggagcccgcgugaccgcgugcacagcgcagccggcucggcuuuggaaggguuucccgggccggccucugaagguggaggcugacagcccugggugggcgcagugccagggacugggagccggcgcaggggaggucccugcaggaagagugggguccuccccugggcaaggccccacugcccuccacccguggcucaucccgggcugucacagggaccucucggacaagacgcugaccucacuaacccggcccccggccccagcccucaggacucaaugggggccagcgcucagcagacacacuuagcaguggggagcagggcccggggcugcccuggacggagauggaggcagggaggcugggcggagggaggggagguggcccagagcccgggcaucccacgaggacccgaugacccucuuucugagccccaagccagagcucuuugcuggggaucccccagucccggcugccacgcagguucagaacaaagggcuugagcaagaggacgaagcccagggcccaacggggacagcaggaguggaaacaggugagaaaggacaaggccacugcagggccugggaaagggcggccaggccccaccuggcagagcucuggcaaguccaggcugcuccaagggagggagaagcacaguccgcagggagggagcagcacaguccgcagggagggagggaggagcgagguccccagggagggaggagcgcgguccgcugggagggaggggcgcgguccccagggagggccgagcgcgguccgcagggagggaggagcgcgguccccagggagggaggagcgcgguccgcagggagggagggaggagcacgguccccaaggagggaggagcgcaguccccagacagggagcacaguccgcagggagggaggagcgcgguccccagggagggaggagcucagucugcaaggagggaggaguacaguccacacucgcaacuugccccauuggucugcacugcaggggaagacgccaggggcaugggcagagcuccugaccccaggauggaccucucugugcugucaagucacagggaggcccaggcugcccucuccacugcccccggggugaccugaaccgugcagaacgcugaacaaaucaacgcccuuuccagggaagcggaauccaaagucagagccuguuccuccacuuuugagaggcaccaggaugugccucucgcuugcccaaacccccagacucgggacucagggcugggcucucugcgcaugagcuaaugccgcacgcagcacaggguggccaagaacaggacucuguccccugucccacaugagcgccaccuccaagccugccuaccguggaccacugucaaggugaacgcccggggggauggcccucgugggaccacgugaggugcaagagucccacgggaucaccagauauaaagaauguucccggugcgaugugaauuucagguaugcagccaaugcucuuuuuagugucaguauagcccaaauauuguugggauauacucguacuaaacaauuacuacuaacaguuuuccugauggucaaauucacccuaaccucacagucaaacuaagccucccacguuuucauuugccaaauccggccaccccgggucccagggaguccugcgugcccuucuguaaggcugagggcgcgggacaguguccuuggcccccaggaaccuucucgcuugguauuucuaacugcaggucuuugguuugugccagguaggaccauaugaaacugcuguaaaccaggcgugugucaggaauuccacucagcuuccccugcucccucugaucccucugaugccugaauacaucgccgacuucucacaggggacaggcuccacuaagaggcagcgcuccgagucggcccauccauaggaugggggagcccgccgucugcugggggugugggacucccucacaggggccgccgggcuccguguggcgcuggcccugucuccagcucccucgugggcggugcggucccggcccuaccugggauguagauguccacgggcacgaugcggucgcagccccucaccaccgaguaggaauagugguaguagccuccuccguuggcgcagcuguuggggaggcaccgugaggggagugugccgaagacccgccugcccacccucccuccacgaggccucgccccauccccacccgccuucaacugcaggccaggcaccuacgaggcuggaacuugucacggagaagcaaugagcaaacacgcacaggcucccagagccucugugggaccaguggggcgcaagcucacacguggcugauaacucggggaaaagugcuccccucccgagggggcuccugaccaccgauucccggggcugggaugugucagaucacaugugucaacaaaaagccacuucagacagccacagugccaacacccagccccugucuauggggcggcugagccucacccucgccugauuccggcucugucagugaggcgcugggguccacccggggcagggagcuggaaaccccaggagaccacacagacuccacucccagcacugcuucccacagccguaaaaauggacauacccugaaugcccagcagugggagacgguuaugaaaacucuggaauauucuaauuaacuguuuagaauuagauuaguaauauguccacacagugggauauuauucagccaagaaaaggcacgaggcucggacacaggccacagcacggaugcaccuugaggacgucgcgcucagugagagacgccggacacagaaggccaugcggcgugugauccuguuucugugaaauguccaggacgggcccauccacagagacagggaggggaggugugggcaccggggcucggaaggggaugcagagugacugcugauggggacagcauuucauuugggggugaugagaauguucuggaauuagaggugguggccuaaaaaccacugaacugcucgcuuuaaaaggguaaacuuaucaagaccugaucucuacagaaauuuuaaaaaguaggcacaguggaguacaucuguaaucccagcacucugagaggcuaagguugggggaccgcuugagcccaggaggucaaggcugcagugagcuaugacugcaccacugcacuccagccugggcaacucagugagacucugucucuaaaaaauaaaaauaauaaauauuggccaggcaugguggcucaugccuguaaucccagaacuuugggaggcugagguggguggaucacgagaucaggagaucgagaccauccuagccaacauggugaaaccucuucuuuacuaaaaauacaaaaauuggccaggugugguggcaggugccuguaaucccagcuacucgggaggcugaggcaggagaaucgcuugaaccugggaggcggagguuguagugggcugagaucgugccacugcacuccagccugggcgacagagcuagacuccaucuuuaaguaaauaaauaaauauuuuaaaauguuaagagacuaaauaccuuucaauguuacggggaaaugacuaaaaaaugagggcaaggccaggcgugguggcuuaugccuauaaucccagcacuuugggaggccgaggcaggcggaucaccugagggaguucaagaccagccuggccaacaugguaaaaccccgucucuacuaaaaauacaaaaauuagcugggugugguggugcaugccuguaaucccagcuacuugggaggcugaggcaggaaaauugcuugaaccugggaggcggagguugcagugagccgagaugguuccaccgcacuccagccuggguugacagagcaagacucugucucaaaaaaaaaaaaaaaaagaaaaaaaacuaauggcaagugagaaggcugagauuauaaaacuaucuacagcaccugucaucacuuaugugugaguaaagcagagaacugggcggaauguggggucugcugcguggggguggaugggaggaaucguucuggggagaggcccaccagcgcaucugccuaggguggaggcaccgagacggcugaagggcagcgccgggaccacgugggauuucacugaauguagaugacacuuuugauaagcgccaucagggcacggccaggccagcacucacgcuacgucugucccuggagaccccccgcccugcacucaccuccccauggagaccacguagcgcggcuccggcaucuggucguagaccuggaagagaggcgggguccgugcgcagcucacucugggggcggcugggcggcugggacgaggccuaccuugcgaagcgcuggggccaucuuguuggugagugugccggccacgaucaugacgucggacuggcgcgggcuggcgcggaagaccacgccaaagcgguccaugucguagcggggugcugccaugugcaucaucuccacggcgcagcaggccaggccgaaggucaugggccacagagaacucugcggaggccgggcucgggucagacgccacccccggagccccgcguggcccagcgugagacuccacguggagcacccagaacccccgacucaugucccggggcggcagccggcagaggugagaggcacagcggcuccugcagguggccuccgggccccaagaguuguaaagcgcgccccaccagccacauucaaauacauaaaauagagagaaacgggugagaucuguccucaucacauaguuccucgaacccaguguauccuaagucccaccauuucaacagggggcuccagccacucucugagcgcgugggcuacaggcgaguaguagcgcaggucuaaccgggaacucucugcguuaacuagaucuggguccacauaccaagugcgacgccuccaggaagcccucucagaucuccuuggccacucccuccccucuccuccaucccuguggcuucucauuucccccaccguucccgcucucccugcacgcggcucugagaccuggcaggggcccugcugcauguguuggcgggugacagggucaggcuacagagugaggcagggcugcccgggcagaaauggccagguccaccugcccgccagaagccuguguugggacggccgcuggccaugucucagguucccuccauuagaaacuauccugcauuagccgggcgugguggcucacgccuguaaucccagcacuuugggaggccgaggugggcggaucacgaggucaggagaucgagaccauccuggccaacacggugaaaccccaucucuacuaaaaauaaaaauacaaaaaauuagccgggcgugguggcgggcaccuguagucccagcuacuuaggaggcugaggcaggagaacccggcaagcggagcaugcagugagccgagaucgcaccacugcacuccagccugggcgacagagcgagccuccgucucaaaaaaaaaaaaaagaaaagaaaagaaaaagaaaagaacuauccugcauuaaaaacuauccuugucucgaccacugcggcccuggcaggacguucgccguggcauuguuuaggaaacaaaaaacaaaaggaaacagugaacguccaucaaugggggauuguugaacccgggcugucgcagcaagugccgcaggagcuggagggagcugcacgugcucacgcugcagggggauggcaggggcugcgugggggcuggcgccacaggcaggggaggcuuuaaacggguaccgagaaggaucuacugccuucacacgcgcuccuuuuaacuuaaaacacugcuuucaccuuaaaagagaaacaagaggaacacacggacgccagaaagagaaugacggaaacggaggggucaucuccagcaggguccgaauccucagauggaaccacaggccaccaggccagcacaggggccuccgggaggguccgcccugcuccacggccgcaggggugugugugcaucagugagugugccugugugcaugcaugccaacaggcacacaugcauguguccacacaaggacgugugugcaugugugugagugugcaugugugugcaugacugugcauauaugugcacgugugugcgagugugcgugugcauguguauaugugcgcaugagugugcaugagugcaagugugcauguguguaugugugcaagcgugugugcacaugugcuugugugugcaugugugugcaagugugcaugugugcgagugugcauaugugcauugugugcgugagugugcgugugguccguguacacaucuguccauacaugugagcuugcaugcacaugugcgcaugugagugugcaugcauguguuguguguguacgugucugcacguugguguguguaugugugugccugugagugugcagagaggcccuggcgcucgaggagggccuacagcucauaguacucacccggcgggcccaguugacgaggucauccagcuuggccaccacauacucgccccggcugcuggguuugggagccacggcucuggccuuuggcagggcaggcugggugcuggcacagagacacacgggcacaggaggcgucagccacgcaggugcuucccagaggcggaugcgagcccccacggccgcugccagaggccuggacccacaugaggucagggacugggaugugugacccccucccugccccauccaugcaccucaguggcugcggcacugaugcagaaaauaaggaagggauggggguggggcgaggggguacgaccucccccagaaggccagcuucaccugcuugggccaucgguggccacgcucugauggacaccucgugccugcacagccgggcccacgcuggagcugccgggagauggaacgcgggucaguggcugucccaggccccuccagcucccccagccgcacucacuguuguccugccucuccccucccugcugcgagacuguucucaccucugccugucaacacuugggccacuggccagagccgcuggagccaugcggccaucgccccgacccccaaugauggcccagacuugaauggaacuucuuuugugacguacccagcaggucaacaguguccaagcaaggacggucccaggaucauccacagaaggaaacuggcagcaggcccuccacacaugaccaagguaagaucccugggcaugcgcccucaccgcccugucagucaccugggucugcaggaggccugccccagcugccaucugcacagggcucagagaaugccuucccaccccagguggcggugagcucugacggcacugagccgggcccacaggguuuuccuccugacuguccagccuuugccacugcguggacugucccagggagggucccggcacaucacgggcagcgugcagaccgucaccugcauccugucccuaacaugacacgugaccuucaacaaggcgcuccccccaccccccaccccccccgccccguucgucugucgcugcugaaggccccucccagcugagggcuggagacucaggcacucaccgcagaccaaggauccggaagccgcgcaggccaggagcugcagagaggaccacggggugggaacagugagcugcgggcagcacgcagggccggccuccaggcgcuuccccaucaggcuccugcccgcacagccuagcucugaucccaacucgagugccacuuaacaaacguuagguaacgaggggguuuucagaacacgagagagucuuaguccccugcuugagacugcauggccccggaaggaacccaaacgcugccccgucuccccgcccuggcgaucuucacuggcaccugccgcuuuccugcgccagggcccccgcacuggcugcugcccugugggggacaccccgccucacacuugcacacuggcugcugcccugcgggggacaccccgccucacacuugcacacugcuggccccuucucaugaggcagguuucaguucagauacccggggcgucccgccuacaccaggaccccagguccuccgguugccggcacccgguucuaucuccaucuaugcgugcuuguggggugccugccacuccagcaaugcuggggccucccugggcacccagugcucguccuggccucagcugugccugacaagcgugugcugggugcuccaggcccuggcugcugcucgggcguuucccacgcagcugagcacaggccccauccugcaggaaucugcaguccgcuaagcggggagggcgcugcccacgucaaucuacacagaaaagcaccccuagaggagccagccucaaaggaagcgcagaggagggaacgcgccugcacgaagucuccugggagagccuucccgaggcgaagacuaaggccagagcagggccuugccacgcccggggcacucagcgggaggaaaccuggaggugccaggaauccuggcucacaaggaagaauccagaaaggcaggcuuggugcuggugacggcugaacugugacccuccacccgaccugcaucugaagcccuaaccccaggaccucagaaugugacugcuuuuggagauggggucuuuaaagggaucauuaaugccugggcgugguggcucaugccuguaauuccagcacuucaggaggccgaggcagguggaucaccugaggucaggaguucgagaccagccugggcaacauggugaaaccccgucucuacuaaaaauacaaaaauuagcuggguguaguagcagguaccuguaaucccagcuacucgagaggcugaggcaggagaaucacuugaacccgggagguagagguugcagugagcagaggcugcgccacugcacuccagcuugggugacagagggagacuccaucucaaaaaauaaaauaaagggucauuauaaaggacagugaggucacgagggugggcccucauccgauaugacuuauguccuuguaagaaaaggcgaucaggacacaaacauguacagaggaaagacgcagggagaagauggccacgggcaagccaaggacagaggccucagcaggaaccaacccugcugacccccaaucuuggccuuccagcccccagaacugugagaacaaucagcuucuguugaagcugcccaggugaugguacuuugucgcugugggugaggugaggcccgauggagaggcugugggcagccuccaggggccagggccaggguuugaugccccugaaugcagcgauccauggggccuucuccugccucugagccccucccucaccccagccuuagccucauccgggguugcuguuucccauggccccguccaggccacaacucucugaaggacacaagccugugaccuacuucuuggcaugccugaggcugggcacagcagacaggcuaacugcccagccccaggcucuggugggagcugccccacuccaggugucaguuucccaagcugaaaaugcaggacuuuggaugagcuccuagcagaggagauacucuucugagaaccucugaggugaugggauucugugccucugggucaggguuuuuguuguuguuguuguuguuuugagacggaguuucgcucuugucacccaggcuggagugcaacggcacaaucuuggcucacugcaaccuccaccucccagguucaagcuauucuccugccucagccucccgaguagcugggauuacaggcgccugcuaccacgcucagcuaauuuugcauuuuuuaguagagacaggguuucuccauguugaucaggcuggucuugaacucccgaacucaggggauccgcccaccucggccucccaaagugcugggauuacaggccugagccaccacgcccagcugguuuguuuuuguuuuuguuuuugagacggaguuucacucuuguugcccaggauggagugcaauggugcaaucuuagcucacugcaaccuccgccucccggguucaagcgauucucuugccccagccccccaguagcugcgauuacaggcaugcgccaccacacccagcugauuuuguauuuuuaguagagacgggguuucuccauguuggccaggcuggucucgaacuccggaccucaggugauccgcccaccuuggccuuccaaagugcugggauuacaggcgugagccaccgcgcgugggccaggcauucuuaacaaggggccuggugaggauucagaacugugaauuugcuuggaauaaaaaaauauauaugucuuuguugucaccagcaucuuauggaaaauuagcccuucauucaauucuuagcguaggcugggugccguggcucccagcacuuugggaggcucaggugggaggauugcuugaacucagaaguucgagaccagccugggcaacagggcaagacccccaucucuacuaaaaauacaaaaacuagccaggcaugguggcgcacaccuguggucccagcuacacaggacacugaagugccagaaucgcuugagccugggaggcacagguugcagugaugagccaagauggcaccacugcacuccagucugagcgacagaggcagacccugucuuaauaaauaaauaaaaaauucuuagcauagacaacaaaauacggcaguauuagcaggaccuguaacuuuucaccaagcggaaucacagauguuuccuagcuauggugcaggggcugcagacguuuccguaucaucaaagccucauuuccacuccucacuccuuccaaaucacagucgcaauuagaccugccgcuagaucgcguucauaagggaagcacuuagauuacuaagucgccaaucagguuucaagacaaucuuuuaauaacugccucuccguguaacugauuuccuugcaauucuauggauuuuauuccaugcauuuaauaacuuuaucugagcagagguccgcaggcuucagcugaucccaaaaaagucccuggagcaggacaggcucugcgagaggcccuuaccucccagggguggggagggagguggaggguccagcaggguggcguggauguccuggguccuguuccuucccaggcccggcccugugaccucgaagacccucaaugggccucaguuucccagccugucaggcaggccccgcucucuccagggcaucucaagagcagccucgcgggccgugcccuggucucggggacgugaauggggccccuccagccuccaccccgagcgccuuccugaggcuggaggcuugcgucaugaccuaccgggccucgguuuccccgacuguacucuggacgcaauaacggcgaccguucaucgcaagccgggcggggagcccgaggagcggccggcucggagaagcccggagaggaccgcggccacgacgccggcaccgacccccgacgccaccacgacacccgaggcucccacggccccagacccgcgcggccccacacccgccgccggugccgcgcucaccugacagcaccgccaucuuggccucggccuucagacaaccucugagguccguucuccuu

SEQ ID NO: 192167 - RNA, 6029 nt, Homo sapiens
uguccgacucgcacacauuuaauaaacugagcucuugcauugccugccgccaucaccucuuccucaaaaugggcugugggcggguagguucaucgcugucuaugugcugccacagaauugcugagaccccccagguuagaucccuggaagcagagccagaaagcagaaacugggggcacaggguuugugggcaccccacccagaugggccggggaggcacuggcugaggccaggagucucccccuggucccaagggagggcaggcuccagggggugcacagcaccccagacaggggguccaaccugggcauugguaccugggccaguuauuauggcaggccccaguguggggcaggaggcacccaugagccacuaggagcuguggcuggugcaacagcugggauggggcagccacagcagccacuaccggggagagucaaugguggacaggggcugcgggagcugggacggccccacgucaaagccacuucagggagcacagcccuggcccagcuggggggacaaggaaagcuaugacugcaagcagcacagaagugcagggugggaagggauggcaggagccggcccccuccccaccuuccacccugggacacugccgggaccucccucggccaggugagcagcuucagaagcaugaccagugagaagucccuagggcccaggccgggcuagccaagucccaguuucuggaugaggcgccucccaggcuguguguggcaggcccccuuucuucagggaauaagaaacaucuuccacauucaagaaacaaagcuggcugugggucuggagagagggugaggcagccccaggucucugggucaggcggacggucccugcaugcagugcccggcaggacugagcaggguucccggggucgccgguacccaucccuccccagcuuccggggccccgggacggagccgcucacagaggcaccauucagacggccagacacacacgaaagcuuuaugugcagggcccagccucugggccgccuugcccagguuuccacucaaguugcuauuuaggaugaaaagccuuuggcaagacccuccgccgcacuaacgcccccucccccagggccagaacccgcagggaagcaggcccaggaccugcugcagcuggcaggguggcuaugagacucaggacacccugggcuccuggccagugacucacagcgguccuccagcaagggcaguggcugggagacacccgugccguggagcuaggcccagccuggcugggucucagggcugcuucucuugggugaccccagcggcccagggucguugugaagaucaacguggcuugugggaggagcccggggcccagaaggaaguggggucaggggcucaggcuggcccucgggcugcucugacauugggugggcacucgcuggauggaaucacaguuaacaccucgaucccaacaccuggacucagaaguggacaggcgagugccugccccgggagaggaaggagguggcaccugcucccaggggccccacugcagagcacggccacugugagcugacgacagaaucacaguacagcaauaaugucccuauccucuuccagaaccccaguggggcccucaggucacgcaggacggagccagcugggugggucccaccaacucggcaugaaugagacgacggaugaaccgcagccccagcaucaggaggggcgccugugucaacacccacgugggcugggaccccgugaaugccagucuggggccgacggacccccagggaaagccugggugcaggccaccuugugcgcugcccaagccugcaggccccgagaggucagccugaggaggcagccucggcugccgguaaugcugccugcuucaucugggccaccucccgcuccagguccucgccggcucgcugcaggagcucacaccucugccucagcacguugcccgccugcugcagccgcugguuggcagccacguaggcccggcuuugcugguagagcugcucucccggggccuccgcauccuccaucauccugaagggaacuggggggucugagacaggacacagcagcaucacugccugcugaccaccccauccuccugggcaccccucacuacugcccccaaagggcaggguucccugcaguccccgagugagcuugccagccggggucuucuuaacaugacggaugcagccaggugugguggcucacgccuguaauccagcacuuugggaggccgaggcgggaggaacacuugagcccaagaguuagagaccagccuggacaacauagugacacccccaucucuaccaaaaaauacaaauacaaaaauuagcugggcgugguagcacgcaucuguggucccuacuucucuggaggcagaggcaggaggaucgcuugagacugggaggccgaggcugcaauaagcuaugaucgugccacgguacuccagccugggugacagaaugagacccugucucaaaaauaaauaaaaacaaaaaucaaguaauggaggcuuccucguccaucagcugggagaggcacaguggcuggguggcaggaggggcuuccagcucuaggcuacccgccuuagcaaagcgugugaccagggggaucgggucacagaaagagcucaagccucgccagcaguggcccuccugggggcggggcuuccauuccugcaaaagccguggcacccaccgggauggacuccacugagcuggccuggcucucauuccugcugucucuggaagccagagacgcaacaagcccgccaccgaaaaccucuccaggggccgugcaaccuccuggagcacacacuuagggaggcagggguggcgaaggugagaggugggcauugacguccuggugacucccacauucagcagaaacuacguauggcucccugcucccccacguaugcaagcccagugcagcagggcugaagcagcaccgacuucagggucacucagagaagcgucaggggccccucggcucuggccugccccucggcaguguggucucccacggacgaaggcuccacgugccgcacgggucugggcugaucaaaucaccucugucaucaccugcuuuagcaacagggugggaaaggccgggcagugccuggaugaaggcacaggaggcccccuaccuucugugagcgccccccgucccccgcacagcgugccucaguuucgccacacucaacggccauggaccugagcccaugaagcucaaaccacggccccagcacccucaggugaccgaacugcaugcugggaauaaaaccaacucaugcaccuugaccaguaccggcccacagaaccuuccagaugaugcgcacaccucccaccgaugcugguccacaccagccaccagccauguguggcuccugggcacuugaaauaugucuaaagggaaaacacaacucaauuuuucucuuuuuuucuuuuucagagacagggucucacucugucacucaggcuggagacuccaacuccugggcgcaagcaacccuccugccucagccuccugaguagcuaagaccacaggugcaugccaccacacccagcuaguuuguguauuuuugguagauauagguuuugcuaugcugccaaggcuggucuugaacuccuggccucaagucauccuccugccucagccucccaaaguccugggauuacaggcaugagccacugcaccuggccccagaauuuucuaauauuacuuuuuaaaaauguucccuuagaaauucacaguuucuaucauuccacauggcucauuuucuuuuuucuuuuuuuuuuuuguuugagauagagucuugcucugucacccaggcuggaguacaguggcacgaucucagcucacugcaaccuccgccuccuggguucaagcaauucuccugccucagccucccaaguagcagggauuacaggcaugcgccaccaugcccagcuaauguuuuuguauucucaguagagacgggguuucaccauguuggccaggguggccuugaacuccugaccucaaaugauccgcccaccucagccacccaaagugcugggauuacaggugugagccaccgcaccuggccgauucaucuucauuuguuucccgccagccccagaacagccuggggcagacauucuuguuucuuuuguucacuuguccauuagcagugcucuaagcgcagagcccagcacacaggaagugcucaagaaaaggauuguugaaugaaugaaugagccucauccagaacacaaaauucacccaacugcacugcugaauccuuuggucucugacuagcuuccaccucguaaaucaggaguggacaagcuuuccugccaaaggcuggagucucugcucccacuacucaacucugcccuucuggugugagagcagccacuaaccguaugugaaucauuuggcugugugccguaaaccuuuacuuaccaacacugaaaucugaauuucauaccucuuucaggugucagaaauguucuuuuucacccacccccauuuaaaaaugugaaguccauucauagcucccagaccuuaaaaaaacagccaggggcaggguuuggggggcccuagcuuaccaccucuguuuuacuuuauuuauuucuauuuauuaauuauuauuauaauuauugaaacagagucucacugugguccaggcuggagugcaguugcgugaucucagcucacugcaaccuccgacucccagguucaagugauucuccugccucagucuccugaguggcugggauuacaggcccaugccaccacacccggcuaauuuuuguauuuuuaguagagacaagguuccaccauguuggccaggcugguguccaaccucugaccucaagugauccacccaccucggccucccaaagugcugggauuauaggcgugagccaccgcaccggccacuuauuuauuuuugagacacagucuggcuguguugccuaggcuguauccucccacuuuagccuccaagaagcuggggcuacaaguguccaccaccacacccaguaauuuuuuuuuuuuuuugagacagucucgcacugucaccugggcuggagugcaguggugcgaucucggcucacugcaaacucugcaucccggguucaagcgauucuccugccucagccucccgaguagcugagauuacaggcgccugccacuaugcccagcuaacucuguuuuguuuuuguuuuuguuuuuguuuuguuuuuucauuuuuagcagagacgggguuucaccauguuggccaggcuggucucgaacuccugggcucaagcgauccucccgccucauccuccgaaagugcugggcuuacaggccugaaccacagcgcccggccuccaccccugucagaagaacccucugaaaaucggucccacucuacggaggaguagagggagacucggagaggauacggaccgugcccauguugcggggguucccagggcguggggucaggaguuaggggugugcuucucucccguccccuugcugccggggucucagguccgcuuuuccccgggaccgggcucccccuaccuuccggggccaggauggugaacacuggauccucugccggcgcaccccgcacauccuccaggaucugcuccaccguggggggcgcugggcgggugggcagcagcacgcgcuucuuugccuuggagcccaucucugaaggcggggaagggggcgcugaccggggcguccaccucuccgcccuugcccgggcugcuccucccgcccagcgaacucguacgcacccgucgcggucccgcucccggggaagcccgcccugucccgccccucugagcucgccccaggcccugacccucccuccgcccaaaaacacgguggccaaggcuucagggucuggcucaaccucugccucaguuuccccgcggucaccccagucgccggccucuucccaccugggcgcgggacccgaaagcccagcgucgacgacgcagccacuuccgauuccggucggagcaccgc

SEQ ID NO: 192168 - RNA, 50564 nt, Homo sapiens
uuguccgccauuugcaaggggcccggagcgggaucgcggcaccugccgagcgggucgccgccucugccgcgguccuuggaccccgccgccgcccuggccugggagcuugccccgccgcagcggccggcagcgcggcgcuccgcgggcggcaggcacgggccccgggcccccucacggcgcccagccgcgggccucccgaggcaaaagcccgugggccgccgcgauggcccucaagauggugaagggcagcaucgaccgcauguucgacaagaaucugcaggacuugguccgcggcauccguaaccacaaggaggacgaggugagcccggcgcgccaaggggcugcucggccuggucacagccccggcccagggcccagcccugcucacugggccugcucggccugccgcccgcccgggcucugucuuaguuggaggucccgcuuagggcuccggcccugccuggccugggccuggggcgccgcccaccuccucggucccccagcaucaguuuccccacgaggggcgaaggccuuggagcagcacaucucggauccucgccucaucggaucaccugggggaagcgcuguucaaaaugcaaugcccugggccccgccuauaggugcccucccccuggacccucaguuuacucucucagagggagauucgggcccaccugcccccgucucgggccacccucccaggagacuugcgaggucucugggcagagcuucuucaaccugaguguguuuccgaaucaccgauuaaaaaugcaggggcccgggccccgcccccggacccuccccgggagaccgaggcaggggguccugggccgucccuggagaaacuccuucuuccuucugggucguguaaaugcguguccaggucgcucccugaggccuggcucggaaccaggcagggucuuggggcguugccuccagugcccccguucccaggaagguggggcugcugccaggagggaggaaggacagcggcauccugauccccagugagguagcagcuugcgggaagcuggaauggggaagcugacuucaaguaggaaccugaaagccagggcgaggaaauaguuuuccagaaguaaaauuacaaccguggggaucguuuccuucccgcuccucccuucccccaaccugugaccuagauugaagaagaaugggcagaguggccaccacgugucuggcuucauuaaggauacccgugcagcccuugggcagugggagccuuagaaaguguccuacuugagcgacugccugccugcuucccugcguggacagcaaggcaggccugaaagagagccgccgucugauaccgcaccagucccaguaccagaggcuguguccaggacgaggugcccaggagggcagggaaguuaagggacuugcuuccuggcaccaugucccucagcccaugucccucucucugggaacccgagcucuugccguauuguuacaccuuuacacuuuccuggaagugguguggcuucgccugcccccaccuuaaugaggucauuuuuguucuucuccaccccacuucccuucggccuccuugguuuucuucaucucagaagcucucccuaacugcuuugguuacaacguguaacuaacuggaguaauguucagauucuuugugaguugaaagcaucgcugaugggccugguuuuuacugagcuugguucagauuggaaaugugguucacuucccgagaggacuuuuucugcacaggcaggaucucccagcgcccgucccugcucccuucagcgcaugucacugagcagccuguucugggacccugacgaugggccagggggucuguccaguggaggaccacaccucuagucuggggcaugguuuucagggggaugugccugucuucacugggaagccccugagccugguuuucuuccuuuggaauuggugugaguugauagcgccuuccccacaagucugggccccuucaagggggucuuggugguggaaacuuuuuuuuuuuuuuuuugagacggaguuucacucuuguugcccaggccggagugcagaggcaugaucuuggcucaccacaaccuucaccucccagguucaagcgauucuccugccccagcuccugaguagcugggauuacaggcaugcaccaccacacccagcuaauuuuguauuuuuaguagagacaggguuucaccauguuggucgggcuggucucaaacuccugaccucagugauccacccgccuuagccucccagaguguuagaauuacaggcgugagccacugcacccggcugggaaacauuuuuaaaacggcgcaggguuguccuugaaagucccaggcuuccucauuggcccugccauuggcgggugggugauuucaggcaggacacgcagugucuggggacccuggcuuucucacuggaagacgauuguuaugguccagagggugguaacucagguguucaugucugauucuggauguucucugcagcugcuggagucuccugauuggagagcagcaaaugacuguucaaugacaguucuaguuguaccuccagcacccccacucacuuugaaaaagcagcuauccuauagaccguauguuguagguucuucccucccgcccacugcacccggaacaaagacucuagacagugugcgcauuuucugcagcaguauaguuuccaaaaaaaguuuccauuucguaauagauuuucaccuaaaacuugaguguggcaucauggaaacaaggcuuagcaaugacuuugaaagccacguggaaaggcagugcgauggaguagaaaucgcaugagguuugggagauccgaguccaggugcuugggcugacuggcugacuucauggggcggcccaucuagagcccccugcucugucuccucccuuguaaauggggaugacagucaccucccuccuugcuggaugaugcggaggaugcugcagugacacgcgguuuucuggaagcgccagagcgcugagguugucuaguucacuguuuuccaguccucaggcugugaccucuuuguggguugugaauucaauuuaaugguuaugcuagguaagaaaaaggaaaagaaacuagaagagaccagagugcaggcacauacaguaaccguccuguccugaaacuuugauuucugcaugugauacuuguguguacguguaaacguaucggguucccaugcaaaaccuauuaagaugaguccaaaaagcgugagaaguaguggucucauguguaugugucuugguccacuugggaguguccucagcuucuaaagcucgauagaauuggcacaaaaaacaaacgacuuuuaauauuuuguucucacaaguccuuuucauaguuuugggaaaguuuucuccauuuuuucuuuuucuuuuuuuuuuuuuuuuugagacggagucuugcucugucccccaggcugcagugcaguggugcgaucugggcucacugcaagcugugccucccggguucacgccauucuccugccucagccucccgccaccacgcccgucuaauuuuuuguauuuuuaguagagaugggcuuucaccguggucucaaucuccuguccucgugauccucccgccucggccucccaaagugcuggauuacaggugugagccacggugcccagccuuuuuuucuuuuuuuuuuugagacuaagucucgcucugucgccaggcuggagugcaguggcacgaucucggcucacugcaaccuccaccucccagguucaagugacucaaccucccaagcagcugggacaacaggcgagugccaccacauccagcuaauuuuuguauuuuuaguagagaugggguuuccccauguuggccaguauggucucaaucucuugaccucgugaucugcccaccuuugccucccaaagugcugggauuacagggugagccacugugcccagcccauauauucuuuuucuuuuuucuuuuuuguuuuuuuuuucuucuucuuguuuuuuuuccaagucagagucucgcuguguugcccaggcuggagugcaguggcacaaucuuggcucacugcaaguuccgccuccuggguucaagcaguucucccugccucagccuccccagcggacuccaacuaaaaaaaaaaaaaaaagaaaggaaaagauauaaagagauuaaauuugaacugaguguguuuucuuuucuuuuuuuuuuuuuuuuuuugagacagaguuuugcucuuguugcccaggcuggagugcaauggcgcgaucucggcucaccgcaaccuccgccucccagguucaagcaauucuccugccucagccucccuaguagcugggauuacaggcaugugccaccaccccggcuaauuuuuuguauuuuuaguagagacgggguuucuccauguuggucaggcuggucuugaacucccgaccucaggugauccaccagccucggccucccaaagagcugggaugacaggcgugagccaccacgcccagccgaacugagcggguuuucucuccuuuuaauaacgucagucauuccacuagaucagcgucugccccucaccacuguggauguuggggcuggaucauucucuggguagagcuauucugggcacuacagggugcugagcagcauccccgcccccacccacuccgugccaggggcuccucuggucaugccagccacaggugugcccagaccagaaugucucuuggagguagaaucaaccccaaauuaaaagccccugaccccccuugaugguaagaaaagucucccagaauucccgaaugcgucccuguuguccaggugcccucgucccccgugcugucacgguggugguggaccagagggcguggauucuaaaugugcuuuguuuucccucugagcugcuuugauugcaaaauaugcagugcauaggacauuguacggcuuuuuuuuuuuuuuuuuuuugagacagggucuugcuccgucugucacccaggcuggaaugcagcggcacaaucuuggcucacugcaaccucugccuccuggguucaagugauucuccugccucagccuccgaaguagcugggauuacagguggccgccaucacaccuggcuaauuuuuguauuuuuagcagagacgggguuucacuguaucggccaggcuggucucaaacuccugaccucaaguaacccacccaccuuggccucccaaagugcugggauggcaggcgugagccagugugcccggccuguacagcuaauuauuaugguaaugauccugacuucuguaaguuuaauuuccuugacuugcuuguaguuuuaucacuuaaauuugugucccugaaccauaggcgugauugccuaaggugugugugcuuugcagccgucaugguggggagggagcuguccucgguccuugacguggguggcugugcucuguuguuuacacacagcuuccauacauagucggacaugugggugguuuccauguggggucguuuuaugaauggacucaagccguagaggcccucaggaaagcgcccgcuccccacagagcuucucccagcagcaagcaugaaagccgcagccucgccucccgcaccaccagcagggcugggguguuuggggggugcagcuguagugucagcugcccugcuuaugagugcgguucacucauucacaggcguuuagccgcuugcguucuuccugaagcucucucuucaaagaggcuugggccucuuugucuauuuuacuccuuugcagggguuuucaaaaggcaaucucugggcagaaggcuugguguguguguguggagguggcuucaaggccgaggcauguggguccuggaggggcaugugggugggggugaguucugcccuuguaaccagcuucugggugaugcucacuugcguugagcuuuggagagccaggaagaccagagggcaggagcggcgacgccagcccugggugugcucuggcccagccguggcacuguggacaucaggcuggauuguucuugggguggggguguuggggcacugcagggcacugagcagcguacccggccuccacccacuccaugccuagauaucugcaagucguggcaaccacagaugcugcauacaucgcccaguguccccuggaggggcagagucaccugcugggaaccacugccuuaggaguucuuggacuggcugguggcugauuuguccacguggcagugagacaggcggagggauguggggaccccggguggccugcugggcauccaccauguggcccacucugugcugaguggucccuaaugcuccugcucaucugugacuggggccugaggacccuccucugcucugcccaggccuccagcccucagggagcugcgguccagauggagccucacguccuuccugguguuuuguccuguccugugaugcugcugagccaaggugguuccuuucuuugaacaguugagauauaauuuacaugccacaaaaucugccuguucuaggcaugaaaugaaguagauuucaguauauuuacaaacgugcagugauucagcacaauacguucagaacagagaaaccuaugcccuggcgaccacugaccugcugucucuguggauuugagccagaagcguuuuuguuuuguuuguuuguuuguuuguuuuuggagacauagucucccucugucgcccaggcuggagugcaguggugcgaucuuggcucacugcagccucuuccucccagguucaagcaauucuccugccucagccuccugaguagcugggauuacaggcaugcaccaccauaccaagcuaauuuuuguauuuuuaguggagacgguguuucaccauguugaccaagcuggucucaaaccccugaccucaagugaucugcucggccucccaaagugcugggauuacaggugugagccauugugccccgccuugacucagaggguuuuaauggugaccgugccaccccacagacauccaggcugagcugaggggccgcaaguuacaggacugagcacagagacgggcuggggcuggacuaggcagggcuggccggggucugguccuggauggggcuguuucugguuucugcccuguugcguguuagugugcugcaccagccucaguugugggaguggagguaggucccggugugggggccucgguuccaugcugccucaggguggccgcggccgcucugcuccugggugcagagggcguugagccuguccacaacaagagaauaaagcaggacggugucccgggcuguugaaagagcagagcgcuccgcaggagaagcuccuuucaugcugcuucugggguucugggguuugguggcuuuucuguuugaauucgaagugauggugauuguggauaguaacuuauccugggcaggauggaccacuucgccggcgcguccccuuuccugacucaguuacuguugggacuuggaauucuuuuuuuuuuuuuuugagacggaguuucacucuuguugcccaggcugaagugcaauggcgcgaucucggcucaccgcaacgucugccucccgggugcaagcgauucucuugccucagccucccgaguagcugggauuacaggugcgagccaccaccccggcuaauuuuguauuuuuagcggagaugggguuucuccacguuggucagacuggucucgaacucccaaccucaggcgaugcacccgccucggccucccaaagugcugggauuacaggcgugagccaccgcaccuggccgaggcagcacuuucauuuauuuccuuuuuuauuuuuuuuuugaggcagucuugcucuguugcccaggcuggagugcaguggugcgaucgcggcccccuacagcauugacuuccugggcuuaaucaauccucuuaccucaaccuugcaaguagcugugacuacacgaugugccaccacgcccagcuaauuuuuuauuuuuugauuuuuuugaaacagggcuucaaaaaccuccucucuacacaaaaauacaaaaauuaggcaggcuuggccuggcacgguggcucacgccuguaaucccagcacuuugagaggccaaggugggcggaucacaaggucaggagaucgagaccauccuggcuaacacggcgaaaucccgucucuacuaaaaauacaaaaaauuagccaggcauggucgcgggcgccuguagucccagcuacuugggaggcugaggcaggagaauggcaugaacccaggagguggagcuugcagugagcugagaucgcgcugcugcacuccagccugggcgacagagcaggacucugucucaaaaaaaaaaaaaaaaaaaaaaaaaaaauuaggcaggcaugguggcacgugccuguaguccuagcugcuuggaaagcugaggcaggagaaucacuucaaccugggagguggaguuugcagugagcagagaucauaccacugcacuccaacuuggacgauagagugagacuccaucucagaaaaaaaagaaaaagaggcugggcgugguggcucacuccuguaauccccgcacuuugggaggccgaggugggcagaucaccugaggucgggaguucgagaucagccuggccaacauggagaaacccugucucuacuaaaaauauaaaauuagcuuggcgugguggcucgugccuguaaucccagcuacuugggaggcugagacaggagaaucacacuugagcuugggaggcggagguuguggugagccaagaucacaccauuguacuccagccugggcaacaagagugaaacucugucucaaauaaaaaaagaaaaaaaaaaaacagaaaaaaccccucagagcccccauuggggugagggggaccgggcuuugcucucaugagcugggugagcucccaggcccucagccugcaugcggcucagcggcccggcuccccucagccaggcggccacguggaaagcaccgugggaugugccaagggcucagcucguuggucuuugaacuggacagcaccugagaaucagcugcugagguugugaccauguggccucccuggucucaagaugcugacuuaauucauuggaggcgaaggacugagaaucggaaguuuaaaacuagaaaaagcgccagccaggugcgguggcucacaccuuuaaucccagcacugugggaggccaaggugggaggaucacuugaggccaggaguucaagaccagccugggcaacauagugagaccccaacucuacaaaaguaaaaaauguuaggucgggugcaguagcucacaccuguaaaucccagcacuuugggaggcugaggcuggcgaauuacuugaggucaggaguucaagaccagccuggccaacauggcuaaacccccucuaaaaauauagaaauuagccaggcgugguaguaccugcuuguaaccccagcuacugggaaggcugaggcaggagaauugcuugaacccgggaggcggagguuacagugagccgagaucacaccacugcacuccagcaugggcgacgagcaaaacucugucucaaaagauacauauauauauauaaauaaacauauauguaaauaaauguauauauauguaaacaaguauauacauaaauauaugcaaaaauaaauauauauaaauauauauaauuuuaaaaauucgcccaauaugguggcauggcccuguaaucccagcuauuuacuguacucccaaauacugaggugggagaaucucuugagccugggagguugaggcugcaguuagccaugguuaggccacugcacuuuagccugugcaauagaggaagacccuaucucaauaaaagaaaaaaaaaaggccgggcaugguggcucacgccuguaaucccagcacuuugguaggcugagacagguggaucaugaggucaagagaucgagaccgucauggccaaaauggugaaauccugucucugcuaaaaaugcaaaaauuagcugggcguggugguguguaccuguaaucguagccacucgggaggcugaggcaggagaaucacuugaaucacuugaaccgagaggcggagguugcagugagccgagaucguaccacugcacuccagccuggugacagagcaagacuccauuaaaaaaaaaaaaaaaaaaguaccccagggaguuuuccuguguaucuaggguuuaaauggccugucuuacugcaguccugaggacuuaguguauaaaggaaauacgcacccuguguucuaaauuacaucccagaauuaaauagaugcugagaccagcaucauuguuuuaguaucucacuugcuguguggugaagugugaauuuaguguggaacuagcugagguguuugagaaauuucaccauguugcuccucugauuucccgguguuuuuguagaaagugucaaugauguauagccacauuauagcuucagcuaauuuacaucuauguuuauaauauaaucuuuugggucuaggucaugucucccuaccccaacuaauacauuuuuuuucuaauucaggccgggcgcaguggcucaugccuguuauccuggcacuuugggaggcugaggcgagcagaucaccugaggucaggaauucgagaccagccuggccaacguggcgaaaccccgucucuaccaaaaauacaagaauuagcugggcaugguggugugccccuguaauccuagcuacucaggaggcugagccaggagaaucacuugaaccugggaggugaagguugcagugagccgagauugugccacugcacuccagccuggcaucagagcgagacuccgucucaaaaaaaaaaaaaaaaaaaaaagacguuugugugaggcuuggucugagaggagcuacuuggacuuuaucagaaguuaaaagccaagagggagucccaggguugugacccacugccgaguuccuagaaagcugacuaguggcugggcgugguggcgcacaccuguggucccagugcuuugggaggcuagcggggaggaucacuugagucugggguguggaggcugcagugagcagugaucucaccacugcacuccagccugggcgacagagugagacccugucucaaaaaaaaaaaaagucaagcaaguugacuggagcagacccaccacaugguguguauccauucaucagcggcgagcgugggggcuguuccuguuucaggccacuagaaauggugcugcccuguguguucgugugcuuguuuuuguuuggacaccuguuuuccauccccucgggugcacgcccagaaguggaauugcuggggcgguaacuccacauggaaccguggaggaaccccaggcugcuuuccacagcagccgcgccguuugacauccccuuugcccucgugagggucugaccucuccacgccugggauggucuuuuuguucuuuuccuuuuaaaucaacaguccugacccuuugagcaggaggaguggguuauccuugcuccggggaugggagcacaguccuggggugagguguaguaauuugaagcccgucuggaggaucggguggcacucuuuccauuguacaaaguuggaucauaaagcauggaggaaaauauuaugugucugugcccucccccacccccccacucccccacagcugugucuccuuccccagcccggugcagcuggcagccgagguuggggugugguccugggugacacaugagugguggguacuccuggggcugcuucgaggccagcuacaguggggcugaggacagaagcgugauggggugggcuugccauccuugccucuggugggcacagcaggaggaacauugcaucccgacguaggggcuggcaggacggggcccgggcagccgucacuccugaccugucggaugauggagaggggcuccugugcauuaggagggcuugugggugccucaucguucacugauggaggcacuccaagccucugcugcucccuccucuccuuccaggugggguggguugucucuggggccagcauggcaucgacucggcuugucucuggugcuauguugggcgccucacgucugccugucccuugggaaccuugucugccauucuggaccucgugccugaguucgcuugggucagaauuguccuugaugguguucuggagacacgcgcaguuagugagcaggcccagggggauccagacacaccagacacauccccucaaaaccugagugugguuuucacagcagugagagucacccuggcugaaggugggaaggccccacauguucguccaccaaggaguuggcaaacgguggggcguguauagcggaaugcugugcgccaccaccacggccaaguuccagaacauuaucagccuagaaagaaagcgaacccucccgucuccucucccagccuguggcacccacgaauccccuuccugucucuggauuggccugaucuggacauuucauagaaauggauuacacggugugcucucucuuaugccuggcuucuuuccuuuuuuuuuuuuuuuuuuuuuuuuuuugagacggagucuggcucucucaccugggcuggaaugcaguggugucaucuuggcucagugcaaccucugccucccagguuuaaacgauucuccugccuuagccuccugaguagcugggauuacaggcgcccgccaccacgcccagcuaauuuuuguauuuuuaguagaggcgggguuucaccauguuggccaggaugaucucaaacucccgaccucgugaucugccugccucggccucccaaagugcugggauuacaggcgugagccacugugccuggcccgaaaucauuauuccagcccucuuagcuggauguuuguaaucucuguguuuaucccccauuauaggcaaaauacauaucucagugcauugaugagaucaagcaggagcugaagcaggacaacauagcggugaaggcgaacgcggucugcaagcugacguauguaagugccucccaguggccagcgcccagcacugucgggcugcuucuccacucagcacguguccccuauucaucagccugucuguccaccugucagucauugguaccaccugcugucggugagccacucagggccaacccagaguccuggagcagaaagccauguuggucacauggcuggcaaacaggccagaggguggcaacccacaggcccuggugguagcccugagggagccccaugggguccucuucugggugggauucacuggggacgccccucgccugcagucucggcucccucccaccacaggcugggccaggacaccuaguggggagagcuagggcccuggaccuuccagggcuggcuccuuuccuggcugcaguuccaggucagugcgugagcuggggacaggcacuccucccucuggcccguuuccccgugggaggacgagacaaagggcucguccagggucccccaugcugcugcucgucucguaacuauuucaaggagccgauucgccaaggguugguaggggaauguagccaguacccguaagcgccaguuaaccaauugcagacauugagucucuuuuuagugccuguuacuaacuugucccuguagcuuuuaaaugucagagucguuugucaaaagaagaaauuaaaggccccagggguacguauugggugguuugcugacagugaaugagucuguuccagcaccgugugcugggagggagcgcuugaugccgcggcucaaaaccuuucucucugcuuuggcuugugagugcaauuuccugugcgucccuuaacaguuacagauguugggauacgacaucagcugggccgccuucaacaucauagaagugaugagugccuccaaguucaccuucaaggugagguucugggacggcaaggcuggugggguggggagugauuacaggugugaggcaccgugacuggccaauuuuuauuauuauuauucuugagacagagucuagcucuguuacccaagguggauucaguggccuguaaucccagcacuuugggaggcugagacaggcggaucaccugagguugggaguuggagaccaggcuggccaacauggugaaaccccaucucuacuaaaaauacaaaauuuaguggggcgugguggcgcacgcggcuauaauccuagcuacuugggaggcucagacaggagaauugcuugaacccgggagguggaaguugcagugagcugagaucgugccauugcacuccagccugggcaacagagcgagacuuugucuccaagaaaaaaaaaaaaacacauacauauuccaaacugggaauuuccucauggaauuuugaagaaaucugcguugguuuucaaaugcggguugguucccacuugcugguggccccagcguccaggcugcaggguguugcuucugggcuggcgcugccugguguggucgcugcagagcagagcuggagcuccuggaggcugcggguguccugccucugaugugcucaucuguucucucccagcgaauuggcuaccucgcugcuucccagagcuuucacgaaggcaccgacgucaucaugcugaccaccaaucagauccguaagguggguguucccgggccggggccgcucugugcugagugcagucugcccuugccggagcgucugguucccacacgcgucuuccugugggcagcaggugccuguggcccccuugagugcgagcggggcuuccggagccacaguccucccagcagacgcagagaggaggcccggcgggucugagccugcgcucccuggugggcuugugagguggagggaugcugaguggugcggugcccccuucccucgcucaccaccuggaggggccggcgaauggggcuccaggguccacucgcagcuggccucugcggucacccacuuucuucccuucuccccucaugguagugccugguguagcugugggcccuucccugcccauguggggugcuuccugcccgcggcuuuuuuugagucccacgaggugcauuuuucagcaccauguaaauguugcauuuugaaauggucacggaggccacuggguaguaguaaagguccuuauuggccccgagcucugaacaccuuugguucccgccucucaauagagggguugggguguuggagaaucaggcccacccuuuucaugggcagcuggccccuuucuggccccagaccgcacgucagaggccacggucccggcucuccaauguccaugugcaagggcgggacccuguggcuguguugucgaccccacagugugaccugaaguccugggcugggggcucccagcacgccgagggacaggugugggggcacuggcugugacugauguccggcacaggguguggugcagguccugggacuguuggcucugcugggcucaccguugugggcaagguuauagagcugggcgucccgccugggccgcgggcgacaugcgcccuagaugccguggggcucuugggucauggccauguagcaggagggaccugggcgggagucuucuugggucguggccguguagcgggaggggccugggcgggagucuucuugggucguggccguguagcgggaggggccugggcgggagucuccuugggucguggccguguagcagguggggccugggcgggagucuggcccgcuaagaggaggaugggggcggguuuugcaggugguaacugggagggaggaggguggagggcuccagccgcccuagguacccagguggcagcugcccagcaaggagggccacgugucgugcccagcuuugugucucuugcugaugggcucggcacggccggucccugugugagcaccucacuggggacuuagauccgccgcugccuugcgaggugcucagggcuguuagacccugugugucgggcgcggcucugaccuggugccugccccuggccuggccucggacgcaggugggcccuggcucagccaguuagcaccugcuuccucuguguaggaucacgugcuuccgauguuugcaguccagugugucauuuguuuguuuuguuuuguuuuguuuugagacugagucucacucuauugcccaggcuggagagcaguggcgugaugucggcucaccgcaaccucugccuccuggguucaagcgauucuacugccucagccucccgaguagcuggaauuacaggugcccgccaccaugccuggcuaauuuuuguauuuuuaguagagaugggguuucaccauguuggccaggcuggucuugaacucccagccucaagugaucugcccgccuuggcuucccaaagugcugggauuacaggcaugagccacugugccuggccucauuuuguuuuuuauuuuauuuuuuuguuuuguuuuguuuuauuuuguuuuugagauggagucuugcucugucguccaggcuggagugcaauggcgugaucuuggcucacugcaaccucugccucccagguucaagcaauucuccugcgucagccucccaaguagcugggaguacacgcaugugccaccacacccggcuaauuuuuuuguguuuuuaauagagacaggguuucaccauguuggccaggcuggucuggaacuccugaccucaggugaucugcccaccucagccucaccaagugcugggauuacugcgccuggcuuguuuuuuaauaaaaaaaauuauuuccugggccgggugcgguggcucaugccuguaaucccagcauuuugggaagcugaggcggguggaucuucugagguugggaguuugagacuagccugaccaacauggugaaaccccgucuguacuaaaaauacaaaauuagccgggcgugguggugcgugccuauaaucccagcuacucaggaggcugaggcaggagaauuguuugaacccaggaggcggagguuguggugagccaagauugugccauugcacuccagccugggugacagagcgagacuccgucucaaaaaaaaaaaauuauuuucuuucuuuuuuuuuuuuaggguauuuuuaguacagacaggauuucaccauguuggucaggcuagucuugaacuccugaccucaugaucugccugccucggccucccaaagugcuggaauuaaaggcgugagccaccacgcccagcccuaaaaaaaauuauuuucuuacuuuuuuuuuuuugagacaggguuuugcucugucacccaggcuggagagcaguagcgcaauugcagcucacugcagccucgaccuccuaggcucaagcgaucuccccaccuuagccuccugaguagcugggacugcaggcauacaccaccacaccuggcugauuuuuuuuguauuuuuuguagaggcagggaggguuucacugcguugccuaggcuggucucaaaccccugggcucaagugauccuccugcuucggccuuccaaagugguaggauuagaagugugugccaccacuucagcucacuguguuauuuuauuuuauuuuauuuauuuuuugagacagagucucacucugucgccaucuggaguacaaugucggcucacugcaaccucugccuccuggguucaagcaauucuccugccucagccucucaaguagcuggaacuacaagugugcaccaccguguccgacuaauuuuuuuuauuuuaggagagacaggguuucaccauguuggucaggauggucucgaucuccugaccucgugaucuucccgccucagacucccaaagugcugggauuacaggcgugagccaccgcgcacggccacuguguccuuuuaaaagaaccaguuggccccgcacuguggcucacgccuguaaucccagcacuuugggaggccauggcgggcggaucaugagaucaagaguucaagaccagccuggccaacaugguaaaaccccaucuguacuaaaaauacaaaaauuagccaggcguggugacacgcaccuguaaucccagcuacuugggaggcugaggcagagaauugcuugaacuugggagguggagguugcagugagcugagaucgcaccacugcauuccagccugggggacagagugagacucgucucaaaaaaaaaaaagcuggccuugucauauuuugaccacagaauauuaacccugaaaacggaucuugguagaugcauauauagaugaagucucgggaguuuccuuaagaagaucucuccccaagagcagguuugugauaucaagagaggauuuauuuccccaagugcugacacaggagcuggggcagauuccguguuuuagugagagcugcgggagugaagagcuggggcagaguucaugggagggcgugggcagcugccagcugaacuuugagagggacccaugggagcuguuccugggcccuuccccucaguuguugcggaaagggaccccaaaugggagcagggucucugaggaccccauccuguggggcuuuccugcccauucugugccaggcccagcaccgccgucucugcaagcugggagcugccagugauacgugagggaagcccugguuuuaggccuggaacgcucugcucuugcacccgggguggcccuuccccacacuuggagugacuugugacaggcgccucugucccaggaggugccaggaaacucgguugauucccacgcagagugcuucagccugugccucagaccucucuguccccagcccugcccauccaggaggagccaagaaacuugguugauucccacccacagagcguuucagccugugccucagaccucacuguucccagccgcgcccaucccggcuccucucuuggugacagagucucccaugggcuguaaauucuuccuccuuguccgaguucagcuucagaccccucagcagcaggggugcuaaggcacagcugcaccccaagaggauaugccgaguccuggggcauccugggagaauuucgcuccugcugcuccuggugacccaggcgucggaugugccacccagggcauccuggccacggccccuuucucucacuuuccaggacuugagcagccccagccaguacgacacagguguugcacugacgggucuguccugcuucgucaccccagaccuugccagagaccuggcaaaugacaucaugacacuggugaguuuguaagccugcccaccaccccugcaugucugcucugggaaaaacucggucaaaguggcaugccugggaagcuuggcuaugcggaaaccggccgggguccccggugcguggccugccugaaaugggaaccaaaucacugucagcugguggagcggcucuugggccgcuuugguuccugcgugucuuaaguugauauuugaaaucaucuugccgagaggagcaacagggugucccugacaggccaggcacggugggggauguuugcccugaggucugacaguggcuccugucugagcugccagugggcuucugugugguccucuuuccuccaucccuggccacagcuugacuccuccuugccacucugcuugucaaaggcuacgcccccggcugugacagucuaaaaccugggaagccccuggaaauuuuggccccagaaacaucuguuuugugccugacuuaaccuccagcucaugaggggaccuuuguuccuuuucauuuaaaacacaguagccagauuaacaguguggagcgggcaugcuuuccucccugggaagcacuguccucacauggcugccuguccgcccggaggugucuagaucguggccgaugggcgcuguccccgcguggcugccuguccgcccggaggugucuagaucguggccgaugggcgcgguccccguguggcugccuguccgcccggaggugucuagaucguggccgaugggcgcgguccccgcguggcugccuguccgcccggaggugucuagaucguggccgaugggcgcaguccccgcguggcugccuguccgccuggaggugucuagaucguggccgaugggcgcuguccccgcguggcugccuguccaccuggugucuagaucguggccgaugggcgcuguccccgcguggcugccuguccaccgggugccuagaucguggccgaugggcccuguccccucguggcugccuguccaccgggugucuagaucguggccgaugggcccuguccccucguggcugccuguccacccggugucuagaucguggccgaugggcgcuguccccgcguggcugccuguccaccuggugucuagaucguggccgaugggcacuguccccacguggcugccuguccaccuggugucuagaucguggccgaugggcgccguccccauguggcugccuguccaccuggaggugucuagaucguggcugauggucuuggagauugucagcacagccugcuaagcuucuagaucagggaucagcaggcugcggcacagggccaaauccagccggcugcaccuucuuuucacguguuguguugucucugguggccuugguugugaaggcacagcuguguggucaugacagaggcugucuggcccaugaagcugaaaacacugacugcuggccuucacagagugccggcuccucuagaguaaagcaguggggagcccacgagaggguggaugucagugccccaucauggauuggcucugucaggaccaggcaguucgaggcgacucccugggccuguuagaugggagggcucccgcuggggaauuugagcagucgcagggcacagccgugaggagcugggcuguaggcuguguucccagcacacccucguucccugugugacuuuccucuccagccuuccucccacugugggacccaggacccuggggcaggaaggccacaagggaagagggcucucucuggagggcaggccugagucaggggcacagugaggcuggcuuccaugccauccaagaugcuggucuguggccccugggacuggugugcagccacagcgucgggcuggagggcaucuccucucuguggaggaggcggcugggaggggcgagagcagggaugaggcgcagaaagcccgcgcaggcugaagcccgcugccccgcagaugucacacaccaagcccuacaucaggaagaaggcugugcugaucauguacaagguguuccugaaguaccccgagucgcugcgcccugccuuuccccggcugaaggagaagcuggaggaccccgaccccgguuuguggauuugaguuaagccucaggguugagggugggggcucagccggugcccugggaagaggugguggcguguuuuggggggugcugcggggaguggugaagggcucaguccaggaacaugccuguuggagguggcugggccuccccuugcuggggcagccaggagggaggugcugguggugggggcaguaagauccaauguggcagcuggcggugagucuggcgugucccugagcagagguguacccacccccgccagccccucuuaggaccagugccaccaggaggcaccuuccacagggcaggggauggucuagaccauaugucccgugcaggagcugccuccaccuaguguagcuguuguguauuugugguguggugacugcgggacgcggcugcagauucaguuucacugaguuucccugggcuggugugugaagccucuggcguguggcaggcgugggucgguggaccccaaagccagcccacaggaaucccaaggcccugugugcaggaggggagaccccagcccuaagcccgggacccgaugggcgagcuucucccuggaguggugggcauggaugcagcaggaagacucccugagccccgauggcugggcagcuguuucuggagcccucaugcugaaacccccacucagagggccgcugucaggcuguccugagcuuggugacgcuugugcgcacuuguuccuggcaacagugccgagcaaugcuuucucagcgccaggagcuggcugcuguggccuguucccuggaggaucaggucuguggcugcugucccugucaccaggaggagguggcagagccagggccauguucagugggagcugcugcaggccccagaacuuccucgcgggccaggaagacaguaggaugguuuucuagguggaaggacaggcaugcugaugagaaccccuuguuccccagggguucagucggcugccgucaaugucaucugcgagcuggccagacgcaacccuaagaacuaccugucccuggccccgcucuuuuucaagcugaugacguccuccaccaacaacuggguccucaucaagaucaucaagcuggcaaguacugcccgggaauguggccuccucacccuguguggggcauucccucacccuguguggggcauucccugcgggugaccgaggcccccccugucccucacccugcguggggcauucccugcgggugaccgaggcccugcuguccccacaguucggugcucuuacuccuuuggaaccgcggcugggcaagaagcugaucgagccccucaccaaucucauccacaggugagugcaggccaugcgcggugggggcgggccggcuccacggggugcagugucggagcggcgggggcgggccggcuccacggggugcagugucggagcggcgggggcgggccggcuccacggggugcagugucggagcggcgggggcgggccggcuccacggggugcaguguuggagcggcgggggcgggccggcuccacggggugcagugucggagcggcgggggcgggccggcuccacggggugcagugucggagcuguggggcgggccggcuccacggggugcagugucggagcggcgggggcgggccggcuccacggggugcagugucggagcuguggggcgggccggcuccacggggugcagugucggagcggcgggggcgggccggcuccacggggugcagugucggagcuguggggcgggccggcuccacggggugcagugucggagcggcgggggcgggccggcuccacggggugcagugucggagcggcgggggcgggccggcuccacggggugcagugucggagcuguggggcgggccggcuccacggggugcagugucggagcuguggggcgggccggcuccacggggugcagugucggagcggcgggggcgggccggcuccacggggugcagugcuggaguggcugcaagcccggccccagugcgguacagcgggggcugggcgugaagcagcugaaagaugacuguccguccuagacuggaagccuguaguggcauucccggccacuagacucuucuccaugcugcuuagagacguuuggggaguuuggguuuucuuugugggucuccgcacugcaagguuguggaaugggauccuauguuaggagccuuuucaggccaggcugccuuugguugcuagaaggggacacuuuaauuccucagaccaagugcugaggcggagccaggaccccuccccggcccccacugcagggaaggggaggggugcagugggccgcaggcagaggcgucaucgccaugacuuucagaugcagucaugugucggcaacaaggacacauucacagaagggugucauuaguacauuucaccaugugagcaguguagcauacgcgcacacggacuucacugcugaagcucgccacacuccuaggcuauggcgcguggccauucuccuggcugcggcccuacgcugcaggugacuguaaagcuguaagcagcugcgacuccauggugauuaucugugugucugaacacaucgaaacaccgaaaagggcugggagcuguggcucacgccugugaucccagcgcuuugggaggccaaggcgaguagaucacuugaggucaggaguucaagaccagucuaggcaacauggugaaaccccgucucuaccuaaaaaauacaaaaauuagccgggcgugguggugcacgcuugcaaucccagcugcacgggaggcugaggcaggagaaccgcuugaaccugagaggcggaggucgcagugagccgaggccgcgccauugcacuccggccugggcaacagagcgagacuccgucucagaaaagacaaaaaacaaaacaaaaaaaacucuagaaaagaugcaguaggaaggcgguauugccaucucacaggccgccgggggugcgugguccgucccugcguggaugcugucacgggccugcaguugcagagggauugcucaccugcccuuucugggaagaugagacgaugaccagccgagcaccacaggccuuggagagcaaggcacgggcucccuccuggggcacacucccugagccguggggcggaggccgucuccagcugagcugccggcacugggucacugcaucugacgaggcccccaguccucaugccgcuucccuguguuccuuuccuuagcacgucugccaugucucuccucuaugaaugugugaacaccgugauugcaggugagaacuggcacucuccccaucuggaagggcuggcacugccaggcuggggucucagguggggacaggagggcgccaggccuggugucuccgagcgccaccccugcuggaacugagaaggaaagcuggcugguggggccuggggcuggcugggaguccgucccaggccucugcugucaagguggccaugcgucugccuggucuuccaccgccauuggugcuggguguuugcuucuuaagcugccugguggcccagccacucuggaguccccuuggguaugaaagauucaccugcagauaaagccccuccucauaccugcuuccacagaugccggccccugcugcucagggccugccauccgcucucacaguacacugcauuuuuucugagacuuuaaagcacuccugagacagcauaucguuucacccguggauacuuaaauagcagcaucuaccacaaaaauauuuucuuuuucuuucuuuuuuuuuuuuuuuuuuugaggcagagucucacucuguugcccaggcuggagggcaguggcgcaacuuggcuuacugcaaccuccgccucccagguucacgccauucuccuaccucagccucccgaguagcagggacuauaggcgcccgccaccacgccuggcuaauuuuuguauuuuuaguagacacgggguuucacuacauugaucaggcuggucucgaacuccugaccucuugauccgccugccucggccucccaaagugcugggauuacaggccugagccacugcgccuggcccacaaaaauauuuucuaaggcagagucagaauccacaccuccggcugggccagggcacaagggccaacgaccaauguccccaguggucucugccaagcugcuccaagucagccaaagccucacggggcauugggcgguggacuuccuuaugguugauaaagcagaagcuucucaccaguaggagggcccagcuauucaggaggccgaggcaagagcaucacuugagcccgggaguuccaggcugcagacagagugagaccccgucucucuugaggcuggugugcaguggugcgaucauagcucacugcagccuugaccucccgggcuuaagcaguccucuugcuucuacaggcgcaugccaccccacccagguaauuuuuugaauuuuugguagagacaaggucucacuauguugcccaggcuguucuugaacuccugggcucaagccauccuccugccuugaccucucaaagugaugggauuacaggccugaguuacuguacucagccagcaccccaucucuuuuguuuuuuuuuuucuagcuuuacuuagguauaguugacaauuaaaaaugguauauuuuuaagguacaccucuagauugucaaauagcacaauucagauaauuaacacaucuacacaccgcgcccggccuacauuucuguuuaaaauacauuuguuccuaccuggguaaucuauacaccuauuuuaagaaaaaaaaauuaccaucuacuuuuauauucacauaacacuccuggccgggcgugguggcucacgccuguaaucccagcacuuugggaggccgaggcagguggaucaccugagguuaggaguucaagaccagccuagccaauaauggugaaaccccaucucuaccuaaaaaauacaaaaauuagcagggcuuggugucgggcgccuguaaucccgacuacuugggaggcugaagcaggagaauugcuugaaccagggaggcagagguugcagugagccaagauugugccguugcacuccagccugggcaacaagagcgaaacuucuucucaaaaaacgaaacaaaacaaaacaaaaaaacaacacuccuacaaagauugggugugacauuucugaaaucuugcaugcgugaauaugcauuuauuuugccacauuucuucguucguauuuacauuuauauguagacuuucuguccaggguuauucauuuccagauauuuguauuuuuuguauuaaaaaaauuauuauuucaguaguuuuugggcggcauuuggugguauuugguuacagggaucaguucuuuagcggugauuucugagauuuaugugcaccaacacccaggcaguguacacugcaccccaugugcagucucuuaucccucaccccccaccucccacaagucccuggaguccauuagaucauucuuuuuuggggcggugggggggaucgcggaguuucucucuuguugcccaggcuggaguucaauggcacaaucuuggcucaccgcaaccucugccucccaggucaagcgauucuccugccucagccuccagaguagcugggguuacagacaugcuccaccacucccgcuuauuuuuguauuuuuaguagagacagaguuucuccauguuggucaggcuggucuugaacuccugaccucaggucaucugcccgccucagccucccaaagcgcugggauuacaggcaugagccaccgcgccuggccuagaucauuguuaugcuuuugcguccucauagcuuagcuuccaagaacccaugucuuaaaaagaaaacacaugcacacgcacacgcacacacggucuccuguacaccuucauuccaugccacuggcuugguggaaaaugagucucugucccugcaugugccuggcgguccccuggcuucaugucuuucuuuuaaagcuguuagagcuggggcucugagggucggcuucucgcugccugccugucccugcccaaaggacgcagcagagucagcaaaggggaauggcuccggggauguuggggaggccaggcccagcuucuagagccuucuuucaguggaguccugccggaugugcuucaucccccagcagugagcugugaugauaauuugugaagugucaccauggaggcucccagagacccagcgccuggguuccuacagggucugguccuguggccucggggccuggccccugccgggauuccagacuccagagggaagcagggguugcgagugaaccaguguuugcaggaacagcugaggccccgagccauccugucagugagggugggggccccugcagguuccuauccucaggccugugauggagcuagguuuuugcaaacacaguugggcugcguggucccaaacucaguggcauuucuguccucccucccaucccuccucccggcgagggggugcuggugccccguggcccugaguuggugucggcgcuggccauggugcugaccguggugcugaccaagcugucuguugcagugcucaucucgcuguccuccggcaugcccaaccacagcgccagcauccagguacgucccgcacugggcggggcccauggggucccacacugcagaggccacaccuuuccacaggcgggagcuugcccacccugugaccaaggugcugguccccccacgccaucuugcggcuugggagggcacagccgcguccugugugcacuaccuacccgagccugcuugggauccccaucaugugucugugggguggaugcauggggcacugaggagugggggagagcgcccgugggaagcagggccucccuugucuccagugccccaugugggccaugcuuguuucccuccugggcuuugauugguggguggggcugacgccgggccuuaggccagguugagguugaaucuggaggguaccugugggacucacccuugguuuagaggauguaaccagcaucguuuuuuucuucuuuucagcuuuguguucagaaauuaaggauauugaucgaggacuccgaucagaacugugagucauccccuccccagugcugucauuuucguguccccagcucugugaaguuagggguccuccuagugugaggaggaaguggacacggcaucugcaaccccagcugucucccugauggauggcacucugccucagaggcagcccucugccagugcccuguggcgcccuugcaccccgaccuaucugcgugggguggcugggaaacaccagcuccucugagccccagucccaggggagaugcagggggcauggcaaaggcccccacuggggagauccuggcaguuggacagaugccacucacugagcaccuugguccgaaauuucuggauauuucagccucugcauguuuuugcgggggugcgugaggcuuugcguugugagauagagcagcacacagcacccuugcccaggugccugccugcaugugggugcccccgugcugcucuguugaggaaucagaauuagcggccccugccugguaccuuguaccugggcgguguuuuggaugcucauuuugaagccaggucuuuuuguugagagcaggaguuggcaaacucgccugcaacagcccagauaguggaguggcccuccuuaucugagguuucagguacccccaacacaguccaaaaauaggcaagcaccccacagucggguauugcaagagagaccgcgaucacauaccuuucgugaccguguuuuaugguuguucuguucuuaguuacuauuaguuguucauuucuuauugugccuaauguacacacugaacuucgccauaggcacagacgugucagaaaaacacccacacgcgggucucaguaccgcccgccgugucagccuuccacuggggucaugggcccaucccccacggguagguggggacuacugcguuuucuccguggaccucacggugucugucucugcucagugcugccccguggccugaaagccaccguggauggcaguaugugaauggguucagcugugugcccuguggcugggguggcccuggcuuagguuguggcaucugugccucaugcccagccacccuuagcuguccgugagcugguuugggcuagucgggugaacagugaguacuggguacaggugagacccugccuugggccaaggguaucugcugcugcugcuggaaagucuucucugcguucuucccugcacuggcugggugggaagaggagagcugacagcagcuacuacaacgugguaguagguaggggaggccuuccugagggagccggcaugggggcagccugcaccccggcucccagggagggggcucugcuagggcgacaucccucguggugagcuccagcugggauacuugcucuguccacccccagguugccaaggccaggcagccucccgagguggagacccggcccggagagccgugggcccugccugcacccugcugccuguguccgucccagugacccggcucuggccucucucugcagugaaguaccuggggcugcuggcaauguccaagauccugaagacccaccccaaguccgugcagucccacaaggaccucauccugcagugccuggacgacaaggacgaguccauccggcugcgggcccuggaccugcucuaugggauggugcgugcccucuguccgccgcccgcccgccuggccuuaguucucuaagggacauuaagugucaggugcagagccacguggaaugcauggaguccccucacacucggccaucaguuagugugguggggcagggcagaggggcgccaguccugguccaugccugucuuccagggccuguguggagggggcggggccgagccugcagaacagacugugcugggccaguuguugcucccuggcuggggucgugugccucuaacccagcccacaucgcaggggccugcugccucccuggcaucgaucugugaauccggguccgccugugucccguggauucugucucaggagcagguguugggugucucaccaagcaggccccaggcuggguccgcucucaccacugucuguacacuuuugcccagguguccaagaagaaccugauggagaucgugaagaagcugaugacccacguagacaaggcagaggguaccaccuaccgugacgagcugcucaccaagaucauugacaucugcagccaguccaacuaccaguacaucaccaacuucgaguggugcgucccgcucccagggguguggccggggguuccguggcgccgcucacucaccgccucugccccacagguacaucagcauccugguggagcugacccggcuggagggcacacggcacggccaccucaucgccgcccaaaugcuggacguggccauccgcgugaaggccauccgcaaguucgccgugucccagaugucugcgcugcuugacagugcacaccugcuggccagcagcacccagcggaacgggaucugugaggugcuguacgcugccgccuggaucugcggggaguucucagagugagugggcgcugggccucugggcuggcagcuucuccaagcuucugagggguagggaccagggaugugccuggcagauccuuccuaccgucucccaucgcccugccaccccggccgucuugcagguccguggguuuccagcaccuguccccugacaauggucgggcccauucccccuuuacagaggcgagucugugcugcccugucugcccucugcccucgggcaucuguggcguucccaggagauuguagaucccgugggcacuaggacugggaggugggaggauccauggggugggcugcagacggggggcuggcccugggcaucugcaaggcucaguuccagcugggcgcguggcagcccuucugagcccuguuugcuguaggugaggugggagcuccguguggcaguuagguggcccagggaggcaccugcucagccccagccugccugcgccaggccccucuggaggcacaggggucucagugccagguuccaggugggccgcagggaugggucuuaucgacacugccccugccgucuccaggaaugucagguucucccuggccaagaggacagaucacagccacugcugggcaggcucgggucaccgggccugccuggaggugggaauguguugcugagacucacgguucucacagcagucuggauuuccaggcucucuuggaaauuuaugagauuugcugcuaugccucacugccucgggcccggccccaucaccaccacuggccgcuaccugcugcucaucacggccacaccgagcacuccccacccugggccugccccggcucaggaaggcgccugacuucugggaucccgaaaggguccccagccagccugcauccuggagaugagcacuucugucauuuucuuuuuuuccccucgccccgagacagagucuggcuaucucccaagcuuugcccaggcuggagugcaguggcgugaucucggcucacugcaacuucugccucucggguucaagugauuguccugcuucagcuucccgaguagcugggauuacaggcaccugccaccaagcucaagccuggcuaauuuuuuuguauucuuauuagagaugggguuucaccauguuggccaggcuggucucuuaacucuuuuuuuuuuuuuuuuuuuuuuuuugagacagagucuugcucuaucuguuuuccaggcuggagugcaguggcaugaucucggcucacugcaagcucugccuccuggguucacgccauucuccugccucagccucgcaaguagcugggacuacaggcgcccgccaccaugcccugcuaauuuuuuuugcauuuuuuaguagagaugggguuucaccguguuagccaggauggucucgaucuguugaccucaugauccgcccgccucggcgucccaaagugcugggauuacaggcguuagccaccgugcccgcccucacuuucuguauuuuuaguagagaugggguuucaccguguuggccaggcuggucucaaacuccugaccucgugaucugccugccucggccucccagagugcugggauuauaggcgugagccaccacacccggccacuucuaucauuuucuuauugggaaaaaaguggacuagaaacauauucaagucccaaggcauugugucagacgccagugaggcgcaccccgaggccccacugucccacagaucagggucucccgguuccgucuguucccugcccauccugcuuauccucccagggccagcugcacaguugaccccguuguccuuuuuccucuucugaccuuuccuccauucaguggcucugucaucuccacaucucugccuuguuuguguuacgggcuguugacggccugugguuucuucuacuucgugucucagccccuggagaccgcucagggaaugggaagggcccagagucaccuuguuggugacgagcccaggccuccuagguccucaccugcuagagaggagccccgggauuggcauccugggggcucacaguguuuccuguccucaggcaucugcaggaaccacaccacacuuuggaggccaugcugcggcccagagucaccacgcugccaggccacauccaggccguguaugugcagaacguggucaagcucuacgccuccauccugcagcagaaggagcaggccggggaggcagagggcgcucaggccgucacccagcucaugguggaccggcugccccaguuugugcagagcgcagaccuggaggugcaggagcggguaagauccaacacuccguguugggccgagccucagggagcccucagugccuuucuguccaguggcggccaggucgacggggccucgcuuccucuuccgaagccacucacugagauucuuuuguugccacuugugccagcugggguuugggguuagucagugggaccuggaggucagcaggacgggggauccgucaguaggacuggggcaggucucuggggugcuggguaugugagggugcugcuccuggccacaggaagagguuguuucacaugcggcgagacagcaggugugagagccuggggcuggcaguggcucuuucugguggcugcaggugacguggguucuagguugagcagacuguacaccugugccaggcggugcccaccacuucccaggugucuguuuuucugcuuguuuuuuguuuuguuuugauuuuucgagauggaguuucacuccuuugcccaggcuggagucaaguggugcgaucucagcucaugacaaccuccauccccuggguucaagggauucuucugccucagccucccuaguagcugggauuauagguacccgccaccacgcccggcuaauuuuuguauuuuuaguaaagacggaguuucaccuuguuggccaggcuggucucaaacuccugacgucaggugauccacacuccacagccucccaaagugcaaggauuacgggugugaaccaucgcaccuggccaucugugagagaggucgggaguggcgucagccuguccaauggcugaggagacccagcuucaaggcugcauggggcguggccccgggcuccucugugcgguggcauuagcucggggcuggccaugauccuuggcccauggucacuguuggagcugcccagccuggcugugucugaguuggagccagcacagaggcggggagcccgcgggggccgagggagguggugcuucuggugucggggcacugaccugaugggaggcauuucugcagugggcaaagcucccuguugugcccccaucucuguucuguuuccggacuggucuguuucugccgcuuccuggcgaggaugaugacgacagagacggcaugaaggcugggcucucuguggcuauguggcuguaccagggggcccacacgucacugugccaggggcugagccaccccgugucccugaagguggccgaguggccuuccgggcaggugccagcagugaccccugugucccccacaggcguccugcauccugcagcuggucaagcacauccagaagcuucaggccaaggacgugccuguggcagaggaggucagcgcucucuuugcuggggagcugaacccaguggcccccaaggcccagaagaagguuccaguccccgaaggguaaggauacgggggugggggcauugcaaccauggcccugacauggucccuugaugccugguggcacagcgggggcuccugcaccccugaacagccaggaggguguggggcugauuggaggccucaggcggguauaucccucacacggacucaccaggucucucacugguucugggaucuggcuucugccuggggaugcucccugcgaagugggccugcucccacccuugccauaaagcucugaggcagccugagccugccgugggggccccacugugacccugccgcagucuuccugggucccugcguccucuuaaggggcagugacaccugccucgcuggcccuguguggguggcaggccccacuguuugggauaucacauggccaggcacguggugagccugcucagggcggacgccugcaggcgcgugcucggucacacacugccuuguguggcccuccuguccggugcagccuggaccuggacgccuggaucaaugagccacucucggacagcgagucagaggacgagaggcccagggccgucuuccacgaggaggagcagcggcgucccaagcaccggccgucggaggcggacgaggaagagcuggcucgggugagcugcuggcugccccuggcgagcccucgucuccucccuccugucccagggagucuuugaggcaggucagcggccucuguggguccuggcccugacccuggcaguggaggcaugggcgucccugccucccagagcguuagcgauuccuuuucccccaauacgugcucuucccaauugcgggccuugguuucccuguuagugaaagcucaguagugaaaauagccagagauccagccuuccccagcuggguggcuggugguggacguccacagagggguauccugcccgcuucucucgggcucaugccaagcugugucccacagcgccgagaggcccggaagcaggagcaggccaacaaccccuucuacaucaagagcucgccaucgccacagaaggugaggcccguccccgggugccugucccucagcacccucuacccucaccacccgagccccgcggcauccaucugaguuucggguucccucaggaagauccugggaauggagcuggggccacacggugacugugcggagccuuugaggggcaggcgccucccugugggccccauucauucgagccuccagccggggggcccuguucccugcgccuggcagcccagcugcuguccagcccugaccccacggucgugggcaaccugcugccucacucugggcuugaggccgcauuacuuuucucauuugaggagaaaacagaauauucacguaaaaaaagugaacgaggauuugcuucucucugcucauaggccuguggggucacucgugugacaagcuuuccaguccucacugucuuaaagagucggguccucgggaugcgcucgcucacggcgcuccucgcggcccagggcucuggcaggaccccagcuccuuaggauguuggggcugcgucacgcucccugcauccccgaggcuugucuugcacgugugucaccccucggugcaccgguaacgccuggguguugccuuugcagcgguaccaggacaccccgggcguggagcacauucccguggugcagauugaccucuccguccccuugaagguuccaggcaagugucuccggugugucggcgccgcauuugucacaugggcuguggggugcucccgccgcccuccccgugagccccuggggugcagugcugaguggcugcccgcugccggcccgcagggcugccuaugucagaucaguaugugaagcuggaggaggagcggcggcaccggcagaagcuggagaaggacaagaggaggaaaaagaggaaggagaaggagaagaagggcaagcgccgccacagcucgcugcccacggagagcgacgaggacaucgccccugcccagcagguggacaucgucacagaggagaugccugaggucagccucgcuggaggucccgguccuaggaugucuaucuuuccgcauguguguguccuggggccaugcacaguggccucuccccauggucuucguugguggcugggaugaggccccaccccggagagcauaggaggagaggccucucuguccucgagcacgcgucccgacgcaccgccccagggccagcagcuucagaggcagaugcagguuggcugcguccuggggcccagccgcccuuagugccuagacgcugagcggagccucugguggagccacgucacugcccaccugugcguguggcccgcaugggcagucccacugcgucccagauagauggcguuccaccaggccacaagggcggguuccagugaugggguuccucucuuccugucagaaugcucugcccagcgacgaggaugacaaagaccccaacgaccccuacagggcucuggauauugaccuggauaagugaguccauauggguucagggugaggguggaggccacaugugguugcuucccuuccucucguccucccuuccggguggggccgggcucugcagggugggcaggcugggguggggugcgggcgggccuuccccagaccacguccucacugcacugcucuuggcuggcccucccaaccaagacucuuaaguguggacucugaagucuccaggccuggggugcucgggaggucuccaugccuugacagggcaggguguggccaccacagacccucccaugagagccuccagcaggcuguguugaguagaucuauguugggccauggcuggggccaggggcuggaggagcaggucccgcacugccacaugcuuggacacggcauguacugagugguccugggggguggccaguggugcugauguguggcccggucauuccuccuccaggcccuuagccgacagcgagaaacugccuauucagaaacacagaaacaccgagaccucaaaauccccugagaaggacguucccaugguagaaaagaagagcaagaaacccaagaagaaagagaaaaaacacaaagagaaagagagagacaaggagaagaagaaggagaaggagaagaagguaaggcuagugcccagggcggcggccuucuccauuccccucccuugccgugaacucccaggagacagcggugagcucaggggaaauggcugugagucugagucaggcagcgagugccagccgccucgcccugugccccggcggagugaggacauguggcuucugaggggagcugacugugcacuugugucaggggagacugaggaggacccaacgaucccaugggugagccguguccucaccuguguuggggggacauggucagagcucggcgugguccagaugccacccucacgugcagcuccagaaccguuucugcagugucugugugcagauuuucacauagagaaagaaauggguuuuucaaaggagcauguguuugcagggccugggagccuguccacacccacgucagguggcccaggcagacauaagacauaugggccgccacgggccuucugaccacuggaauggcacacacccacccacagcuuuguccccggcccucuucuggcagcgaaagccagagccagcagggcuggcugaggacaucgccuucagcuccuggauucccaggcucugcaaggcccagcuaguccaggacccugggggcagcgagggcagcuggggccuccuuggcccugcuguccccguccccucuucccaggaccauugcacugcguuugcugacagccugucuugugguuucaggcugaggaccuggacuucuggcugucuaccaccccaccgccugcccccgcccccgcccccgcccccguuccauccacgguaagagacuggcagcuggccagugccagccucggugucugcagaggucauaccuggcacucagggaagagcccugggucuccugaggcccugugcucucgcggucagcaccgugcaccugugggacccagcacugaguggagccggggucaugcucccgggucccagugggccaagcaggggccaggggaaggggaggacagccagggccucugugcucacaggcucccugucacucggagggcacuguggccucucaggcaggcgugagggcaagcugaggguguguggcauggaggcugucuggggugcaguggaguggggccccucauugcccagcaugagccccaagcccuggcucccugcagggggagcucagugugaacacugucacuaccccgaaggacgagugugaggacgccaagacggaggcgcagggcgaggaggacgaugccgaggggcaagaccaggacaaggugaggcugucacucccccaggggcuguggagggcugcaugagccccagcaccccaacguggggccggacacagcuuccgccacccaggucccagggcagcccugcucucgcauuuguguuggcguucucacgggccuuuuguugugguuguggucuuguguuuuuuuaauaaccuucuuauucacacaugguucauaagucucauagaguuuauucauuugaaguauguauacagugguuuucuguauauucacagaguugugcaaccaucaucaccucugucuaguuccagaacuuuccaugaccccuaaagaagcuccauucccaccagccguuacuucucacucccuucccugcccuggcacccacgcauccccuuccugucucuguggaucaguguguccuggacauuucauagaaauggggucauacaccguguggucuuuuguguguggcgucucacugagugugauguccucaaggugcauccacacuauggcuugggucagagccugguuccuguucguggccgggucauguuccagugcguggacaggucacccucugcugaccccguuccuccgcggaugggccacacugugcugacccacucaucuguugauagccacuugggccgcuuccccuuuguggugacacaguaugccgcuuugaacaucugcgcagugcgcguggauguguguguucccucucggaugugcacaugggcgugggguugcugcgucaagugugguguccucacugguuugcccugcauggcucccuggucgguggggacuguuccccgggcugcuuuggcgcuugccgccaaccagagacggccccagccuccgcugggccuggucuggccugagcuugucccgguaggccugaggcguggcugguccugccaucccacccaggcacgugggacccucagccugagcagcccugcugugauccugaccucacacugugaugggggcgugcuggagcagccugggcacugaacccgacccuccucuugcuccagaaaucucccaagccuaagaagaagaagcacaggaaggagaaggaggagcggaccaaaggcaagaagaaguccaagaagcagccuccaggcagcgaggaggcagcgggggagccggugcagaauggcgcgccagaggaggagcagcucccggugagggguacuucagcgcccccgccccacgccgggguuccuggcgggcugugcgcugcuccccacuccugcagccuccaugcgggagagaacugagcagauucgagaagaagccgagccuggcgggggcaggggacuggcccuggcccgcagccccacauuaggcacccccguggugggcugugugguccugggagccggggaucccucaucggcuccuuugaagccccuugccccaagcauucuuggagucguggcauucgaccugggguauugggccauacuggagucuucgcugagacggagcucggggcccccaaggcugaugcgccuuuucuauuuccagccugaguccagcuacucccuccucgcugaaaauuccuauguuaaaauggugaguggcagccgcucccaggggcagggugggccagcccacacucuuuggcaugggaucgcgcggaacccgggcagcccccacagcucccggauguugguauacccagggccugugauuccuggcaggggcguugcuugggcagcaccucuggcuugggguaagguuggagacaugcccugagacuuggacuggcaggaggguccccgccaugcacucaaagagcagccauaggaggcgcuuggccugcggcuagggggcgccccucuccgugccuuccugugccugugggaccccugcugccucuguggucauuaagagacagguggcugugccuguucccuguggcgggcccgccugcccugcuaacacuggccaugcccugcagaccugugacauccggggcagucugcaggaggacagccaggucacuguggccaucgugcuggagaacaggagcagcagcauccucaagggcauggagcucagcgugcuggacucacucaaugccaggauggcccggccgcagggcuccuccguccacgauggcguccccgugccuuuccagcugcccccaggugagcccugccccacucacggccucuccuggggacugugggagcgcaguggcagcuggugacugcccggauccgcugguucuuguugcuuccuccccauguccccuuuguccccaggcugcaccucaguaccuccugagugucggggucucgccacagcucucugagaagcgcaauggccucggauggaccuggcuagagucccaaggguugugcugggggcuggauucuggggccuucuuggguuccacgguuccaguggccaagucugcccucugaaacagggaugggaccaaguccaggccaaauuagggacaccaguagccucuuguuucugcuccuguccccuggugcucccuugggggcugagcucaguuuccuaaucagccacagaggacuugggacugaggacagaccuggaggccccacccaugcugagcccccgcagcgucucaggccccacucccucucgcccccgccaggcgucuccaacgaagcccaguauguguucaccauccagagcaucgucauggcgcagaagcucaaggggacccuguccuucauugccaagguaugcagggcuccacuuggcguugaagagccgacucugcaggcaggggcuccuccugccccaucgcaguggguguccaggugucccuaggggaagugggccaccugccuggggaacccugagcccugagcugggcccgacuccccucucaacugcaccaccuucacuccaccgcagaaugacgagggugcgacccacgagaagcuggacuucaggcugcacuucagcugcagcuccuacuugaucaccacucccugcuacagguggggcccaggcccacuccccuauguccccgaacccccuccgccuccccucuaccuugcagacaccugugccccggggacugaggcuucugggcaggacuuuagagacggauuuggaggcgcuggcucgugacuggugcaggucaggcugccuggugucugcgccagccggggccguguaguugaagccacaggccaggcagcgucacccauagagguccaggccccuggaaguccugaaggcuggaggggugagaccaaggagccagcagggcaggcuccuccugaagccucuccucggcacggcuuggcgugcggcacccccuccccccugaguccucacaggccguccucugcgugccugcauccuagccuauccccccagucccuuccuacaggacauccguccuugucggaggagggcccaucccauggcuucaggcaccucugugaccucuuuaaagacaagucauugucaguuucugggugugacggcuuccgcacaugaaaaugagccacaccuuccaggacccccaagaccucccggcccagacacacaggaggguguccaagcgcagcguguguggcagguuuuguuggccucugugccaggaagccugaggagcccggccccaccgcagucagccucccugucccucccacagugacgccuuugcuaaguugcuggagucuggggacuugagcaugagcucaaucaaagucgauggcauucggauguccuuccagaaucuucuggcgaagaucuguuuucaccaccauuuuuccgguaaggagagugaggggcugauggauugcacggggcuuucacgcacgcggcagcugucccuuccuauuggagccgggccuguggcccucccacccaaacucacacccuuugggaucccggguggcugguggccccgaggccugggagcuggugcgggggcugcauuccccacaccccaggccucucagggccacacccugcuccuacaggccuccugaagcuguggccaagggcagcccaagaagguggccccugcucuggggguggggcugcagccaugcaauguccgggaagccuaacacugcccgcucuguugcaguuguggagcgaguggacuccugcgccuccauguacagccgcuccauccagggccaccaugucugccuccuggugaaaaaggugagccucgggcugcugugcacacccuggcuccugccaccucuccuggggucaugcccaggccuucauccccagaggcgcgcuuugggacuuagagggcucgaggacagugauggcagcacugcugccaugagccccucaccugugccagccccacucagcagcacagacucucccucagcaagacagggcuucugccuccugcugcgcugcucaccgcaggcugacacauggcuccaggggccccacucccacugcacuccugcccaccaccccaccccugugcacaaggcagccaaggcccuggggucggacucuccaccucucacugcugcgcuucuagaaugacuccucgcucccuccgcuccgggccucccucuccugaguacugcagggugguugucuucgcagugugucgacugccaaacgcagugugugaauauuuuguugagggcuuuugugucuguauaugaggaguugggucuuuaguuuucuuuucugguggcuucuuugguuuugucauccaguggcuucaucagacgugcaguagaguguguccucucuguuuuggggcagacugugugauaaguggcauuucuuccuuagaaagaaauguguauacagaauucaccagaaaaccaucgggccuggggaguuccuuuucugcaggcuuuuagcuacauccucaguuuuuuguuuuaacaguuguaggaauccccaaguuaccguucacguugggugaguuugguaguuuuguacuuuucaaagaauuagcgcaaggaaucaucagucacugaguugacgcguggcggugcgugccguauucgcgcugcuccuugugaugauaccgggucacuuuccguucugauggucacgguuugugucucuuuuuuccugguucuccuggguagaaccauuuuauugcacuuuucuuuuuuuuuuuuuuugagacggagucucgcucugucgcccaggcuggagugcaguggugcagucucagcucacugcaagcuccgccucccugguucacgccauucuccugccucagccucccaaguagcugggacuacaagcaccugccaccacgcccggcuaauuuuuuguauuuuuaguagagacaggguuucaccguguuagccaggauggucucaaucuccugaccucaugaucugcccgccucggccucccaaagugcuaggauuacaggcuugagccaccgcgcccggccuuuauugcacuuuucaaacaaccaauuuuucuugauguccgguuugguuccagugcccucugggagcauacugaggauuuccaguuugcacguguuucuuucgcuucucugccuucuucuggcucauguucacuacucagcauuccguuccuagaggucuguugugguuuugauacccuugcuuuguuuuuuuuuuuuugagauggagucucacucugucgcccaggcuggacugcaguggcgcggucucggcucacugcaagcuccgccucccgggcucaugccauucugccucagccuccgcaguagcugggaauacaagcgcccgccaccacauccggcuaauuuuuuguauuuuuaguagagacaggguuucaccauguuagccaggauggucucaaucuucugaccucaugaucugucugccucggccucccaaagugcugggauuacaggugugagccacugcguccggccugucauugcuguucuuuucauuccuaauguucaguuuucuccugauucacugccucccaugaaacacucacuccccguugccuccccagccccuggcaccauguauucuacuuugugucuuugugaaucugauggcucuagggaccuccuaggaguggaaccacacggaauguauccuucugugucuggcugcuguuauuacaccucauguccuuaaggugcauccacaucgcagccucugucaggauucccuuccuuuucacagcagaaucauauuuuguuguacagauggaccaugcuguguguccacucauccaucgcugcucccaccuucuggcuguugugaauugugcugcuaucaacauuguuguuaaacaaauaacuguuggagucccugccuucaguacuuuuguuuuuuuuuauuuuuuuguuuuggaaacagagucuuguucuguuacccaggcuagaguacaguggagccaagggcucaccacaaccuccgccucccagguucaagcaguucuucugccucagccuccugaguagcugggauuacaggcacaugccaccucgccccacuaauuuuuguauuuuuaguagagaugggguuuugccagguuggccagacugauguggaacuccugaccccgggugaucugccugccucggccucccaaagugcugggauugcaggagugagcccauuuguucugaauauacacccgggagugugauugcuggguccugugguaaugccacguuugagguuuugaggagcugccagacugucuuccccagugcugcacuuuguuucccgccugcugccgugcaggaggcccuguuucuucaccugucgucaucgugcugacagcagccauucuuuuuuuuugagauggagucucgcucugucgcccaggcuggagugcaguggugcgaucucagcucacugcagcuccucccggguucaagcgauucuccugccucagccuccugaguaguugggauuacaggugcccacgaccacgccuggauaaucuuuuugucucuuuaguagagacgggguuuccaggguuucaccauguuggucaggcuggucucaaacuccugauccgccugccucagacucccaaagugcugguauuagaagcacgagcccccgcgcccggcugacggcagccauucugcugggccugaggcggcuggagcugaucuguugcugcuuuuugggugcugcacacuuccucccugccgagaccagcuuggucagggagacccuaacccaguggcgcuagaggaauuaaagacacucacacagaaauacagaggugugaagugggaaaucagggaucucacagucuucagagcugagagccccgaacagagauuuacccacauuuauuaacagcaagccagucauuagcauuguuucuauagauauuaaauuaacuaaaaguauccccuacgggaaacgaauggaugggccgaauuaaaggaauagguugggcuaguuaacugcagcaggaacacgcccugaagacacagcucgcucaugcuauuguuuguggcuuaagaaugccuuuaagugguuuuccacccugggccagccagguguuccuugcccucauucccaucaacccacaaccuuccagcgugggcguuagggccauuaugaacaugucacagugcugcagagauuuuguuuauggccaguuuuggggucaguuuauggccagauuuuggggggccugcucccaacaccuccccagccugggcugcugccccucacgccccagaggccguauucagauggguucauggcuguugcucucuugccaagcucaccagucugccucguccuagcuguucugccauugagcccacacagggagggucuuauuuuucaggucugaaauucccacugggcccuucuuguaucuuccaugucuuugcugaugcccuggugaucuguuggagcauuuuccuaacagcuacuuuaaagcuuaggccagcugggcaugguggugugugacuguggucccagcuacuugggaggcugaggcaggaggaucgcuugagcccuggaggucaagaucagccugggaacauggcaagaccccaggucuacaaaaaauuaaaaaaauuagccaguacuaagaaauuaguacagugagccuguagucccugcuacuugggaggcuggggugggaggaucucuugagcccaggaguuuaaggcuacggugagcccugauugugccacuguacucuagccugggcaacagagugagacuccaaaaaaaaaaaaaaaaaaaaaaacuugugucagagaguccuaguguccguccaccuugguacgcugauggccuugguguuggggucugcacguuggggucuucguguugguuucugccaauggccuuggcauuggugucuuggcguuggggucuggguguuggugucuuggcauuggggucugggcauuggugucuugguguuggggucugggcauuggugucuuggcguuggggucuggguguuggcaucuuggaguuggugccucggcauuggggucuggguguuggcgucuuggaguuggugccuuggcguuggggucuggguguuggcgucucaguguugcggucucggcauuggggucuggguguuggggucugcguguuggugucuuggcguuggggucuggguguuggcgucuuggaguuggugccucgguguuggggucuggguuucggcaucucgguguuggagucucaguguuggugucucgguguugcggucucagcguuggugucucgguguuggagucugaguguuggugucuuggcguuggggucugaguguuggcgucuuggaguuggugccucggcguuggggucuggguguuggugucuugguguuggugucugcucacggccuugguguuggggucuugagcguggggucuuggcauuggugcuucagcauuagggucuggguguuagugucuugguguuuggucugcugauggccuuggcauuggugccuugguguuggcaucugggugaugugaucuuggcauuggggucuaccgacggccuugccauuagugccuuagcacuggugucuugguguuggugccuuggcacuggggucuuggcacuggggucugccgagggccucucuguaugaguggauucuccuggucguuuuccguggagugcugugagccucugggccuuguuccauccuguggaggacguggguggucaggucccagcugcaaguccccccugccuucuggggacuguggccccaagcacaccaccaccugcccagccucuccugucagugcugccucuugucccuggccuugggacccggcagcggccucuggacucagugccuucgguugcucuuuggaacgggauccgcagcauggagugagccuagcagaucgugagcagcuucacgggguggcuuuccccgcguaccucccucucugggggcucugguuaccccacuccacuggcuucuuccacagucacuucaggggcccaguggcaggagggcggaaggacagacagugcucaacugucugcuagcucaggagcucuucggauucuggucuucauccccggcugccucuggcugccucagggcccucaggugccggcucccacuucuauguaggcuggagccccucccacgggagacccaggugccuugggccgcucccucacccgagcccuucccauuuuuuuuuuuaauaauuagcaaauucgcaaaauuaaaaggacaacacauacagcugcgaggcaauauuugcacauaguguuuuuuuguuuguuuuuuaauuuuuuugagguaggaacucacucuuaucgcccaggcuggugugcaguggugcaaacacggcucacugcaacuucacccuccugggcucaagcgacccucccgccucagccucccgcauagcugggaccacaggcaugagccauccggccuggccugcauguacuuuuauuuauuuauuuuugagauggaguuuugcucuuguugcccaggcuggagugugguggaaugaucucaacucacaugcaaccuccacccccuggguucaagagagucuccugcuucagccucccaaguagcugggauuacagguguccugccacgaugcccggcacauuuuuuauuuuuauuuuauuuauuuauuuauuuauuuauuuauuuauuuauuuauuuauuuauuuauuuuuugagacagucucgcugugucgcccaggcuggagugcaguggcgcgaucucggcucacugcaagguccaccucccggguucacgccauucuccugccucagccucccauguagcugggacuacaggcacccgccacccugccuggcuaauuuuuuauauuuuuaguagagacgggguuucacccuguuagccaggauggucucaauauccugaccuggugaucugccugccucagccuccuaaagugcugggauuacaggcgugagccaccgcacccggccauuuuuuguauuuuuaguagagacaggguuucaccguguugaccaggcugguuuugaacuccugaccucaggugauccacccaccuuggccucccaaaaugcugggaucacagacuugagccaccgugccuagccccugcacacacuuuuaaaauauccaucuuuuuuccuuacacagggugagaacucugucucagucgacgggaagugcagugacuccacgcuacugagcaacuuguuagaagagaugaaggcgacgcuggccaaguguugagagcugccugcgagccccgcaccaccccgcggagcacguacccagggaccgcagcccugacgugucucgccucuccucagucguguguacuguacccaagccugaguguuaauuuaacucuauguuguccgccguguagacauccgaggucauuuguugcguugaauuaucugaccauccuuuuuuacugugacucuucccauucucuuuggcaagaaguccccuucucgcccccaaaccagcaagggacucccccaccugggucugugcccugccccgcgcugggggccgaguccuugaauguggcuucaggggcuccuguccugggccagggccugaugggcaccacgugaggggcacuugguggacagggcggggcugacguggccuccucuggggucgccugcuuuugacccaaagguccugacgguugcguccgggggaggggaaggaagggccgcugucgccaagguuuucucucccagaacccacagugggaaagcggucuugccaggcguuguccauugucagugugcucgugggcuggugacugggucuugggaucccaggccacgcgccagccaggcugugggcagggcggggccagggacgccaaagagagguugcagucagaaccguggacgggguggguugaggccucucugccacccgucuuccuggucagcagaagugcaucucggcuuggguuuggggugguccgcauccccugcuugccacuaugcgcaccaagguuuccccacauccuucccagcacccuuaggaaggcccaggcagggccuggaagcagcggaccugggcuguucuguguugaaggagugugcccagugcccuugggcaggaccugugagagccaccucacaggcagagcccccaccaggcagggcaaggagacuccgcucacuccccacggccagcgugggcacaggacugacccuucuucagagauaaugacauuuuaucuucuccuuuugaugaaaacugucacuuuagcauguaauccauuacagaaucccaugcagugauuccaggauuugaaauuguaugauguguuacauaagaauuuauuugcuaucgacauucccguauaaagagagagacauaucacgcugcugucaugauuuugugucaagaugauccaauaaaguuguaaaacaggca

SEQ ID NO: 192169 - RNA, 11863 nt, Homo sapiens
ggaagugcuuucuuugcccgccguucgccaaacgaagucguggagguggcgaaacgaggaggagauaacgcggccuugggcucuggugaggaguagaggcgguugagggcggcggccgacgcggaccggggguucccugggggacagcggacguaggagagaggcgcuugcgacaggccgcgggccgaggguggggcggcggcgucgcuccccucccuccucccgugagcguccggccuugugcauccugaggccccgcgcugggcgggccuggagggucgggcccgccaggaacucuauuuccaaacuccuguugggaggccgcgcgcggggccucacgccuguaaucucacugcucagggaggccuuggcgggaggaucgcuugaggccaggaguucgagaccagccuggacaacacaccgagacccccaucucuacaaaaaauuuuaaaaaauuagccaggaguggugguuguaccuguaggcccagcuacucgagaggaucgcuugagcucggaaugucgaggcugcagugagccaugaucccaccacugcacuccagccugggcaacauagcgagaccccaucacugcaaaaaaaaaaaaaaaaaaaauuagccgggcgugguuggugacgcgcgccuguagucccagcuacucuggaggcugaagcgggaagaucgcuugaguccaggaggucgaggcugcagugaguugugauugugccguugcacuccagccuggacaacagagcaagacccuguuugacaaaauaaaaaagaaacaaccaagauucguuggggucgaaucgggaucgcggcugaaaugguuucggccgccuuccuuguagccgagaacgcuucuguaugcucaucuauaccuguuaguugacuggggcucugugauguaauuccugugagccucaguucccuuaaaaugggagugacggcuucaacaucaugccaaaggcgaccagaacacguuagcuggccccauuuugcaggugcaccccgcugugaccguuguucuuguguauccuuggacgacaccaaacagccaggcggagcucuggaaaauagguuguuggcuagguuaaggagagaacgguguugccacgaaaaacuaauuccuucucaauggucuagucccaggucccagaggccacuuuuccucaauucuuaagcucauuuccccuggucgucaucgguuuuuuguuuguuuugagacagggucuugcucugucacccaggcuggagugagugcaguggugcaaucacagcuuacuccagccucaaacucccaugcucaagccauccuccugccucaaccucucgaguagcugggaucacaggugcucaccaccauguccggcgaauuuuuguauuuuuuguagagacgagguuucgccauguugcccaggcuggucucgaacuccugaccaggugauccaccugccacggccucccaaagugguaggauuacaggcaugagccacugcacccggcuaauuuuuguauuuuuuguagagaugggguuuuaccagguuggccaggcuguccccugaucuuuaccuuaguaaguaacagauuucuucauggauuuaucaauuuguagacaucaucugcugauuucuugucacggcuguugagaucuucucccucccauccacccacugcaccuucaccuuccauauccugaaugaguuuaugucaugagcauaguuggucauugguuguguuuucuaaauaagaugcaaaauauuguuggcugcuaaaacaaguaauauguucagcuaggcuuuucuuguaccauucuaucuucccuuaaagcuaauuaacuuuguuuuuaccaugagccugauuuucuuuuaccugcuguuuguuuuuuccccacaaagcucccaccucucacacaccuaucaguuguauuuugcauagguuuaaauaaauugaucuccccucaccacuucccuccaagacccccuuauccuccuccuccaaaugggacugguugugcucugaccuggaaguggagcuguugucccaaaccuuccuguccuugcuccccugugcugaccucuguuuccaguguggucaucucuuucccuucaugcuguccgagcaaaacuucugggagcuuuugaagaaacagaugauuuuuuucggggggugggggaaguccuugauugucugaaaacgaguuuauuuacccucauaguuagaaguuuggugggguauaaaaaucuagauugaaaaucuguauuuguaggccgggcgugguggcucacgccuguaaucccagcacuuugggaggcugaggcgggcggaugaccugaguuugggaguuugagaccagccucgccaaccuggcgaaaucccaucuccacuaaaaauauaaaaauuugccaggcguuuuggcaugugccuguaaucucagcuacucgggaggcuaaggcaggagaauggcuugaaccugggagguggagguugcagugagccaagaucgagcuacugccugggcgacagagcgagaauccgucucaaaaaaaaaaaaaaaaaaagagagagaaaaaaaucuguauuugcucagaacugugaaagcauuguuuucagugcuguucucaaaagaucaguuccuaugcugguuucugauguuuucugcucaguugucuuucugucuaguagaagcuuaacaucuuccuuggugucguaaaauuuccugauuuccucauuuaccggggaucuuuuuauuugcugauccuggugggugcuugguaucuggacaguuugguuccuuuaguccuggguuuuguuuuuguuuuuaauuuucuugcuaauguucuuauguuauuucugugauaauauuuuuccuguuuuauuuuguuggguguuuuuucaguucucacucuggaauguccucuagguucuugcuuuuccuccuguuuuuuuaacuuuugacuuuccuuuaugaaagauuuguuuggcucagcuuccaacucugguauggaauuuuuuguuuggaucguccugucuguauuuuucaagggcuuuuuguuuuaauucagcuugucauucagcuuccuguucuggguuuguggugcaguggcuucccccgauaaugaaggagggugucagcgaucucuuacugggauacccaucagucucuuuguucucggaugcguguguuucucuuuaagaacaaagcggccggcagcucugugugagcgccacuucucauccagggaggucaacugcccaguggccuggcaaggagcgggccuuuucuuugagguguggggacccugaaugucaguauuugagaacucuuccucuggcgcuguuuccccggaaaagacuccuggccucccccgggguggggggcguccgugcugggccgccugccaccugagcugugcggaggaaccgccagacuucccgcugcccaggcggcaggucgugauucaguccccccuuuucagccugacccuggacccccuugcucugcugggccugucucucuaacucuagaggcccuuuuauaccaguucuucugggaauaaaguucugaucuccucgaggguugugggcgauccgagcgugggaccuuccccggggugccgccccauuucagcugcugaggagggacaguguggguguucgguggcugcgauggcuuggguucggaugguuucugguuuucggaucagagcuuuacuuggugagugguugaguauuggucuggguuuagguuucagugggccagacuccacaggugcucccugugacagcuggagcuuguguccugagccagccacuggccgcuggggcguucugucuggccaguuuuaagaaguaacuuggcuugcccuagauggauuugaacucuuggcuuuguuagcauuuugccaucuaaguuccuucuccaaguccucccagccaucgugucauuagaacguucuggaaaugucacuaaaaugugcccggaaauaagugcaucaagauagauugguggcucuugguguggccaucugcaccuguccuggccccagaagcugugcugccucuuccgcauggaggagcaaagcgcaggucgcuccugaggcugagcuccgcuccuccugggcccuggguccuccgcagacacgucccacccacugcucuucucucugccagaagcugccggccaugaggacgcaugggugggcgcuguggagagugcaggcuuggggguagagaccagugauggcucugcagagcuuagccucagaguaggggcgugguccaggagaggccacgacagggacaagcagggcguucgcaugcuguugaauuccuucaugacgaaaggagcaggucguccucccgggagaggggagcgcuugaugacgccccgagaucugugugugggagugccucucagcaccaggccccuccuggguucuuggagugcauccgugaaagaaggccgauucccugccuucucacacguucccccgagcgagggcuugguucggugcugagaugcguggaggacugugguuucugugauguguggagaggcaagugcggcugcggccuggugggaggcugcuugcugggcuccccacgcacguccccugaugugaguuucaugucacuugaccaggaaaugcuugaauguccuccagagaaaaaugaggcacuucaugaaccuguccgggcggcacccacacaauccugcccgccugugggccguccggagacagaaccucccaggcagcuguaagcuguuguggcagcagggacuguaggaguuggcguggccugcagcugacggcgccagcauggagagggugcaguucucccugguccugaagaauguguggccaagaagcccgaggcggggaggguuccuuggggccagaggguggcguucccagcaaaggacaguccuucuggugucacagucuccuuuuucacacuggaauguucuuuguuuugugaagggauggcgauggucacaguggugguuucucgaaguuuacgugacaacauguaaaaaugggcaucucuaggugggcuuuugugacaucugaacuucugauggggcagccgugauacugcagugagcugggagguccaccucaccaguuaccaugcuugaucauuuucauaaacuugcccagggaauaaaaacugguuggggagggcuccugggcccccauagaguaaggggugacuucaggccccaccacaagucagcaguacagcuggccugucccucagcaugccccugcacaccugcggccacuguggccugucccucagcgugccccugcacaccugccgccacuguggccugucccucagcgugccccugcacaccugcggccacugugcccugucccucagcgugccccugcacaccugcagacacugugacacaucacugcagacgcaguaguucagaugacacggcuguaucagcuucugguucuggggucagaguccaaacaguccacagggcuccauuccuucuggaggcucugggggacaacucguuuccugccuuucccaguguccagaggcaccugugugccuugccucggggccccuuccuccccauucacagccacagcgcagccucucugacucucagccucccgccuccucucaugaggucacccaggaucaccugccauuuuaagauccucaagcccaccugcacaucccuuuucugccaugaggggacauguucacaggucccagggauuaggauguggacaucuuuugggggcagugauucacucagucucaugggccccaucucucugagcucacccaagacccuuaaaccagggcccggggccaacauugagcaggcaagggaaagacuaccaggagaugagaggaggcugccuggaacucagauuugcacagagccugaaagggcgugggagaccuuggcagaggccugcaucaggaagaggauguuggggacucagcagagcccccugcgccacaagcagauguggcagaucucccagguguuacucagugaggaugcgaagaucaguguccucacugaucuccgccuaacaaauuuacaucgagcccaagagauuagguugggacaaguaagcguagccaaccagagagggaauucagaggaaggcgugaacacuaggggcuugggcaguccgggauggcuuccuggagguggugacucguuugugagaucuuggucuugucuucccuuuaugccuucucugggcucccuauuacaauuucaggucuccaggccuuggcacccugggcuggagcggcuuccucuccaucccucaugccuggucacuuggagacaggcuccagcuuccuugugucugugccuguccacagugggccucagccuccuggaagagacugggugcgcuaugggguggcccccucagggcugguuagacccuggcgcugggagugcagggugaggggcagucucgagggcuccagcccagcccgcccagggaggucccagcagcagccccgaguucugagccaucuuccucacucuccucuuggccuccacaggugucucccagucugcuaaagcccuaaggccaucaccauggacuuccagcaucgccccgggggcaagaccgggagcgggggcguggccuccuccuccgagagcaaccgugaccgcagggagcgccuccggcagcuggcccuggagaccaucgacaucaacaaggugggccagccaccgugcagcugccuguggugggugcugggcuuuccagggcagcccuggagagggugccagaggcucuucuugggccuccgcccaggcugggcgaugcagccccguguccagacgcuccccuguugcccccgagcagccacagcucccaucuguccaccccagagagcagacccucuguggcucugagucccauguggacauguuuuguucuguccacagccuucuguuuugcauuauuuaauuuucugggaguggggagagcugaugucaguccagccagauguggugaagggcagccuuugauuuuagcuugugcagaggcaggggugagccgaguccccucagcaccguggacaucggggcuggagcacucuuuguguacccugacaugccccacgggccuggccuauggcaagggcucuguuaccguccccgucuuccagaugaggucauggguagagggggugccacagccgcagaugguggaguuagacuuugaacuccagcgucugagacgagaugugugcgcccggcugccccagcuuagggccugcagaugggcgggucuuugggucuucaguguagcccauuugcuuuucuugugccugugucugccuugugccuacugcuggcgugguggcgugggcaguggacggcucccugccucgggagugaccggcggugcuguccuggcugugccucccucugacucagaaccaccaggaagguggugucgggggcucccugggaacccccacugcucgaagccuggcccacagccccagguggugacacccgugcucacgaaggccucccgcuggaucccccguuuucagaaaugcuugaccacugucagcgguagccaugccucuacagaagggggguucugccuccaugccucuacagaaaggggaucccgccucugagggccuugacggcagcaggccgcgaucuucugucuaacgggccccuguucuuccccuccaggacccguacuucaugaagaaccaccugggcuccuaugaaugcaaacucugccugacacuucacaacaaugaggugcggccucugccuggcuccgggcggcucgcggcgggcugaguggcugacgucagggggaccugccugugucuguccgcccggccucgagucaugcguguuuccuuuccacuccaggggagcuaccuggcacauacgcaggggaagaagcaccagaccaaccugugaguaccucaugucccuuugaugccuggugcuccagcagccguuggcucaagucucugugagccucgcgggccacugcuccacagccggggagccagccuggccugagccucccugggcgcuugaguacgguuccuggggagcauuagagaacagaggcauggauggcugaggcgggcagaucacuugaggucaggaguucgagaccagccuggccaacauugugaaacuccaucucuacuaaaaauacaaaaauuaggccaggcaugguggcacacgucuguaaucacagcuacuauggaggcugaggcaggagaaucuugaaucugggaggcagagauugcagugaaccaaggugcugccacuguacuccauccugggcgacagagugagacucuugucuuauuaaaaaaaaaaaaaaagagcagaggcauggaguuguuggaagggccccagccagggacagugaggagcaugacaggaagagaacaugccuguccuaucccuguccucagccaaaccccagggccccucccaggccccuggcccuccucaucucucagcuuguagugagcuccaaggucagggggcuccuggcaccugggcccauggcuuuggugccuguguguggaggggucccagcagcaccuccauccuguccgcagggcccggcgagcagccaaggaggccaaggaggccccugcccagcccgcgccugagaaggucaagguggaggugaagaaguuugugaagaucggccgcccgggcuacaaaggugagucugcccgcagcggggccggccacagccgcugccgugacauaaguguguucuuuagucuccagugcgggaggugcagcccugauagccuccucccugagccacuguuuuccggccuugguggccgucccucacccaccugcagccucuggcguugugucugggagcugucaggcugggcccgauaagcacccaucucacccagcagcccauuucccagcugagccacagucugugcccuccuguccgggucuuguggaagcuucugggaauucuugccaagcaaaagaguggaaguggagguguggugagcccuggcacaucccuccgguuaaccuugaagccuuugaaggaggacagggagaagcggcuguuagaggcagcuccucccggacccucagcagugggaauggcuagaggugaccccgguucagaaagcuggggaagugaccaggguggaagauagagacuuguguccauaggguucaggaaggcgggcacgcuacccagcaaguguucuuuacagaaggcggggacagccugugugccuggccuccagacagaagccugcagggcagaggucccggggcaggugcaccgggugggcgaggguggcuagagcggcaggcuccugguggggaggcccugacagguccugggcuugggcucaggacggugaggcggcagagggcuugugagugugcgugucugaggccgcauggagaguggccgggcggcaggcagcccagcagccauucucgggguccaggcugcugagcucuggcgggaagggcauccucucucgcucaccguauacauggugucagcccuguucaggcggccccgcucgaaucccagagccagggugccgagggccccucccuacccaguggccccaacuccugcugggugguaucccagcaccccuggugaagggcucuggggauugggacaaaggagcaccauccucggucccugccugagugacuccgcagguagcucagcucuggcgcaccugugccuucaccuauaccagaaucccagagccugggcggagauugucuaaugguugccagagcugcagggccucccccggggucccgcucucguucaguggguggcauuagccugccccagguuccucagcuucggagaggacaagcagccgggaccugagagcuuucuguguugcagugaccaagcagagagacucggagaugggccagcagagccuccucuuccaggugagaucagggacuugggcguggggggcggccaaaggcacccaagaggcggcucugccacccggccgugucccugcagauugacuacccugagaucgccgagggcaucaugccacgucaccgcuucaugucugcguacgagcagaggaucgagccuccggaccggcgcuggcaguaccugcucauggccgccgagcccuacgagaccauugccuucaagguagcguggcugcgggguucccugggcccccuugagaugugcaagccagaaggaucugcauaggcugggcaggaugccccucccaucgggcuugggguccccugggccccccccaagucggagccagaagggucugcacaggccgggcagggcaccucucccauugggcucugcaggagggccugcuugggcuccacugggccaaugagaagggaggccggcagggcugagcgccaggccugugaggccuuugccaagugaccucacuuccugggccaggcugcuggagggcuuccuacagccuguccccaugccuggacagggcggccaucaggaaacaaauaauacaaacggugacugcccagggagggggccaacagcgugcuagcauugaggccaggucuguuucacuccagaacugaacccugugccccacgaaagucuuaccagccuucuccugggcucccaggguagaguccgggcuggggaggcuagugccucgggcucccugccugauggucgcccugaggucacagggaccaggagcccucucugucccccgcccucccaggugccgagcagagagaucgacaaggcggagggcaaguucuggacacacuggaaccgggagaccaagcaggugaguggcucgccccgagccuggcuccuucccacccagcccuggcggcccuagcccugcccuagccccacccgugccugcugaaccuuucuccgucucucuaguucuuccuccaguuccacuuuaagauggagaagcccccggcuccacccagccucccugcuggccccccuggggugaagcggccuccacccccgcugaugaacggucugcccccucggccaccgcugccugagucuuugccaccgcccccgccaggaggccugccucugccacccaugccccccacagggccugcgcccucagggcccccgggaccaccccagcuacccccgccagcuccagggguccaccccccggccccaguggugcaucccccugcaucugggguccaucccccagcuccuggcguccaccccccagcuccuggcguccaucccccagccccugggguccacccaccaaccucugggguccaccccccagcuccuggaguccacccuccagcccccgggguucacccaccagcccccggaguccacccaccagccccugggguucacccaccagccccagggguccauccucccccaucagcggggguucacccccaggccccgggggugcacccagcagcccccgccguucacccucaggccccaggggugcacccaccagccccagggaugcacccucaggccccggggguccacccccaaccucccgggguccauccgucggcuccugggguccacccucagccuccgggaguucaccccucaaauccuggggugcaccccccaacucccaugcccccaaugcugaggcccccacuucccuccgaaggcccagggaacauaccucccccucccccaaccaacugagaagcugcucccucccccagcaagcccagcgccaggugcucuugccuuuucccacugagagaaggcugcucuuuuguacugccccccgcucauuaaacagccucccccagcccugagugcacugauguccgca

SEQ ID NO: 192170 - RNA, 28795 nt, Homo sapiens
uaaaaucaaaauguuuauuggaguguuguacaaaaaaguuuccagucauaaaauguauauuacaaaucauuggaaaaaaaaaagaacacauuaggcaugcaucuucuuaaaaaccgaaucucugaaaugaaaguccaugccagccccagcugcagcccagcuccguuuuugcagguugugcugugacgcucgcuggacgcagggcuuggaagaggcugcaggcggcgacgccccaggacugaggagucccucagaucuuuaacaaagaacugccgcgugcaggcuucagaccaaccccagccaaagccgcuggcaugaggacaggugcaugaucggauucugggucagcccgcaggccucccggcuccugggcucagcggggcaggcuucagcguuaaccuggcgcugugcaccccagaacccgcguugguccagcaggcgugggccuccccccagggcuggguggcgucugaugcuucgcagggagggcgcuaggcuucgagucacacggcacgggcuuacacagagggaugguuucgcaucguucuaagcggcacacagcuaagcguauuuggggacaaaugcaaauuguuucccaggccauaaauaacuuuuaaaaauuugauuuucuuaguguuuccaaagacucaauucucaaugaaccuccaauuacccacaggcugcccaguccacgcuucuccccacccccuucagcuaagggcacccgcaguccuaggaccacccccagcuccacccaaggcaaauguagggugggggguucugugggccuggggcgugcuguuuucaggacaggacugggcagcgucuggacaugaggaccugcggguuuugggggggacuuugucccugagcccagccugcaaggcugucggcaaaucacagaccaacuccaggauacagcuuugcuccuccagagccaaaauacauaggauguggcugagaccacugcagacuccccauaggacaagaucaccaagacccacccccagaacccucgcuagcacgaagcccagccagucggguccgggugauuccugcuaugaaggugggaaagaggacacagucugucgccagcauucccacuuccagcggcuggcagaggguauccccggggcaggcaaagcucccuaccagccgccugacugggagcacagcggcguagccuccaggaggaaaugcuuugguaagaugcgccccccucuaucuacaugggaccgggacuucugagagcaaggacagcgagcaggggcuacguggagcagcggguguuucugcuuugucggccgcuggcuccuucccggccuggggcuggggccccccauuccuuccugccacaggcagguccccagggaggcgggaugcagucacaggggagcggugccgcccccgcccugcagugaacgccauggcccggagacggcgcgugcccauggcucaguuuuggugucuuuaagacuugagcugcacuuucugaaggaggcucugccgucggagggugccccagccccacgccaccccggggaggagggucagccuguccucaaggcccuggcgugagcuccugaccuguguacugaccaauguaaaaaaauaaauauccauuaaaaaaauaacuucuguguaucuaugagggaggguguaaacggugagcuauugccgaaggggggugccaggcauugggaagcuggacugaggggcuugggugcgucgugauaggagucagguggccuuggccugucugagaaacaugguuucagcgagaaaaucacagauaaaagcacaguauggauagacgcauguguauauauaggcacagggcagacggagcuggaacacgggaggggcuccacagcgcucuccuccagagggucaacaugguggcguucccugcagacagcuguucugaaacucacagcuucugccuccaaggcaaccagauguguccccuccacaucuccccucccugcuuauuguugugacaggucuuacgacgggacuguccucauucuuccuuccccaggucuuccccuccccugcccuguuggccuugcacagucaggaacugaacugcgggaaaacucccccaaauaaagucaacgguccgagaaacccggccggugcgcugccagaacgggaaucuggaagcccaggcagcggagugaaaacccgcccugggggccacgccauccccaugcuggcccacacccgcugcguggcugccugaggaguucccgcuguccgaagcugggcagccagaaugcaggcuuggccccgggccccaccaggucgacgccuggauucugaauuugguuuuguagaaagccuuaaaaaaacccaccaccacugaauuccuacgcaguuuccgcgcuccguccgcagcagggccgucuccuguccccucgcuagccucgccggcccuccucccuccaagcccaagcaucuucuaaaccuccggguccuggcccugggcuuccaauuugaccaaauggugagaugaggaguggggugggauugaaaagucuccggggcagcggcgaaguggcagcgaagugaggcuggaggagacccgccaggagggagggcugggggagacccacccacacguucuggcaguucgcuuagaaauucucuagaaauguaucaagaacuaaagaaagccaaugauauaaaaauaguuuucaguggcucuggguaaagaaagguguguggaugaggaguguggguucacaucacguagcagccucuugaggugguccucgggucccccugcaggaaggaaggaaggaaggucggccaugaucagggccagccuggaggcagccggcagguagauggcugcccccaccuccccaccagggaggggcugagcaacaacagugucuauuucuagagccuuccauuccacuuccauguccccaugagcccgccugugagcuacacauucuguucuggguuccaaaacagucacaggaacuugcgacgcacgcguuuaaugcagcugugguuucugcacucaucuucuccccagaagccaguauugaagggaccugugucuucgacugaggaagccgguugaccagagagcauuuggggagcuguucaacacccaccucucaggggacccccuggccagcuacccugaggucugugaugucgcaaauucacacgaugggcacgacccaggaggcaagaacaggucucugccgugcugguaacagccaaggcuggcuucacccugagccacggcagccagauggagcucccgucggggaugcggccagcacgcauguguaugugugugcacgagcucacucugccccagaggcugccccccagccgcaagugggcacagggguccuaccuguugguggaaaagauccuccucgccaaacucggcuuccuccuccucuuccuccccauucucauucucacgcaucaccgaggacuucuucacaguccucauggccacuuccugugcgggacaggacacggcggcaugucccgggaucgggcccagagcugcuguggcggccccgagggugcccagacccugcccaggacuccagccgagcaccccccaagccacacacacccaccucgccauccgcguuaaccaggacggugcggaagcucucgcccgugccccagcugcucuggcccuuccacaccagcgucgagggggggcugugggccacccccgcaccagcugcccacaccugaggacccaauaacaauggccccaucagggucaccucugguuccagggacgugggccagccaguggccccuaccacaaagcccccuucaaugcccugggcguucaguccuuccagcccgacgcaggcuuauccagggugaugguccccaggauacacaagaagagaccaggguucacagaggccaagggcucuuggcaagcaggggcugaacugggaucugacacccaccaggcuccauggcccaugcgccugacuguuaacacuucacggggacgccugccagccccagcagccuggacucagacccagggcacaccacucaggcuccagggaggcccaguggggugacaccagcacauggagguucuaugacugcggcagccgcucugagacggugccuggugccaccaucauccccacccacccccgccaaguccugugccuccaguccccugaccccaccucacaccccauccguggccacccucgcccuccugccccaccaccuaccgugaccaucuggccggcgcgcaggauguacuugggcgugaacuuguaggcgaucuccucccccuccaagaccugccucuugauucuccaguuccccagagacugauccuggaagacacggcacacaccugacccucagccaccaggacugugacaccgcccccaucgcccuggcugguggccccaucacccugacccuggucacccccaccagcuaggucaccccauuacccccaugcccuggucauuccagucaccuuguccccugccucguccugaccggcggcccugucacccugacccuggucacccccaucagcuaggucacuccauuaccccugugccccggucuuuccagucaucuuguccccugccucgcauuggccggcagccccgucacccugacccuggucaccccaucagcugggucaccccguuacccccaugccccggucuuuccggucaccuuguccccugccucgcauuggccggcggccccgucacccugacccuggucaccccaucagcugggucaccccguuacccccaugccccggucuuuccggucaccuuguccccugccucgcauuggccggcggccccgucacccugacccugaucacccccaucagcugggucaccccguuacccccaugccccggucauuccagucaccuuguccccugccucgcauuggccggcggccccgucacccugauccuggucacccccaucagcugggucaccccguuacccccaugccccggucuuuccggucaccuuguccccugccucguauuggccggcggccccgucacccugacccugaucacccccaucagcugggucaccccguuacccccaugccccggucauuccggucaccuuguccccugccucguauuggccggcggccccgucacccugacccugaucacccccaucagcugggucaccccguuacccccaugccccagucauuccggucaccuuguccccugccucgcauuggccgacagccccgucacccugacccuggucacccccaucagcugggucaccccguuacccccaugccccggucauuccggucaccuuguccccugccucgcauuggccgacggccccgucacccugacccuggucacccccaucagcugggucaccccguuacccccaugccccggucauuccggucaccuuguccccugccucguauuggccggcggccccgucacccugacccugaucacccccaucagcugggucaccccguuacccccaugccccggucauuccggucaccuuguccccugccucgcauuggccggcagccccgucacccugacccuggucacccccaucagcugggucaccccguuacccccaugccccggucuuuccggucaccuuguccgaguuguucuugagcugcacaaacuugcccuccaggucgaucuccucgaugcugacgcuacccgaggccgaggccugcugggccagguggaagccaccgcugccacccgugcccgugcccaggacgcuugggccgcugcccaagggcuccuccaccuccagccgcuuccgcuuacugcggcccaggcgcccgguggcggacaagcugccgcugcugcucgagguggcucgugagacggugacgcgcgaggaugggcugggggacagcuucagccuguggggaaggcaaggaaggugggacugguagugggagccccagacagcccagggcacgcagaguggcggccacggcccggccccaccuccaccccugcccagcacuccccgcagccccgucccgccucuccuccugcccugccccuccuccucacucugugcucccaagccuccuggccugccgcaccucuccuccucgcccuccaggagcuuccgguaggcguugaucuccauguccagggccagcuucacguccagcagcuccugguacucggccagcugcugcugcaucacgucccgcaucuccgucaucuccugcuccuuggcguccagcaucuuccggaacuugucccgcuccccggccauggccuccuccagcucccgaaugcgaucuucagcggcacuggccugcggagggggcggguggcgaaggucagggcagcccaugggucacaaggcccaggugauccugggacugcgggagaugggcccucaccacagacuggggcagagaccaggccugggcauggggcgcacgggaggggagggaaggggcaucgcugggcgccccgagggcugcauccgaugccaagaggccagagccccacgccccgcacauccagggcagggcccagaaguugggccagggggacggcagacgguggcgcugugcucaucaccugcuucuggaggccggagagcugguagcugagggacuccaggcgcaugcgggccuccuucagcuccucgcgagccgcacuggccgccuugucguucuggucagagcucagcuuggcgcuguccagcuguggggagacgggcgggugagugcgggcgcggggcggggcgggguucccaccggccgcccccgcccacccgccugccggccacaccuuggccugguaggucugcuccagcuccagcuuguagagccgcacuugcucgucgugcuggcuccgcagcuccuccagcgccugugccaucuugaagucguacuccugcugccggcugcuguccaccuccaccaggcgccgcucgugccgccgccgcgucucccgcaccuccugcggaccaaggcuucgugacccucuggucccgccugggccccaagcaccaggcccaagggagggcucaaaaaugugccaagaggaaccuccaggcaauuccugguuccuugugcacaaguuacaaaccgauacacgugcaggugagaggcgacccaggggccguccacgcgcuagaacgugacucagccacgaaaaggagcgaggcucugacaccgccacagcauggaugcaccuugaggacgucacacucaaugagagacgccagacacaaaaggccacacggugcgugaucccauuuccaugaaauguccugaaauguccaggacaggcccauccacagagacagggaggggaugcgugggggccagggcuggggacugcugauggggaggggguucuuuuugggugauggaauguucuagaauuagagguggugguugcacaacccuguggagauccugccaaugcugaacuguacacuuuaaaaagguggacuuaaaauagccaggugugguggcgggcaccuguggucccagcuacucaggaggcugagacaagagaaucgcuugaccuugggagguugcagugagccaggaucgcaccauugcacuccaaccuggguaacaaagugagacugcgucucaaaaaaaaaaaaagugacucucucuuauaaaagccauuauugaagaaagcgggccaggcgugguggcucaugccuguaaucccagcacuuugggaggcugaggcaggcagaucacgaggucaggaguucgagaccagccuagccaacauggugaaaccccaucucuauuaaaaauacaaaaauuaggccgggcacaguggcucaagccuguaaucccagcacuuugggaggcuaagacagguggaucaugaggucagaaguucaagaccagccugacaaacauggugaaaaccccgucuguacuaaaaauacaaaaauuagucggguugguggcacccgccuauaaucccagcuacucaggaggcugaggcaggagaaucgcuugaacccaggaggcggagguugcagugagcugagaucaugccaccguacuccagccugggugacagagcaagacuccgucucaaaagaaaaaaauuagcuggguguggugcugugcaccuauaaucccagcuacucgggaggcugggcccagugugggcaacagagcaagacuccaucucaaaaacaaaacaaaacaaaacaaaacaaaacaaaaacaguagaaacgcuucugaaggaagcuggccaccuuugcagucagcaaggcggguagcccaggcaagcagagcccugcgggccgcgcacccaccuccacggccgcccucccgccuccacggccgcgcacccgccugcacagccgcccucccgccuucacggcugcgcacccaccuccacggccgcucacccaccugcacugccgcccucccacccccacagccgcgcacccaccuccacggccgcccucucgccuccacggccacccucccgccaccacggccgcgcacccaccuccacggccgcccucccgccaccacagccgcgcacccaccuccacggccgcccuuccgcccccacggccgcccucuccaggacuccgcacccugugggcugcacaggccugcaucaucaagcucccuaccgcagcucccugugagggccccuccagggccucuucccggccccugcaccgccuucgugggucuuuucccaggugcccuguggguuccaccuggggcacguuccugggcccccgcacagaagcucucgugagucucuucacgggcugucucacagguuuccccacaggccccuucacaacugcccuggcggccuccccucuggcuccuguggggccccccccacucccugggccuggccagagcggggcgcagcuccugagcggccuggacaucccuccaccagcagccagcagcucucccugggcagggagugugggcccggccggccccggcauuccacccugcacugugacagcacaauugguucuaaaggacacaggcugacgccuuuccuccccacuccccucuccgagcccccggaggcagaggccccaggugaggggcugcaggucagggaaggaggcuggguggggagagcgggccucacccucgcuuuggacaaggaggcccugugggaggcuggacgguggcacccagaagaugcaccugacgccugccucauggucuagcaguuaggaucccaggcggccaggguucagcucucagggugggaacaccaagcuuuuagaaaggcaagaaaucaaaauagaccuuccuugacacugaagagauauguuuuggcugggcauggugacucacgccuggaaucccagcaguuugggaggccgaggcggaugaagcaccugaggucaggaguucgagaccagccuggccaacguggugaaaccucgucucuacuaaaaauacauaaauuaccugggcaugguggugcacgccuauaauccagcuacucgggaggcugaggcaggagaauugcuugaaccugggaggcggagguugcagugagccaagaucgugccaccgcacuccagcaugggugacagagugaaacuccaucucaaaaaaagacgugcccacaucccgauccccagcagcugugaauggaccuuauuuggaaauggggucucugcagaugccauuaggucacucuggaugauccaggcaggccccaaauccaaugacaaguguccuuguaggauacacagaguauggacacaggggaggcagccgcgggaagacagaggcagacacuggggagacgcagccgaagccaagggcacccuaagaggcaggaaggagccucccuagagccgugggagggaccccggccacacggugcccucaggcuuccgcccuccacagccaugaggguggacuuugcguuuccgcugugccaggcuggaggccaggccacucacucaccuccucgaacacacucuuccggaaguccagcuccuccugcaggcucuggcagcgguucuccagguccacacgcaucagcgucuccuucuccagcugcuuuuuggccacugcaugaccguccucggccugggagacacaggacagcgagcuggugugacaaucugucuguugcauauacccugcuggggcgucccguggcuccuggcaccuaccuuggccagcugggcccgcagcucagccacgucacucuccaggccgcgcuugucgcugagggcagcugccagcuccaccucgcuccgguggaacagggacuccagguccuucacacggcccugggccaccguaagcucgcccucccucuucuuggcgcugaaagucaagagggcaagugaguggggaggggcaagguccauggggccacagggagcaccucagggggcgucaggcaagcccaaagacaaggucaccgaggccuccgagccccagaccuucccguccugcagacgacgcggccccacgcgcccaggcaaaggcacacgugcccucaucaucugcccugcacugucaggaguccagcaagugacaggcaccagcgcuugggaccacccuggaggcaugggcuuucccagccucuccugccuguucuggacccaggacgaccauuuggggagaaauuaaugcauccucuguaaauguuacaaagacccuggccuuugaagggucagccuuguuuguaaacuuaagcugucugaagcaggcucaccugguuuuccacuaaaccaaauuagcuccaacauuagauauuuaagauagcaaauacucaggcuuuuuaaacacacaaauacuaccaguguggauuguaggcacuuaagcuuuuuuuuuuuuuuuuuuuuuuuuuuuuuuaagagacagggguucacuuguuugcacaggcuggucucgaacuccugggcucaaggaauccuccugucucagccucccaaagugcugggauuacaggugcgagccaccgcguacggcugacucuuaaauguuuuuaagcauaauuauaagucuuggagcugaauuuuacccccucccgacagggaacuaacuauauccucccaagaaacagugaggacacccaggguuccgcagcgucacaacugcugacaucugggguggucuugagugagggcacccaggguucugcagcgucacaacugcugacauuugggguggucgagugaggacauccaggguuccgcagcgucacaacugcugacauuuggggugguccuaggcacugcagggugcugagcacugucccuggccuccacccacuucagaccaggagcuucuugcugcccaguuuugacaaccacaaguguccccaggaaucacccaguguccccuggggacagaaucaccccaggauggggacaacuggguguaucuggaauaacacagccaaggcugcuggcuggacauucaaagaacauccacauccaggcggcucgagcccguggccagaggucagaagugacagggaccucuccugcccagcagaaugcacucccgacucucccuagagccuuuuuuuuuuuuugaguuggaguuucgcucuuguugcccaggcuggauugcaauggcgugaucucggcucacugcaaccuccgccucccggguucaaacaauucuccugccucagccuccuguguagcugggauuacaggcaugcgccaccagcguccgcuaauuuuuuauuuuuaguagagaugggguuucuccauguuggccaggcuggucucgaacucccaaccucaggugaucugcccgccucggccuccaaagugcugggauuacaggcgugaaccacugcgccuggucccccagggccuuucaaaagaccaccuaggcauuugcccaagaaaugaaagugacccauagcugaaagugaccguaugucugucuaaguauaucuccaucaauaacuguauuuaucuauauaaucuauguccguauauaucaauucuacagauggcuguaucuuuuuuuuuuuuuuugagauggaguuucgcucuuguugcccaggcuggagugcaauggugcgaucucgguucacugcaaccuccaccucccggguucaagcgauucuccucccucagccucccaaguagcugagauuacaggcaagugccagcacgcccagauaauuuuguauuuuuaguagagacgggguuucuccauguugguuagccuggucuugaacucccauccucaagugaucuguccgccuuggccucccaaagugcugggauuacaggcaugagccaccgcacccagccuuacagauagcuauaucuaucuauugcucuaucuauuacugucuauccaucuacccaucauccauccauccauccacccaucauccauccauccauccacucaucuguccaucuauccauccacccaucauccauccauccaucuacucauccauccaucaucuauccaucaucuccauccauccauccuuccauccaucccucaaucaucuauccauucauccaucuacucauccauccauccauccaucuauccacucauccauccaucaucuaucuauccauuaucuauccaucauccauccaucuacucauccauccaucauccguccacccauccagccauccauccaucauccacccaucucccucucucucucacuagcugccaagcucucacucucugugggacucuuccuuccuuccuugugugacccggggagggagggcugccuucccagcucacagugcccucccugccuaggauccguaauaaaucuucaaacuuguuuccuaucgcugugcugaauuugcgccuucugucagaagaaccaggagcugccccaggcugggaucccagugccagagcgauggucggacaggcauacccuggacacaggucagacacgagcuacggggcagccacuguguaaacaggucucucgugugaggggucccuggucgggggucagacaaccaggucuaaggccaccugccagguaaaagcauccgugccggguacccugaaucccgggucuggcuccgguugugucccgccagggcagggcggccagccgcucuggcgcuggaccugguguagccagggcucuccacacacuagagguguggcaucugcuugcuuuugagaggcgugaaggccagagacuucggccacaaggcugaugcaccccuguccgcagcccucagggacacuaagcucuacuuccccacauggagcagaucuccagcagggucuggggugcagaucccgcaucucugagcacaugccacacaggccaggcccuuucgcucagagggcugcgagcccugcggcccugcuggggauuuuugcagggguuugggggaagguggaaucuguugggcaaaucccgagugcccgcuguguggaaggcaccgcucucacaccagaggugcaucuagaacccuugccuuacacugcgggacguccuugcggagggaggcaucagcgacacaggcugccuaccagacaggagguugccugggggcagggcuggaguggggcugggagacaacccugggggcagagaccugaaggagcagugcuggaggagccagggccaccgcugcugaaagagccuuccaggcaggcgagcagcagugcaaaggcccaggggugagguggaagaggcaggcugcagaccagcucagaggacuggagcggagaucggggaauccgggaagcuccucagcaacucggucuaaaccacaggguuccgcaggacugcagggcacacccagaaggcagggugcgggcucccagggcucagacccguuuccuaagcgccaggugcugaguuagaaucuucagcugggugcccgggguuuuguggcaggcucuggcuuguuagguccugcacgcugcucccaguguuucucucauugugggguuuuggagauaaauuuguuaggauaagaaaaacauuaggcuuggcccaguggcucauaccuauacccagugcuuugggaggcugaggugggaggaucacuuuagccugggaguugaagaccagcuugagcaacauagcgagaccucaucucuacaaauaauaaaaaaauuaggccaggcauggugguuuacaucuguaaucccagcacucugggaggccaaggcggguggaucgcuuaaguccaggaguuugagaccagccuggccaacuugguaaaaaaauuagcugggcaagguggugugagccucuaaucccaacuauucaggaggcugaggcaggagaaucguuugaauuugggagguggauguugcagugagccgagauugcaccacugcacuccagccugggugacagagcaagacuaugucucaaaaggaaauaaauaaaaaauaaaaaaaauuaguuggguguaguggugcaugccuggggucccagcuacucgggguggggcugaggcaggaucaccugagccugggaguucgaggcugcagcgagcuaugauugugccacugagcuccagccuaggcaacagagacccugucuuaaugaaaaggaaaagacgggccucucuguagaugccacgcacugcucaggagauugugaacugggaauuccucaacaccuagggcgggcacuguguaccauuuucuuuuuuuaauguuuuaauuugaggugaaauucacauccuguacauuucaacaucuuaaagugaacaguugagaggcgccuggugcggggccagcagcagcucugucccaucugcacgguguaguucugacauuucagagcuccgugcaccccugaccaagcucuagucaucccacagccugcauggcuccacugaugaaccugcuuauuaaacacggugggugcuggagguagacagcacagagcugcugccugagcaggucccggggugcaccugugcugugugggaugugcugagagugggcagccuguccuggcuggugccuggccccaggguccccggcucauggccaccaucagggcacaaauggucccuccuggagccccaggccccgggcaggcgggcgguggucccugggcugaccuggagggucuccuguuggggaagggaagucagcucuccacgggagcagcgccagcccaggaaggaggagggcgucggauggagaggucaccugcaaccacgcaugggggccccggcacuguuggacacaggguccccggucauuccucuggccacacuccaacucagggacaacguggauucucaagccacuggcugcugucacccccguaccagguggccgaggugccaccccuccugccagcagaucccuccaugcugagccaggccugcguggcucugggagaaugagcagugugggaagacccugacccaccccagccugaggaaauccgaggcaccugcaggugccugaaugccgguggccggagaccacggaagacaguguccacacgcagggcaccagagaccucgcucuagcuggagccucacaucaagaaaagccuugagcucaguguuucauuggccuccuggcuccucugaauaaauauuccuuuugucaucaucguucuguuuaaauugccgcccaaccacaucccacgcccagaaucaggcaagacucacugccaggcugagaggggagaucguuucugccgauggacacaguugucacccagaaggacuuugcagccaacccuggggcagcccaacaacccaugagcacccuggucacacaccacacacccgagcgucccaacagcugggacaaaaccccggcaccaagaacauccaaccacagggaaaugccuacgauggggccugaggucaaacgcgucucacgguguccacugggugccgcccggggucuagguaagcaugugcaagcgcgugugcacacuaaggagacaggccaggcugaccaggaagcccucucuggggaggcucgcgggagauuuuacuugugagcuuaagcugcccugcgcuuccugcuguccgaugugagcaucuaucacuuuccucagaacagaaaaagugacguggcagccacuggugggggagagaggaugggagcugugagcuccaggcugugcccguaucagagcaugccccgcacgagcccagcgcccaccugcccccguccaccccguggugccaggaucagggugacgucgugcccagccgugaccacucaccucuuguugaccucguccaacucugcccucagcuucccaaucucuaucugcagccgggcacgcucucgagccgucucauccaggacucuccgggcaucggccagcuccgacucguacagcgccuugaugccacucaccuggggagacccaggacagggugaagcgagagggacccuuccccuuggacuacagcagucagggggcccggccacuggcccugcucagauucccagggacuggcacgcagagagagaggauggcagccuggggacacugggacacccuguguugcccaucucacagacacagcaaagggagcccccugucggggaggguccgguaaccaggaggaagccaggcgacccugggucccagccaucccaggagccuccuccucugcugcggcccccucuggaaugaucgucucuccacgagcuccagcucccagaacagcggcgcccagugcuggagaccaaaggcccugggccuggaccagcacagcagcuggauggagccuguccccuuccccggaggaccagccacaccuggacaugcagccccuuggccgcugucauagcgacacgaugccuggccauuagaugcauuuuucacacucucgguuucagaaccagaaaacuggugggauguuuaaucaaggaucucucccgcugggcaccauggacacugggcugaucacucucggacaacuggugaugacagcaacccggggcccucccagaccccacugggccugagagcccccugcccccaccagccuuugcaaccuggaguccccucccagaccccucugggccccugagacuccccccaggccucugcaaccuggagcccccgcucccccagaccccgcugagcccaagaucccccacuucugccaaccgggggccagcccgugccccucugugccccuaccucacacgcaggcacauggcccaggcucaggcugggcuguucccugggauggagggaggagcaucuggccuucccaugcuguguccccccgacaggccagcugccaaugugguggcucggaggcuccaggacagaagcucccaccccucaaucacagagaucugcagucagaguccccagcuccccaccccaccagcggcccccaccuuucaccccucgaucacagggaucuguagucagaguccccaacuccccaccccaccagcggcccccaccuuucaccccucgaucacagggaucugcagucagaguccccagcucccuaccccaccagcggcccccaccuuucaccccucgaucacagggaucugcagucagaguccccagcuccccaccccaccagcggcccccacguuucaccccucgaucacagggaucugcagucagaguccccagcuccccaccccaccagcggcccccaccuuucaccccucgaucacagcgaucuguagucagaguccccaacuccccaccccaccagccgcccccaccuuucaccccucgaucacagggaucuguagucaguccccagcugccccccccaaccagccgcccccaccuuucacccgucgaucacagggaucuguagucagaguccccaacuccccaccccaccagcugcccccaccuuucaccccucaaucacagggaucuguagucagaguccccaacuccccaccccaccagccgcccccaccuuucaccccucgaucacagggaucuguagucaguccccagcugccccccccaccagucacccccaccuuucaccccucgaucacagggaucuguagucagagucuccagcuccccaccccaccagcggcccccaccuuucccgacggagacccagcccagccagcaaggacauggggaggggcuggagagccaggggucaccagggcaggcagaagcgacuggaacacccucugggccgcccagcuaaagaaagccccucccuaagccccgcgcaaagcccccaaacccgccccucucgagggccuccaggugaacucgaggcacaugcggugccagggaaggcgaccucuucacuuccuacuaauccugcugcaaccacagccgccaccugcccggccucugcacgcgccagcugggggcacagcucaggcuucuaguggccuuccugccuccccuccucccacagggccaugcacucagugaguuuaaaaauauguggaagcaaaccgcagugagaugccacuucgcaccagccagggcguccgucaagaagacagacagucgcaggugcgggcgaguacgcagagaaaucggaaccucacaggcagcggcaggaaccugagcugagacagcucuacagaaaacaguccaggggcucccccaagagucacagagccacccugugacccgguaacuccacuccuggguguggacccagaagacaugaaauucacauccaugcauguuugaaaacuacacauggugccgggcgcaguggcucacaccuguaaucccagcacuuugggaagccgaggcgggcggaucacaaggucaggagaucgagaccauccuggcuaacacagugaaaccccgucucuacuaaaaaaacauacaaaaaauuagccaggcgugguggugggcgccuguggucccagcuacuugggaggcugaggcaggagaauggcaugaacccgggagguggaacuugcagugagccgagaucgcaccacugcccuccagccugggagacagagcgagacucaguuucaaaauaaauaaauaaauaaauaaaaugaaaaauaaaaauaaauaaaaaaauaaaagcaaugcggucccuccaccauccacacacaggaacaugacccagcuguguaacggagcaagguucugacaccacaguguggaugccccuugaggaugucacacucaugagacgccagacacaaaacgccacacaguguguaaucccauuuccaugaaauguccaggucaggccagugcacagacacaggcagcgggugugugggcagcggggcuggagaaggggacggggagugaccgcugagggggacaggcuucuuuuaguggggaugaacguucuaaaauuggacacauuggugguggcacagcuguggagauaugaaaacgcgaaaccuacgggugagcugggugaaccuuaugaggcgggaauuaacugcuccggcucuggcgcugaggaaaaggaggaccggaggaugguaggcggaaccaggcccagcaccacccgcuagaacgccgugauguucccacagcccuacagggccaagggugucuaugcaagguggguacagggucggccugcaucuggagggccacacccccauguuacaggcgaggcuccugugcagagggcugggggccugccaggacgcaccccuuggcagugaccgggccucuucugaggugggacccucagccucaaaccaacgcaugcugggccaucuggacaagucagagucucaggcugccccagcaccgcagcuccaagucccgucagccuacaguggggcgggauaaggguucccaaccugauuuuauguaugggaaaacugaggcacgggucaguaaaaagccgccuccugaccaccgcuggguccuagacauaucaggucugcggggaccaauuguaggacggggacccacagaggcagcagugcaaagcgagcuccucccgcggcaccccggccacccccaagcccucccucccaugcaggcgaucaucugggccgugcccuccacaucuguguccugggaacagacuucuagaaaaacccaaaucaggaaaaagcggccagcuccacgcugcaaacagcugggcaccaggugcaggcaugguggugucugccucucccucaaagcucccaaauaccccuaaccucaagggaggggcugacgggacacccucaggaugggggucacacacgagcucuccuguccccacagagagagagcugacugcggcucacgaggcagaggggccaggaugaacaaaacagcagaguuuccaacaaagacaagaucagcgccgggacacacaggagcccguucaaggugagaaaaaacagcaacucugcaauggcagccacacgcacagaggcaugcugagcacccccagaccaugugcacggcgguccuguaagacucuaaugcaaaccuggcaugggggcucaccccugucaucccagcacuuugggaggcugaggugggcggauuacgagguuaggagaucaagaccauccuuguuaacacggugaaacccugucucuacuaaaaauacaaaaaaauuagccgggcaugguggcgugcaccuguaauaccagcuacucaggaggcugaggcaggaaaauugcuugaacccaggaggcagggguugcugugagccaagauugggccauugcacuccagccuggcgacagccagacuccacuucaaaaaauaaaaagaaaaagaaucuaauaccauauucuuacugcaccuuucuuguguuuauuuacuuauuuugagacagagccacacccagccuggagagcaaugccgcaaucacagcucacugcagccucaaacucugggcucaagcaauccuccugucucagcugccccaauagcugggacuauaggcacacauacuacuaugccugccuaauuaguuucuaacuuuuuuuuuaagagauggggucuugcuauguugcccaggcuggucucaaacuccuggacucaagcaaucugccugccccagccucccaaaguacugggauuauaggcgggagccaccgcacccagcccuuucucguguuuaaaugcucacauacuuaccauuguguaaccggugcccacagcauuccacagaggagcgggcggugugggucuguggccuaggaggccacgcccaagccugggugugugguggcuuccaccauccgggagugugggagugcacucuaccaugcccacacaaggggcacgucuccuaacgacacgcuuuccacaagguaucccugucacuaaacgacaccugacuugaauuaauaguuuguucauuguagauuuuuugaauuaauugauuuuuaaaagauaauccauuagggcccggugcgcuggugcaugccugaaaucccagcacuuugggaggcugaggcgggcgaauuacuugaggucagcaguucgagaccagccuggccaacauggugaaacccugucucuauuaaaacacaaauuagcuggguguggugguaggcgccuguaaucccagcuacucgggaggcugagacaggagaaucacuugaacccgggaggcagagguugcagugagcugagaucacgccacuacgcugcagccugggugguacagagagacccugucucaaaaaaaauauacauaugucugggcgccguggcucacgccugucaucccagcacuucgggaggccaaggcaguuggaucaccugaggucaggaguucgagaccagccugaccaacauggagaaacccugucucuacuaaaaauacagaauuagccgggcauggugguguaugccuguaaucccagcuacccaggaggcugaggcaggagaaucgcuugaaccagggaggcggagguuguggugagccaagaucacgccacugcacuccagccugggcaacagagugaaacuccgucucaaaaaaaagaaaauaaaauacauauacauauacauauauauauacacauauauauauauauuccauuaaaacauuacucaucccaucgccccagcgugacgaugagcaaaacaacacacaaacccccauugaggaacauccuacugcacaccugcccagcccgcucaggaccaaccagaaccucuaaccaggaacgugggggaaacuaucagccuggaggagccugggagacagugacguagucacuaaaugucacgugagauaguggauggggucuuggggcaggaaaggacaucggggaaacugaggaagucugaauacaugauggauguugcugggagcaguggcucacagcugcaguccuacaacuuugggaggcugaggcaggaggaucagccugccucagccuuccaaagugcugggauuacaggcaugagccaccgcaccuggcauaagaugaugggaggcugaggcgggcagaucaccugaggucaggaauuuaagaccagucuggucaacauggugaaaccccaucucuacuaaaaacacaaaaauugcaccauugcauuccagccugggcgagcacagggcaagacucuguugcccaggcuggagugcaguggcaugaucugagcucacagcaaccucugcuucccggguucaagcgauucuccugccucccaaguaacugggacuauagccgugcaccaccacgcccagcuaauuuuuguauuuuuaguagagacggggcuucaccauguuggccaggcugguuucaaucuccugaccucgugauccgcccaccucggccucccaaagugcugggauuauaggugugagccacugcgcccagacgguuuuuacauuuuuaaauggcuagggguagccaggagagguggcucaugccuauaaucccagcacuuugggaggcagaggcuggcagauccccugaggucaggaguucgagaccagccugaccagcauggugaaaccccaucucugcuaaaaauacaaaaauuagcugggcguggcagugcaaaccugugaucccagcuacuggggaggcugaggcacaagaaucgcuucaucgccugaauccgggaggcagagguugaagugagcggagauugugccacugcauuccagccuggaaaacgagacugucucaaaaacaaaaacgauaaaggccaggggggaagaugaagagacuuugugacacaggcagauucuaugcacuucacaguuccauguguauaaauaaaguuuuauugacacauagcagcacccacuuauucaccuaugggcuaaggcagcuuucauccuauggcagagcugagugguucagaugcagacagucuggccuuuuuuagaaaaagucugcugaccaugccuggucugccgugcugugaugaugaggaaaguucuagaggcuggggcaccucacaaagacccuuugagccugcggaacgggugugccggggcaggacggccuccuugugcuugugaggcgcugcaaagggcuggggacaggcugggccuuuucuuucaucuuucacggcaucuagcaagugcuaggcuugagggaagucaacaaguguguccacacaugugggccuggcagggcucagauagccugagauggccuuugccugggaccccucggacacacagagcagcauaacucggcuggaggaggccacggugggacaaaauggcccggcuaagaacuacagcccugugcagaaaaugcaaacaccggcuuggggucacuuccaaaguggacuccauccuccacgcucgccugggccgccuccgagacccccuccagcagcccugagcagccaggggacaccggggcaggggaagacagaagaugccgaagccaggucuccucccucgggaacguaaggccuggcagggaaguaccuggaguaccugccucucccgcgccuggacacgggccacagcgcggccucccugcaccugcccccgcccccagcacucagugauccuccuucaacaaauacccaucuggccagcccccaccccacccuuucccaagcccuccaacgaugcuuguauauggcgauucauccacaccgccaaaagacacccccuagugucacaugggaauguggaacccaugcuuggccugguuuuguacgagugugcaagggugaacuccugcgggcaggaaagaagugagcaaguuagccgggcaugguggugggcgccuguaaucccagcuacucagaaggcugaggcacgagaagcccuugaacccaggagguagagguugcagugagccaagaucacgccacugcacaccagccugggcgacagagagagacucugucuagaaaaaaaaaaaggccaggcauacuggcucacaccugcaaucccagcauuuuggaaagcugaggcgggcagaucacaaggucaagagauagagaccauccuggccaacauggugaaaucccaucucuacuaaaaauacaaaaauuagccggguguggugguacacgccuguaaucccagcuacuuaggagggugaggcaggagaauugcuugaaccugggaggcagagguugcagucagccgagaucacaccacugcacuccagccugggcgacagagugagacucuaucucaaaaaagaagugagaaaggcgugugugaggaccucgggggccgccacacaccaggaugcugugagucguguuaugagccugaaaaaaucugaacugagucccucacgccucccagcaggcuccucggccuggccauucucaugggggccguguuacccucauggaggcugcgucauccucgugggggaugggucauccucaugggggcugcgucauccucaugggggcugggucauccuaaugggggaugggucauccuaaugggggcugggucauccuaaugggggcugggucauccucgugggggcugggucauccucgugggggcugggucauccucauggggcugggucauccucgugagggcugcgucauccucgugggggccaggugauucucuucucggggcgcugagcaguacccagccuccacccacgcugugccgaugccgucucccucccaaugugacaaccaagggcaugcccagccuuggccaagaguccccugggggcagaagcuggccaggugagagaggcccugcuguccaggugaccugcaugcucuuaggccugacaccccaggucccuccucguucagagcucccuccccugcccccauccugccagccugagccugaggcugcucucugaaccccacguggcccaccugugucuagaaggcccccagcuauuccaggucacucccuccaugugggcccacaugacguccccccaccagcggcccccaccccagcaggcuuccaacucugcuccccacuagccggguuccuggcccacuagucgcaggcggaacucccagcuguccccugccacaugcccugcagacacggcugggugacagggcucacggaggggccagugugucaccugcuaaauggcugccuucacuggagucagacccgcauuucacccagccugagugaacugaguuguaaaggaugcugcugcggccccgagagguggcugggccaggcucccucuagggcacagggccgguccaauggggcguccaguggggcuggggcugguaccuccccagcacucaccaggcccugcacccucaaagcucccugcagcuguucgucccauuggcaggugggauaacagaggcccaaagacaagaaaccagcucuaacccugcacgccacggguccagcaggcggccucuaaguugggacaacuccgcacuggacagauggcaagauggaggcuccaagagacacaggggccugcccaaagccacacuaauugaaaagcaggggacuggccaggcacggcggcucacaccuguaaucccaguacuuugggaggccgaggcaggcagaucaccugaggccaggaguuugagaccagccugaccaacaaggccaaacucugucucuacuaaaaauacaaaaaugagccgggcaugguggugaacaccuguaaucccagcuacucgggagacgggggcaggagaaucacuugaacccgggaggcagagggugcggggagcuaagaucgcgccacugcacuccagccuggacgacggagcgagacucuaucucaaaaaaaaaaaaaaaaaaaaagaaagaaaagcaggggaucccaccaagcacugaucuuccuucuaccucccugaaggcaccagcuacauucuuucagguucccuguccccagggcacugugaaaacaacccacagggagcuacugaacaaaaguuaaccugcuguggccccacacacaaguaagagguggguauuauaauuacacccauuccaaaggcgagggcacugagacccagagaggguaagcgacuagcccaaggucacacagaggguaaguggcucccagaaaugacccgacccccucaacaagcagcucuucucccagaagcccaccacguccucugaucuccagaugggcgaguggggacugggcgcugcaaaucccgacuucggcacccagcucucccaacaggacacuggggccuagggaccccaggaccccaacccauggcaggaaucaagugggugcuccugccugccccccguucuggaguccuguccuuggauugggcauggccagugggagggacaaagagccuccccaggguuagguuggggggcaggacagauugcacccagaccccaagacaccccgaccucauguccccuuggugggcagacuuucccgccucuucuccuucagucugcacugaagccucggggcccauucagaaccucaacacuuuccaccggacccaagaucccaacucucacccuuccuucauauucucuugggggcagaaccugccagaccaccgcugacaccagggcacaaauaagggacucccaaauuucccgugggaccccaagguaucagaaccucucccucggcccccuacccacccugggccuggugagagaugaggggccuaauucccaccccagucaccaaucucuucuggauucaucagggaacucgcuaaagcuccagggagaacugagaccacgugacucaccccagagacuccagggagaccccccacacaccccaucuugggccuccucagagggccugggccccccagucuccuuggagcccagagaccacccccauuccaccccagauaccccaauacccagcuucauccccagagacucccacucacacccccucaguugggggggguccgccaagucuccuuggaauccucugagggacgaggcauauggggggcugcagcccaauacucagggagcccccaaauccccaggaccucucuuugguggggagcccuagucuguaacccccauggccccaaaaugcaccucucacggaaggguccccagagcuagcuggaggccccucugcagcccucacucaggacacggaagaucuccugggacccccuccauagguggggcauuccuggucugcacuuuucacucagugcccuagaaacccccuggagguccccaagagaaugggccacuccggucugcaccccucccaaggggucccccaagaucucggaaacugcggugggcagggccugcccagguggcaccccucacucagggucucccccuggagauccccgaggccaggcugaccccaccccugcucagggucccccgugaucgcguacuccgcggugggcugggccuggccgagcugcaccccucacucagggaccccuugaaacccccuggagacccccaagccgggacccuucccggucugcaccccugcccaggguccccgcgaucgcgcaccccgcgguggccaggaccugcacccuucauccaggagccccccgcaaacccccuggagaccccaagccgggagucguucagagucccccgcgaucgcgcgccccguggugggcggggccuggccgaguagcaccuuucacucagggacucuccgaaacgcggcggagauccccgaggccggacuguccccgucugcaucccagcucaggguuccccgcgacugggagccccgcagugggcugggccuagccgagcagcaccccucacucagaagcccccaaaccuccuggagacccccgagccggagccuguccccgucugcacccccgcccaggguccccgcgaucacgcaccccgcggugggcggggccuggccgaacugcaccgcucacucaggggccccucgaaacccccuggagacccucgagacccgggcccgucccugucugcacccagggucccagcgauugcccaccccgcggugggagggaccuggccgagcugcaccccucacucaggggccccccgaaaccccgcggaaacccccgaagccggggcccguccccgucugcacccccgcccaggguccccgcgaucgcgcgccccgcggugggcggggccugccggcugcacccccgcccggccccuaagccccggcgcccaccucgcgcguggucaccuccuccuucucugagaucuugagcaggagccggucguucuccagcuccagcgcgcggacgcggucgauguagugcgccaggcggucguugagcucgcgcagcuccuccuucuccugcagccgcgacaggcgcgugggcgacagcggcguggcgggcccgcccgcgcggccgggcagcggcguggccaugguggcggcggcucgcggccugcgcugcucccgacggcggcccgggcucggcgggcucauucaauccgcgccgccggcugcaagaug

SEQ ID NO: 192171 - RNA, 28795 nt, Homo sapiens
caucuugcagccggcggcgcggauugaaugagcccgccgagcccgggccgccgucgggagcagcgcaggccgcgagccgccgccaccauggccacgccgcugcccggccgcgcgggcgggcccgccacgccgcugucgcccacgcgccugucgcggcugcaggagaaggaggagcugcgcgagcucaacgaccgccuggcgcacuacaucgaccgcguccgcgcgcuggagcuggagaacgaccggcuccugcucaagaucucagagaaggaggaggugaccacgcgcgaggugggcgccggggcuuaggggccgggcgggggugcagccggcaggccccgcccaccgcggggcgcgcgaucgcggggacccugggcgggggugcagacggggacgggccccggcuucggggguuuccgcgggguuucggggggccccugagugaggggugcagcucggccaggucccucccaccgcggggugggcaaucgcugggacccugggugcagacagggacgggcccgggucucgagggucuccaggggguuucgaggggccccugagugagcggugcaguucggccaggccccgcccaccgcggggugcgugaucgcggggacccugggcgggggugcagacggggacaggcuccggcucgggggucuccaggagguuugggggcuucugagugaggggugcugcucggcuaggcccagcccacugcggggcucccagucgcggggaacccugagcugggaugcagacggggacaguccggccucggggaucuccgccgcguuucggagagucccugagugaaaggugcuacucggccaggccccgcccaccacggggcgcgcgaucgcgggggacucugaacgacucccggcuuggggucuccaggggguuugcggggggcuccuggaugaagggugcagguccuggccaccgcggggugcgcgaucgcggggacccugggcaggggugcagaccgggaagggucccggcuugggggucuccaggggguuucaaggggucccugagugaggggugcagcucggccaggcccagcccaccgcggaguacgcgaucacgggggacccugagcagggguggggucagccuggccucggggaucuccagggggagacccugagugaggggugccaccugggcaggcccugcccaccgcaguuuccgagaucuugggggaccccuugggaggggugcagaccggaguggcccauucucuuggggaccuccaggggguuucuagggcacugagugaaaagugcagaccaggaaugccccaccuauggagggggucccaggagaucuuccguguccugagugagggcugcagaggggccuccagcuagcucuggggacccuuccgugagaggugcauuuuggggccauggggguuacagacuagggcuccccaccaaagagagguccuggggauuugggggcucccugaguauugggcugcagccccccauaugccucgucccucagaggauuccaaggagacuuggcggaccccccccaacugagggggugugagugggagucucuggggaugaagcuggguauugggguaucugggguggaauggggguggucucugggcuccaaggagacuggggggcccaggcccucugaggaggcccaagaugggguguguggggggucucccuggagucucuggggugagucacguggucucaguucucccuggagcuuuagcgaguucccugaugaauccagaagagauuggugacuggggugggaauuaggccccucaucucucaccaggcccaggguggguagggggccgagggagagguucugauaccuuggggucccacgggaaauuugggagucccuuauuugugcccuggugucagcgguggucuggcagguucugcccccaagagaauaugaaggaagggugagaguugggaucuuggguccgguggaaaguguugagguucugaaugggccccgaggcuucagugcagacugaaggagaagaggcgggaaagucugcccaccaaggggacaugaggucggggugucuuggggucugggugcaaucuguccugccccccaaccuaacccuggggaggcucuuugucccucccacuggccaugcccaauccaaggacaggacuccagaacggggggcaggcaggagcacccacuugauuccugccauggguugggguccuggggucccuaggccccaguguccuguugggagagcugggugccgaagucgggauuugcagcgcccaguccccacucgcccaucuggagaucagaggacguggugggcuucugggagaagagcugcuuguugagggggucgggucauuucugggagccacuuacccucugugugaccuugggcuagucgcuuacccucucugggucucagugcccucgccuuuggaauggguguaauuauaauacccaccucuuacuuguguguggggccacagcagguuaacuuuuguucaguagcucccuguggguuguuuucacagugcccuggggacagggaaccugaaagaauguagcuggugccuucagggagguagaaggaagaucagugcuuggugggauccccugcuuuucuuucuuuuuuuuuuuuuuuuuuuuugagauagagucucgcuccgucguccaggcuggagugcaguggcgcgaucuuagcuccccgcacccucugccucccggguucaagugauucuccugcccccgucucccgaguagcugggauuacagguguucaccaccaugcccggcucauuuuuguauuuuuaguagagacagaguuuggccuuguuggucaggcuggucucaaacuccuggccucaggugaucugccugccucggccucccaaaguacugggauuacaggugugagccgccgugccuggccaguccccugcuuuucaauuaguguggcuuugggcaggccccugugucucuuggagccuccaucuugccaucuguccagugcggaguugucccaacuuagaggccgccugcuggacccguggcgugcaggguuagagcugguuucuugucuuugggccucuguuaucccaccugccaaugggacgaacagcugcagggagcuuugagggugcagggccuggugagugcuggggagguaccagccccagccccacuggacgccccauuggaccggcccugugcccuagagggagccuggcccagccaccucucggggccgcagcagcauccuuuacaacucaguucacucaggcugggugaaaugcgggucugacuccagugaaggcagccauuuagcaggugacacacuggccccuccgugagcccugucacccagccgugucugcagggcauguggcaggggacagcugggaguuccgccugcgacuagugggccaggaacccggcuaguggggagcagaguuggaagccugcuggggugggggccgcugguggggggacgucaugugggcccacauggagggagugaccuggaauagcugggggccuucuagacacaggugggccacgugggguucagagagcagccucaggcucaggcuggcaggaugggggcaggggagggagcucugaacgaggagggaccuggggugucaggccuaagagcaugcaggucaccuggacagcagggccucucucaccuggccagcuucugcccccaggggacucuuggccaaggcugggcaugcccuugguugucacauugggagggagacggcaucggcacagcguggguggaggcuggguacugcucagcgccccgagaagagaaucaccuggcccccacgaggaugacgcagcccucacgaggaugacccagccccaugaggaugacccagcccccacgaggaugacccagcccccacgaggaugacccagcccccauuaggaugacccagcccccauuaggaugacccaucccccauuaggaugacccagcccccaugaggaugacgcagcccccaugaggaugacccaucccccacgaggaugacgcagccuccaugaggguaacacggcccccaugagaauggccaggccgaggagccugcugggaggcgugagggacucaguucagauuuuuucaggcucauaacacgacucacagcauccugguguguggcggcccccgagguccucacacacgccuuucucacuucuuuuuugagauagagucucacucugucgcccaggcuggagugcaguggugugaucucggcugacugcaaccucugccucccagguucaagcaauucuccugccucacccuccuaaguagcugggauuacaggcguguaccaccacacccggcuaauuuuuguauuuuuaguagagaugggauuucaccauguuggccaggauggucucuaucucuugaccuugugaucugcccgccucagcuuuccaaaaugcugggauugcaggugugagccaguaugccuggccuuuuuuuuuuucuagacagagucucucucugucgcccaggcuggugugcaguggcgugaucuuggcucacugcaaccucuaccuccuggguucaagggcuucucgugccucagccuucugaguagcugggauuacaggcgcccaccaccaugcccggcuaacuugcucacuucuuuccugcccgcaggaguucacccuugcacacucguacaaaaccaggccaagcauggguuccacauucccaugugacacuagggggugucuuuuggcgguguggaugaaucgccauauacaagcaucguuggagggcuugggaaaggguggggugggggcuggccagauggguauuuguugaaggaggaucacugagugcugggggcgggggcaggugcagggaggccgcgcuguggcccguguccaggcgcgggagaggcagguacuccagguacuucccugccaggccuuacguucccgagggaggagaccuggcuucggcaucuucugucuuccccugccccgguguccccuggcugcucagggcugcuggagggggucucggaggcggcccaggcgagcguggaggauggaguccacuuuggaagugaccccaagccgguguuugcauuuucugcacagggcuguaguucuuagccgggccauuuugucccaccguggccuccuccagccgaguuaugcugcucuguguguccgaggggucccaggcaaaggccaucucaggcuaucugagcccugccaggcccacauguguggacacacuuguugacuucccucaagccuagcacuugcuagaugccgugaaagaugaaagaaaaggcccagccuguccccagcccuuugcagcgccucacaagcacaaggaggccguccugccccggcacacccguuccgcaggcucaaagggucuuugugaggugccccagccucuagaacuuuccucaucaucacagcacggcagaccaggcauggucagcagacuuuuucuaaaaaaggccagacugucugcaucugaaccacucagcucugccauaggaugaaagcugccuuagcccauaggugaauaagugggugcugcuaugugucaauaaaacuuuauuuauacacauggaacugugaagugcauagaaucugccugugucacaaagucucuucaucuuccccccuggccuuuaucguuuuuguuuuugagacagucucguuuuccaggcuggaaugcaguggcacaaucuccgcucacuucaaccucugccucccggauucaggcgaugaagcgauucuugugccucagccuccccaguagcugggaucacagguuugcacugccacgcccagcuaauuuuuguauuuuuagcagagaugggguuucaccaugcuggucaggcuggucucgaacuccugaccucaggggaucugccagccucugccucccaaagugcugggauuauaggcaugagccaccucuccuggcuaccccuagccauuuaaaaauguaaaaaccgucugggcgcaguggcucacaccuauaaucccagcacuuugggaggccgaggugggcggaucacgaggucaggagauugaaaccagccuggccaacauggugaagccccgucucuacuaaaaauacaaaaauuagcugggcgugguggugcacggcuauagucccaguuacuugggaggcaggagaaucgcuugaacccgggaagcagagguugcugugagcucagaucaugccacugcacuccagccugggcaacagagucuugcccugugcucgcccaggcuggaaugcaauggugcaauuuuuguguuuuuaguagagaugggguuucaccauguugaccagacuggucuuaaauuccugaccucaggugaucugcccgccucagccucccaucaucuuaugccaggugcgguggcucaugccuguaaucccagcacuuuggaaggcugaggcaggcugauccuccugccucagccucccaaaguuguaggacugcagcugugagccacugcucccagcaacauccaucauguauucagacuuccucaguuuccccgauguccuuuccugccccaagaccccauccacuaucucacgugacauuuagugacuacgucacugucucccaggcuccuccaggcugauaguuucccccacguuccugguuagagguucugguugguccugagcgggcugggcaggugugcaguaggauguuccucaauggggguuuguguguuguuuugcucaucgucacgcuggggcgaugggaugaguaauguuuuaauggaauauauauauauauguguauauauauauguauauguauauguauuuuauuuucuuuuuuuugagacggaguuucacucuguugcccaggcuggagugcaguggcgugaucuuggcucaccacaaccuccgccucccugguucaagcgauucuccugccucagccuccuggguagcugggauuacaggcauacaccaccaugcccggcuaauucuguauuuuuaguagagacaggguuucuccauguuggucaggcuggucucgaacuccugaccucaggugauccaacugccuuggccucccgaagugcugggaugacaggcgugagccacggcgcccagacauauguauauuuuuuuugagacagggucucucuguaccacccaggcugcagcguaguggcgugaucucagcucacugcaaccucugccucccggguucaagugauucuccugucucagccucccgaguagcugggauuacaggcgccuaccaccacacccagcuaauuuguguuuuaauagagacaggguuucaccauguuggccaggcuggucucgaacugcugaccucaaguaauucgcccgccucagccucccaaagugcugggauuucaggcaugcaccagcgcaccgggcccuaauggauuaucuuuuaaaaaucaauuaauucaaaaaaucuacaaugaacaaacuauuaauucaagucaggugucguuuagugacagggauaccuuguggaaagcgugucguuaggagacgugccccuugugugggcaugguagagugcacucccacacucccggaugguggaagccaccacacacccaggcuugggcguggccuccuaggccacagacccacaccgcccgcuccucuguggaaugcugugggcaccgguuacacaaugguaaguaugugagcauuuaaacacgagaaagggcugggugcgguggcucccgccuauaaucccaguacuuugggaggcuggggcaggcagauugcuugaguccaggaguuugagaccagccugggcaacauagcaagaccccaucucuuaaaaaaaaaguuagaaacuaauuaggcaggcauaguaguaugugugccuauagucccagcuauuggggcagcugagacaggaggauugcuugagcccagaguuugaggcugcagugagcugugauugcggcauugcucuccaggcuggguguggcucugucucaaaauaaguaaauaaacacaagaaaggugcaguaagaauaugguauuagauucuuuuucuuuuuauuuuuugaaguggagucuggcugucgccaggcuggagugcaauggcccaaucuuggcucacagcaaccccugccuccuggguucaagcaauuuuccugccucagccuccugaguagcugguauuacaggugcacgccaccaugcccggcuaauuuuuuuguauuuuuaguagagacaggguuucaccguguuaacaaggauggucuugaucuccuaaccucguaauccgcccaccucagccucccaaagugcugggaugacaggggugagcccccaugccagguuugcauuagagucuuacaggaccgccgugcacauggucugggggugcucagcaugccucugugcguguggcugccauugcagaguugcuguuuuuucucaccuugaacgggcuccugugugucccggcgcugaucuugucuuuguuggaaacucugcuguuuuguucauccuggccccucugccucgugagccgcagucagcucucucucuguggggacaggagagcucgugugugacccccauccugagggugucccgucagccccucccuugagguuagggguauuugggagcuuugagggagaggcagacaccaccaugccugcaccuggugcccagcuguuugcagcguggagcuggccgcuuuuuccugauuuggguuuuucuagaagucuguucccaggacacagauguggagggcacggcccagaugaucgccugcaugggagggagggcuuggggguggccggggugccgcgggaggagcucgcuuugcacugcugccucuguggguccccguccuacaauugguccccgcagaccugauaugucuaggacccagcgguggucaggaggcggcuuuuuacugacccgugccucaguuuucccauacauaaaaucagguugggaacccuuaucccgccccacuguaggcugacgggacuuggagcugcggugcuggggcagccugagacucugacuuguccagauggcccagcaugcguugguuugaggcugagggucccaccucagaagaggcccggucacugccaaggggugcguccuggcaggcccccagcccucugcacaggagccucgccuguaacauggggguguggcccuccagaugcaggccgacccuguacccaccuugcauagacacccuuggcccuguagggcugugggaacaucacggcguucuagcggguggugcugggccugguuccgccuaccauccuccgguccuccuuuuccucagcgccagagccggagcaguuaauucccgccucauaagguucacccagcucacccguagguuucgcguuuucauaucuccacagcugugccaccaccaauguguccaauuuuagaacguucauccccacuaaaagaagccugucccccucagcggucacuccccguccccuucuccagccccgcugcccacacacccgcugccugugucugugcacuggccugaccuggacauuucauggaaaugggauuacacacuguguggcguuuugugucuggcgucucaugagugugacauccucaaggggcauccacacuguggugucagaaccuugcuccguuacacagcugggucauguuccuguguguggaugguggagggaccgcauugcuuuuauuuuuuuauuuauuuuuauuuuucauuuuauuuauuuauuuauuuauuuugaaacugagucucgcucugucucccaggcuggagggcaguggugcgaucucggcucacugcaaguuccaccucccggguucaugccauucuccugccucagccucccaaguagcugggaccacaggcgcccaccaccacgccuggcuaauuuuuuguauguuuuuuuaguagagacgggguuucacuguguuagccaggauggucucgaucuccugaccuugugauccgcccgccucggcuucccaaagugcugggauuacaggugugagccacugcgcccggcaccauguguaguuuucaaacaugcauggaugugaauuucaugucuucuggguccacacccaggaguggaguuaccgggucacaggguggcucugugacucuugggggagccccuggacuguuuucuguagagcugucucagcucagguuccugccgcugccugugagguuccgauuucucugcguacucgcccgcaccugcgacugucugucuucuugacggacgcccuggcuggugcgaaguggcaucucacugcgguuugcuuccacauauuuuuaaacucacugagugcauggcccugugggaggaggggaggcaggaaggccacuagaagccugagcugugcccccagcuggcgcgugcagaggccgggcagguggcggcugugguugcagcaggauuaguaggaagugaagaggucgccuucccuggcaccgcaugugccucgaguucaccuggaggcccucgagaggggcggguuugggggcuuugcgcggggcuuagggaggggcuuucuuuagcugggcggcccagaggguguuccagucgcuucugccugcccuggugaccccuggcucuccagccccuccccauguccuugcuggcugggcugggucuccgucgggaaaggugggggccgcuggugggguggggagcuggagacucugacuacagaucccugugaucgaggggugaaaggugggggugacugguggggggggcagcuggggacugacuacagaucccugugaucgaggggugaaaggugggggcggcuggugggguggggaguuggggacucugacuacagaucccugugauugaggggugaaaggugggggcagcuggugggguggggaguuggggacucugacuacagaucccugugaucgacgggugaaaggugggggcggcugguuggggggggcagcuggggacugacuacagaucccugugaucgaggggugaaaggugggggcggcuggugggguggggaguuggggacucugacuacagaucgcugugaucgaggggugaaaggugggggccgcuggugggguggggagcuggggacucugacugcagaucccugugaucgaggggugaaacgugggggccgcuggugggguggggagcuggggacucugacugcagaucccugugaucgaggggugaaaggugggggccgcuggugggguagggagcuggggacucugacugcagaucccugugaucgaggggugaaaggugggggccgcuggugggguggggaguuggggacucugacuacagaucccugugaucgaggggugaaaggugggggccgcuggugggguggggagcuggggacucugacugcagaucucugugauugaggggugggagcuucuguccuggagccuccgagccaccacauuggcagcuggccugucggggggacacagcaugggaaggccagaugcuccucccuccaucccagggaacagcccagccugagccugggccaugugccugcgugugagguaggggcacagaggggcacgggcuggcccccgguuggcagaagugggggaucuugggcucagcggggucugggggagcgggggcuccagguugcagaggccuggggggagucucaggggcccagaggggucugggaggggacuccagguugcaaaggcuggugggggcagggggcucucaggcccaguggggucugggagggccccggguugcugucaucaccaguuguccgagagugaucagcccaguguccauggugcccagcgggagagauccuugauuaaacaucccaccaguuuucugguucugaaaccgagagugugaaaaaugcaucuaauggccaggcaucgugucgcuaugacagcggccaaggggcugcauguccagguguggcugguccuccggggaaggggacaggcuccauccagcugcugugcugguccaggcccagggccuuuggucuccagcacugggcgccgcuguucugggagcuggagcucguggagagacgaucauuccagagggggccgcagcagaggaggaggcuccugggauggcugggacccagggucgccuggcuuccuccugguuaccggacccuccccgacagggggcucccuuugcugugucugugagaugggcaacacagggugucccaguguccccaggcugccauccucucucucugcgugccagucccugggaaucugagcagggccaguggccgggcccccugacugcuguaguccaaggggaagggucccucucgcuucacccuguccugggucuccccaggugaguggcaucaaggcgcuguacgagucggagcuggccgaugcccggagaguccuggaugagacggcucgagagcgugcccggcugcagauagagauugggaagcugagggcagaguuggacgaggucaacaagaggugaguggucacggcugggcacgacgucacccugauccuggcaccacgggguggacgggggcaggugggcgcugggcucgugcggggcaugcucugauacgggcacagccuggagcucacagcucccauccucucucccccaccaguggcugccacgucacuuuuucuguucugaggaaagugauagaugcucacaucggacagcaggaagcgcagggcagcuuaagcucacaaguaaaaucucccgcgagccuccccagagagggcuuccuggucagccuggccugucuccuuagugugcacacgcgcuugcacaugcuuaccuagaccccgggcggcacccaguggacaccgugagacgcguuugaccucaggccccaucguaggcauuucccugugguuggauguucuuggugccgggguuuugucccagcuguugggacgcucggguguguggugugugaccagggugcucauggguuguugggcugccccaggguuggcugcaaaguccuucugggugacaacuguguccaucggcagaaacgaucuccccucucagccuggcagugagucuugccugauucugggcgugggaugugguugggcggcaauuuaaacagaacgaugaugacaaaaggaauauuuauucagaggagccaggaggccaaugaaacacugagcucaaggcuuuucuugaugugaggcuccagcuagagcgaggucucuggugcccugcguguggacacugucuuccguggucuccggccaccggcauucaggcaccugcaggugccucggauuuccucaggcuggggugggucagggucuucccacacugcucauucucccagagccacgcaggccuggcucagcauggagggaucugcuggcaggagggguggcaccucggccaccugguacgggggugacagcagccaguggcuugagaauccacguugucccugaguuggaguguggccagaggaaugaccggggacccuguguccaacagugccggggcccccaugcgugguugcaggugaccucuccauccgacgcccuccuccuuccugggcuggcgcugcucccguggagagcugacuucccuuccccaacaggagacccuccaggucagcccagggaccaccgcccgccugcccggggccuggggcuccaggagggaccauuugugcccugaugguggccaugagccggggacccuggggccaggcaccagccaggacaggcugcccacucucagcacaucccacacagcacaggugcaccccgggaccugcucaggcagcagcucugugcugucuaccuccagcacccaccguguuuaauaagcagguucaucaguggagccaugcaggcugugggaugacuagagcuuggucaggggugcacggagcucugaaaugucagaacuacaccgugcagaugggacagagcugcugcuggccccgcaccaggcgccucucaacuguucacuuuaagauguugaaauguacaggaugugaauuucaccucaaauuaaaacauuaaaaaaagaaaaugguacacagugcccgcccuagguguugaggaauucccaguucacaaucuccugagcagugcguggcaucuacagagaggcccgucuuuuccuuuucauuaagacagggucucuguugccuaggcuggagcucaguggcacaaucauagcucgcugcagccucgaacucccaggcucaggugauccugccucagccccaccccgaguagcugggaccccaggcaugcaccacuacacccaacuaauuuuuuuuauuuuuuauuuauuuccuuuugagacauagucuugcucugucacccaggcuggagugcaguggugcaaucucggcucacugcaacauccaccucccaaauucaaacgauucuccugccucagccuccugaauaguugggauuagaggcucacaccaccuugcccagcuaauuuuuuuaccaaguuggccaggcuggucucaaacuccuggacuuaagcgauccacccgccuuggccucccagagugcugggauuacagauguaaaccaccaugccuggccuaauuuuuuuauuauuuguagagaugaggucucgcuauguugcucaagcuggucuucaacucccaggcuaaagugauccucccaccucagccucccaaagcacuggguauagguaugagccacugggccaagccuaauguuuuucuuauccuaacaaauuuaucuccaaaaccccacaaugagagaaacacugggagcagcgugcaggaccuaacaagccagagccugccacaaaaccccgggcacccagcugaagauucuaacucagcaccuggcgcuuaggaaacgggucugagcccugggagcccgcacccugccuucugggugugcccugcaguccugcggaacccugugguuuagaccgaguugcugaggagcuucccggauuccccgaucuccgcuccaguccucugagcuggucugcagccugccucuuccaccucaccccugggccuuugcacugcugcucgccugccuggaaggcucuuucagcagcgguggcccuggcuccuccagcacugcuccuucaggucucugcccccaggguugucucccagccccacuccagcccugcccccaggcaaccuccugucugguaggcagccugugucgcugaugccucccuccgcaaggacgucccgcaguguaaggcaaggguucuagaugcaccucuggugugagagcggugccuuccacacagcgggcacucgggauuugcccaacagauuccaccuucccccaaaccccugcaaaaauccccagcagggccgcagggcucgcagcccucugagcgaaagggccuggccuguguggcaugugcucagagaugcgggaucugcaccccagacccugcuggagaucugcuccauguggggaaguagagcuuagugucccugagggcugcggacaggggugcaucagccuuguggccgaagucucuggccuucacgccucucaaaagcaagcagaugccacaccucuaguguguggagagcccuggcuacaccagguccagcgccagagcggcuggccgcccugcccuggcgggacacaaccggagccagacccgggauucaggguacccggcacggaugcuuuuaccuggcagguggccuuagaccugguugucugacccccgaccagggaccccucacacgagagaccuguuuacacaguggcugccccguagcucgugucugaccuguguccaggguaugccuguccgaccaucgcucuggcacugggaucccagccuggggcagcuccugguucuucugacagaaggcgcaaauucagcacagcgauaggaaacaaguuugaagauuuauuacggauccuaggcagggagggcacugugagcugggaaggcagcccucccuccccgggucacacaaggaaggaaggaagagucccacagagagugagagcuuggcagcuagugagagagagagggagauggguggaugauggauggauggcuggauggguggacggaugauggauggaugaguagauggauggaugauggauagauaauggauagauagaugauggauggaugaguggauagauggauggauggauggaugaguagauggaugaauggauagaugauugagggauggauggaaggauggauggauggagaugauggauagaugauggauggaugaguagauggauggauggaugauggguggauggauagauggacagaugaguggauggauggauggaugauggguggauggauggauggaugauggguagauggauagacaguaauagauagagcaauagauagauauagcuaucuguaaggcugggugcgguggcucaugccuguaaucccagcacuuugggaggccaaggcggacagaucacuugaggaugggaguucaagaccaggcuaaccaacauggagaaaccccgucucuacuaaaaauacaaaauuaucugggcgugcuggcacuugccuguaaucucagcuacuugggaggcugagggaggagaaucgcuugaacccgggagguggagguugcagugaaccgagaucgcaccauugcacuccagccugggcaacaagagcgaaacuccaucucaaaaaaaaaaaaaaagauacagccaucuguagaauugauauauacggacauagauuauauagauaaauacaguuauugauggagauauacuuagacagacauacggucacuuucagcuaugggucacuuucauuucuugggcaaaugccuagguggucuuuugaaaggcccugggggaccaggcgcagugguucacgccuguaaucccagcacuuuggaggccgaggcgggcagaucaccugagguugggaguucgagaccagccuggccaacauggagaaaccccaucucuacuaaaaauaaaaaauuagcggacgcugguggcgcaugccuguaaucccagcuacacaggaggcugaggcaggagaauuguuugaacccgggaggcggagguugcagugagccgagaucacgccauugcaauccagccugggcaacaagagcgaaacuccaacucaaaaaaaaaaaaaggcucuagggagagucgggagugcauucugcugggcaggagaggucccugucacuucugaccucuggccacgggcucgagccgccuggauguggauguucuuugaauguccagccagcagccuuggcuguguuauuccagauacacccaguuguccccauccuggggugauucuguccccaggggacacugggugauuccuggggacacuugugguugucaaaacugggcagcaagaagcuccuggucugaaguggguggaggccagggacagugcucagcacccugcagugccuaggaccaccccaaaugucagcaguugugacgcugcggaacccuggauguccucacucgaccaccccaaaugucagcaguugugacgcugcagaacccugggugcccucacucaagaccaccccagaugucagcaguugugacgcugcggaacccuggguguccucacuguuucuugggaggauauaguuaguucccugucgggaggggguaaaauucagcuccaagacuuauaauuaugcuuaaaaacauuuaagagucagccguacgcgguggcucgcaccuguaaucccagcacuuugggaggcugagacaggaggauuccuugagcccaggaguucgagaccagccugugcaaacaagugaaccccugucucuuaaaaaaaaaaaaaaaaaaaaaaaaaaaaaagcuuaagugccuacaauccacacugguaguauuuguguguuuaaaaagccugaguauuugcuaucuuaaauaucuaauguuggagcuaauuugguuuaguggaaaaccaggugagccugcuucagacagcuuaaguuuacaaacaaggcugacccuucaaaggccagggucuuuguaacauuuacagaggaugcauuaauuucuccccaaauggucguccuggguccagaacaggcaggagaggcugggaaagcccaugccuccaggguggucccaagcgcuggugccugucacuugcuggacuccugacagugcagggcagaugaugagggcacgugugccuuugccugggcgcguggggccgcgucgucugcaggacgggaaggucuggggcucggaggccucggugaccuugucuuugggcuugccugacgcccccugaggugcucccuguggccccauggaccuugccccuccccacucacuugcccucuugacuuucagcgccaagaagagggagggcgagcuuacgguggcccagggccgugugaaggaccuggagucccuguuccaccggagcgagguggagcuggcagcugcccucagcgacaagcgcggccuggagagugacguggcugagcugcgggcccagcuggccaagguaggugccaggagccacgggacgccccagcaggguauaugcaacagacagauugucacaccagcucgcuguccugugucucccaggccgaggacggucaugcaguggccaaaaagcagcuggagaaggagacgcugaugcguguggaccuggagaaccgcugccagagccugcaggaggagcuggacuuccggaagaguguguucgaggaggugagugaguggccuggccuccagccuggcacagcggaaacgcaaaguccacccucauggcuguggagggcggaagccugagggcaccguguggccggggucccucccacggcucuagggaggcuccuuccugccucuuagggugcccuuggcuucggcugcgucuccccagugucugccucugucuucccgcggcugccuccccuguguccauacucuguguauccuacaaggacacuugucauuggauuuggggccugccuggaucauccagagugaccuaauggcaucugcagagaccccauuuccaaauaagguccauucacagcugcuggggaucgggaugugggcacgucuuuuuuugagauggaguuucacucugucacccaugcuggagugcgguggcacgaucuuggcucacugcaaccuccgccucccagguucaagcaauucuccugccucagccucccgaguagcuggauuauaggcgugcaccaccaugcccagguaauuuauguauuuuuaguagagacgagguuucaccacguuggccaggcuggucucgaacuccugaccucaggugcuucauccgccucggccucccaaacugcugggauuccaggcgugagucaccaugcccagccaaaacauaucucuucagugucaaggaaggucuauuuugauuucuugccuuucuaaaagcuugguguucccacccugagagcugaacccuggccgccugggauccuaacugcuagaccaugaggcaggcgucaggugcaucuucugggugccaccguccagccucccacagggccuccuuguccaaagcgagggugaggcccgcucuccccacccagccuccuucccugaccugcagccccucaccuggggccucugccuccgggggcucggagaggggaguggggaggaaaggcgucagccuguguccuuuagaaccaauugugcugucacagugcaggguggaaugccggggccggccgggcccacacucccugcccagggagagcugcuggcugcugguggagggauguccaggccgcucaggagcugcgccccgcucuggccaggcccagggaguggggggggccccacaggagccagaggggaggccgccagggcaguugugaaggggccuguggggaaaccugugagacagcccgugaagagacucacgagagcuucugugcgggggcccaggaacgugccccagguggaacccacagggcaccugggaaaagacccacgaaggcggugcaggggccgggaagaggcccuggaggggcccucacagggagcugcgguagggagcuugaugaugcaggccugugcagcccacagggugcggaguccuggagagggcggccgugggggcggaagggcggccguggaggugggugcgcggcugugguggcgggagggcggccguggaggugggugcgcggccgugguggcgggaggguggccguggaggcgagagggcggccguggaggugggugcgcggcugugggggugggagggcggcagugcaggugggugagcggccguggaggugggugcgcagccgugaaggcgggagggcggcugugcaggcgggugcgcggccguggaggcgggagggcggccguggaggugggugcgcggcccgcagggcucugcuugccugggcuacccgccuugcugacugcaaagguggccagcuuccuucagaagcguuucuacuguuuuuguuuuguuuuguuuuguuuuguuuuguuuuugagauggagucuugcucuguugcccacacugggcccagccucccgaguagcugggauuauaggugcacagcaccacacccagcuaauuuuuuucuuuugagacggagucuugcucugucacccaggcuggaguacgguggcaugaucucagcucacugcaaccuccgccuccuggguucaagcgauucuccugccucagccuccugaguagcugggauuauaggcgggugccaccaacccgacuaauuuuuguauuuuuaguacagacgggguuuucaccauguuugucaggcuggucuugaacuucugaccucaugauccaccugucuuagccucccaaagugcugggauuacaggcuugagccacugugcccggccuaauuuuuguauuuuuaauagagaugggguuucaccauguuggcuaggcuggucucgaacuccugaccucgugaucugccugccucagccucccaaagugcugggauuacaggcaugagccaccacgccuggcccgcuuucuucaauaauggcuuuuauaagagagagucacuuuuuuuuuuuuugagacgcagucucacuuuguuacccagguuggagugcaauggugcgauccuggcucacugcaaccucccaaggucaagcgauucucuugucucagccuccugaguagcugggaccacaggugcccgccaccacaccuggcuauuuuaaguccaccuuuuuaaaguguacaguucagcauuggcaggaucuccacaggguugugcaaccaccaccucuaauucuagaacauuccaucacccaaaaagaacccccuccccaucagcaguccccagcccuggcccccacgcauccccucccugucucuguggaugggccuguccuggacauuucaggacauuucauggaaaugggaucacgcaccguguggccuuuugugucuggcgucucucauugagugugacguccucaaggugcauccaugcuguggcggugucagagccucgcuccuuuucguggcugagucacguucuagcgcguggacggccccugggucgccucucaccugcacguguaucgguuuguaacuugugcacaaggaaccaggaauugccuggagguuccucuuggcacauuuuugagcccucccuugggccuggugcuuggggcccaggcgggaccagagggucacgaagccuugguccgcaggaggugcgggagacgcggcggcggcacgagcggcgccugguggagguggacagcagccggcagcaggaguacgacuucaagauggcacaggcgcuggaggagcugcggagccagcacgacgagcaagugcggcucuacaagcuggagcuggagcagaccuaccaggccaagguguggccggcaggcgggugggcgggggcggccggugggaaccccgccccgccccgcgcccgcacucacccgcccgucuccccacagcuggacagcgccaagcugagcucugaccagaacgacaaggcggccagugcggcucgcgaggagcugaaggaggcccgcaugcgccuggagucccucagcuaccagcucuccggccuccagaagcaggugaugagcacagcgccaccgucugccgucccccuggcccaacuucugggcccugcccuggaugugcggggcguggggcucuggccucuuggcaucggaugcagcccucggggcgcccagcgaugccccuucccuccccucccgugcgccccaugcccaggccuggucucugccccagucuguggugagggcccaucucccgcagucccaggaucaccugggccuugugacccaugggcugcccugaccuucgccacccgcccccuccgcaggccagugccgcugaagaucgcauucgggagcuggaggaggccauggccggggagcgggacaaguuccggaagaugcuggacgccaaggagcaggagaugacggagaugcgggacgugaugcagcagcagcuggccgaguaccaggagcugcuggacgugaagcuggcccuggacauggagaucaacgccuaccggaagcuccuggagggcgaggaggagaggugcggcaggccaggaggcuugggagcacagagugaggaggaggggcagggcaggaggagaggcgggacggggcugcggggagugcugggcagggguggagguggggccgggccguggccgccacucugcgugcccugggcugucuggggcucccacuaccagucccaccuuccuugccuuccccacaggcugaagcugucccccagcccauccucgcgcgucaccgucucacgagccaccucgagcagcagcggcagcuuguccgccaccgggcgccugggccgcaguaagcggaagcggcuggagguggaggagcccuugggcagcggcccaagcguccugggcacgggcacggguggcagcgguggcuuccaccuggcccagcaggccucggccucggguagcgucagcaucgaggagaucgaccuggagggcaaguuugugcagcucaagaacaacucggacaaggugaccggaaagaccggggcauggggguaacggggugacccagcugaugggggugaccagggucagggugacggggcugccggccaaugcgaggcaggggacaaggugaccggaaugaccggggcauggggguaacggggugacccagcugaugggggugaucagggucagggugacggggccgccggccaauacgaggcaggggacaaggugaccggaaugaccggggcauggggguaacggggugacccagcugaugggggugaccagggucagggugacggggccgucggccaaugcgaggcaggggacaaggugaccggaaugaccggggcauggggguaacggggugacccagcugaugggggugaccagggucagggugacggggcugucggccaaugcgaggcaggggacaaggugaccggaaugacuggggcauggggguaacggggugacccagcugaugggggugaucagggucagggugacggggccgccggccaauacgaggcaggggacaaggugaccggaaugaccggggcauggggguaacggggugacccagcugaugggggugaucagggucagggugacggggccgccggccaauacgaggcaggggacaaggugaccggaaagaccggggcauggggguaacggggugacccagcugaugggggugaccaggaucagggugacggggccgccggccaaugcgaggcaggggacaaggugacuggaaugaccggggcauggggguaacggggugacccagcugaugggggugaucagggucagggugacggggccgccggccaaugcgaggcaggggacaaggugaccggaaagaccggggcauggggguaacggggugacccagcugauggggugaccagggucagggugacggggccgccggccaaugcgaggcaggggacaaggugaccggaaagaccggggcauggggguaacggggugacccagcugauggggugaccagggucagggugacggggcugccggccaaugcgaggcaggggacaagaugacuggaaagaccggggcacagggguaauggagugaccuagcugaugggggugaccagggucagggugacagggccgccggucaggacgaggcaggggacaaggugacuggaaugaccagggcauggggguaauggggugaccuagcuggugggggugaccagggucagggugauggggccaccagccagggcgaugggggcggugucacaguccugguggcugagggucaggugugugccgugucuuccaggaucagucucuggggaacuggagaaucaagaggcaggucuuggagggggaggagaucgccuacaaguucacgcccaaguacauccugcgcgccggccagauggucacgguaggugguggggcaggagggcgaggguggccacggauggggugugagguggggucaggggacuggaggcacaggacuuggcggggguggguggggaugaugguggcaccaggcaccgucucagagcggcugccgcagucauagaaccuccaugugcuggugucaccccacugggccucccuggagccugaguggugugcccugggucugaguccaggcugcuggggcuggcaggcguccccgugaaguguuaacagucaggcgcaugggccauggagccuggugggugucagaucccaguucagccccugcuugccaagagcccuuggccucugugaacccuggucucuucuuguguauccuggggaccaucacccuggauaagccugcgucgggcuggaaggacugaacgcccagggcauugaagggggcuuugugguaggggccacuggcuggcccacgucccuggaaccagaggugacccugauggggccauuguuauuggguccucaggugugggcagcuggugcggggguggcccacagcccccccucgacgcugguguggaagggccagagcagcuggggcacgggcgagagcuuccgcaccguccugguuaacgcggauggcgagguggguguguguggcuuggggggugcucggcuggaguccugggcagggucugggcacccucggggccgccacagcagcucugggcccgaucccgggacaugccgccguguccugucccgcacaggaaguggccaugaggacugugaagaaguccucggugaugcgugagaaugagaauggggaggaagaggaggaggaagccgaguuuggcgaggaggaucuuuuccaccaacagguaggaccccugugcccacuugcggcuggggggcagccucuggggcagagugagcucgugcacacacauacacaugcgugcuggccgcauccccgacgggagcuccaucuggcugccguggcucagggugaagccagccuuggcuguuaccagcacggcagagaccuguucuugccuccugggucgugcccaucgugugaauuugcgacaucacagaccucaggguagcuggccaggggguccccugagagguggguguugaacagcuccccaaaugcucucuggucaaccggcuuccucagucgaagacacaggucccuucaauacuggcuucuggggagaagaugagugcagaaaccacagcugcauuaaacgcgugcgucgcaaguuccugugacuguuuuggaacccagaacagaauguguagcucacaggcgggcucauggggacauggaaguggaauggaaggcucuagaaauagacacuguuguugcucagccccucccugguggggaggugggggcagccaucuaccugccggcugccuccaggcuggcccugaucauggccgaccuuccuuccuuccuuccugcagggggacccgaggaccaccucaagaggcugcuacgugaugugaacccacacuccucauccacacaccuuucuuuacccagagccacugaaaacuauuuuuauaucauuggcuuucuuuaguucuugauacauuucuagagaauuucuaagcgaacugccagaacgugugggugggucucccccagcccucccuccuggcgggucuccuccagccucacuucgcugccacuucgccgcugccccggagacuuuucaaucccaccccacuccucaucucaccauuuggucaaauuggaagcccagggccaggacccggagguuuagaagaugcuugggcuuggagggaggagggccggcgaggcuagcgaggggacaggagacggcccugcugcggacggagcgcggaaacugcguaggaauucaguggugguggguuuuuuuaaggcuuucuacaaaaccaaauucagaauccaggcgucgaccugguggggcccggggccaagccugcauucuggcugcccagcuucggacagcgggaacuccucaggcagccacgcagcgggugugggccagcauggggauggcguggcccccagggcggguuuucacuccgcugccugggcuuccagauucccguucuggcagcgcaccggccggguuucucggaccguugacuuuauuugggggaguuuucccgcaguucaguuccugacugugcaaggccaacagggcaggggaggggaagaccuggggaaggaagaaugaggacagucccgucguaagaccugucacaacaauaagcagggaggggagauguggaggggacacaucugguugccuuggaggcagaagcugugaguuucagaacagcugucugcagggaacgccaccauguugacccucuggaggagagcgcuguggagccccucccguguuccagcuccgucugcccugugccuauauauacacaugcgucuauccauacugugcuuuuaucugugauuuucucgcugaaaccauguuucucagacaggccaaggccaccugacuccuaucacgacgcacccaagccccucaguccagcuucccaaugccuggcaccccccuucggcaauagcucaccguuuacacccucccucauagauacacagaaguuauuuuuuuaauggauauuuauuuuuuuacauuggucaguacacaggucaggagcucacgccagggccuugaggacaggcugacccuccuccccgggguggcguggggcuggggcacccuccgacggcagagccuccuucagaaagugcagcucaagucuuaaagacaccaaaacugagccaugggcacgcgccgucuccgggccauggcguucacugcagggcgggggcggcaccgcuccccugugacugcaucccgccucccuggggaccugccuguggcaggaaggaauggggggccccagccccaggccgggaaggagccagcggccgacaaagcagaaacacccgcugcuccacguagccccugcucgcuguccuugcucucagaagucccggucccauguagauagaggggggcgcaucuuaccaaagcauuuccuccuggaggcuacgccgcugugcucccagucaggcggcugguagggagcuuugccugccccggggauacccucugccagccgcuggaagugggaaugcuggcgacagacuguguccucuuucccaccuucauagcaggaaucacccggacccgacuggcugggcuucgugcuagcgaggguucugggggugggucuuggugaucuuguccuauggggagucugcaguggucucagccacauccuauguauuuuggcucuggaggagcaaagcuguauccuggaguuggucugugauuugccgacagccuugcaggcugggcucagggacaaagucccccccaaaacccgcagguccucauguccagacgcugcccaguccuguccugaaaacagcacgccccaggcccacagaaccccccacccuacauuugccuuggguggagcugggggugguccuaggacugcgggugcccuuagcugaaggggguggggagaagcguggacugggcagccuguggguaauuggagguucauugagaauugagucuuuggaaacacuaagaaaaucaaauuuuuaaaaguuauuuauggccugggaaacaauuugcauuuguccccaaauacgcuuagcugugugccgcuuagaacgaugcgaaaccaucccucuguguaagcccgugccgugugacucgaagccuagcgcccucccugcgaagcaucagacgccacccagcccuggggggaggcccacgccugcuggaccaacgcggguucuggggugcacagcgccagguuaacgcugaagccugccccgcugagcccaggagccgggaggccugcgggcugacccagaauccgaucaugcaccuguccucaugccagcggcuuuggcugggguuggucugaagccugcacgcggcaguucuuuguuaaagaucugagggacuccucaguccuggggcgucgccgccugcagccucuuccaagcccugcguccagcgagcgucacagcacaaccugcaaaaacggagcugggcugcagcuggggcuggcauggacuuucauuucagagauucgguuuuuaagaagaugcaugccuaauguguucuuuuuuuuuuccaaugauuuguaauauacauuuuaugacuggaaacuuuuuuguacaacacuccaauaaacauuuugauuuua

SEQ ID NO: 192172 - RNA, 6826 nt, Homo sapiens
ugguggggaaugcaggauccacuuuuuuauugcaggaagacuaugucuagagcgaaggcuacacagaccccacgaugggggagugggggcacccacaugcggggggagagggggcaggggcggagucacagcaagcauggccuggcacaguccccagcaccagggaugcccaggcaggaugggccagcagccaggacaggcucggguccccuccuauugcagaugcccucucuccccagggucgggcagggccugaggugggagaggccuggaggugggcagggccccaaggagauugugcuaucagggugugucccugagaaagggccgcagaccccugcccagccucacucucuccggcaccuucagaacccagaagcuacugccaggacaggagaggaggcaacaucagcugcuggugggcccugggccagcccaaguuuuggggggacccagcucugcucagacacaaugccagcucuucugggagcccgguccacgugcuggauagcaacacacacgcacgugugcacacucccucucucugaguguguccaauaaacauuuguugaguaaacacucacacgaacacagaggaaaacaaacaugcuuguaccaaaucagacacgagcaaucuguuaccuacauagucccaccuggccacaugacuacagagacacaugugugcaaucucucucucucucucacugcacaaaagggcgugcgcacacacacacguugcuuccucacacccaauaagaccaaaaccuccaucucaccuucccucacuaacuuagcugccaugcuccgagccccgcuguggagagacccacaugguacagaacaaagggcagcuuccagccaacagccagcgaggaacugaggccuucagucuugcaacagcaaggaacugaaugcugcaacaaccacaugagcuucuaagaagcaaauccuuccccgaucaggccuucagaugagaccucugccuggcgaaugcuuugauugcagccuccugagaucccaaguagaggacccagccaaccugcacccaggcucuugacccacagaaucuaugagauaauaagcauguguuguuucugguugcuacauuuguggucauuuguuacacagcaguagcugacugauacagauuuggaaccgaaagucacauugcuagagucauguugcuauagaguggaacacagaucgugucccucaaucaggacaaacauauuuacagauaaaugcucucagauaaaccauaucacccacuccccaaaauauagucaugcucauacaggcacaaagauucacacagacaccucacacauauccagucuugcugacaaccacacacagguaucuacaacuacccaccucucuguauacccuacaccacuauuacacacacagacugccacaaaaacauaucaucccagacagacacacacagguauacacgcagaugcacuuagauacaagucacccauccgcgcaccccagguugcacaaauacaccauuccauagccacuuccguguauguuggacacaacccuguggggucacacgaguguggugucacucagacucucucaaaaaacacccagaaccucauggcugcagguacacucgacuccaggacgccaccuucccgggcaggcccugcucucuggggcacaggugguggggaggaaguggguggggcagaccucuguccggggcgcccucggauccugcuggugcuggcucccaucggcuguccccccacggggguguaauugauguaucucuggccggggccccggguacccccuccugagcaccccagguccccacccgccaugcguugcuaacgucucugucuugguggaagaggcgggucccgggugggcgguguccgggaagccccuccacgcccauggugccucuccagcggggcaguugugcuguggauguggcuggucccgggggugggauucggggcuggcaggggcacugcugcaggcccugugguuauugccugguggccugaggcccaucccacgggccccacaccccacugugaagacagaggagagaggugcgucuggaaccggaggagugggcacagaucagaggucacgacgggccgggugggcuuggguguauguuaacaccaaauaggagaaaaaagaaaaaaauaucugaggccgaugugcauuuucaacuccccccucccccagaaggucacagugaucaaaugugagggacaggacgcgcaggucuggcuggggacaccccagggaaagagauggaaacggggaaacgcagccuccucugguccuggugggaacaagcagcuccucuugccagcuccccauccuguuuucccaucugcaggacaagggggccaccuccggcucuugguuuuggaggguacagacagaacaggaggguggagagagagcaggggaggaagaaaagccccagcccugccucggggugggcaggggcagcggaggggggggcgguggccucgguuuccccagccgaggugucggaggaaggaugagagaagaggaggaggccgaggagggugucgguguugggggaggcagcgggggucagugggggugggcggcgggcaggcgggcguuccgggcucacaugagggugcauuugcccuugacgcggucuguccucuucugcuucccggagcgcuugccgucgauguugaggcucauguuccggcgcgucuccagcgucagcagcuccuggaagagcuccuugacguuguaguucaucuuggccgaggucuccaugaaagcgcacuuccacuccugggccaccgccugcgccucgcgcguguccaccucccgcugcgucucaucgcacuuguugcccacgagcaucacggggauguccuccacgcugcccuugaucugcacgaugagcuuguagaugggccccagcuccuccagcgacugcuugcuggugacggagaacaccaggaugaaggcguggcccuuggagauggacaggcgcugcauggccgggaacugguggcugccgguggugucugugaucugcagcgugcacacgcucuugucgcagcugaucaccugccgguagguguccucgaugguggggauguaggugucgcggaacgugcccuucacgaagcgcagcaccagcgagcucuugcccacgccgcccgccccgaacaccaccacgcgguaaucguuacucuguuccggcaucuuccccgcggcgggugggcggccggggccgggagggcuggugccagcugcaagaaccccagaccgagccugugcagagaggagggucacacgucaaaggccacccaggcuugaggggacagccccacgccccggggagggaggaggacauggcggcuucucagaggagguggcugccgugccuccugccuccugaaaaggcccauuugcuuguggcugacuuugcaguucugucccacaggcgggcgcacagccaacacccuuugcuuacuucucccuaacaaaaucuggggccugagcuuccccgggggacgcugagcuaggagaggcgugggagacgccgggaugcccacgaaacuccuuccccgggugugggugucccuuccaggcugugccagcuucccccucucuucccaguguggcaggggccccuggaagcuagcaggccuggcuuccaccucucgcuccacaccugccuggcucugagaccuugccgagccaucaugccacccugagccuguuugguggcucaaacggugcccgucuccaacaaccauggguccccugcucuuccgccaacccagagauggccaauccucauggaagccgcacauggucggguguuuaagaugcauaugucagggccgcagcccuaggugugaugaaucggucggccagggcaacggcccugggaacucguauuuuauuuuauucuucuuauuuauuuauuuauuuuuagacagaguuucgcucuugcugcccaggcuggagugcaauggcacaaucuuggcucgccgcaaccuccaccucccggguucaagcuauucucuugccucagccucccaaguagcuaggauuacaggcaugcaccacaaagcccggcuaauuuuauauuuuuaguagaggcaggguuucuccauguuggucaggcaggucuugaacuccugaccucaggugauccacccaccucggccucccaaagugcugggguuacaggcgugagccacugcaccuggccuucuuauuuuuuuuaaaaccaagucuugcucuguugcccagguuggaguucaguggugcaaucucggcucacugcaaccucugccuccucgguucaagcaauucuccugccucagccuccagaguagcugggauuacaggcaugcaccaccacacccggcuaauuuuuguauuuucaguagagacgggguuucgccauguuggccaggcuggucuugaacuccugaccucaggugcuccucucgccucgggcucccaaagugcugggauuccaggugugagacaccgcauccagcuggaacuuguauuacagggcugcucuccucaccugccauaaaugggauccugaggcugggaaucugagaaccacaauuugcaaaucagggcacugauucccaauagccgccccagggaggaagggucuugcagcccaggugggacacaaaaauacaaaauccagaagcugaacgggaaaaucgccacucccuaaacucuaaaaucaaacuauggccuggugugcccuagccccucccguucaggucugaaggauccuuagaauagcacuuccugggaggggcaccucuuagccccucucuuccuucuugggcucagagagguccagcagccugaggaggucacacagcacagcagauccugaaaugauggaggugggggaagaacgcuggggggagggcggguggcuuaucuccagaauugauguccuccccuccccuuccuccuuccaggcucuggggcagcgguggggggugggggagggguguuccccagcaagguggucuacagugggagaggaggaggaaccaguuucuaccugcugcacuggggguggggguguguuuauggggaggguccagagguuccccgggggucagugguuugaaccuaaacaggcaaauucaagucccuaagccuccguuuucucuucugugaaaugcgagccacuguuggggcaaguaaggugacaagguggagaaaggcccuaggcagugcccuguacagcggagaccccgaucacaauugugaucacagucacaagggcuuggggccggugggcagggcacuuggcugugccuguugguugcaaaggcaccuucuggauuaucaaggguaacagauuugccaggaaaagaaaagaggcugaugaaagcgccagcugacacaguccccaguugugaugagccaggcaaacuucugggcgccucggcaaugccaacucaugugauuggcugccggguuuguggacuacaugcauaguaauuucucggcauucggaggaggcugggggugcugguggugggggggaggcggccugugcugcagacccugcccuuuccugggugggcgcccugagaggcgggcacgcugcugugcagaaagacgccaccaagaccggccugggguccuaauggccauggguucuguggacccagauccagccuuugccuugcugcgggcacugaagcuccagcccccaugagcaguacuguccuccccgcugggucuggaaucccugaccagaaaggcgcuugcacucaacagccccgaagcccacgccacuucccaccuccaccgccuggggggugcggguggagggagggggucgugggcaccgaggcaggagcaggaggggcuggcucaaggucacagagcagggggguggaggcgcacagcggggcuggaagcccacccugcuuggcuagacuccugggguuucccgccugugcggggcagcccacccccagacguccaggcagggccaaucuaccccagcccugggucccugaagcccggcucccggccgggcacggcgugguuggugggggcgggggugucaaagcaaagcucagggucaggaaagcagagagagccgcgacccaggggucuagcgggggucacgccugaccaaggguggggcgggggucugacccagggccgccuggccggugagggguuugauggagaaagggccugcucuagggggcccgagggcgcagaggcacagugcggggccagcccaggggcgacccuugacucaggaggaccucagugguggagaggaggagcccaccccggggagggggcgcggagggaggggcuuggcugggcagcggggcggagggcgaagaaggcggcugcaggagggaggaggcccugcccgaggggaccaaugcggagaggggcggcggggugggccucgguggggcgggcucggcaggggggcgcccuccgggugggggaggggaggcggccgggagcuguccaaggugagcgcggaggggccggccgggcccggcgggaagggacgggggacgcccggcgaggggccccggagccacgcggggaagggcccggccccaaggcccgggaggcuggggccgggacaaaggagggacgcgcggcggggaggacggccggcugggggcugcgcagggacccccuccccgccccgggccgccuaccugggcccgcuggucccugcggcgccgcggccgcugcuccugcccgcuccgguguccgcuggcgccgccgccccccgcccgcccgagcc

SEQ ID NO: 192173 - RNA, 11375 nt, Homo sapiens
guugccauuaggggacuccugagguccuaucuccaggcugcggugacugcacuuucccuggaguggaagcugcuggaaggcggaccggccgccauguccacguucaggcaggaggacguggaggaccauuaugagaugggggaggagcugggcaggugagcugucugcccgcacggcugggcuccagggauaggagagaggcgcugugggguuuucugaacagcagcucuccuuuccuguucuuuauccuguaugcugagaaggaaugagucaguaucaugcggugggggaacgaauuugggccguggagucagacagccccggcugugaauuccugcuugggaauccucuguguguuuccuguggggagaaaaguaauugagccguuacagcagccaagaccgugccuggcauggggcaccagagcaacagaugccagcugcuuuuguuauuaaaagaugugucuucugccugggcaacauagcaagacuccaucccuacaaaaaauaaaaaugaaaaaaaauuaaccaggugugguagcucaugccuguagucccagcuacuagggaagcugagacgggaggauggcuugagcccaggaguuggaggaggcugcagugagcuaugaucgugccacugcacuguagccugggcaacagagugaaaccccauuuauuuaaaaaaaaaaaaaucucccuguguuaauccucuuuugugggaggcacuuuaguuuuuuugcccagcucuuggauguuuaaaguggggggagggaggggcgugucucccagcugggcccaaaccucggucaauuguuuaacaugcuugugggaaaaagcagagguuuccucuuccagggaggcagcugauuuccugccugucugggccuuggagggucccccuggggccccacccccuccagacuagccaggcaccacuaggcccugccuccuuuuguagagccuccagccuuauuuggugaguuugcuacuggccagccucccuggagccuccccaugaugucaccagaagggaauguaaauaagugagcucugugucaggcuagggagagugcugcaggcucuuuugggauccugaggucccuccuucaggaauuuccucguuaguggcagagaaagcaugcucccuccucccccuucucaugcuucaguguugaccccuccugcuaggggucguuuggcaaaagucagcaaaauucagccaaauuucuuuuaacucgccgauuucaccucuaggaauuaauucauuggaaaacuguacauacauggauggaaugacuuaagacugggguaguugcuagaacguuuaccagaauaacagccuuuuuuuuuuuuccuugacacuaucucauucugucgcccaggcuggagugcagugaugcgaucucgacucauugcagccucggccuccagccuagccucccgaguagcugggauuacaggagcccgccaccaccccuggcuaauuuuuguauuuuuaguagagacaggauuucaccauguuggccaggcuggucucgaacuacugaccucaggugauucaccugccucggccucccaaagugcugggaucacaggcgugagccaccgcaccccgcugggaacagcagccucuuaaauggccuuccccaaaccacugcaucagggcuggaauaggaugcagcuuguaaaaagaaccaggcagggccaggugcggcggcuuccgccuguaauucuagcgcuuugggaggccaaggcgggaggaucgcuugagcccaggacuucaagacuagccugggcaacauaaguugacccccaucucucaaacaaacagaaauucauaauuuuaaaaaaaguauuuagccuucuguuuuugccgugaagccuuggaggucugguguguauuucaugucgcaguuuuucucgggacuggccacaccucacggguuugacagcucuggguggccagugucugcuguucugacggcacugcuucagguaguggucuggaacauucucagagauacaugaagugcaagaugaaggcccagaauguagcaauuuuuguuuguuuguuugagacggugucuggcucuguugccgagacuggagugcaguggugccaucuuggcucacugcaaucuucgccucccggguucaagugauucuccugcuucagccuuccaaguagcuggaauuacaggcgcccaccaacgugcucagcuaauuuuuguauuuuuaguagagacgggguuuugccauguuggccaggcuggucuugaacuccugaccucaaaugaucugcccgccucugccucccaaagugcugggauuacaggugugagccacugugccuggccccagcccacacuuuuuuuuugagacggagucuugcagugucgcccgggcuggagugcaaugccgcaaucucagcucacugcaaccuccgucucccagguucaagcgauucuccuugccucagccucccgaguagcugggauuauagaugccugccagcacgcccggcuaauguuuuuguauuuuuaguagagacguggcuuucacuauguuggucaggcuagucuugaacuccugacaucgugaucugcacgcuuuugccucccaaagugcugggauuacaggcgugagccacugugcccggcuucccagcccgcauuuuuaaacaucaugaacucuaucaguagaaauugucgguguguaggccacgcuugggucgugucuggguuguggcaggcacuuaggaaguggguugggagugacaccugagaccaucacugaggagggcuugcugugcccccaccugcgcugggggcuggggaaguuacagagaagcgaagagggugggcucagcucuuggggaguuucuuucccggcuggggagaugaggcacguuucacauuccguagaggaacugagagccugccaguggccuugccucuaaggagcaagucuguggccagugagaccgggggcugucuggaggugggcggcuguggucugcuguugcuguaggaggacucaguggcagaaccugaaaucugguuggcaauagcaaaacagggaaaggcgugguuuacagaaccagguuguccaggugugcagcggccgcaggugugacugggugcuggugcauauggugcccuguguccccggggccgaaguccacuccagcauggaggaggcgcccuggcagagugaaugacggggcuuaugugccacccgcagugccugguggcuccccucuccuggccuggucuguucuuaggcaggcuucuuagguagccuucuacgugguggccccugccgcgagccuggauccaagcccagcagagggagagagagauccucucuucccagcaggcguucagagcccuguggacuggaccggucucuuugggcuggaaggcgugguuuucugcuugcccagguccagucguguccccuuccaccccuuuccugggccacugagucccacagacugagagugagcggcaaaggcugcccugggacagcugggucuguuagcaggagacagcguggagccgggagguaggcacgcaggaacccgguacccagcagcagcugucugcuuccuguuagagcaccugggcucuggagccugcagcaccugguuugaagguuugaauccucccgccacugacugacugcaugaccuugggcuaguugcuuuccuuuucucagccuugguuucuuuaaaaugcggauacuggccagauguagcggcuccaccuguacugccaacacuuggggugggggagugggaggaucucuugaggccaggaguuccaaagcagccugggcaauacggcaagacccugucucuacaaaaaauaaauaaaucaggugugguaguguguuccuguagucccaccuacuugggagggaucacuugagcccaggaguucgagaccagcgugggcaacauagugagaccucauccuuacaaaaagaaaaaaaaauuaauuggguguggugguaugugccuguagucccagcugcuugagaggcugaggcaggaggauugcccgagcccaggaggucaaggcugcagugagccaugacugaaccacugcauuccagccugagcaacagggccagacccugucucaagacaaaacaaaacaaaaacaaaaaaagcggaucuggcacuugccuugcacuuuuuauuuuuuugaggcaggaucuugcuacguugcccaggcuggaguacaguggcacaaucucaguucacugcaaccucugccucccagguucaagcgauucuccugccucagccucccaaguagcugggauuacaggcacccgccaccacacccagcuaauuuuuuguauuuuugguagagacaggguuucaccauguuggccaggcugcucuugaacuccucagcucaaguuaucugcccuccucgaacucccaaagugcugggauuacaggcgugagccaccgcgccuggcccccucaguucccucuugauaugcauugaacuguucauucuuucacuuuucaaaaauacgccggugccaugguguuaacguguggcucugcacuccccuccacacaccugcugggcauagcccugggaggggugggaacgccgcgucugaugguguggggcgcuaaggaauugcucucugagaaggcgcagagucugcacccccgcaguggccagcucauguccuucaagugccuggugcagggccgcgcccaagaggagcaaguggaggugacggggagccagccacccccacuuacucccuccgccuccuccacccccacucacucccucccccuccuccagcggccaguuugcgaucgugcggaagugccggcagaagggcacgggcaaggaguacgcagccaaguucaucaagaagcgccgccugucauccagccggcguggggugagccgggaggagaucgagcgggaggugaacauccugcgggagauccggcaccccaacaucaucacccugcacgacaucuucgagaacaagacggacgugguccucauccuggagcuggucucuggcggggagcucuuugacuuccuggcggagaaggagucgcugacggaggacgaggccacccaguuccucaagcagauccuggacggcguucacuaccugcacucuaagcgcaucgcacacuuugaccugaaggugagcccuguagggcccuguggggccggccuggccaguguggggguggggauggggcggggaagagccuggaaggcaccuccugcgcgugggggugagguguggggagcgugggggugagguuuggggagcgugggggugagguugggggagcgugggggugagguugcggggagcgugagggugagguuuggggagcgugggggugagggugggggaggcccgugcuuucccugcugagccuccucccaccccagccggaaaacaucaugcugcuggacaagaacgugcccaacccacgaaucaagcucaucgacuucggcaucgcgcacaagaucgaggcggggaacgaguucaagaacaucuucggcaccccggaguuugugggugaggcccugcccagugggcagccccggccuggggaggguggucuggggcugccugcugugcguggggugggucaugcccggugcugggugccgcguccucggcccugaagccaccccucuugggcccggcuuugcgggaggucugggccuccauuuggugcagccccgcuguccuacccgucaggcccugagggccagcucugccgcauucaugcccccaagggcugcgacaugugagaaccuugaccccaugccugugucuugagccucuuccuuggccagcauguccccagugccugacccacaucucccuguucugcagccccagagauugugaacuaugagccgcugggccuggaggcggacauguggugaguguaccaccugcucccaccgggccucccugcauuccuggagcgcaggccagugcugcagcuggggaugaagcggggccuugcugcuguugggguauggggggaccguugcccuagaacaggggcgcuggacgccacgguccugggagggugggcggccccacgcugcgcugacccuugccucuugucuguccccaggagcaucggugucaucaccuauauccugugaguaccuggcgggggcccccucggcugugcaacacagcuggcauggguccccggcuccgugugucucauguggacgccagggguccccagccuggcugugacccaucgcggguacucaggggauaccgggugaacggaugagugauucucuguggcugcugucacagaggcuucuggagaguucugaaggcaggacacucacagagcggcugagcaggcuccggguugggggucgugugugcuccugucccucuggcugcuagggagcccagccuccucucgaagugcaaggaagggguccgaccccacgcuggguuuuggcuccugucccugggccacacgugggccugcuguuguuuauuauuuuuauuuguugagacggggucuuacucucuugcccaggcuggagugcuguccuagcucacugcagccuccaccucccagacuuaagcaauccucccaccucagccuccugaguaccugggacuacaugugcacacaaccaugcucccaugcucggacuuuuuuuuuuuuuugauggaguuuugcucuuguuguccagguuggagugcaguggugcgaucucagcugcucacugcaacccccaccucccagguucaagcgauucuccugccucagucuccugaguagcugggauuacaggcgcccaccaccaugcccagcuaauuuuuguauuuuuagaagagacgggguuucaccauguugaucaaggcugguuuugaacuccugaccucaggugaucugccugccucggcuucccaaagugcugggauuacaggcgugggccgcugcacccagcuggcuaauuuuuuuuuuuuuuuuuuuuuuuuugagacagaguuucgcucuuguugcccaggcuggaugaagugccaaggccccgucucagcucaggcuuacugcaaccucugccucccggguucaagugauucccaugccucagccucccaaguagcugggauuacaggugccugccaccaugccuggcuaauuauuuguauuuuuaguagagacgauguuucaccauuucggucaggcuggucuugaacuccagaccucaagugauccggccgccuuggccucccagaaugcugggaugacaggugugagccaccgugcccagcuggcuaauuuuuaaaaguuuuuguagagguggaguuucacuguguugcccagccauauugaaugggcauagcucauucaguaagcaaggaaauaaacaauggcgugggcccagcccgcuguagugcgugagcggacccaaaggcuucaggagaugggcuagaccguuuguauucuuuuuaaauguucagauaauucagacuuacaaaggagcaacagaaacagcacagacgcccccugcagcuuccuccuccuucaguuuacauuuuucaugaacacgaacguuaugaacaccaagacguuagccuuggugcuacgcuaaucacaaaagugcuagaugggccgggugcgauggcucacgccuguaaucucagcacuuugggaggcugaggagggcagaucacgaggucagggcauugagaccauccuggcuaacacgaugaaaccaugucucuacuaaaaauacaaaaauuagcuggguguggcagcgggugccuguagucccagcuacucaggaggcugaggcaggagaauggcaugaacccaggagauggaguuugcagugagccgagaucgcgcuacugcacuccagccugggugacagagcgagacuccgucucuaaaaaauuuaaaaaauuuaaagugccagaggugguuagacacccccguuuuccacuccuguccucucugagguccccacacggcauuuagccauucagcuccuucgccgccuccagucugaggcuguuccucugucuggcuuucaugaccuugacccugacuugugcucacgggucagguguuuugcagaaggcgucugaguccacguuuagucucgugcgcugucacgaucagacgaucagacggggcuucagugucucugcucaaaaccccagggaugaugcugugucacccucccagcgucaggcugggaggcagacgcuguuggggccucucacugccgggcuguugaccuugauccuuuggcuaagguguuggcucgggcuccccacugcaguuacccuccccucggcguuacugagcacugggggcuuucgggcucugcgucugcacagauacuucgagucuccaaggagacuucugccuguucauuucugcugcugucaguggcgggguggggggguggauuuugaaugccucuuggguggugucugggaucguugcaggaagguucuaagggcucaggagugugaguggcccaggcaccugccgucagccugucuucugugcuccgccugucgugggcagccggagaggcggcgcggccguggugggagcccaggaccccacugagcccccacgccugucucgcagccugagcggugcauccccguuccugggcgagaccaagcaggagacgcucaccaacaucucagccgugaacuacgacuucgacgaggaguacuucagcaacaccagcgagcuggccaaggacuucauucgccggcugcucgucaaagaucccaaguacgaggggccggcagggggcacggggugggacaugggacacaggcccacuccacccacggaggcuccagaggacucuccucccagcgccaccucccugcggcuggggaucagacauugcuuaccccuugggcuggagagaguaaacugauaaacugguggcccaagcuggccauugccaugguuuuuuuuuuuuuuuuuuuuugagacggagucuuuuuuuuugagacggagucuugcucugucucccaggcuggagugcagugcaguggcgugaucucggcucacugcagccucugccucccggguucaggcuauucuccugcguuagccucccaaguagcugggauuauagacgcccgccaccacgccuggcuaauuuuuguauuuuuaguagagacagggcuucaccauguugcccaggcuugucuugaacuccugaccuccuugguuugugauuugccugccuuggucucccaaagugcugggauugcgggcgugagacaccgugucuggcugcuugcuguguuuuuagcaaacuuuuaauuaguugccgguguguaaaguaaggauccauguaaaauuccaggucacuuguuuuccuguaaacacuuagaauucuggcagugcugagcccucacucguaggccuccccgggccuccauggccgcccagucccucucucgggcgccuggguuugcgacuccagccugaggucucagcucucuccaccaccccccagaaaaccccacgcucccugcaguacccuuguucagcuucugugguuggcugagcagaggcuggggggcgacuuuagggcuuuugggggucccgggagucaguuguucacgggaggacgggacagauggugcagguguaccuaaccagagcgggggucuuccaggcggagaaugaccauugcccagagccuggaacauuccuggauuaagguaaguggggaggugggggagcucccugggcuucccgccuuggccuucucgcuggggucccggggggccuucagcauuuaaggcuuguggaugugacaacccccaguggcuggggaggguccccagaggagugagccuguguggcggggguuggguccugggcgugggauguccagcacccgacagaccugguggcauccuuggcugguguguguccaacggggcugacuccuggggccagggccgcagcguuuuucucgagagagcacucucggcuuugcgucgggcugggcagucuccgucacgaggcguugacucugcugccggaugagccccugaaccucaguucacacuggcaggugggggcuggcggggcuggguggcaucgcggggaccccgcucaggcuucccuccuuccuaggcgauccggcggcggaacgugcguggugaggacagcggccgcaagcccgagcggcggcgccugaagaccacgcgucugaaggaguacaccaucaagucgcacuccagcuugccgcccaacaacagcuacgccgacuucgagcgcuucuccaaggugcuggaggaggcggcggccgccgaggagggccugcgcgagcugcagcgcagccggcggcucugccacgaggacguggaggcgcuggccgccaucuacgaggagaaggaggccugguaccgcgaggagagcgacagccugggccaggaccugcggaggcuacggcaggagcugcucaagaccgaggcgcucaagcggcaggcgcaggaggaggccaagggcgcgcugcuggggaccagcggccucaagcgccgcuucagccgccuggagaaccgcuacgaggcgcuggccaagcaaguagccuccgagaugcgcuucgugcaggaccucgugcgcgcccuggagcaggagaagcugcagggcguggagugcgggcugcgcuaggcgcaguggggugggccaggccccaggacagccggagcucggccugcggugggggcgcuuccuguggacgcugcgccucccaucgcccgggugccuguccuugcccagcgccaccaggcuggaggcggagugggaggagcuggagccaggcccguaaguucgcaggcaggggugggugugggacggggcugcuucucuacacagccuccacgcuggccuucaccuucaccccugcaucgucggugacccugggacccuccaggcagcguggccuguggcaccgugaggguugggacccaccgaggcgcagaggcggcccgaaugcagcccugguucaggcccggaggaggguuugcggguaguugcacggacaauucggcggggugcugccuguugcugccauuagcccaggaggaggucgugggacggggagggugggauggacggcggacaggcaguccccacgcugcuggguggcgccgggcuugguggggucuuccacugugugcccuucucgccgaggccggucccccggguguggggugcccugcugcggacuccuccgcgagccccaucgucgcgccuguggacgccuaggcaagagcggcccucugcagccaagagaaauaaaauacuggcuuccagau

SEQ ID NO: 192174 - RNA, 70299 nt, Homo sapiens
cucccuuggccggcggcgcuuguuguucggcggcggcggucgcagcucgggucccccucgggcgcccccgccgccguccgcgcgcggccauggagcuggagguaccggacgaggcggagagcgcugaggcgggggccgugcccucggaggcggcgugggcggcagagagcggggcggcggcagguaacggcccggccucccggggcugcggcccgcugggcucguccgagcgccgagagucgcggggcugcggggccggggcgggggcugcacggucgcugcgggggcgccgccgguuccaggagccuggggcggggcaguccccuggagccgcggggaggacggggcugaagccgcgccgggaagcgggaggccugcgaggggcuaccucccaccgcucccgggccgggggcgacucggcgugggcgccgcuggggauccccguucugccugacccgcucccaggggcugcccgucgugugaguggcggcugcuuggguggaggcgggggucucugaggccgugcgugcccaccuccugaugucaccucccuuucuguaaguccccagaccugaguccgggugcgcgaccuuuccucaccuuccugggccucaguuuaccucccugcuaaaaugaggggaggaaaaggguuacaucucaagaugccuccaccgccccggcugugcacacagggugcccugucgcccccuuuuccucuccccgagccuucccccaggacacacugguggggcugcgggcugggcggggggcacggcugucucaugcccccuuuagcugcuuccuggaccuccagccggguagguggcggcagcugggccuucccuucuguggggacggugugcagagcccagaggaagggaacaguuccuucucagucgaggucacaagcucccaaaucggaaguuuccggauucacaaaauccucugcuccucccaggcagccagcagcagcgucucuguagacacccacacgggcauccguccuccuucuccccccaggccucccgaagcuuccuugguuggcaggcgggcaagcgggcgggcgggcgaugcgugcugccugggaguuggggagaugucuggagagagagagaguguggaagucaucaagucccccccccaccccccgccuugaaagacacucguggcuucccucccggcggccaucuggaaccgcuugguaggugacccgguuccuuccccagagccaguggccucgccccuuucuuugcgggcagccgguguccuggccuggccagcaagagacaugguggaggaacccaggcagggcaccaggccccagcccggguuccuuucuugggccccccaacuuccgcugucagcccucugaccccagcuggucagagacaaaguagcccaggacucgcugaccaaaagaaaaccacaccgcgaccauucaucuuaucaggggcucugggagcaccggggacagauaaaguugccagcuccagacugagcauggugguggggugggagagcgggggaguggggggguggggguggggggccggggagggcuggaaggucagggucuggcaucucugcccaucccugaaauccacagaaaucugaccccagcuggccauauacugcuucugaauguuuaaaauucagaguugccucacuccuccaacgccaucccuccugauguuagcgcuggugaguuuagguugugccuggcugggccacagagacgugagcacauaaaggggccugcuuguucuucaccgagaugguuucaugccucacuggggcuucugugccuuggcagagguauuuugagucaggaaauuaggggugcugagcaacgccccuggcuucugcccacuccaugccaggagcaccugccaguugugacagccacaagugacccagacaccguucaguguccccugggggcaggacggcccuggugagaaaugccacacguuuaugacucugugaacugcuugcuuuuuaucucuggucaucuggagucuccccacccuauguugguaucgguuuguagagagggcgagcgccaggcagugguuaagggggagccccagaguuggucccgccgaugucccccucccagcuccgcgcuucaggugcuguguggccgucacuuccccgggcuucagcgucccgucugugaaguggggugaugaccgugugugcuaggggcugagccugggaugaguuggcgcucgugcuuggugauugucgugccgguuggccaccccuuuccggccucuccaccaucggugccuccaggccccugcugaggcccaugcccgugguuucuggagucaccgcucacuguuagaagcgauggcgacaccuuccagaaagcucagcuacagcgggagccuuguccgacaggggccgagggaggcugcccguuucccacggcacugccagcucccagugucaucguccuuggcgauuucggcugauccgaugggaggcaaagcaaugucucguugguguuuagaauuugguuccucuaauugccugggcuccuggcucccgaggcguggccugaauggcgucuccaugggccguggccguggggcacgugggggcggucucgggaaggccggggcuugggaugcggcugugcccacugugugggccgauggccugugguggaguuuggucugagcuguggccugggcgugucugagccucucccaggcuguccugucucugugaugccccagaacggucagcuccaucccugccccugccccacucccacggcugaucugucucugugaugcccuggaaaggucagcugcaucccugccccugccccacuuccacggcugaucuggcagcaaaugauggcagcuucaccuucagaacuggcccagaacccacugacuccuucccuguccucugccucucccggguccagcuugguccucccggguccagcuugguccucccugguccagcucgguccuccccgguccagcucgguccuccucgguccagcucgguccuccuccguacagcucgguccuccuccgucuggcugaguacuccccgguccagcucaguccuccuccgucuggcucaguccuccucugucuggcucgguccuccccgguccagcucgguccuccuccguccggcccaguccuccuccauccggcucgguccucuauccggcuugguccuccuccaucuggcucgguccucccggguccagcucgguccuccccgguccagcuuaguccuccuccauccggcucaguccuccccaguccagcuugguccuccucuguccggcucgguucuccuucguccggcucaguccuccuucgucuggcucgguccuccuugguccuccucgguccagcucgguccuccuugguccagcucgguccuccccgguccagcucaguccuccuuuguccagcucgguccuccucgguccagcucgauccuccuccguccagcucaguccuccucgguccagcucaguccuccuuugcccccugagccaggccuggcgccccugcucuuccucugcucccugucccacauuccaggaggaccccauuaaaaaccagcggcccgagucccgacccuccucugcucgcagcccuccauggcucccaccucccuuggggucaaagacauaguccucuuugaagcccaucaggcccugcacagccugccccgggcccucccugcccucccugcccuccccuccgcacucugcccucccugcccucccgucugcacucugcuguaggcccaugggccccuugcuguuccuccagcaugcagggcaugguccugccccggggccuuugcacggcugccccccacccccaccccggaaugccccuccucccaucuguguccuuugcucccuuagcgcuuuccagguuuugugggagcaucuccucuccgugaggccucccugcccugcugucaccacacagcggucuccccuucuccguccccugcccucccgguuccucuucccugauugugccaccauagcguuugucaccaccugaaacauauggcucugcugacguguuuucugaccaucuccuccugagcgagagcuccacgagggccaagaccgucugugccacuccugcggcauccccugcgcccggaagagcucagcacagugcagauccuggugaacaucaggugcaugaggccagcagugccagggaggaaggguaagguagaaugggguggcugggaaggccuugccaagaagguggcauccgagggagaccugugggcauugggcaggaagagggcauggccccagcagaggccccgccugccuggagcacaguguaguguggucacagggcggccgggcagggagucagcaccgccaccagggccucccuguagcugugguggucuguguaaaaaggucagggaggccgggcacgguggcucacaccuguaaucccagcauuuugggaggcugaagcaggaggaucacuugaucucaggaguuugagaccagccuggagcaacauagcaagaccccugucucuacuaaaaaaaaauuaaaagaaguagcuagacguaaugguauguaccuguaguuccagcuacucaggaggcugaggcaggaggaucaccugagccugggaggcugaggcugcacugagcugugaucgugccacugcaugccugggugacagcagaaucguaucucaaaaaaaaaaaaaaaaaagggucagugggauuguggugucucuuguugcaagucagcagggcccaggcggaggcugaggacacuggggacggaaaguuccccauucucucccgcccuggccgccucccgggaugcaggucaggcacugugaccaccacagccugggugucccaguggagaggccucgggggccggcccuccuggguucacacccagcgccauugcaugccagccggggaugugcagccucgguguaccugucuguaaagugggcgugauggcugccuuucuccugggcugcauggagaaucaugggguaaagcccuuagaaggcacgggacaggcagccggccccgugagaaagcugggugcccccuccgucccagguugcuguuggaggagagggaguccccuucgugugcugcuuccggggcccaggugccaagcgagcucaccugggcgcugggguccgccaugggagucggcucgugaaagugugaguuccacuccugggcuccagaccuuuguugagcaccucgugugggccagguggggcucagggugcccagucuucuggugcuaacgggacugccucgcugaccccuuggagcccucagguugcugggcgucaggcugcagaugggaacaaguggccacgugagaccccacccgaaucuguccaugccgcuucuugucaacaaaguuuuauuggcaacggccacaccauuuguuccguugccggccuugguggcccccacgcugcagcggcagagcugggagcugaguggccaugcuuggggcuacgugucccacgaagccgaaaacacuugcugcccgguccuuuacggaagauguuugcccagcccagagccgggcugcguugggcggugaugaguguggugagggcaccugggaggucaaguggccaggccugcggcagcugaggacucggagggaggugacuguccccacgagcugaauaagggugggcuguggcucaggcgauguaggcagcggaauagucgcgccgaggccguggggugggaacuugcugcacccacuugagccgcagaagugaagucaacguggugggagagggucgcguggggucggaccugaggacagcggguggcacgggcaucugaguggggcggcgagcccgauucacagcgccuggugggggaugguccgugggcagugcucugugggguuggggcagguguccaggugagugccaccggugccuggaggcagacgaggggccuggaaggauuuuggccugggcccuggagcugguggcugggguggcgaggacugaggacagagcaggacugggagcccaggcacuguggcaggugugugccgauguggggugagcaggcaguggggacccccaaagcagguggaggcuccgggagccugggcaggguggucccagggccuggugugggcugagccugccuuggccgcuuagacccgugugccucugagcaagugacuucccuuuguuuuaaauuuuuuuuuuuuuuuuuuuuugagauggagucucgcugucucgcccgggcuggagugcaguggcgcguucucggcucacugcaagcuccaccucccggguucacgccauucuccugccucagccuccugaguagcugggacuacaggcguccgccacuacgcccggcuaauguuuuguauuuuuaguagagacaggguuucaccguguuagccaggaggguguugaucuccugaccuggugauccgcccgccucagccucccaaagugcugggauuacaggugugagccaccgcgcccagccucuuuuaaauuuuuaaaacuuuuuuguagaggugaggucucacuauguuguccagggugcgagggucucgaacccuuggucccaagcagcccuccugccuccaccucccaaagugcugggguuacaggcaugcgcccccaugguggccccuucuuucccuuuuggaacaagagcugcggguguccugagugccuggcaggacagggaugggugaggcccuagccccugggaagcugcacgaccugggucuuuguuuacagauggggaaaccgaggcuccaggagggcuggagaguccacacaggguggggcugugaacgaggagcggggcccaggccucccugccgccugccgccugccgccuggccccggcagcaugucccuucacgcaggaccaggccggucaagacccugcaaggauuugccagcaggcgccagcuggacggggcccgugguggugccaguacucauggggauuacagccugaggggauuagcucggagccccugcaccugccuccccgccacccugagaggccagcuugggaggggcuggagucgagcaugagggcccccaggugccugagcuggcaugggggugcgaggggacccggccucuggcugagugaagagaggaccccagcacccugcccggccgcucuccuccacugaaaugccucaugccuccacuuugcaggcagggcugcugcugaagguuuccgggaguggggugugguucgggcaucgucuacgugugcuuuccugcgugugcuguggccgggugcugggagccugggggaacgagagggccaggcccccuaaggaacucugggaguggggccaggacauacagacagcaaagaaaagcaaaacacgcaacgcaguggacaagugccacggagaagagccgagcagaggaggggagagaguggcggcggaggugcccucaaggcuggggacucgggggccacacuugaacagagauccaggggaagugaggggguuguggaaguguggagggagcugucuggcagaggcacugugcaaaggcucuggggcaggaccacgccugguguuuuagaggaacagugaggaggggagggcagggaggggacggggcagggugugcagggccuugugggcugcagggaggacuugggcuuugaccccaagggaggugggagccauggagggcugcgggcagaggagggaugggcgagacucaggagcucacaggcacccccugguggcugcuguggggaggacagauggggugagggcgggacgugggcuaggggaaccagggcagaggggacugcacuggcccaggugggcgaagcuggggcugggccagguggggaccaugagcagugcgccaucugggauggauuuuggaagcagagccagcaggaccuuuugaagguugaguguggggcugaggggggauugaguuugaaaucaagauuuuagccugagcccuggaaggacagagcugcccucagccaagauggaugcaggaagggcagcaugggggccgccggggcccagcauggccgagcugcgagggaggccccaggagccccuguagggagcguugggggccguggugggagccggcagugggacuggguggggccgucgggacccuggugguggcugugcucaguggacggugucucuguuccauugugcuguuggcaggaggacagcugagaugauuggguucgguugcccagccgcuccgugccucaguuuccucauuuggaaagcaaugucccuugaggauuagaugagucaaugcacacaaaaggcucagagccggcccugcccauggugggcgcccagggaguggggacagggacgugagcgggcagcucccacugugcacccuucccgugcggugcuuggacuggccacggugcaugcgcugacaugggcggggcugcuggggcagggaaaagagccuggggugggagcagcugccucggggccugugccugugggcgcguaugagccagccuggcuuggcgucugcugcuaaaacaaacauccccacucucccggccaucccagaggcucauuucucgcuuguguugggggcuuuggugguuuugcuccccgaucucucagaucccagguugacggaggugcugucacccccagugcaguaaaggcucuaugcuucuguaacccagaaaggugguacguguauucagaugcacucugauugguuuaaaucaggccuggugaggccaagagagcaggaggugacugcuauugaaaagcucuuguguuacaguucccgaggcuuugguuggaagggacgggccaggcgggguagaugggcugggugugccuaggaugggcugguuugacucccgacuguuugcggcucuuggcuguugggguggucccuguucugggagcuggcccuggggugauucagggcagggaaccugggcguggcgcgugagaguuugaucaggugcgugggcucgcgguugguugcucugcacgucacagugugcucgcaggcgggccguuugcaacguuuaggaauccgcuuacccuggaaggggccgucauccccagauuagcgaggcccccaagaugucguaaaauccagaaaacaaaacgcagcaucagcacuguaccagaccgggcgcuccguguuccggcagcggaggacgcguccaucucucccauccucagcagccauaugggugcaaggcgacuucuucccucacugcgucauugcagcguauauucgucuucuugugacucagagaaaaaguccuuguggcucuucgcagcauuuccucuuuguuuucuuggaacugcguuuccacaaggggagcagagaccacuagaggcgaagggacucgccacacaggagcucccucccacuccucccgacggucaccuguguuucuaucaagagcuggaaaauggaguguccccaccagggagacggggucaccaccgaggcuggcucugagcugccucagcuccugcaagcuccguggccccgaccuccacccuccccggcccauuuuccuugcacaguuccuucuuguaagcacacacgucagguugaacucugaccucauuuucugggaccuguaugauugugucuuucccagucuacaguuaucugucaccauuuuguugauucguaggagcucuuuauuuguuauggcagcuacucauuuauuggugacacaagugcagguacuucuuugcccaucuucuccuacgaugauuguuaacgucuggcagguauuuugggguuuauguggucaaacuuaucacucuuuccuuuucugguuuccuaguuuggugucaugaaugggaaagucuuccuguucugagguuaugauuaaauucugcuaagacuuuuauaacuuagcuucuuuuuuguucacauuucaauucuuuuuuuuuuuuuuuaagacagggucucgcuguaucacccaggcuagaguucagugacacgauuguagcucaccgcagccucgaccuccuggguucaaaccagccucccaacuagcugggacugcaggugugcgccaccaugcauagcuaauuuuucaucuuuuauggagacagggucuucccauguugccugggcuggucucgagcuccuggccucaagugauccucuugccuuggcuucucgaugugcugggguuacaggugugagccagugcgcccagccuauuucuggacuuuuuauucugcuccacuccucugccuuuaccuucaugcuacagccaugucucgucuugaacaaaugauaacauguucacaguuaaaaaaaaaaaaaguaaucagacuugcagugaguaaaaagugagucccaccucacccucuccaucucuguggagauaaugacugucaccccagguguuucucuggcccauacacuuggggcucagauuauauuaggcuauuaaaaauaguuuauuuggaaagcuuuccagccuauagaaggggcaagaaugcuacagugaagaccuguacagcccgcacagagauccaccagcugcuaacguuuugccaugucuuuaucauucuguguguggggggggaguguacguuagugugugcaaguuugugugugugagagugcaugugaguuaguguguguguguuagcgugugcgugugugauuaugucaggccauuugcguguugauugcuggcaugguaccucucugccugaagcagccaguuccauuauuugugguaguucuuuauuuuauuuuaauuauuuuauuuuuuugagacggaguuuugcccucucguccaggcuggagugcaguggcgcgaucucagcucaccgaaaccucugucuuccgguuucaagcaauucugcugccucagccucccaaguagcugggauuacaggcgcccgccaccacacccggcuaauuuuuguauuuuuaguagagacaggguuucaccauguuggccaggugggucucgaacuccugaccuugugauccagccaccucagccucccaaagugcugggguuacaggcaugagccacugcgccaggccuguuugugguaguuccuuugugaagcugcugcagacacuucaggcgcacacugagcccuggcuccaggggaaacccaaggucggguuccugugagccucugggcaugauguuuccaucagccagucgauacgugaccuuguuguauguucguuuuuauuucaaggcguguuauuuuagggcugggugcgguggcucacaccuguaaucccagcacuuugggaggcugaggugggagaauaacuggauuacugagcccaggaguuugaggcugcagugagccgugauugcaccacugcacuccagccugggcgacagagugagauccuaagaaaauuuuaaagacacccguguuguugauuuauccacagggagcucacagaccauaggccgcgugcgccaagccccccccaccccccagccccaucccgggcacucucccaggcccccgcccauuugcaggcuguguuggggacaaggcuggaagggggaccgggggcauguauucggcugugugggggcucaaaaacgggguggggggccauggcgacgugggugugggucccccucccccggcccaccagcucggugugucucucgcucucguucuccccccacucuccucucucucucucucuuuccgcucucaguccuguuugagcaaagcuucucucacuacggguuucuccauggggcucauccgggucucuagcccugagggacacgaaaccaccugaggacaaugccugggggggcaauuucagcagcagaaucaccagcaaaaccgcaaaaaacacacgcggcucucaguggaccagggaaaggccaggugcucacagcaggaguugaaaccagggggcgaggguggccucaccggagcugccuggggacgugugugccccagaguccugggggugcugcccuggaaauagccuuccggucuucuagaucccuccccgcccacagcagggggccagaggccgucccccccucgcaggugaggaacaggagcuccugcgggcuccccugcggcaccccgcucuguuucccaccacggccuaaccucaggcucuggaaggaauucccuucagggacacuguacuccccggagggacgcugcgccccuggaggacagggacgcuggggagccagccgcgaggggcguccaccucugcugugcuggagacggagcgcgcaaggagguggggaccacgcgcagacccuggcugcgggagccucagcucggggcccaucaggaucucccgcagcccgcacgggccgggcuucccccaggggcuggcgugugcucugugcacccugacccaucccgucggccccgccaccugcgggcuggccacgccccacagccuccugccccggcccgcccgggagcuuggugcugagaguggagccucuuucucccuggacauuggggcccugggaaacgacccaacaccucagggccugcggaguucuggaugcuccgcccgccugcgcagagcuuccuguuuaccggccuggcuccugcccgcccaccugcugcggggaaagcgaucacucuaugcccugcggggagcacccggcagggagaagggagaaggggcaaggaagaggggcggccuacuacucggguggaccccaggcugucccuccaccgugcuggggucccccagguguacccuccccuccagccaccucaccccuuccuugcugugucccgcagguguucugugguguccucugagggccugugcgugugugugcguguaugcauguguguaucugcaugugugugcgugugcaugugugugcgugugcaugugugcauguaugugugugcgugugcaugugugcauguaugugcaugugugcguguaugugcgucuguguccccuucccacaggcccucaccgcucccugcaccuguggguccuuucuuccuuuccugcccuguugggacauauuccuuauugcacacuuggacuucuuucuuaaauucuuuucuuuuugagacugagucucagucugccacccaggcuggagugcaguggcgcagucucggcucacugcaaccuccgccucccagguucaagcaauucuccuaucucagccuccugaguagcugggacuacaggcaugugccaccaugccuggcuaauuuuuuuuguuuuuguuuugagucggagucucacucuuuucacccaggcuggagugcaguggcaugaucucagcccacugcaacgucugccucccggguucaagccaaucuucuucuucagcuuccagaguagcugggauuauaggugugcaccacuaugcccggcuaauuuuuguguuuuuaguagggacaggguuuuaccauguuggccaggcugcucucgaacugccgaccuuaggcuauccaccugccucggccucccaaagugcugggauuaccggugugagccacugcaccuggccuugaucuguuuuuuucuuugcuugcuuaugcuuuugguguuuauuuaagaaauuguugccuaauccaaggucacaaagauuuauuaccccauuuucuuaaguaguuuuauaguuuuagcuauuacauucauuccaguuuguaauuauuuuauuuuauuuuauuuuauuuuauuuuauuuauuuauuuauuuugagacggaguuucgcuccuguugcccaggcuggagugcaauggugcgaucucgguucaccacaagcuccaccuccuggguucaagugauucuccugccucagccuccugaguagcugggauuacaggcgcccgccaucacgucuggcuaauuuuguauuuuuaguagagacgggguuucuccauguuggucagacuggucucaaacucccgaccucaggugaucugcccgccuuggccucccagagugcuaggauuacacacgugagccacugcacccagccuuuauuuuuauuuuuuugagacagagucucacucugucgcccaggcuggagugcaguggcgugaucucagcucacugcaagcucugccucccugguucaugccauucuccugccucagccuccugaguagcugggacuacaggcgcccgccaccacgcccggcuaauuuuuguauuuguauuugggaggaucggccucccaaagugcuaggauuaccggugucagucacugugccuggcuaggaaacucuguaaagggcugaguaguaaauuuuuuagcuuuuagucuaaguacgguggcucacgccuguaaucccagugcuucgggaggccaggguaggaggaucaguugagcccaggaguuugagaccagccucggcaacaacgcgagacccccguuucugaaaaaagaauuagccaggugugguggcgccuguagucccagcuacucaggaggcugaggcaggacggucgcuugagcccaggaguuggaggcugcagagcuaugguggcaccacuguguuccagccugggugacagugcaagaccccgucucuacaaaaaaaucaagaugaacauuuuaggguuugugguccagauggucucugucacaacuccuccacacugcgguuguagcacuuaaggagccagacaauucgugaacacauggguguggccauguuccaauaaaacuuuuuuuuuuuuuuugagacggagucucgcucugucacccaggcuggagugcaguggcaugaucucagcucacugcaagcuccgccucccggguucacgccauucuccugccucagccucccgaguagcugggacuacaggcgcccgccaccacacccggcuaauuuuuuguauuuuuaguagagacgggguuucaccguguuagccaggauggucucgaucuccugaccucgugauccgcccgccucggccucccaaagugcugggauuacaggcaugagccaccgugccuggcccaauaaaacuuucuuuagugggcuguguucggccccuggacugugguauaccagccccugcuuuagacagucuuuguaggaccuuaugaguuccauauaaucagcgagacuccugucuuuuuaccugugccgaaguugucuaggagaaaguucuagaauugaaguugcugccaagggcacacacauuagaaaugcugccaggcugcccccuaggggagaaucuauugacacgggcaucacccccagccgugugaggacccccugaguccccaacccauugcuggcaggcugguuucauaucaugucuuuuaucauuagaggggucugggcgucuuuuucagauguucacacuguuuguuuucuuuuccucugccuguuuuacaaguugagugaguuaaugcuuugagaaaagccucauuucuauaaauaaaaaugacaaaauauguauuucagacggcaccaaaggauggaaguugcaaauuaagagacccucccccaucccacacccagaaauaacuuggaaccuucuaagauucacgugucuggcccugacugcugagugacgugucuacagugguggaagccauguggcacuaagagcuugaguucuccuggugggucacagggaaccagauccuggugcucagagggagagagccgcccggggcuuugcugccugggcccuacgugccgggugaccuucagcaggugguggucccgcucugggugcgucuguggugggauucguggauuaugcaacaaaccacugccacacugagaggcuucacgcugcagugcuuuugcugucaguuucccaguauuggcugggcuuggcugggcucagcaggucgguucugcugcggcaucuggcuugugccagcacacccugguggccuccugucccaggccucucuccgcauugcugccacccuccagccuggccccagcaucguacuggagggauuccaagagagcagaggcugauggaagaauuccccccaugucacuucugcaucaugugauuggccaaagcagggcuugagacccgcccacuuucaaggggaaggaauucggcccuguccccgggauggaagggacccuggcaggcagcagguguccccaucugugugugagugcugugagauugugcgcuggaugauguguguggggugagggggcggcaaugagcucaucuugaugccucuaauuauaaggcaaagaaaugcucaugcgugacuggugugguuaccacugcagcgcugugagcgggaggcucuucuuaucguuccgucuuuauuuugaggaauccugagguccagugggugacacagaggccacuucccagccaggaggcugugggugcugcuccaggcaccgaagcaucugcucugccucuccugugcugggggccgggccugcugcagagacagagucagcacuggucgggguggugggggcuccaacaugggggaggugugggacugcccgggagaggaagcgggggcuccagcguggggggggugugggacugcccgggaggggaagcaggggcuccagugugggggaggugugggacugcccgggaggggaagcgggggcuggcugugcucugcacaggauguuccugcugugcccgggcugaucccagcucuccagacacgguccugccccggggccuccguacuggcugugccucugccugggaggccccucugcccuucccccgccuggcuccuccucacucuccucccgucccugcuguggugacgcagacuggggccugacauccuggaaucaggugcguccaccccuacauuuuugcugcaugaucaggcaagcgaucugaccucucugagccucaguuuccgccucugcauaaugggagcaguaauagugccuacgucacaggguuguugggacaauugcgugacuaagccaugggguucucauauggugcgggccccgccacacacacggcgaaggugggcuagcucgucucuggccagcuccugccugcgcuccagcuguuccaggguggcucagugguuagagacgggaagcagccugcgccccugggcucuugaccccauccaaccccguuucccuccugagccaagcccacugugcccuggacccagaucuccguggaacuccugggaggaggacacugucgcaggcagccuuacccacgugccaggcucgugcugucugcacuguugcagaggggaaagaugaagucgcugcccuggccgggcucauggccucagagggaacaaauguggaggauccaaggaguagagagaaguaaacccagcgggggcagggugaccagggaggggacucucugaggaggugacauuugaucuagaccugaacaagguugggugggagagagaguuccaggcagaggcgcagccugugcggaggcccuagggcaggaccaagccugguguggggagggagggggaggagaggagggaggggaaggacaggaggggaggggagggggaggaggggagguguucuccaucugggccucuguccagcaaacguucauugaggcaacaucugugaccucacacaguuucugagucaggagucugggagcggcguagcugggugguccuggcucggggucucucaugaggcuguggugaagcugucagccgggacugccuccucugaaggcucaacuggggcuggaggagccgcuuccaagagagcuucugcucuuuauuuuuuauuuuuuuaauuuuuuuauagggacagucuugcucugucacccaggcugaaauggagugucaccaucauagcucacugcagccuccaacucuggggcucaagcagucuucccaccgcagccucccgaguagccgggacuacaggcacacgucaccacgccagauaauuuuuuuguuuuuugaagagguggggucuugcuaugucuugcuauguugcucggucuggucuggaauuccugggcucaagcaauccucccaccucggccuccaagugugcugggaugacagguaugagaacugcgccuggcccacaaugccuuuuuuuuuuuuuuuuuagauggagucuugcucuguuguccaggcuggaaugcaguggugcgaucucagcucacugcaaccucugccuccuggguuugagcgauucuccugccucagccuccugaguagccgggauuacaggcgcgcacccccaugccuggcuaauguuuguauuuuuaguagagacggggccucaccauguuggccagacuggucucaaacuccugaucucaggugauccacccgccucagccucccaaagugcuggguuuauaagagugagccacugugccuggcccacgaugccuuuucuaagaaauguuaggcaccuucucuuugucucccucugugcuauugguggggguggugacggggucagaccagcaugcagcgugcagcaggcucugcaaucugggcucguggaagcauauuccuacacgccaggcugacggggaaggaguucgcuuuggauccuggugggccugaggggccagaggaccaaacgcaggccccagggcucguuuggcuaagugacccccuggaguuuaucugaagaaugugccuuaaguuugcuccucccccaggggcugcccuggggcugcuguuugcccucccccaggggcugcccuggggcugccguuugcccuucaaguccaggcuggagcgaauguugcugccuuugacuagcagagaccucugagccucaguuuacauagcuguaaaauagguccaaugccagucaccucauggagcauugagagggucagagacgcagcuugcagagcaccagcccgcggggggauguguguacgagcugcagcuuuuauuacagggaacuucaaacaaaagacaaaagugggccaggcgcgguggcucaugccuguaaucccagcacuuugggaggccgagguggguggaucaccugaggucaggaguucgagaucagccuggccaacauggcaaaauuccgucgcuacuagaaauacaaaaauuagccaggugguaguggugaacgccuguaaucccagcuacuugggagacugaggcaggagaaucgcuugaacccaggaggcagagguugcagugagccaaaaucaugccacugcacuccagccugggcgacagaacgagacucuaucucaaaaaaaaaaaaaaaaguggacagggugguacagguacggguguucuuuuccugaaacauuguacacacccggagaauagugucaggaacacccugcccgcccccacucccaucccacauaccuccauacuguguugacuccggguucuugugugugcagaugcggggggcgaacaggggcgagauucuaccaucccagucucuaaaacagggucucugccucucagcacugccgaccugugggaccugaucuuucucugggguagggccauccugggcacugcagggggcugagcagugucgcuggccuccgccuacuuuaugccaggagcacccuuagucaugacaaucacaaauggccccagacaucaaccagugugcccuggagggcagagucuccccuggugagaccuccauuucggucacucccuccacccccagggccacgcucaaagccugucccagaggagauccuggccuccgccugaucuccucugacccuuuacaaaaguuugcugaccccugacuuaagggauaaacagaaaagauguuuuuugaccuauguaguaauagaugggugucuuuuaugugauucugugcuuuccaggugcuuaaaaccuuuucuuauuagacauuguauuuagacaguccgggcgcgguggcucacgccugucaucccagcacuuugggaggccaaagugaguggaucaccugaggucaggagcgagaccagccuggccaacauggugaaacgccaucucuauaaaaauagaaaaauuagcugagaauaguggcggaucccuuuaaucccagcuacucgggaggcugagacgggagaaucguaugaaccugggaggcggagguugcagugagucaggauggugccguugcacuccagccugggcgacagagcaggacuccgucucaaaagaaaaaagaaaagacaguugcauuuagacagagagccggccgccucaguggugugucaucccccaaacccaagagaugcuugcugauuuugguuuggauggauggauggauggauggaugaacggaugaacgagccaacagacaaucaccugacaccauucaccacgcugggagucucagaaucagaagagagugcaucuucaggguaagaacuagccuguagucacuucagggccauuguuccaggcuugauuguggggcuucaggccuuugccacguccccccgagggggcuguagccaggguguucucacagggccagagggcaggagcugggaucccccaaaccccaccauagcccgggcagugucucccacagcaucugccucuucguuugcugcagaaaguuucuugagcgucugcaacaugccgggcacguucuaggcuccaguugccugcuccaccacuccguccaccaugcgugcccagcgcagcacgucaagccacauccagggcgccccuugggccccuccaacccugcagguccugacugcucagcacaucugacccaagccugugcuucuuccugaugccccaucuugguagccaacucacugugugccugagcccaggucccaggucacguccucuccagugcucccccuccacagcugaggaccccucuggaucucccagauccagcccagcccgccugccccagcuccauucaccggugcugcugcgccccuacugaguagcgaguaggucugggagagcaaccgugaacgagacgccaggucugugcucccacaggaaggagcaagaucagucccaacugaugugcagugugaggaaauagaaugggaugcaaggcggguaggaagguggcugugaggacggucucccuggggaggugagaggcugagacccaaacgggaggacaggagccggccaagcagggacacaggcgcagcacgcgcaaggccccugaggcaggaacaugccccucaaagguguggugcuggguggggagccugggcacagggcccggcccacuggagcuugggggcauccucugugacccguguccccacucagguuccucaagcagaguucccucaaaaaccguguuucuucagagcuugaaaacaccuguguccaagguaaagacucaccuuuccccugggggaaagggauuuuuaaagagaauuuucaaaagugcugaaaaguugaaagaauugggcaguagacccacgacuuaccgccugggucuugcaauuggcaguuggcuguguucacgccaucccuccaucccaccaucccuccaucccucccuccaucuugccaucccuucauccuccaucccuccauucuccaucccucccuccacuccuccaucccuccaucccuuccuccguccugccaucccgccaucccucccuccauccugccaucccgccaucccuccaucccucccuccauccaucuugccaucccuucauccuccaucccuccauucuccaucccucccuccaucccucccuccguccugccaucccgccaucccucugucccucccuccauccugccaucccgccaucccuccaucccucccgcccuccaucucgccaucccuccaucucgccaucccuccaucucgccaucucuccaucucucccuccauccuuccaucucuccaucccuccuuccaccccuccaucccuccaucccuuuaucccuccaucccucccuccaucccuccuuccaucucuccaucccucccuccauccaucccucccuccaucccaccauccuuccauccuccuugccuccaucccuccuccaucccuccauccuccaucccuccauccuccaucucuccauccuccaucccuccauccuucaucacuccaucucuaucccuccauccaucuauucuccaucccuccauccuccauuccuccaucccuccaugccucugucccugcaucccuccgucccuccaucccuccgucccuccaucccuccaucccuccaccccuccauucuccauuccuccaccccuccauucuccauuccuccauccuccaucccuccgucccuccaucucuccaucccuucauccuccauucuccauccuccaucccuccaucucuccaucccuccauuuucuauccugccaucucuccaucccuccaucucuccaucccuccauucucccucccuccuccauccuccauucuccuuccaucucuccaucccuccauucuccaucccuccauucuccaucccuccgucucuccaucccuccaucuguccaucccuccauccuccuucccucuauuccuccauccuccauccauccaucccucccuccaucccuccauucuccaucccucccuuuaucccuccaucccuccuccaucccucccucccuccccucccucccucccucucucuaucccucucccaccccuccaucccucccucccuccaucccuccaucuaucccucccucccucccugcaucccucccuccaucccuccauccuccauccuccaucccucccuccaucccaccauccuuccaucccuccaucccaccaucccuccauuccgccaucccucucagcuuguuuuuuggaagccuuucaaaguugcagaccucagcacccccaccugucaacacuuaacacgauucagcaucuugaacuggacucacugucucuuuuuuuuugagagggagucucacucuguugcccaggcuggagugcaguggcaugaucuuggcucacugcaaccuccgccucccagguuuaagcgauucuccugccuccgccucccaaguagcugggauuacaggcacuggccaccacacccgccuaauuuuuguauuuucaguagagacgggguuucaccauguuggccaggcuggucucuaacuccugggcucaagugacccgccugccucggccucccaaagugcugggaugacaggcgugagccaccguaaagccuggccuaaaacuuucucuuuuucuuuucagucuucauuccuuucucuuuuucuagucuuauugcuccagccagcacuuccgcugcaguggcggcucucacagccacaccccuggucuugugguugacauuaaggcauuucccauaacuuuuugcuuuauacuucuuucauuuuauauuuuauuuuauuuuauuuuaauuuuaagacaggaucuugcucuguugcccaggcuagagugcaguggugcagucauagcucacugcagccucaaacuucuggguucaagugauccucccgccucagccucccaaguagcuagaaauacaggugugcaccaccacuccuggcuaauauuuaaauuuuuuuguagagaugggggucucacgauguugcccaggcaagucucaaacuucugggcucaagccguccuccugccucagccucccaaagugcuagagccaccucgccuggucuuauauuucuuuuuaaaguaaaagcagucucccuuucucuccuuuuuuucuuucuugguaguauuuuggggggacgugaaauucauguugaauuucguugaagguuuuucuggauucggagaugggaucacagcguuuuucaccguugacuuuggguaacuuccuaaauuuccccaaauccccauuucccggccugucaaacggugaucaugaauuagguggcagcuggaucaggugcucacaggcgccuccuggccacgcgccgucggggagugggccguggggggcgaaggcagaggcgagugugccaggcggggggccgagugauggugcagccuuuuauuucuagaucugccuguuuuucgagaaacccagguuuuucuccaaaacauugugauuucuagaguugaccgaacccaaacaccgcagggcucagaaccaagcccgggcgggccacucaccagggugugcugggaguggugggugccggggaccgcggauguaccgggugacaguuuacggcgacucgcugggcuuggggcugcagggccgggcagguaccugaguucacaucucucaucacuucccgguggggaccaucagucgggugcugccuguccccaaacagggaccccauugccuaccaugccaggccuguauggguuagagacggucacgcgggaggccuggccacauggguucuccccagcggugucagaauccuuccaccucucccagccucgguuuccccaugugucaaaugaagccgugaggaguggcugccuggucaggcugggugggauccuguguggggagagcuuggucggcaccuggugcagauauuugcuguugcagccguguugaacaucucacccaaggguuuaaccucaggggcuacugaagcggggcaucaccuggggucauccugccccccuggggacacggggccaugucuggagacaucugugguuguuacagcuggggggugccccuggcauggaguggguggaggccagggaugcugcucggcacccugcagugcccaggacggccccagugaccagcccagagaacaauccagcccuaagugcugaggggggagauccugguuugcaugggcuuuggggggugccuggaggcccccaagccguuugcauguggguacacucauaucaagagagaagaggccugaggcagggccguuugaugucaccauggacgagacuguccaucccgguccauaccagagaggagcagaagcugagggucggcaccagccuuucagaccucgguaguugcuguuuacugcguuucacaaaagccuugguccaugauggagagaaaagaaagguugaacucaguucuacagcacagacagugugagaagcuccagccugcagcagacuggcugcccuucuggucaagccuugaccaagucccccaaccuccuuuagagacaagcaaacugaggcccugggggaugaccgaguuuggagaagguuccagaugguguaugucacugggcaaugcuuuugcaacuaaagggaucugcaucuucauuuugcuuuucugggacacaaaauucacucuuugaaagugucuuacugcuuacuuauugcaacugaguaaauucuucucggcguauucacagaguuguucagucacugccacuaauucuaguacauuuccaucaccccgaaagcaaacccugcgccuggcggcugucacucuccaucccuccccagccccagcacccaugcauccccucccugucucucuggaucagccuguccuggacauuucauagaaauggggucacacacugcauggccucuugugucugguaucucucacugagugugacgucuucaaggugcauccgugcuguggccugcgucagagccucacuccuuuucauggcugaauaauccauguacagauuauuaaugcuucuuugaauguaagaaguccaaguaagacaaaggaauuaaaaacuguaacuccuccuguuccaaagaaguccacagauaggccgggcacgguggcucaugucugucaucgcagcacgcugggaggccaaggcgggcagaucacgaggucaagagauugagaccauccuggguaacacggugaaaccccaucucuacuaaaaauacaaaaaagcugggcaugguggugcgugccuguagucccagcuacucgggggaggcugaggcaggagaaucgcuugaacccgggaggcggaggcuguagugagccgagaucugcagcuacucgggggaggcugaggcaggagaaucgcuugaacccgggaggcggaggcuguagugagccgagaucugcagcuacucgggggaggcugaggcaggagaaucgcuugaacccgaguggcggaggcuguagugagccaagaucugcagcuacucgggggaggcugagacaggagaaucacuuaaacccaagaggcagagguuguagugagccgagaucuguuucagucagcuauuguauaacaaaccacccccagacagaagcuucaaacaacuguguauuugcuugcgauucuguuauuuggguuggguucaguugggugguucuucuguaggucauaccugggguuaguuccauggcuguggucggcaguggcaggaaauucaagcucguccuacacuugccuguccaacccucagccaggauggcaggaacagcuggggccgcccggucuuuuugcagggagcuggccucugagugucguggcccagguucccagaggcacagugagaagugccagccuuccucacgcccacaccaucccuugcaucacauucuguuggucagagcaagucacacuacugccaagcgucgcagccaucuguggacagccacagaaggccuuucugcaguuuagcaggagaagauucuugcacggccuacccuuguccgccggguccuggucugagccucaccagagcugagggucggcccugccgccuccggguccccaccccagccugugucguggagugccgcugcccagccuggccguccuggcagguccucagaggggccugugguccccauggucggaggccugcacggcgggaggccagaggauggguuguuccagcgaaugagggaggugaccgugagcucuggcccgggguugcuuccugcuugugggaucgcaggaccccgugccugggccguccucacacacccggguugcugugucacggcgagccugcaccuguccuggggugcccagcaguugcccucugggcagcggccccacccaggggugcaggcccccugugcuacucugacacaccugggucccacugccgccccuuucucacuggccuucccuugcugcccucagagcuuugccagagucugugagcaggugacagagcaggccugggaccccuguuguggggaugacaacagccauguaucagguggugccgugugccgggcagugaggaggggaucguuuggugcagguuggcuggaggaggccucugaggggugauguucaagccaggucuggggugaaacaggaacaaaccgugagggaaucuugggacuggcaggccaggcagaggcaccgcucgugcaaaggccaugacacaggguggcgcuggcgugcuggagggacagcgagggcccguguggcuggagcagagggaggagcagagggcagggagggggccacacagggucugguggggugacagggccuggucuucacccugcaggguugcagugaggccuggggagacccuugucugcggugggggcggggugggugggcccccuuucgcagaaucccuccccugccgugggcucuccccggccccccaguccccagccccccaguccccagcuucaucauccugggccuuccagggcccugcccacucuccccccgcccccaccgccuccagggcuggggcuuucuccucccagccaugggggucuggaccuugguucuacagggaugaggccaccacuguuccuguccugccugcugucacagugcccugcaggugcccacaggggcugaggcaccuuccacccacccucgagcuugccucgcugggcccucugccccacggcgcccugucggugagcccagaaugugcccuguuuccucucacugugaugccucccucccucuggccaccuguccagaccucuccguccccauucuuacuuugggucucacugcagagccagccugacaaucugccuccucccccaguuuagucauucccugccucaguguccaugucagacagauguggagaggaagcucuggcggaggccuguugugcagagaaaagaggaacggguaucugucaguccaugggucagucaacaaacacgcccaugcugucagcccagggcaggccccguccugagggagcccccaggcucagcaggagggaccaggcuggucugcaggauggggcggugucagugggguggcaaagguggcuggugugggacacaguguccagggagcacuggcagggccagggcggagaccaggcgcaggccagggaacagcugggugcagaggcggccauguggccccguggagaauggcagugccucuagggcucgagcuggcuucagccgcacuuuauagagagagacugaggcucagagagaagcccugggcacacagggaggugggguggccgaugaggucaccgugcagccagcgaucagagccgugcaccgcaggcccgggucgccaccacguccugugauggggccaggagagaggggccccagcggcagagcccccgccucgggccuggccagcggaaacugcucagaggggccaccucccggcuccgcagcgcggcucgccuuuccucccccgacuauuuuuaaaaccuaauuuccucgaaaacgggguggcucauucagcagauaauuagucacgucucaggcugagcagagcucaccgucaugacagcccccuaugggggucacggcaggcucugugcccugagcgggccucauggggagcgaggauugagugaagauggcgcucaccugcccccacccccugggcaggcgguggcagcaaggcugugcuuucuccccguccccucuccuccacaggacacucggcucuggucuccccuugcugcccguuccugccugcccugggagccccacauuuucccuggggucccccaaccgagugccuccccucuccguccugcuccaccuccaccucagugcuucggccccggccagucccuuaacccuacaggcccccagugcagggacguucccagcagggcccgagccgccugccccucuccucuccucuccccguuagccagcucaggugagucgggcaggugaagacguggaaccacagagggaaacugaggcagggggccuacacccaacacgggugaccccgaggugccuggugaggucagcagagcugggucuggagggccucacugcauccacugggucccggggccguagggagccugggagaguccgggcagggguggacccaagcgcugugaccucucagcaucggggccacugaggaaaacagcugagucacccaagugggugugggggggccccagaggggugguuucgcgaguagagucaggacugugggcagggaggccccagacaggccgagcagggggacgcccgggcccccgaugaggucuggaacgucccgccccggcccaccgcuggcuuccugcccucucuucuuuuccuucccccacacccuggacguaaaaccgugaauuguucugcucccgggccgccaacccaaacaucacgucagcguccagcaccuuccgccccgccgcggcccagagcaggcccuuuguggccugucagagaccugggggcgacuggcccuguccucuggaaggacagagaagcagcccgucuuucccuucaccguggcagccggaauccugagucaccccacucccuccguccccguccccgccccugcagugagcaccaugggucugucccccagaucccuccagggcccacccgcugcccacccagcccugcagggcauccagguggcccgaggggaggacccuucagcuguucuugcugccuugagaaguacgcccccucccacccagggcugggguccucacuggagggcuccgugugagguccugggcugcccagacaaaguccccgggacuggggggcuuggagcagcaggccuugaacaggcguuuguucuggcucagcucuggaggccaggagccugagguccaggagugggcagggcucugcccucccgaccgaccucggagaagcuccacaccccucugcuccuggugccuccgggcauccuuggcguuucagggccuggaggaguggugcccuccccgccuccaccccacacggcaucuuggccucccugagcggcuucucuuauaaggacagcgguggauccagggcccaccccacuccggcaugaccucaucuuacccaaugacaucagcaaagacucucuuuccaaauacgguugcaggcugagguucuuggaaggacgugaaugucggagggacaccguccaaccccgcacccucaggcaggcguggggacugaccacgacugcaggggcccaccagcgucucgaaugcggcccccuccccaccugccgccugcagaggcuccugaccccagcccccuccccaccugccgccugccccagguuccugaccgcaguccccuccccaccugccgccugcagaggcuucuggccccagcccccuccauaccugcugccugccccgaggcuccugaccccaggccccuccccggccugccccugccccgaggcuccugaccccagcaaaguuuuccaccucgugccuucgucuugucuccggcaguucugacccggcagcagagcaaagcuaugggcugcuccaccaagucgcauucaguugccuucagugcccgcgguggacguguuuucagacggcagggcggucaccggggugcagccucuggaugggacacacgugggucucccgugcacccaccgagagcagcacagugcccaugggggccgaggggcgcuggcagggcugauaggguggggcaucgccgacccaggcccagguuugacuuuccuucuccuucugugugaccucggguggguucaccccucccucugagcaucucuuuccgcgucauaaaacagaagggcucccgccuucucugcacucuuugcuggcuuuguaaggccuugguccagaaagacuuuuugucucucggggaaauucuccucuguccccucucccgaguccacacccagccggguccccaccccugacggcccccgucugcaccgcggacuccgcacccaccuccucaccugucugcaccucccugaaccucgcccaguuggccccucacauguccuggccuccccugcucaccucagccggccuggaagccagggccagaccaguuccaacgcacugcugcccagcccagagcagggaggcagccagagggccgagcccuacggagcagggcaccugccgcacccuccugcacacacuccggcgcagccugagugucuccacgggcucauaauaauccccuuugagggccugccccagcacccccagcugccagaccucagccagcccucccuuccccaacccucagccucuuccucuaggaagggggaauggagugagaagaugcuggcagagcugggguggagucagcccugacccacagccccugugauugaaaagaagcauuugucuccaugccccugggcccuggguggugccagcaucggaauccaacagggaggcacuccccuucgguacccgccucugcaugagccuggaggacgcugcuguuauccgugcagcguggcugccucagccaccuugugaccuuugugcugccguucccuccgccuggaacucccuccggcucccacggcauccuuguucggcacugagcucagacaggaccagcccagggaagcccccccuugcugauccgcaccccgccugucaccccacaucaaacacccagcccugcgcccaccccuguugaccgugagccccuugagggcgagaccaggucuuccccaggccugcaugguggacgccagcacgugcgaucccugcagucgcugacaucgcuucccaccucagggcuccgaggccaggaguccagccccagaacggggccucaccaggcuaaagucaagcugugggcagggcugggcccagcacaagcugcagaggagaauccguuucccccuuuucccagcaucuagaggcgcccgcaucugucggcucaggucccuuccucccucuucacagccacagcgcagccucuuccagucucugucugacucacccucucgcccccgcucgugaggacccugugaggacaucgggcucccaggucccccaggaucaucucccgucggucucagggccuguaaucacagcuguagagucuguucccguucuccagaugaggaccccagggcccugcugcugggagccagggcuggggaugugguccuggguccuaggagcugagucucgccugcuccccucgucccagccuccuugcauggaggaaggugcucccggcucagcccaggccugggcucguuggcucaauccugcaggccucuguuguccucucuggagcugcggcccaggcccugcugcgcugaccggaggcugcgggcccaggagccagggcagggcuggggguccccucgcagccucucuuacccuuccacaaaccucacucuggagaggggcagggagggcggcagcccuggggaccccuggccaguucccacugaccgcagcugcccaggugcugggcgcucccugcaacuccagccugcccucgccccagcgggggccugcccccccucacuccccacgcuggcaccugauuuccccaugcccgagccucuccuggcgccugccuccgaggaagcggggcuuggucaguucagaccugcucaguuguugacugcccagaaccucaugucugggugugaagggggucagagccgggggagguuugcucccuauuuccccuccccuccuccaggcagguccaagccccaggcccuccguggugggugccaagccuaggcgucaccagcugcccaucucccugaggcugcaaagccucuccccugcucuaggccccaguggcugccaaccagggugaccauggcaggccccaguggcccccacccucaucacauccucccagcgcacucaguccaugucuucacuuguguguagccuugagaccagccccacgcagaguuacacacgccaggccuggggcgccagaaggugggccgggggcugggcccaggacucccagaggucaccgguuuccugucugauacccagcuugucucuucugcagguuuggcucagaagaaggcggccccaacagaggugagugucuggagcggacgaagggccugggguccccacccugaccugcugccucccuacucgcggagaagcuguguggccuggggcagcucacuacaccucucugggccccaaaugccguccaguguccacaagcaggaugaacgugaggucuacaccaacugcgucuugagaggucggggugaaauuccgugauggaggagggggcccugcaucugaggggccacacccucaguggcaggggugccuggucagggcugcaggggcaggaagggcuucucuggguuccaggccacguggagccuggauucuggggggugggcgguggggagagagcagcucucgccgggggacugggggcaggaauggaagaccuggcuggaggguuagacgcugcccagagggcgaugcccgaggcuaccagcugcacccacgcccucagugucugugagccacacaggcguagugcacagugaggcugugugcagccuaugugugcauguuugccugcgugcgugugugcacguuugugugugugcauguuugccugcgugcgugugugcacguuugugugugugcauguuugccugcgugcgugugugcaucuauuuuugcuuguguggauguuugccugugugugugcacguuugugugugugcauguuugcgugcaugugugcacguguuugccuguguucauuugccuacgugcgugugugcacguguuugccuguguucauguuugccugagugcauguguguuugccugugugccuguuugccugcgugcguauguacacguuugccugugugcacgucugcacguguguuugccugugugcauauuugucugugugugugcacaucugcauguacauggguccugucauugcugcccgucuccucccgagagcuuucucugcacguuggcccugccuuugcagcuucugccagccccguggcgccgaguggccuucuucccagccccagugggcgcaguggggugggccguccucugagggcacccgagcugcugcaucucccgucuucccgcaugcaguccucagggcaccuguccaugagccccauucacaggagcaguccccaaggcaccugucccaccugggccacccuuggcccugcguccguagccagagcuuggagggcuuuguccaccaggccugggacccugggauccuuccucagagucccccggcgugggggcaguguggaggguggcgcggguggaggguggcccggguggcggggugaauuccuggggagagccugcccccuggcggccaccugggagaaugcagggaacauggcugagcagcgucggcuguggagggagggcaggggcaggggucagggcugcaggcgugucccuggggcugauagcggugggauggggucuggccaguggaggguccauggggucuccuagcaaacgcaguggcgcuccuuaaaugacggugccaggcggggcuguucuccuugguuggccucugugucccuucaggcucccaaggccccuccucacauccucccucgagggcaacaagcugaggcccccuggggucggcggucccaucugcugggacacccgcgcugcccgacagcuugcaggagccgggccugacccuggccagugagaccaucucccucagggacaagguggucuuuucaauccuuccaucccagcggucucacaguuaggggcccuggugagggagaggaguuacgacucccaccaccaccucaggcggugggugagaugcucugaggcuggccuggcucacaccguguuggcaggaagccugacccccgcucuguucccacccccaccucaguccuguuuuuuuaaaaaauacccacuuuacugagaugugauuugcauacuguacucucugaagugugcagugagugacuuuuaguacauuugcagaguuguguggggacaucugugguugccacaacugggaggugcuccuggcauggaguggguggaggccaggaaugcugcucagcacccugcugugcccaggguggccccaccccaaagaacgguccagccccaguguccacagcaccugggggagacccuggaauuagagggcuggagcugcccaauccucuugcccuuccugaggaggcagaggucuccaccuuggagugagcgcuucuggguguccagugugggacacugaggggccccagccagcccgccaggcgcccacgggugaggggccuccugcugcaccccggagucgccuggaccugcccccugcccugugcaccccugcugggcccaacgacuaaaccuuucuucccaggguuucagagcgugcccugucccggugggcgugcuccuuagggaguuaacgcuuccugcuuccucuucccagguucuguccaugacggcacagccgggcccuggccaugggaagaaguugggccaucgagguguggacgcauccggcgaaaccaccuacaagaagguuccucggcuccccuuagcuggcuggagggagcgggacagagcagaggggagggggaucccacugguagcauggauggggccuaucgcccccgacacaaaccagggucugcccagggacaggugugggcuguguggaggcagaggcuggaguccucaguccugcaugaggccccacuguuugcuguccuugccgggcggccgggcagcauguucuguggcucagccuggcugcaacgccugcccggcucugagucccugaaaccucgggcagagccugggcucucggcccuggugagggagagggguuauggaccccaccaccaccucgggcaguggaugggacacucugaggcuggccuggcucacaccguguugguaggaagccugacccccacucuguucccacccccaccuagggccuguuuuuucaaaaguaaccguuuuacugagaugugauucauauacuguacaauucagccuuuaaagugugcaguaaaugacuuuuaguacauaugcagaguugugcagccgucaccucuaauuccagaacauugcaucagcucaaauagcaacucugucccuguuagcagucacccccaucccgacucccagcccuggcacccacaucccuuuccugcgucuguggaucagccuguccuggacgugucauagaaguggaaucacacacuguguggcuuucugugucuggcgucucucacugaguguagcguccucaggguucauucgcacuggggcccgugucagagccuugcuccuguucauggcugagucguguucuggugcguggggcgcccgugcugcacuuguccuuugcugcgucauggacgcucgggugcuucacacuccuggccauugugaauugugcugcugaggacacgugugugugagucuguguggauacauguguucguuugucucgggcagacacccaggaguggaauugccaagucacguguaacucggugucaucuuuugagaaacucgcaaacuguucuccauagcagcgguaccguuuucacacccagcaacagugaaugaggcccagcguccccguguccucaccagcacucgugauuguugucucugauucuggcguccucaugggugugagguggugucucuucgaggugucuuuuuguuuguuuugguagagacagggguuucaccauguugcccaggcuggucuugaacucccaggcucaggggauccucccaccccggccucccgacuggccgggauuccaggugcguggccccccugugguuugaugugcuuucccuuggugcccaguggcauggagcgucuuugcgggcuucagggccguuuguauguuaucuuugggcacaugucuguucuguccguggcaucucggggaggugaacauacaggccagaccccccaccacccagaguguggcuuaggagggagacaggccgaaacugggcaguggcagaaaccaacucccaacucccgaccucccucccugccaccucgcaccugcgacaggagcacuggagaccggaauuagagagcggagguaugagccggcuucccagggcuaaagugaacauggcgcgagagcacacagugagaauaaugcaaacgaugccaauggcaaaaauaacagcagccggccgggcgcggaggcucacuccuggaauccuagcacuuugggaggccgaggcgggaggaucaccagaggucaggaguuggagaccagccugggcaacauggcgcaaccuugucuguacuaaaaauacaaaaaaauaauuagccgggugugcuggugcgugccuguaaucccagcucuugggaggcugaggcgggagaauagcuugaacccaggaggcggagguugcagugauccaagaucgcaccacugcauuccagccugggcaguagagcaagacucugucucaaaaaauaauaacggggccggcgugcuggcucacacgugcaaucgcagcauuuugggaggcccaggcagguggauuagcugaggucaggaguucgagaccagccuggccaacauggugaaaccccgucucuacuaaaaauacaaaaauuagccaggcgugacggcgcgcaccuauaaucccagcuacucaggaagcugaggcaggagaaucacuugaaccugggagguggagguugcagugagcugagauugcgccacugcacuccagccugggcgacagagcaagacucugucucaaaaaauaaacaaauaaaaauaauaacagcagcugacaccacguccgcaagagggccagaaccauugugcccaucccugucuacaggcagggaaacugaggcacauagcggccauguggguugcccagugugaccacgugcguuacauagaaagcagcuaacgggaaccugcgucugcagaugugaaagugaucugggcaucucgcuguaaaugguacccccuaaaaacaaacucuugacagugaaucgacccuuuugcuaaguuggagcuguuucaaaaugggagaaccuuuagaaccuagcuagccaacaggacugggagggcugagugacguggugcggcaguugcagccgagcccuguccuggcuguguggcccgagggaggguggcuucaucccccggccugaugucgacagcucagcagccgcaggacaggcagccccggggaccaccaggaggggguuggcaggugccgggucccaagcugcagcuggucacgaucuccaccccccggugcacacagggggugcagggcagcguggggagcagccgggggcccugacacucuggucucccugcagaccaccuccuccacccugaagggugccauccagcugggcaucggcuacaccgugggccaccugagcuccaagcccgaacgcgacgugcucaugcaggacuucuacgugguggagagcaucuucuuccccaggugggccgggcccccggagccucagggcucacccagcacacacguggcucugaggcggaguggccuguccugagcgcccuucucugcugaaagcagcaccuggccccuccuggcgccuccuuggccuugagcucuggcccucuguccgucaggacguuuguuugcugcugaaucagagacccaauguaaaggcaguuuaagaacaggaaaaagaaaagauagaaguuagcucuuuucuaaucuacaaauaaccagugggcagugcagggcuggucaggagguuccaugguguugggguccugggauccuucuggucaccccacaccgccauccucaauauacagcucugugaccaguggucccagguggcugccaaagcuccugccaucacggcugcauuccagccacaggaggcaacagaaggagaacaacagcccuucccuuucggacaugaccaguguuucugcuccacucgugucauuggcugagugcagucacgugagcacaccuagcugcaagaggcuggggcggcaugguccuguucuuggcggccaugugccuggccaacacugugggccccguuguuaaugaaagaagagagggugguuacugggggacagucccaucgggagcccccuguugcuugugggauugggccguuucaaggaagucuuggagcugagccgcuagaggcucagcugcuagaggcacuaggagggaccauggcgggggugggggagaggugcccaccaccccucacagguuuccucccguccuuccuccacagcgaaggcagcaaccucacccccgcccaccacuuccaggacuuccgcuucaagaccuaugcaccugucgccuuccgcuacuuccgggagcucuuugggauccggccagaugauuacuugguaagcauauuugcuguuacgggcuuccaggcuugaaacagaacauguucagggucucggagggucugugggucaggcauuugggggcagccucccuggguuccucguguaggguuauggucagguucagggccggagucuccugugagacucaccgggaaagcaggagagaucggccuccaagcucacaucacuggcagcugcaggacuccguccuggcuggcguuggcugggagccuccauuccucaccaugugggccuugucaucagagcaggcgaggguguccacucaccaaacaguugguauagucuucugcagccuggugccaaagugacugacccauuuucagacuuaaggguuagaacaaggcacugggacgugggugccacuggggaccagcguagagucggaccuccuagcucuagccauggcuuuauuguuucagguuagcaaagucaaaaucuaggccaaccccuuugaccuagcagcccauuauccgggcuccuaaaagagguguuuggaggguggugcuccccacaguggcccuggagcucaucagcgccagcacccccuuuuuuuuuuuucgagacagagucucgcucugucgcccaggcuggagugcaguggugcgaucucggcucacuguaagcuccgccuccuggguucacgccauucuccugccucagcuucccgaguagcugggacuacaggugccugccaccacgcccggcuaauuuuuuguauuuuuaguagagacgggguuucaccgugucagccaggauggucucgaucuccugaccucgugaucugccugucucagccucccguagugcugggauuagaggcgugagcuaccgccucagccucccgaagugcugggauuccaggcgugagccccggcauccaaccugcgccaucaccacuucuaaaagcuccggguggccuuuucccaagccugccuggucaucccgagaacuuuguaucagggaagacuggaacucuguagacaagugcgguuggcguucugguugucacgacagcacgguccccggggccgggagccugugguucuccgauccugcccucacccgcgguggucgguuccuugugccuuucuuuggugguugcugacugugcgugcguuugguuuaucucagucuguaggaagcgcccgaggcugcgcucuuccagggagaacuagcaugugcuccagccagggguacgugugacaccccccccucccccgccccgagaacuccagccuguucaggugcccgggagucaccaugcuccgggucgugucgccaaggcccagccuccggacuucagugucccagcguuugccugagcuuggcagggcaguggggagugaaaacacagcugggguuuuugccuagaaauggcccucgggugaccuggacgcuaccgugugaggcggccaggaacagaaggcagcagccuggcucguagcagagagacagcacccguguccauuagcaggaguggacggauaaaagccgaucuggggccaucugggucucaccuagaacccgauaagaucgcauuccagggccuuaggccaggugugcacccacagcaucuggggagccagcccgguguuggugacccccgaauccuucugcucaucucaggagugugagaauucucuugggggccuccggugcugagcaggcggcagcccccuagccucuguccaggcuguggugugaguguggccgugugccacagcgggaggacgggcuagugugcguguugcuguccacagggccccugagcuugaguggggacagguaggguucggaggggacucgagguugccggugcuucucugauuggacagcugaggucacaguccccccugguaagggggguagcuccaggaaggcccacagcucaggacagccaggaaggagaaggcggaggugggaugcaggguggggcucagcccugcccaguggucagcagaggguggagaggaggccaaggucagcggcgcagcugccgagagccccagcaccgacgaaggaggcugugggggguuguccuggcacugccuggcucagaaauccacgcauggggccugcuuccccguagcagcugaggcccauggaggccauagcccugcaacugccauuagucauguggcuucagaauuucccugucaucgguguucuuuguacaaagccgaacgugcccuuuccacaguguuuuccgcucugcaggugagaucggccucccccuccugccaccguggacaggcagcagugauuugugucucggagggacacuccggcugcuugggguguccccugcuccgggugaccugaggacagcggcccagggcuuggcgggguccccuggccucccagggagggcgccagccccaggagagacccgccuucgcucugcgcugcugcgccugugucugggaggcuggagggcguccugccguggcggggaaggcggaggagccgcgugggcucuguguuuccuguggauauuuguggcucguggcugugggcagaaaaaggcaggcagauggcugggcugggcgacagcaguggccuggacagaucucccuccagccucagaguccaccccacacggcucucucacccugcaccaucacucccagccaggccauggcagaagcagcgcaugcaggaggaaggacccucgcuguucugagcugccaagguuggcagggcuguugcugacuccgcaaaauccagccuguguugaccgacgugugauaacugauggcgccguucccuggcccgagagcaccucgggcagugcagggcggggguggugacuugagcccaaggagggacuggggcauucccaggcccugggccugaugugaccucauguuuccggcguccucugguccccaaacauauucacagaucagaguguguguggcgcuggggacccaacucacgccucaagccccuggcucuuccagcauuuuccaaaggugguuccccucacuuguugggguguuuuuuuaaacacucuugcucuguugcccagguuggagggcaguggcgcugucacagcucacagcagccuugaccuccugggcucaagugauccucccaccucagccucccaaguagcugggaccacagaugggcaucaccaugccuguuuuuguuuucuuucuuuuuuuuuuuuaguacagaugaggccucgcucuguugcccaggcuggucuugaacuccugggcucaaaugauccuccucagccucccaagguguugggauuacagagugcugggugagccgccgugccuggccuccccucgcuucugcucgccaccacuccugacucucguggacaccccccaccuguuuaucacagcagcauuggaggcggcacgcagcacucggagaccacccuucugucguccagcagauacggacccagcguugacccuggggggccuggcuugcuccgcugauggggagcuggcucugaccucauccguguacaccaauggcgaccaguuaggauuuuaaagggcgugacacagauggccuuagccccaugcacacuucauugguuccauacccggaagacgcaggguagcacccgugggucucaucuucauucuaguccuuagcaaaucgagcaccugucgagucagugacacaaaaaaacuuccaccugcacggaccuucugccuaauguccaggagagggcgugggggcagagagacagcgagcacaucaugaaacaaacagcaggggcugagaaaaaggggcagagaaguggggaggaagggcuuggacuguggggugccaggggccagaguggggccugcccaucagagaugcagcuuccaucccagagcuuaccuucuaguccaguguggcugcugagguuccagccaucacaucagcaucucaggagggaaauaggugggaaggagagaagggcaaauacgcagguaugccagcugccugucgcccaucuguggagccuucccugaguuccaccugacagcuucugcuuaugacucauggggcagagcuggcguuguggccccacccagcuucaggggugcugggagcaccuuuuagccacgcgcgucagcaccccggugcgaucagguguccgcuccuaaggagagcagcaggcagccuggggagugcgcccuagcagaccagcccucgggcugcagagucagcucggccucaggcuccaguccuugcuggcuagccucaggcaagucucucgcccucucugagccucucuuuccgcaucuguaaaaugcagcgacccgucaucaguuccuggggcuguugggcagaccggaagccagugcugucuguguguccggcagcuuggggcccgcugacccgccuccucugcuuccaguacucccugugcaaugagccgcugaucgagcuguccaacccgggcgccaguggcucccucuucuacgucaccagcgacgacgaguucaucaucaagaccgucaugcacaaggaggccgaguuccugcagaagcugcucccuggcuacuacauggugcguggcccgcccugcggggcagauggcuccucggucaacccccuucucccggcuggcgggagcagaugucugcaaggcuugggcaagcaggcauccuuggggcguggugagaggcaucuugggucccggggacucacccucgggggucccccgucaggcuucaccagcaccaguguucaggagccgcccucucuuccuccuguggccacacgccuugggggccguccccgggcagggcugggugggcaccggccccugccuggcuccccauccccaccuugccaacacccccuaugagccgugggccccagaaccagcagccugcgggcagcgucugucagcugccacggaggcccaaggggcccaagggugacucagaggguuccagagaggagggggaugggccaccagaugguaccccacaaaagaccagcugcucaggcaggcgugaggcagcuccauccggcccaccccucaucccgcaugacucacagaaagggugcgucaggccccgggaggggggaguaggaguaggagccggcggcugccacaguguuccugggccugggauuccgguacucgcccagacgaggugggcgccuuccauguugccaggcccaagcugcugcccggcccugggcagcacagcacagccugugacucaguuucccuugaggccuccuccauccacucucugugaugcuuagcgaggggcccgggcuccuuagaucaggcucagcaaacucagucuuuaaaggcccagagagaguguuuuuggcucugcgagccagugugcugugucuccaggacugagcucugccuggauggcagcgagcugcugugaccacaugagaauggaugggcgcggccaugugcccauacgcauuauuuauggaccaagaaaugcgaauuccauaucacuuucacgugucaucaaagacuauuuucuauuucuccacuuuuuuauuuauuuauuuauguuuugagacggagucucgcucugucacccaggcuggagugcaguggugccaucuuggcucacugcagccucccccuccuggguucaagccauucuccugccucagccucccgaguagcugggacuacaggcgcccgccaccacgccuggcuauuuuuuuauauuuuuaguagagacaugguuucaccguguuagccaggauggucucgauuuccugaugucgugaucugccugucucggccuccuggaguguuggaauuauaggcgugagccaccgcgccuggccucuucauuuuuuuuuuuuuuuuuuuuuuugagauggagucucgcucugucacccaggcuggagugcauuggcgugaucuuggcuuacugcaagcuccgccuccuggguucaagcgauucugcugccucagccuccugaguaguugugauuccaggcaccuaccaccacgccuggcuaauuuuuguauuuuuaguagagaugggguuucaccguguuggucaagcuggucuccugacuucaugaucugccugccuuggccucccaaagugcuaggauuauagaugugagccacugugcuuggccuuuuuuuuuuuuuuucuuuugagauggagucuggcucuguugcccaggcuggaaugcaauggcacaaucucggcucacugcaaccuccaucuccuagguucaagugauucuccugccucagccucccaagcagcugggauuacaggcaugcgccaccacucccagcuaauuuuuauuuuuaauagagacgggguuucaccauguuggccaggcuggucucaaacuccugaccucaggugauccgcccgccucggccucccacagugcuaggauuacaggcaugagccaucgcacugggcccuuuccacuuuuuaaaaauggaaaaaccauucuuagcucacagcccuacaaaaauaggugguggccggauucggcccaggggcuggaguucaccuagccugcccaggcuggugccugaguccgcgccccucacuccucucccugugggucugucucagccccgacaccugggcagcuucccacuggguucgucauugagaggcucugggcagggggcgcuguugcuucacuugggugccccugagucacccagugccugcuuggggucuacaggguacagcaggacccagacucgucacugcgccuggggacccagauuuggagugaaagucugaguugaucaguucaacacaggcaaagcauaaccaacauagaggcugggcucacgccuggaguccuggcacuuucggaggcugaggugggaggaugguuugagcccuggagguggaggcugcagugagcugugaucgcaccguugcacuccagccugggcgacagagcgagacccugucucaagaaaauacaugugugugugcguguguguguauguguuugugugugcauauacauacauguauguauuuuaggauacagcauugcguuuccggccuccagaccucccaacaggcgagcccagccagggcgaugucugugggcaggcagggaguguggaagcuucugcuggaacagaagcgccugccuuggggccuggcucuguagaaacagacccuccuggagcucacaguuguggcccaugagagucagggugccgugggaaggccagcugggugccugcauaggaacgggguccccgagggcuucuggggagagaggggggcuggccaggggcauccaugagcccccugaggcagaggccugcuuugcccgcccccgugagucuguggcccagccgcccuccacgacuugcccucuucccccggcagaaccucaaccagaacccgcggacgcugcugcccaaguucuaugggcuguacugcgugcagucggggggcaagaacauccgcgucguggucaugaacaacauccugccccgcguggucaagaugcaccucaaguucgaccucaagggcuccaccuacaagcggcgcgccagcaagaaggagaaggagaagagcuuccccaccuacaaggaccuggacuucaugcaggacaugcccgaggggcuccugcuggacgccgacaccuucagcgcccuggucaagacgcugcagcgggacugccuggugagggcucggccccggccggggagggaggguggcaggugggacugcguggugagggcucggccugggcaggcagggccagggagggugccaggccgaggcccaccugcccugcagccuacagcaggccccaccccagugugggauccagaagcgcucaagcuuuuauggccuuaaccuaaaauguggccggacacaguggcucacgccugggaucccagcucuuugggaggcaggcagauggcuugagcccaggguuucaagaccagcaggggcaacauugugagaccccaucucacaaagaaaacaaaacacuuauaacauguccccagacccagcccuugggggucgggagugucugcacugcugagaagugguuccucuggagguuacacgaugacagugguagaguccccccaccccccagagaagagcccagccuucagaugcuguggucacaagcccagagcucccagccagccaugagagcuugcugugccucaguuuccucacccaucaaaugggaugacugcuugcucugcaggccacagugagggcccaugugcguccagugagggucuggcuccuguccccguggagccugcguuggcuccguguuagcgaaagaaugauaugcacggcucuuccucugccuggguuagcuccgucguccccgucccaccccggcagcuucgaggcauggagccaaggaggggaggccccagccugucaggagcagagccugggaccucccagcuccccaacuccacccaggccccgcugcugaccauccccagcuccccgaccccuuugagaacuugacccauacccccagaaaaccgcccagaccacucaggggccuugaggcuacccugggcauccacccaccugggugucaccugucaggccgggcacguccuugcccaugggccugggcuggucagagcauaggcccggcucccugucucucaggaaggaguaaagccaggaagggaagucccugucucagugcccggggcagccugcugugaggcuggaagcccccauucucuggccugcucugaugccgcugugugaccgcagccccucuguuccucaggauaacacuagaacccccacuccugccuggccgugggacuccaucucucacacccgagcccacggggccauccgugcugggaaccccauaggguccgggagccguugugggggauagagacggcugacggcguggcguguuccugcccgaucccgccagguccuggaaaguuucaagaucauggacuacagccugcugcugggcgugcacaacaucgaccagcacgagcgcgagcggcaggcgcagggcgcccagagcaccucagaugagaagcggccugugggccagaaggcgcucuacuccacggccauggaguccauccaggguggcgccgcgcgcggggaggccaucgaaucggaugacacguaggugggcggggggccgccggacccgucccgcuucccuuccccacaggcuccaguuccccauccccgucccaagugugaaaacaggcagggagggcuggcgagggcaugcgugggugacagacagagucugggagccuugugccagcgccucagagcgaagccaggccguagugcgggccgcaggcugagugcaggguuccgggccuuggcuugcaauggugggggcguuucccauucacccgugacugggccgaggccacuggccauccacaggaaugagagagagauagcguuucccgguggcacucagaggggucuacacgccacccgugcagagaggggccacaaagguguggaaggcgcaugggaggccagagggaucgggcgaggcagggcucacagcaggacacagcccacgaagcagagggacugcaaaauccgauuccacacagaucaaagcagcugcuggcugggcgcagugucucaugccuguacucccagcaccuugggagaccaaggugggaggauugccucagccccggaguucaguaccagccugggcaacauggcaagaccccaucucuacaaaaaauauaaaauguagcuggacgugguggcacgugcaccuguagucccaacuacuugggaggcugaaggcguggcaggcgugagcguggcaggcggagguugcagugagccaagaucacaccacugcacuccagcuugggcaacagagugagacccugucuuaaaaaaaaaaaaaaaaacgcugggcgcgguggcucacaccuguaaucccagcacuuugggaggcugaggcagguggaucaucugaggucaggaguuccagaccagccuggccaacauggugaaaccccaucucugcuuaauacaaaauauuagcugggcgugguggugcacgccuguaaucccagcuacuugggaggcugaggcaggagaaucgcuugaacccaggagguggagguugcagugagcugagauugagcuauugcacuccagccugggcaacaagagcuaaacucuguccaaaaagaaaaaaaaaguggcugccacagaagauaggaacggugguggagagaggaggccacaucucaguggccugcagucaugucugcuggacaccaggggcagagggaccaggcaggcccugcccucacagggcucaggguuuggcuggggagauacucacagagcucuccugggacacuggaugugagggcugggucauucucugggguggggcuguccugggcacugcagggugcugagcagcgucccgggccuccacccacuccgggccaggagcaccccccaguugugacaaccacagauguccccagacauggccccggaugcgggauagacaggugucguauagcagugcugagauugugcccuggucacagcagcacccugacagugggggcaggcccgagccuucacuuugguaccuguucagucuucacagcggccuuggaggagggaggugggcuuccccuguuuccagcugaggaaauaggcuccuagguuggggggcagccuuccccagugcagccacgaagguguggagccaaguuccaccuggccuggccccagggacggugcuggcuggcacuggcuggcacuaggccaccagcugggcuuugguuugcagcgguggugguauuucccauggauggcagaggaggagccggggccccaaccaggguguagcugcgggggggugcgggagccaaggccaggcacagcucccccucagaccauccuggcguuuguagggucuucgcuggccuggcgggggagcaggugagcguaccagccuguggcgugagcagagcgugcagggcgccagcccagcgggucugggucccaguggcuucaggaugacugcugcacguguggccucacuaaccgcgcugggcaggggacgugugggcacggugccgggugacaguuaacucccgcgcugggcaggggacgugugggcacggugccgggugacaguuaacucccgcgcugggcaggggacgugugggcacggugccgggugacaguuaacucccgcgcugggcaggggacgugugggcacggugccgggugacaguuaacucccgcgcugggcaggggacgugugggcacggugccgggugacaguuaacucccgcgcugggcaggggacgugugggcacggugccgggugacaguuaacucccgcgcugggcaggggacgugugggcacggugccgggugacaguuaacucccgcgcugggcaggggacgugugggcauggugccgggugacaguuaacucccgcgcugggcaggggacgugugggcacggugccgggugacaguuaacucccgcgcugggcaggggacgugugggcacggugccgggugacaguuaacucccgcgcugggcaggggacgugugggcacggugccgggugacaguuaacucccgcgcugggcaggggacgugugggcacggugccgggugacaguuaacucccgcgcugggcaggggacgugugggcauggugccgggugacaguuaacucccgcgcugggcaggggacgugugggcauggugccgggugacaguuaacucccgcgcugggcaggggacgugugggcauggugccgggugacaguuaacucccgcgcugggcaggggacgugugggcauggugccgggugacaguuaacucccgcgcugggcaggggacgugugggcauggugccgggugacaauuaacuccccagucuguaccugagaccccguggcccuaccugggcaugcagugugcgugugugugcauguguguguccaggcacacguguguguaggggguaugugcccaggccuccuagcugggacuccucagcagugccugggccuggguuugaggcugggggugauggagggaugucaggacagagguucccgggugccaggccccacuccgagagcuuggccaaguugccacccacaggagcagauggacucccuagcccuggaguccccagccccgccugccccgagucccagcucugcgggaugcugaugguacccucggccucucuccccaggaugggcgggauccccgcugugaacggccgcggggagcggcugcugcugcacauuggcaucaucgacauccugcaguccuacaggugggugcccgggucugcaguccuacagguggacgccccgggucugcagucccacaggugggcgcccgggucugcagccccacaggugggcgcccgggucugcagccccacaggugggcgccugggucugcagucccacagguggaugggcgcccccaggacacccaugcacagaggcgcuugcccguggaaacagccgcaccagcagcucucggggcuuccucaaccuggaaagcucuugcuuggcugccccuucuugagcccuaaagggaagguguuuggucgccuugaaaaucuagagugaguugggcguagugguccacaccuguaaucuagcacugugggaggccgaggcgggaggauugcuugagcccaggaguuugagaccagccugggcaacauagcaagaccccaucucuacaaaauaucaaaaaauuagcugagcgugguggugcuccugcagucccagcuacuugggaggccgaggcaggaggauuccuugggcccaggagucuggggcugcagcagugagcuaugauggccguacugcaccccaggcugggugacagagcaagacccugucccaaaaaaaaagaaaaaagaaaauccaaggaguggguuugaggccucacuuuggggcucgaauauuuguuuuuugguuuuucauuuguuuguuuuaagacaaagucucgcucugucacucaggccgaagagcauuggugcgaucuuggcucacugcaaccucugccuucugagucgacccuauucuccugccccagccuccccaguagcugggauuacuggcacgcgccagcacgcccggcuaauuuuuguauuuuuaguagagaugggguuucaccauguuggccaggcuggucuugaacuccugaucucaggugaucugccugccuuggccucccaaagugcugggauuacaggugugagccaccgugcucagcuggggcucuagaauguuuaaaaacagucacccccucgguacuauggacauugggaccagaugguucucugggguggggccguccugggcccugcaggguacugagcagagagccuccacccacucccugccaggagcaccugccacccugaguuuugacagccacgacugcuugaggccauggcccaguguccuggggggugcacaguggccccugagugagguggccuggcaugggcuuggcugaugucagcugccacuccgggugcucucuccacagguucaucaagaaacuggagcacaccuggaaggcccucguccacgauggggugagcgccugcacccuccucccauuccuccucccaucccuccuccuccugugagugccugcacccuccucccaucccuccucccucugugagugccugcacccuccucccaucccuccucccaucccuccuccuccugugagugccugcacccuccucccaucccuccucugugagugccugcacccuccucccaucccuccucugugagugccugcacccuccccccaucccuccucccucugugagcgccugcacccuccucccaucccuccucccucugugagcaccugcaccccuccucccaucccuccucccucugugagcgccugcacccuccucccauccuuccucccugugagcgccugcaccccuccucccaucccuccucccucugugagugccugcaccccuccucccauccuuccucccucuguccuccugucugucgucccagccuuccucccauccgucacuccacaaacgcagaguaccgccuggggccaggcacugaggacuaacgucugugugaccacagccuguagaauccaagaucccaacaggcacccccauuuuucaaaagagcguguagaagguccaggcaggagcuuccagaauaagccuugagcgggucaggauggcagcuggcagaggccucuggggaugucuuaaaccuugccaaggcccggaaccugcugcccagggcagauaggagcgcugucucggcucugacgaggcuggccaggguguccugugcugccgccgcaugucccugggguuguccuuguccccuggcccagaguggccgggcaccaccucccacugcagccugcggggguggagucguucacaguccugguacguggccacuccucacccaaggaggcugggaaaggagguugcauucugggaggccgagaucacaucccagcagggccccagccaggccauccugccucagccuccccuacaaguccacgugggccacugugccuggccggaauacuuuauucagcugguuuaaaaagucaaaaaugcuaacaggucucuaguggaaaagccuccacccauucccuggcacccagucucccuccccagagggagccacuguucccuguuccgugagccccucccaggaagccauggcgccauggacccaucucgagccuuuucacacagaaggugccccccacacacauacagcgucugucuggggcuguccccagcuguugauugaugcacccucugcccccgggcaccccccccaacucucuuccaggacacgguguccguccaccgccccagcuucuaugccgagcgcuuuuucaaguucaugagcaacacggucuuucggaagaacuccuguaagccaccugagccccgcaaggcgggagggacccuggggaaggcccagagcgccguggggcaggagggacucugcgggaggccgagagcccccugggcagggcaguaaacucagagccccugugccccccucagaccgggccucauccggagguaggguagucgggauauuugcucugcacagcgguagagcacgggucuggagccaccgccagagccugaauccuagccuggccucguccugcccauguggccuugagcaggcaccugccucugugccuugguuuccccauuggcacagcacugugaggguacaguguuuauauaugggaugggugggccugacucagcagauagcucacaguguguggggcugcccacagcaucaccaucgccaaggaaacgcaccccgggcaggggaacgcaggaggcuagcccagcagggcauggucgggaaggucccagggcaaacagugguggggaagguggggacucgggauucacccacagggugcccgggggagguccccaucucucagggcucagcuuccccucaugggccacuguagcaucuggacgcagacucuggguuccaggccccugugcagaccucagcccguggccaaccugcugccagauggauuccccccuggggucuguuucucagccacccuccccaccagaaggcucccgggcuccccagcauccugcacaggccuggcccacagagaugcuugggaagugucugguggggggcaugaaugaucugcggguccgcacccacggggguugcagggagguggcagggacaggcacgccagugcccagcgcuugcaggcaggcugcucuucccggccugcacacuugcucacggccucgaggucagggacccccucucaucaacaccgugggaauuggcagacaccacgugucaggaucugucuccagagagccagccguugagccuguccccacaccccacucucugggaccgaugccacaggaucauuccgucauccagggcuguuugccagccuuuggugauuguaggaagcugcacaaggcaaacugagcaccuacuguuuaccaggagcugugugggucauucugggggcagaggucacaagagcuuggugaggaggcagagcucacacagcacugaggacaggccuggcccugugcgggacaucaccugccccaccucaccccaccgcuaaggucggcccccagggcccagagagaccgagccgcacagccagcgggugagccuggaucugcgcucaggcccuacaugcugagccacaggcuucucuaaccacaacaccuggugcuccccaaggcugucaguguccaucugaaagugggggcccugcccgggcugggccgcacauagaagggguugaagccugcaggcaucccuggccagcucauuagaugggagucacuggucugcaggaucccaggaggggcaggcacugugccaggucccagugugucucauagagacagucgggugggcaggacagggaacucgggcucgcagucccuccccaggcagaccccgguuuuccaccaagagguuguggugcuuccuggccucagggaccgguaggggucuggugggccacagggacgugggguauaugugggcggcggcccugucugggcuuugcuaugagcccccagcaaccccaagcaccaacccccacccuucccugcagcccugaaguccucgcccuccaagaaggggcgcggcggagccuugcuagcugugaaaccgcuggggcccaccgcugccuucucggccagccagaucccuagcgagcgggaggaggcccaguacgaccugcggggggcccgcagcuaccccacgcuggaggacgaaggugaggggcagagggcagagugcgcuugugggcgcuacagggggugccagcagcagccccguggguggggugccgccucauccugagugcccaucgcucagccacccccuccggaucugcagggccgccugcccagggagugggggcugcugggaccgccccagggaagagcccagggggagcugaguauagaaggcuccaccaggugggguggugacagcucccgccuucucucacggccacugucaucugaggugcaccaggaugccaucgaaggcaugcagcccccaggcuagggaaugaaggaagggacauagccaugcaagggcccuggggcaggaccacaccugcugagggaacagcaaggagcccguguggccaagcagcgcggaggggaagggaggggggguggggaggggaagagagcaguggaggggaagacagcggggagggagaguggagaggggacggggccaggcugcacagggcccucugggcugucuggauucuauuuugagagcggucagaagccuuugugugagggggaacgucguccuucccugccguguggggaggugggagugucugggaggcgggcgggcacugggcuguggguucccagggugagccaagccucagggagaaucgacuguguguuugggggcucggaggcuccgcaaggugcccacaguccucuccccucaggccggcccgaccuccugcccugcacgccaccuucuuucgaagaagccacuacagccuccauugccacgacucugucauccacaucccucuccauuccugagcggucccccucggagacgucggagcagccgcgguacaggugggcgaggcauccgcagugcaugugggcggggcauccgcugugcgugggggcggggcauucacugcaugugggcggggcauccgcugugcauguggguggagcaucguauguacgguggauguacauacacugcaugugggugcgcgggggcggagcauccaaugugugggagggaggagcauauguacaggugggcagggcugccagggggcagguaggcaggcggguaggcaaggcagguagacugagcaggcgggccacucucuuucugggugucacguguuugcuguaucucugcaggcggcgcacacagucgucuggacaggauggcaggugagacccaacccccuuccuucccugggucucaccagcuccuccugcacagcucccagcuccguuucccgccccccagccccucugcucucugcccauucucuccuggggacagauuuaagauuguagcacucggcccuagcaccgcacacaaucuuccagccacuuuguuuuucuuacagccagagccagggcagcucuggucuguggauccuuccuuauuucuucuucuauuaaguuuuuuuuuuaacuuaaaacaagauacaagagggaauaucgugaaaugcgcccccuccugcccacggccuguccccuccccaggagcaaccacugggacuguggguuuugucucuuggaagauacuuucugggaacacagcagacgugcaccaggcuugugguucccuuuuauuuugacacaaaugggcacacccgugcacgccgcccacaccuugcuguugucacucgacugacggggaucucaggggugggugcgcgccguuccugucacgccugcgugccguccuuccaucccauggacugcaccuggcuuuaagugcccagcccucggggacauuugcgaggucccuggggucucacucuugugaacacuggggcaguggcgcgguguugcuuuucuuaaccguguuuuaaucgcugccgccuggugaaagaaaccccuuggugcccugggugggaugugacccucccugcagucuagcgugccauuuggagagacauguuacauggccaggcccggcggccgggacacugagucacuugugucagggccucggcugccaggugcaggcacugccuggagggugggcagggucuguggcacccacaccggucggggcugccauuugcucauaugcccccagagcccgcuacaccccaggcccugcuggcaccacagucaccaagggacccagguggacaguccccgggcugggagugacagccagaaagaacagacccaaucaggaggcucccaacuccccucugggacuggcccuggaguucacugggcacuccuggggguaggaugggggaagugaggagggaaaccgaggcacaaccucccauugccugcaggccgcaggaggagccacccgcggaagaggaucugcagcagauuacagugcagguggagccugcgugcagcguggagauugugguccccaaagaggaggacgcagggugagcacggccucggcgggaggucggggcgcccaccugcugcgggcccagaggagccaagagcaccccgagguuucaucaugaagcaguucuuucuuacuagguuguauucacagaugguggauuuucccauaaguuuauuuuuugauugaagggagugguucucgacuagccggggugauccuagcccccaggggacacugggcgaugccuggggacauuugugacuguuagaacuggggggugcuccuggcauggaguggguggaggccagggacgcugcucagcaucagccugcagugcccgggauggccccaccccagagaaggaccugguuccaguguccacagggcccaggcaagagacccugggcuaaggguuguguaagagcaucucugaacuuccaaguauuuaacuaauuuuuuuuuaaccuuuuuaguauuuauuaauuuaauuuuauuuuauuuuuaauuuuuuaaauuuuuuuugugagacaggauauugcucucuugcccaggcuggagagcaguggcucaaucuuggcucacugcagccuccgucucccagguucaagugauucuccugccucagccuccugaguagcugggacuacaggcacccaccaccacgcauggcuaauuuuuguguguguuuucaguaaagacaggguuucucccaucagccagcugggcaggcuuggucucaaacuccugaccuuggccaggcacgguggcucaugccuguaaucccagcacuuugggaggcugaggcaggcggaucacgaggucaggagaucgagaccauccuggcuaacauggugaaaccccaucucuacuaaaaaauagcaaaaauuagccgggcguggugguggacaccugucggcccagcuacuuaggaggcugaggcaggagaauggcgugaacccgggaggcagaguuugcagugagcugagaucgcaccacugcacuccauccuaagcgacagagcaagacuccaccuaaaaaaaaaaaaacugaccucgagugaucugcccaccuuggccucccaaaguacugggauuaauuuuauugauuuuuguauugaagaaaaaggcuuaaaagaaauaucuguuuuuuuaaaaaacacaggacacaauaguucuggcccuuuuggggauauggugucagcugcuguuauuauuauuuucuuugagacagaaucucgcucuguugcccaggcuggagugcaguggcacgauuucggcucacugcaaccuccaccuccuggguucaagugauucucuugccucagccucccgaguagcugggauuacaggcaugcaccaccacgcccggcuaauuuuuuuguauuuuuaguagagaugggguuucaccauguugaccaggcuggucucgaacuccugaccucaggugauccucccgccucggccucccacagugcuaggaugacaggcgugagccccguggcggccccuguauguuuuuacuuuucugucaucugucugguguguauaaucccaugcuugcacuguuaccaaauucuucuugccuuuguaaugauuuuugccugagaugcuuuuguauuuuuguuccaagagagcuuuuuuagcgcucacagcagcguagacccaaaacuaaagcccuggggguuuaucuuccacccagugcuccugccacugucaacucuuugccauugccaaaccuugcaccgugaaauuucagguuuugcugaaaggaacuguaccuccgacauggcaggagggcauguuuagccucauuccugggaugaacacgaugcaccguguggccauagccaaggccaaggccguuccucaccuccucuccgugccuccguuuccgcaaaugcaacacaggggcaguagccgcacccucuccaucccccaugauagacucaguggguuaaucacgggagccagcccuggcauguaguaagugcucagugaaaagaacaaagaggcugggcucggaggcuuccgucugugaucccuccuaaaggaggcugaggcaggaggaucgcuugaccccaugaguuggagaccagccugggcaacauagugagaccccaucucuaaaaaaaaaaaaaaaauuaguuggguguagcagugcacaccuauagucucagcuacuugggaggccaagguuggaggaucgcuugagcccgggcgguggaggcuguagugagccgugaugacagcacugcacgccagccuggcugauggagccagggccugucugaaaaaacaaaucaaugaaagaaggaagaagcucugaucccagcggcuaggugccaucucuccccacuugacagaugaggaaacugaggcucagaggaggaacaggcccucccaggguggcacagccggugagggugaggccagcacgugcccacaggugugugugucugagcugggaguggcagggccgagcugucagcgggcuggcgggucacuccaggucacuccuggggccagcaugaggggcuucuuggggagguuuguucugauuugcgauaaauggcagcgcaggagcgcgcggccuguggucagcugccuggcuuuucaucuccgugaugaccguaugaagccccugccuggguccugagugggggcgcggggagucuccguguggggccugagggucaagacccucugucuacuccuguccccaggguggaggcuuccccggccggugccucugcugcuguugaaguagaaacugccagccaggccucagacgaggagggcgcaccugccagccaggccucggacgaggaggacgcgcccgccaccgacaucuacuuuguaagugccccgggcuccuccugccgccggcucgucaaccggacucucucucacacacgcuccaccgugugcacaccgcauacacacaccugcacacaggcacgugagugugcccugucgacccacccacaugcucucucaccagccagcacucucacgacacgcccacacgcacccaccagccacguucacacccaccuucucuuccuggucuaaccccauggggugggaagcuccuccaaaccaggccuuucugaggccccagagccaccccuguccccuuccccggccuugugcccacggcaccuucugugccacccgucucccuggaagucguccggaguccucagacucuuggccccucgggaggcccuggcacaggcugagguccuguguccuugacagccuagacguccagacagggcuguggcggcaggaccuucucccuguugccgugggcguggccaggugggcuuauccuugaggagggccgggggaccgggcaguggcaggagggcuucacgcucccacgccgugggcuggggacucguggcugcuacugggcagggcagggucugcccggcccuggggaccugggaucccugcucucccuugccagggucugggugagguggcugccgggcggccagcgaggccuggaauguccaggcagcgucuccacuccccaguggucccacucagaucaggcagccccaggucacagggagggccggaggcugcagcccacuucccagaugguuuguucucacccugcacccccugggaaggagggcugggcacgggcaccaggccuuagggccuguugugggggcaccuccucgcugcuucauaacuaacuccccugcucugucuccaguggcgccucugggguccccaugcacccaccuggcccuggagaagggagggacgggccgcgugccugugccccuacccaccgcacgucgucaccccuuuuccugggacugguuugugcgcguccuggucuccggaugguacggggggccugggggccaugucgugcugugugucuguguccugaugcccugccaggugggcagcagagaagggagaaggguccucgguccugccccugccccggcaccccccaccuucugcuuggcagucagcuguccccaccugcuccccgccaccucccuccgccucucccacccgaccacggggguggccgccucauccgcuguccucuguuuuccuuccuccuccggcccacccggcccgccccguccaguucacggaugggagguacuggauuuacucuccccgccaucgccgacugcgggccgugacgcugagcgccucggggacuguaagugaccgcagccggccacccuggggagaaggggcagugccccucgggcagcagggagccgcagguccccggccggaagcucagugucugacgucaguuguuuuccagaagggcuuuggguaaaucacggcugcaauugaggucagccacgcuggccccggaccaggcgcugggcugcaugcgucacugggaaugucauucggucccacgucgaaccgggcgcuccauagggcagcaccaucaccaggugcacagcugaggcccagggucugcuucggaccccggccagaccccagcgagccccucucugccccuggacccagcccucucgugucagggugucuuggguggacgcuucucacucgugcagaccuggcugcccguggccccgcuggcugcacaggggagguugcacaggucagcagaguggcugcagggccgggcucugaaccgcagggccauggagacggggaggagauggucucuccacacccaccucacagauggaggcgcugaggccucggcuccccugggagccugggagaccacacgguuuagucaaaauccagauccccaagcucucaaggaggucccccugggacgccacaugggccccacguagcugugagauccucagggccugcuguugucauuaugaccaauaagcaaggggcccagagagccuaagagaccugcccagcaccgcacagccagaacggggcgcagacccaaagcaggaguguccccucgagacaaagccuccgccgaggccgccgugacuccccgcccaucagcaaaccucuccgagcaccucugugugccaggcacuguggagugaccccaagagguggagaccacuuccccggcugcucuaggcagcuccgucccacggagccagcgggaagccagccaccgcgaagccgugccccggagaucguccaggagcugcccagaggggccugcugggaggaggagcacuggagagacccagcggcccugcuggccaccccaccauaggcagggagcaguucgcagaggccgccuacggaggggggugcuuggacuuugaaaaacaccugacuugaaggggcagacguggggaggguggucucggcagcaggcacagcagaagcggaagugugggggccagaagggaggcagggcagccauugaaagcaccccaaggccugagugcugaagaggcugugcccuugguucuggucuuccuggggucacccgguucugggucccagcugcuacugccccccacuuccccugucugcccagcugcuggcugagggugucccucucuguccccccaacuccugcaggacaaggaagccaccuguccugcccuuucuuuuuuuucauuuuuugagacggagucuugcucugucgcccaggcuggagugcaauggcaugaucucagcucacugcaaccuccaccccccagguacaagcaauuauccugccucagccuccugaguagcugagauuacaggcgccugccaccaugccuggcuaauuuugaguuuuuuguuuguuuguuuuuugagacagagucucguucugucgcccaggcuggagugcaguggcacaaucucggcucgcugcaaguuccgccucccggguucacgccauucuccugccucagccucccgaguagcugggacuacaggcgcccgccaucaugccuggcuaauuuuuuuguauuuuuaguagagacgagguuucaccguguucaccaggauggucucaaucuccugaccucgugaucugcccgccucagccucccaaagugcugggauuacaggcguaagccaccgcgcccagccuuguuuguuuuuuuugagauggagucucacucugucacccaggcuggaaugcaguggcucaauuucagcucacugcaaccucuggccuggguucaagcgauucuucugccucagccucccgaguugcugggauuacaggcuccugccaccaugccccaauaauuuuuuguauuuuuaguaagagaugggguuuuaccauguuggccaggcuggucucgaacuccugaccucagguaucugcccaccucggccucccaaaguucugggauuacaggcgugagccaccacgcccggccuuaaucuuuguauuuuuaguagagauaggguuucgccauauuggccaggcuggucuugaacuccugaccucaagugauccaccugccuuggccucccaaagugcugggaugacaggcgugagcuccugcaccuggccuguauccccguuucuaaugcuguagcagaaggauacugucaucccugcccacgugcugugugugcccgggaugccccucccagagagcggcucugagguggcugcugccacccuccucccugcgggccaguucuuucagggcucagguggggacccuguuuuggccccacauuuucaaguccccaugggauccaucagugcagccaccaaaucaguacugagcacccacauaggcuccccaugccgggcucucaagggacguuggguggaccugaccugccauucccacgucagggauuccaggcugcauuugcuacccuggaggaacaggcaaggccugcgcugggguccuggccccucagugcaggagucaguccuccgcgaugcggccucgcagggcaggagugcgcugcccucggugcccagggcccgggaacaggggucuuguggaagcuguaggaucgggcaggguggagugagcacagaggugggcccuuuagagggagcauggaggcagagcccgaggcagggagaggcagugcuccugcaggugaggucugggcucaccuggagcacaagggaggccccugcuggcccaggcugggcaacugggagcuggcagaggcauggguuggccugggcagcaggugggcagcgucauccugacuggaaggacgagcagugggucuuggggugauggacuggguugugacuguggcgaguuuaggggccgagggccgccagguggacguggccaggcagguguguauucaggccuggcacuucaggccgaggccaggccugguggaaauucgcaggucaucugugccgggaggggcguugaaggcuggguuggugacagaggcccgagagagaggaggacacaacaaggaagacagggcggccaggcuggagcccugagaaagcagagcagccuaggggcaggagaagcagggggagcuugagggggugggggcuccucaggaggcgggacggagguguuggaggaacgcacccucccucccuccccagaucccacccagaccugggaccccucacgcaggcacagcugggaagagcuguccgugucccugcacacggcccugccugugccuagcccugaacuuggcccucacucugcccugcugcucaggaaggcgucuccuggcucuugcagggugggugguccgagccucagucucuccuagcacgucugugcuggcagaggggacuggcccugcccgcaggcagccauauauucaggucccaaaaggcuucuggguugggaaguagguccggcaccccgaccucccaggacccccauagagagcuuccaggagccugugcgcuggugcccguggcacaggcaggauugggggcugugguggggccgggcuguggaggaggaggaggaggaggaacacucggugcuccaggucgcgacccccacccgcuuccgccggcucugucaccugcuaucucaggcccugccucgacugaacuaacugcuuucugccgcccgccgugccccgccccgccaagcugagcugaggccccaggcccguccagguugggagcaaguccaccgggucagagagggcagcugggcugagccaccccucgucuuccaugggggauucgccucuuuuauguucuccugucucuuccuuccucccucugccucucuugcaccuccucgcacccugcucuuccgcgcccuccugcacgcgcgcccaccugccagcccaccgaugagaggagcuggguguacuccccgcuccacuauagcgcccaggcccccccggccuccgacggcgagagcgacacaguaagugcagcccaggugcacccgccggucccgugggcuccaagguucuacugagcgugguccccagcuacugggauaggcagggacugaggcccggggcgggagggcacagguggcccagagcuccacccugggcucucuggcucugagguggccgugggcuaagugucucagggccuguguuggcccaaggaagccagucccuggcagggggccuggggugggcccucgccccgcccaccuucaccuguccucuugcucuugcaguaauuucuaugcagcccccgacccagagccgagcuccacuucugcuccggcugcccccgaaggcgcugcccaccccgcugaggcccagagcucgggagaugcccgccucgccgccccaccggaccucguccucccccugcacggaugccgacggccgggccccuccccgacaagccucccagggccccggcaccccggucggcagccugccccugugagacccacccucccgagcggccaaucgcauuugaguccuuauuuggcacagagacggaagcacgugugugccguuuuaggaaaagaacaaaaaagacacaaacaaaccaaccagagggagaagagccccugcccacugcacucuuugguucucugcugugccugccuguguccugaggaagaagccaggcuguucgcgguggccucuggggaccugagccccgggggccccaucggccugcagaggggacggcuggggucccgagcaacucugccuccauccacgugggaagcggacccuccugcccucagcuuggguuugggggccucagugcaggacaucuggccugaacaucgacuguggggacagcccucgcccugccaagcacugcggccacucagcagcuauguucccgccgcaguggggcccugacgcccaccucccaggugccccucgagcaaaaaccucuggcgccuccaauccagacccaccacagcuggagggccaggccuccucuuccccaggcugccacccacgcuggcggagcucagggcuggggacuuguccuucucuuccaacguaggccacucagcaacuggcauggagggcccaggcaacggagacguuuucuccauggcaggacagagcgggaggccgggccuugggccacaggagaccagcucagggcggaaggucaggcuccccgcccccuccacguggagacauggccuagggggccaggcccggcuccacaggagucuccuucaggacugguguggauguccgccgccucuuucuuguuuaagugaugugaugucuccgaggaggggagagaagacuuuguuuccgacucaucacccuccaagagggcagcgcucccaguggugggacucagcccagacugcccuggggcagcuuccugggcccgcugcgcucagagggugcugguuggaggccagagcucggcagagucacccacccugcccuuccccaggaccccugagaggggcuuauuggugauggcugugggaaucccccacuuccaagaugugcccaggaugugaggagcuggaguggaagcugcaccuuugggaagaauuccucuccagaccuggcagagccugguguggggucugagacggccggagaaccucccaggcagggcucuguguuuugucuguuacaaccuccguaugacgccacgccacccgcuguucacgucccgucggccuccugcacagcccacacgcugcgcccggaaggccccugcuguggagaagccggacccauccccgagguccccagcgaggacacacacuccacgagagcagccccuccacucugcccaggagaggggccgacccuccucgggaaccggccagccgcguggcucccagcauccaucaggacaagcccacgugggguccucccugcgugcucagagggucuguccagcccugggaagcgaccuuggccucaguucacagccuggugcucaucugcuggcaccgggcauccacccaucagcccccgcccugucccuccgaaggacacccagcaggcaccccccggggaggcaggggcagaggucagaaggggugucugggaccuggauggccagcagggacaggggcauugucaucucaaaggcccaacccccagaggccacaccaguccucccagggaguccucgagucgcccugcccagagcccuggcaccagagacgccaagagccuguggggugacucggagcagcagguguggccccgggcgggcggcaccgcguccagggcagccucccuccgcugagugacacgggacaccagugcccggccgacgcgccuuugcaggagaaaugugcaaaccucuguggauaccauuucauuuccauucuuguguugucuccaaggcccuuuuggagauauacuugguguugguuguguuuuuugguuccuuuucagagaacuguaaaccgaggcugacgugcuccacugacugugccgaggggcgggggcaggaggacggcaagaccuauuuauaauauuuagcgaacucggucucccucagaucccccgcgagggaggcugcuggacccaccccgcugucccccaugauagaagucuguaaauaccuuggugaccaaugcccacuuccccuccugggucaccucugauggcugcuguccacugagaacgugggcaguguccaaauuccuguacuguaaagacuaaaaggcguuugcucugagacugacaaggcggaaacuuccaugugucuccugccaggcucugucccccuacgccaucccgacacguccccguucccccgaaaccuggcucagugcaauacucccauugccaugggguccuucaccaugguacugucuccacagcccucaguccccaccccaggagaggcgccugccaccuccuccucaucuccggugguucaaucgcuccgccuguccccaacccagucccauuuuuauggccaaacugauucugaaacaaaaugaaacugcaaaccucgugugucuuaacuccccccagggaugccacuccauuccuccgccccguggucuggugcgugacaauccaaagcgccgagacgagggugcugugucccucaaacccagaguggugggcgccucugaaaccauacagccacuccuggccccaaacacugguuugcaucccagguuccucgcccaccuacccccgccacaccccgucuuuuuagagaucucucuaauaaaucggguaauaagcauc

SEQ ID NO: 192175 - RNA, 7971 nt, Homo sapiens
cggguggguggccgaacuucucccgccauggagggagcagcggcccgggaggcccgggggaccgagaccccgcgcgcgucugcgcccccgcccgcgcccucggagcccccggccgcgccccgcgcccgcccgcgccucgucuuccgcacgcagcuggcgcacgggagccccacgggcaagaucgagggcuucaccaacguccgcgagcuguacgccaagaucgccgaagccuucgggaucgcgcccaccgagguaaggagcccggacaccggcgcccaagaccacccgccugauggggugagggguagggagcuuggacccuggacgggagaccccagauccccggaucccagacgucgggguggccgccuaaucgccggaucucagagacccagcccucagaucccggggugccacacucccaggggcccccuuugcacgcucugcgcaaaagaugggcaggucuuaggacuagcggaccccuagauauuccagaaaauccucugcgcagaccuagcuuggagcggaccccagcccucggggaagcgccucugugcuuccugggcguagcuggggucugggguuccagauggcccccuuagggaugggaaguuugaggccgccgugggguugggggguuccugggcguuuuuccaauccggguucguuugguuugcagcccccagggggcgccagcagauuaaaccuggaggucugggggcuggaggucccgggguauggagaggggucuccaccugcuggaagucuccuucucccuccucucucuguucugggggucccacgcccugcccuuucccaugggcugggauccuggucgcugggggcaggggccugcgcagacaggguggcugcguggggggaugcaugcccuggcuaacucuaggcuccuucucccccgggaagauuuuauucugcacccucaacagccacaaaguggacaugcagaagcuccuggggggucagauaggccuggaggacuucaucuuugcccacgugcgaggcgagaccaaggagguggaggucacuaagacagaggaugcucuggggcugaccaucacggacaacggggcuggcuacgccuucaucaaggugcccgggagggggugggcggguggcuuccugggguccagcaacugccccccccacucugggucgacguggguucugcggauuggaggcggguggcugggguugcccugccagcgacgcuggaucccugcagagaaucaaggaaggcaguaucaucaaccggaucgaggcagugugcgugggugacagcaucgaagccaucaacgaccacuccauugugggcugccgccacuacgagguggccaagaugcuccgggagcugcccaagucccagcccuucacccugcgccuggugcagcccaagagggccuucggugaggcgggugggcuggcgggagcucuucccgaagugcguucuacggaugccugggguggaggagggucggggaugggacgggcuggaagguucuaggugcacccgcugcgugccaaggagcuccuggcaggguaucagaaacucguagguaguuucuauuaauagauuguuauggagucagccugugggggaggggugggggagagacuggguaaaguggaguuggaggaggacgcguccagaaccacuuuggagccaggcugggagacuuguuuuuguuuguuuguuuguuuguuuguuuuugagacggagucucacucuguugccugggcuggagugcaauggcgcgaucucagcucacugcaaucuccaccucccggguucaagcgauucuccugccucagccucccgaguagcugggacuacaggcacccaccauugcgccuggcuaauuuuuguauuuuuaguagagacgggguuucaccaucuugaccagucuggucucgaacuucugaccucaagugcuccacccgccucagucucccaaaaugcuaggauuauaggcgugagccaccgcgcgcagccugggaacuuuuaaagcagugcuuugaggucaugguggauuguagagaaugagaauaugagaaaaaaguuuucuuucuuuucuuuuuuuuuuccuuucuuuuuucuuuucuuuucuuuuuuuuuuuuugagacggagucuagcucugucgcccagacugcagugcaguggcuagauuucagcucacugcaagcuccgccucccggguucacaccauucuccugccucagccucccgaguagcugggacuacaggcgcccgccaccacacccggcuaauuuuuuguauuuuaguagagaugagguuuuaccguguuagccaggacggucucgaucuccugaccucgugauccgcccaccucggccucccaaagugcugcgauuacaggugugagccaccgcgccuggccgugccagcuaauuuuuaauuuuuuucuuuuuuugagacggaguuuugcucuuguugcccaggcuggagugcaauggugugaucucggcucaccacaaccucugccucccagguucaagugauucuccugccucagccucccaacuagcugggauuacaggcaugugccaccaugccuggcuaauuuuguauuuuuaguagagaugggguuucuccauguuggcaggcuggucucgaacucccgaccucaggugaucugcccgccucggccuccgaaagugcuggaauuacaggcaugagccacugcacccugcccauuuuuuuucauaacuagacuuucucaaugaagaaaacaguguauugauuuacacacuagcacauucuccucauguagccauggguuggcccuuuggauagcguuguucuauagaacagagacagagauucuagaagugccccagcacacauggagagacgucccagggagagugagcuguaugggguucuagaaucugcccugccguggcugugaacuccaaaagccaugccuaaaaauagaguuuaggccgggcgugguggcucacaccuguaaucccagcacuuugagaggccaaggcagguggaucaccugaggucaggugauccaucguaucaaaaaaaaaaaaaaaaaaaccuggcugggugcaguggcucaagccuguaaucccaguacuuuggaaggccaaggcgggugcaucacgaggucaggaguucgagaccagccuggccaauauggugaaacccugucucuacuaaaaauacaaaaaauuagcugggcaugguggcaggugccuguaaucccagcuacucgagaggcugaggcaggagaaucgcuugaaccugggagguggaggcugcaguaagccgagaucgugccauugcacucuagccugggugacagagcaagacaacaucucaaaaaaaaaaaaaaaaaucaagcuuagucugagacuaaacccagcucuagagcccaggccagcucucagaccaagcccugcucuuaagcccaggccagcucugagacuaaguguguuucuagcaccucaguccugacacuaagccggguucuggaacccagacaagaacauaucuagauugaggauccuaccacaaggagggucccaagcagucccuucuagagaaagucgcuagaagagggagagugagggcauggaacugggauguuaguucuaaaccugcuccauuacaacaccucauucuggacuugugauuuaguuugcuggggaugcgaaguguggaaucucgaauaggucucuggagacuugccguacagauguaaggaggacuuugaaggggaggaagauucuagaaaggcucggcuguuggccucccaggguuuacaaagauguggcuccacccagaacccauggccaucccucacucuguucccuccagauaugauuggccagagaagucgguccagcaaauguccaguagaggcgaaagugaccagcgggagggagacccugcggcuucguucugggggggcugccacaguggaggaagcggugagugaaggggaggggcucuccccaggcuucugcaccuucagcuccuccacugagucagugcggucuuggguaagaacuucuccucggagccucaguuucucugccugcaaaauggguccucauugaaaaguggggcaaugauguugguaccagcacuacugacucgugugaggguccagucuacucuucccuuaggggugggggucgggagggggcugggcuggagggcuccaaagcuuuucaccccugacuucccucccgugugcccccagcccagugaguuugaggaggaggcaucucggaagguugaugaccugcuggaaagcuacaugggcauucgggaccccgagcuggguaaggggccaggguaagccagggggcccuggggggagggaagccuacgggaggaggcaggggucccagcgggaaguugggcgcggggagugcccucacugacauccccucuggcacggcccgcagcguccaccaugguggagacguccaagaagacagcgagcgcccaggaguuugcacgcuguuuagacuccgucuugggcgaguucgccuuccccgacgaguuugugguggaagugugggccgccaucggcgaggccagagaggccuguggcuaguuugcccugggggggcccagcacagccccagcccggagcccagcccccugccccggcccugcuccagaacccagcccagaucggaggacaaguuccucucuagaacccaauccaauuuggagccccagcccaacuccagaacccaacccuucucuagaauccagcccagaucugaggccaagcuaugugcuagagcccaggccagcucugagaccaagcccagcauugagaauaagcucuguucuaaaacucaggccagcccugagaccaagcccagcucuagaacucagaugagcuuugagaccaugcccagcacugagaccaagcccuguucuagaacucaggccugcucugaggccaagcccagcucuagaacccagaugagcucugagaccaugcccagcucuagaacucagaugggcucugagaccaugcccagcucuagaacucagaugggcucugagaccgagcccagcucuagaacucagaugggcucugagaccgagcccagcucuaaaacucagaugggcucugagaccaugcccagcucuagaacucagaugggcucugagaccgagcccagcucuagaacucagaugggcucugagaccgagcccagcucuagaacucagaugggcucugagaccaugcccagcucuagaacucagaugggcuccgagaccaagcccagcucuagaacccagaugagcucugagaccaugcccagcucuagaacucagaugagcucugagacagagcccaguauugagaccaagcccuguucuagaguccaggccagcuccgagaccaagcccagcucuagaacccagauaagcucugaaaccaagcccagcauagagaccaagccguguucuagaauucaggccacaucugaagccaagcccagcucuagaacucaggucagcccugagaccaagcccagcucuagaacccagauaagcucugaaaccaaucccagcauugagaccaagcccuguucuagaacucaggccaccucugaggccaaacccagcucuagaacccagauaagaucugagaccaagcccugcucugaagcccaggccagcucugagacgaagcacaucucuagaauccagcugagcccugacaacaagccaaacucuggaacccagacacauuuuaagacccagaccagcuuggagaccaaucccaguuccagaauccaggcuagcucggagaccaagcccugcuggaaaacucaagcugacucuggaacucuggacagcuccacgaugcagccacaccuggacacucggucuagcuccggaaccccaguuaauuuuggaacccaugugagauucaugaagcagcccagcucuggaaccccagucagcucaggauucagagacagcucccaaaucaaauccuauucaagaacucagaccagcucagaaacccagguccacacggcugcccaguccagaucccaaccccaguugcauccaagugcccauccccauccugcagcccaguccagcuccagugaugauuccagcucugagacugagcccagcucuagaaccucgccuagugcuacaaccaggcccaacuccaggauucagaccagcucuggaaccccauccaucuuggaagcaagacccagcuccagcacacagcuuggugccaagccccacucuccuugcacaaugcagcucagcucuagaaugcaguuuacuuccaggacccagaccaauuucaaggccuggccaagcuccagagcucaauccagcccaagcaccgcacccagcucuggaacucagcucaguucuggagcacaggcugguucugaaaucccagccagcuccaaaacacagacagcagcugagacccagccaaguuccagaauccagcuaagcucuggaguccaaucuaguccugggacccaggccaucgcagcaauagaauuaagcuccacagcccugucuaguuccgacagcagguccagcuccaggacccagcgcugcccaggagcucgaccagccucugggacucaauucgccucuaaaacccugccagguucuagauaccagcuccagaccacagccccagacagcucugguauucaacuggacuuugggaagcagagcaguucugaaagucagcuuagcuuuggaacucagcccagcucugggacccagauaagcucaagaauucaagccagcucuggaagucagcuuaguucgggaacccagcugauuuccggagcccaacccagcuccagaacucagacuaguucuggaaaccagcucagcuccgggacccagaccacugcaagaauucagcucagcccuggagcucaucuuagcuccagaacccaguccaguccugagaccaggcucagcucugaggcucaguccagcucuggaacccaguucaguucugggauucaguuuggcucugaaacccagaccggcucaagaauucagcccgacucuggagcccaacuuaguuccagaacccaguccagcucugagaccgggcucagcucugaaacccagaccggcucaagaauucagcccagcccuggagcccaccuuaguucuggaacccagccuguuucuggaacccaauccaguuccagaacucacaccaguucaagaaucuggcugagcccuggaaauggaaucugcccacagaccccuggccuugacccuagaauccagcuugaggccccugccccagcccaaccucagcccccaggcccaucccccagagaccccaccccagccccuagcaaagacccccagccucugccucagccccaugaucagguauguggcauccaggccagccuuggccccaucccaggcuuaccccaagccuccuaccuggccccacagucacaggucuccucaaccccccagaagccagccgucucucccaagccccgggugggaccccagaaguccaccccacccaccauaucugucacuccuaguccugccccuagggcagcccuccugaguucccagcugucugaguccccagcuuuggcgccagcccuuugccccacucugggggagccaggagcccgcccuuaccgcggggggccguagcuuggcugugacuuagcccugguucaugugguucucguccucuccugucccuuccagccuggggcccccagaagcagcaagugaccuuauuucuccagcaggcggugguagggagugugcgguggugaaaacaggggcuucaccgguccuggcucagauccagguccuuggagggaaaaggagggcaggagacggguugcaccgcauguacccugagggcucauggugaauaaaggcaccuuccaucucugca

SEQ ID NO: 192176 - RNA, 19309 nt, Homo sapiens
uuggguuugguuugguuuuguuuuguuuuguuuauugugguaaaauacaaaaucuaccgucuuacagugagguggcguucaguaccuucaccacgccgugcagccaucccaucugauuccagaacauucucaucacccagaaggcagcccuguccccauuaugucaccuagucacccccaggucccccuccccagucccggcacccacgaauccucucccugauucuguggauuggucuguccuggacauuucauagaagugggaucacagcguacccuucugugucuggugucucucacugagcgugacauccucaaggugcauccgcacuguggccugggucagagcuucgcaccuccuuguggcugagucucguuccagcacgguggcggcgccgugcugauccccucaccuucacuggguguucgguguucuccgccucgggcugucacaaaucgugcugcugugagccacugcgugcaggucucauccuggguguauuuuacaaacggacuggaugugagugggugaggagugaggagcuggggugacaggugccugcgaccccggccaggcacugccuccugcgaucgaaggggcagggggagacagaagccccucaaggggguguggagauggagaagccagaccccagguggggggugcauagagcugggggcucagggccacggaccccaccuggcaguggcccuggccuugcccacccacacugugucacccccaguuguuaaauacucagaacgacucuccagcccuucccucgaggccaccucaccccgcagcugggaggagggaguggucagcgugguugccgagacacuggguggccuuuaugcugucaacgguggccucagaggccuucuggcaggagcccgggggauccaggcagacaugcaaacccucaggcaagaggcugcacggcccuguauccccucggggacccucgaggccagcuucccagcaccgcuguacaggugagccccucccuacaggugagccccucccagccccucccucccucccucccugggugucagguuacaugguguuugguuuggggucuugcacgugucacucguuauuccuaaaaggcucaugugugugacguccccuccagcucuuccuguuccccuccggccaguggccgcucacuguggggucuacagaccuggagacaggccaagaacaaaugugucugcggccgucuccaaggacugcaaacgcacugggagcuucggccacagaaauguucgcccucugaaauccaggccugugcggggcugggcccuucuguggcugagagagucugucccacaccucuugcagcccgugguggcucugggcaaccccaggcacuccuuggcccccggucucugcuucugucuucacccggccuuccugucugcguccaaguuucccucuccuuauaagggugccaggcacuggauucggggccauccuaacacggggugaccucaucuuagcugcaucugcuaaaaccauuuccaaacaaggccauguccugaggcucugggcagaugugauuuuggggguauaccagucaccccgauacagugucuauuaucaauuguuuaaacaauuauggaauacuaugcagccaugaaaaagaagagugaaagcccuuugcuccauuuccaaggaaagaaauuaaaccaagaugguggcugggcaugguggcccacaccuguaaucccagcacuuuggaaggcuaagacaggaggaucacuugagcccaggaguucaagaccagccugagcaacauagugagacccaucucuuuucuuuuuuuuuuuuuuuuuuuuuuuugagacagucucauacuguugcccaggcuagggugcaguggcgcaaucuuggcucacugcaacuucugccucccagguucuaggauucuuccaucucaagccuucugaguagcuaggacuacagguuugugccacaugcccagcuaauuuuuguuuuuuuuuuuggacggagucucacucuugucgcaagacuggaacgcaauggugcaaucuuggcucacugcaaccuccaacucccugguucgagcgauucuccugccucagccucccaaguagcugggauuacaggcaugcgcuaccaugcccagcuaauuuuuguauuuuuaguagagacgggguuucaccauguuggccaggauggucucgaucuccugaccucaugaucugcccuccuuggccucccaaagugcugggauuacaggcgugaggcaccgcgccuagcugugagaccccaucucuauaaaaaauuuaaaaaucagccaggcagccaggcgcaguggcucacgccuguaauuccagcacuuucggaggccgaggcaggcggaucaccugaagucaggaguucgagaccagccugaccaacauggugaaaccccgucucuacuaaaaauacaaaauuagccgggaaugguggcucaugccuguaaucccagcuacuugggaggcugaggcaggagaaucacuugaaccucggaggcagagguugcagugagccgagaucgugccacuggacuucagcccagagcgaaacuccaucucaaaaaaaaaaaaaaaaaauccaggcgcaguggcucacgccuguaauccccacauuuugggaggccgaggcggguggaucacgaggucaggagaucaagaccaaccuggccaagguagugaaaccccaucuguacuaaaaguacaaaaauuagcugguugugguggcgggcgccugcaaucccagcuacucgggaggcugaggcaggagaaucgcuugaaccugggaggcagagguugcagugagccgagaucaggccacugcacuccagccugggugacagagcaagacucugucucaaaaaaaaaaaaaaaaaaucaaccaggcauggcggcacgugccuguaaugccagcuacuugggaggcugagguaggaggaucgcuugagccuaggaggucaaggcugcagugagccgaaaucgugccacugcauuccagccuaggugacaaagcaagacugucucaaaaaaaaaaagagggucucgcucgguugcccaggcuggagugcaguggaaugaucucagcucacugcaaccucugccuccuggguucuagcgauucuccugccucagccuccugaguagcugggauuacaggcacccaccaccacgcccggcuaauuuuuguauuuuuaguagagacaguguuucaccauguuggccaggcuggucucaaacuccugaccucaugauccgccugccucggccucccacagugcugggauuacaggcaugagccaccgcacccagugcaagacccuauuucuauuuuuuaaaaaaauggagaugcagugaaugggcucccgcaaguguguaauaacgggggugagugcauguaccaccugcuccugggaggaaacaccagaaaguagugaguggcagguggguacggggccgacagcaggggugaggggcucauuucucauugaauauuauucugugcuguuuuguuuguguugagacagagucucgcucucucacccaggcuggagugcagugacgcaaucucggcucacugcaaccuccgccucccggguucaagcuaauucuccugccucagcuucccgaguagcugggaccacagguguccaucaccacaccugacuaauuuuuguauuuuuaguagagacgggguuucaccauguuggucaggcuggucucgaacuccugaccucaggugaucuacccaccuuggccucccaaagugcugggauuacaggcaugagccacugcgcccagacaauuuugugcuguuuuaauuguguuuuaaaagcuacaugugucuugcaauucauuucaaaagggugagguucuccugaucuugaaauugccuuucuaguggaaaagccgagucuauguggggucccucaaacaggcucuguaacugaccaggcuacucccauguucugugggcaccugggagucuagucaggauuuaagcagaguuccugccaugagagcuggaaccgggcuuuccgugcagggcagaugagauuguuuugaacccugcuagacugucuuggggccagcaaccuuguuuucugggaugacuuccuugggacauauucccaagagcaaggucaaagcauaaaacaucuuugagucucuugucuuuuuguuuuugagacagagucucacucuguugcccaggcuggagugcaagggcacgaucucagcuuacugcaaacuccacuuccuggguucaagcgauucuccugccucagccuccugaguagcugggauuacaggugccccccgcccccacaccaugccuggcuuaauuuucguauuuuuaguagagaugggguuuuaccaugcuggccaggcuggucucgaacuccugaccucaagugauccaccugccucagccucccaaagugcuggguuuacaagcgugagccacacaccuggccuagugggucccccagucuucccugggccauggcuuagugccagccccagaccacuucuuccuggugcaccuccaggccaggggggcuucccagaggaagggacuugugggucuuggaggcuggacaaggacuguaggaauccaggaguagccagggcccuuguccucuccccucccucuucuccaggcaagaaaagcugagaacagaaagguuuagugcugacuugggugcuuggggugcgauguguggggagagggggagucagccucucuccucaagcacccacucuggggugagggguacagggcugaaggacagacuccaaguggcgagggagggagaccccacgccgugggccaggccucuacaucauccacccuggcagacaucgcaaaggggucaaagcacucgcuguagacaugggcucagucucugcccccugcccacccucagcgaugacuaccugucccuggaggguucccgcuggccaccagccaucaggcaggccacacgcuggaaguacacgcccaugggacgggacgcagccggccagcugugguacacaggccugaccaacucggacgccugggaagccugguacaaccugccacgggccccggccagccccuuccgcgaggccuacaaccgcuggcacagcugcuaccaacaccgugagugcagcaugccaucgggugagugcccccccccccgcccugggcagcgggccugccagagggggacaggaaugaccgccagcccccgccccaccgcagccuacacccagcaccugcgggagaccgccuggcaugaccccaucgucccugcccaguaccaggcccccagcacccggugggggagcgcgcuguggaaagacaggccaauccggggcaaggaauacggugaggcuaggugcaggguggguccuugggaggccagggggacaaggccaccuaggccagggugaaacugcccggggcgauccaggagccccuugcuggccaacggcgaggaggugggggcacauggugacccgagucccaccuacagugcucaacaggaaccgguacgggguggagccacuguggagggcaucagacuacgugcccucccugucggcaccccagcgcccgcccggcaccacccagaacuaccgggaguggguccuggaaccauacugccccuccaccugccagcgguccccgccuucccucacacccacuccccgauaaaggcaugcuaccaggaugcacccacugucucugcacccagaugagggggcacuaaccuagucccaggggaccagaggcucgggacagaggcagacacugggcucgcuggccgcccacaaccagggcagggcugagaugcccaggcuaccccugcccagagcccccccgcaggcagacaggagccaggcugccgucaucucuuuauuugcugccagcagaguccaccaagccugccgggcagcccugcugcccaccacggugggguccaggcccagcccaccaccccguggcugucuccuccaggcuccagccguccugagggggcccuggcagugucuggagacccccaggcuggaggugaggggugaacuggacugagcucaggguuaggguucccccagacccuucugggauuccuacuuccuguucccugccgagaggggcaccccaaauccuccagagggcugggauggauuagaguugagaaugggacacccucaaaacccaggggguccuugcaagucccuggcgggcaucccugcugcccucacccgaccccacccccgggagcugggugaggauggaggguggggguccagagaagagugaggggcagugggggcuuuuccccaaggcccuggggggcauccucgugcguccccacaguucccuugcacaggugcaggaggcugucaggagucagggccgggcaucacgguccccugcaagggagggguggaaauggcauuagagagugugggucagugucuggggagggaggggugggccaggacucacagcgucgcaggcgggucggccacagcaggaggcuacagagacacagggcagcggccacgcccacgccgcccgucacagccaccaucgcccagugguaaaagcucacgcaggcccugcagcagagcucugagcugugggaggaggcgggggaugaguaggcaccgcggguaccacccccccgccacccaagcugaaccugugccuccccucacccccgacagcggcuccguccuguccaauccaggagcugggggcccugccacucccucccuccugucccacacccaacagcucggccaguccugugggcccugcuuccagcauccaugccaaauccaccaugucuccccuucccugucuccucaugguccagccccagcauggcccgccugcacccgccccggucccaggcugcaacuucucccccagcagcuguccucccggcagcaaccaccagagggcgucugugagcgccugggucagggccugucccucuucugcccacagcucucugugagucccacuguccucagggucaaauccccuaaguccuccccauggcccaccaggcccugcacgaccugcccuccccuccucccucuacuccagccacacaggccuccucccuguucuuccaacacaacaugccaggugugguccugccccagggcuuuggcacuacuugucccuccccauuggccuggaaugcucugacauccugcaggugucagggccacgucaccuccuccaagaagcccucccuggcuuccugcccuggcuguccagguuucucugagcguucaccuuuacacaccacccacgccgguaccaaccacauguucaccucugugacuauuaacacggcuggcucugccccaggcccagaccggcugugguuuccaggcccugggccucuacaggcgugaaugcugugaugcuguggucuagaaccauccaugucugaacccugaguucugugggucuggguuacacggacucggggcucccuuccagcugggcccacccccgauauauuucuguacggugucuucagcacugcacacauggacccaacguuuguugagugaauaaacgaagugcucaguggaagaaaggaaaggucuccccugccuaugacucccauuggggcaggugucuuugguccacagcuggaugcccagacccagaacacugcuggacacacagcaggcgcuuaauccccucuuacugaacaaaagaaugaaugaacgaacagcggcacucacgggcaagggugcaggcucuggauggccaugacugccagcccauuggccaccuuauccaagaagcucauggagccguacacgaacgcuccgcuguucuguggagacacaggcgagguggucagcgugcaccccgagaucuaggacccggccucccccaccccagccuggcuaccagcccuaccguguggggaccgaugaggucggccgucauggccagcgaggugacgaggaugguggcacagccagcacccagcagcacagccgcugcguacacggccacacccagucccuccgccagcgccacccaggcggcaaaggccaggaucaccaggaggccugagaaguaggucaucugcagggacagccccggggucaggcccacaccacugggugcccccaagccuggcgcuucaauccgccaccccuacccccaaccccagcaaacaaggcaugagcuggauggucccuaaggagcccuggcucuggcccuggacacaacaccgaggcucugcagauccuccaugccagagcugugcucucuguccacgccguagcggcuggagacguguggcuauucugccugagcgcaggucaguuacaacgaaagcaaacgacggacucggcucaguccccacggccacauuucaagcccucaguagcugcacaggguggacagaaagcgccagagcuccauggcugcgaguguauaaacucgagacacagagaagccaggauccuagaauuccuuguucccagaucuggggcuuuuuuuuucuggagacaagagucucgcugugucgcccaggcuggagugcaguggugugaucucaucucacugcaagcuccgccucccggguucacgccauucuccugccucagccucccgaauagcugggacuacaggcacccgccaccaacgcccggcuaauuuuguuuuuguaucuuuaguagagacgggguuucaccguguuagccaggauggucucgaucuccugaccucgugauccgcccgccucggccucccaaagugcugggauuacaggcgugagccaccgugcccggccuagaucuggggcuucuacaaggcgggaacucggaggccugagagcauccgaggauggaacccggagcgggugggaucucggcugcagggcaccccauccuccgccccagcuguccccgguccccgcccacucacguuccucccaaugcacuuguugaugggcuucaugaggaaggaggacaagaagccgcugagguacaucaccaggggaauggucgcgaugaacuucugcggaggcagagccaggcaugccgugucagucauggcucgccaggcuggggccgucccaucccagcguccccgccccaaucugcucaccuugggcagguggagcgaguaggugagguacauggccauguaggucugggacagguucacgaugagccugguggucauguacaguaugcccaccugugggcagaccgacagagggacuggcaggggucaggagggccuucuccacucccaccagcagggggcaccggggccagggugggcgcccugcagcuggcauuugauccauugguagugacugcccaguggggugggccaggaagaggagagcagcacuugaugagugacguuugcccugggugugggcugcaccaggggccacgugugcucugcgucuggacgcagcugccccacagagcaaaggcccugugggugggagagaaggcccacgccagccccaccguccccagcacgcaccugguagaaagccggcucccggagccagugcuuccagagcagcaggggcugggccguggcaggggccaacaggggggugugcucgccuggcuccuccgcaugcggccggcgccucucccgggugcccagguggaauagcagugagaacacggcgccgacacccaccaccagcagggacagguucuggggaugcagcagaagcagucagugguggcgggcccagcccccgccccuggcucgaggacuucaggcgacccacccggacuccagcucacccggaacacgggcacguccuggccccccagcuggucgcugaugcugaugucuugggugggcuccacccgcgacgagcccugcaggugcagcaggagccaggcggcgccguagacggugauguuggccaccacggugaacgcauaccuggcgggcaggcgggcagggacucaacaagacgccaggaaccugggucacuuccuccccacguggcuacgccgucagagaggccuggggaaccccugacugacaggugauuccaaccacugccacacuggguggccuccaggaagcccgugcuggccucaguuuccccagcccgcacauuaccuaacgcgggaaagcugugaccugcagcuccacccuucgugcccaggaccaggguacagugacucggccaagcggaguccaggcuacaacccaaaagucugagaacccagagacucagaagccagaauucgagaauucuucuuccccagaugcugggcggcuaaagggcgagggcucccuggucuagaaccauccaggccagccccugcccacagcccggccaggcacagagucccccggggggccucagaauccuaccaugaaucagucucucuuucugaaagcgggaaccaugccaccuccagaggccacgugagcacagcaggaggucagcuggcaaagcaauggcacguaggaagugccuggggucuggccccggucagauggggcccucaggggcccugggcauugggcaaccugugucguuagcgccugcaccucugucacauggccauaauggggaacucaaaucuggggguggggaggagcuggugauacacaggcagauguggagacagcggacucccccgacacgaaggcgcugugaggacccuggcuuugggcaccagcuggggccgaguccuccucugaaauacgcgggagagaagaguucccaccucccagcucacggggaggauuaaagaagcugagauucauguuaagggccuauaacuaugccaggcacacggcaggugcucaaugcaucauccucguaaccagaagaaccucuuccagcgccucuagcaaguuaguggauaagccgggcacccgcuguacccagguguaauagaaagaauucuaaggcagccccagagaggccugcccaucccauccccuccccguggcagcagcagcuguaaguccaccauggauguuacucccaggauguagccagggcuaaguggcauucuauagcagagggaaagggacuucgcaguguguuauaaccaaggaccuuggucagcucggguguguccacagggagauuacuggccaggcgcgguggcucacgccuguaaucucagcacuuugggaggcugaggcaggcagaucacugaggucaggaguucgagaccagccuggccaagacggugaaaucccaucucuacuaaaaauacaaaaauuagccgggggugguggcgggugccuguagucccagcuacucgggaggcugaggcaggagaaccgcuugaacccaggaggcagagguugcagugagccgagauggcgccacugcacuccagccugggugacagagugagacucuugucucaaaaaaaaaaaaaaaaaaagccaggcacaguggcucacgccuguaaucccagcacuuugggaggccaaggcgggcagaucaccugaggucaggcguucaagaccagccuggccaacaugguacauggugaaaccccgugucuacuaaaaauacaaaaaaaaaauuagccgagaucgugccacugcacuccagccuggcugacagagcgagauccugucaagggagacuacggugugugagccuggccaagucaggcaauccuuugggagagagggcuuagggcuuccugggaucagagauucucccugcuggccucagaagcagcagccaccgugaucuccacaggugcaagacuacaacuucugccaccaaccacgugagcauagaggagggaccgcccccagccuuccauaagacgcuagcccugggcaaccccuugaaugcaggcucaagacagacccugaagcccaacagcccucucccccuagcucagccaugcuggacuccugacccccagaaacugugagaggagaaaugugugauggcugagugugguggcucaugccuguaaucgcagcacuuugggaggccaaggcaggaggaucgcuugagcccaagaguuccagaccagccugggcaauauagugagacccugucucuacaaaaacuuuuuguuuuuuuuuuuugagacggaaucucgcucugucgcccaggcuggagugcaguggcgcuaucuuggcucacugcaagcuccaccucccggguucacaccauucuccugccucagccucccgaguagcugggacuacaggcgcccaccaccgcgcccggcuaauuuuuuguauuuuuaguagagacgagguuucacguguuagcgaggauggucucgaucuccugaccucgugaucugcccaccucggccucccaaagugcugggauuacaggugugagccaugcccagccuacaaaaacuuuaaaaaacagcuggguguagugacauacuccuguagucccagcuacucaggaggcugaggcaagaguaucacuugagcccaggagguugaggcugcagucagccgagaucaccccacugcacuccagccugggcaacagagugagacccccuuucaaaaaaauaaacaugaaagacugccuggucucgagcugccgagucuguggccgcucauuaugcagugccacugacugauacaccgagccggggcccacccugcccgugggggagggugcccaggcucccaccugagugccgugagcuccaccuucucauggucguuggugacgagcuccgggaugaggcugaggugggagaucuguguggaggcccagccaaacuggaagaucacgaugaacgggccguaguagaggagggcagcccacucgggcguggccgccccacagcccaggcaggggcugaagaugaaggggaaggacagcaggacgcagacggugccuguggaaggcagaguggucagucgcggggcugucccgcaccagccagggcucccagggugaggacauggagggaggagagagggaaacugaggcacagauggagacgccccccgcaugcacacagucacgcaggagcgagggucugcagucggggucccccaggcuuauggccccuggugacaaaaggggaaucugacaccaggugccugggcucagccugcaagucagaagaagccaggcgcagggggucccccggaaaccugccccccacaggugccccgguuacagccgcagccucccccagcuccucccccucggccacuaucaagccucccauagggccucggggagcgggaggcccaggugggccugggcuggaccccuccuuaagcuccgccauccucaucagcuccuaaggugaccacucccuggaaugcuggggcguccuggccuccagggacagucaggaaauagcacccgcccccaccugagaucugcgguggcaaggccuggcucuucacauccucagaagaaaaccccuaagauacccuggaacaaauguaagauccuccccgcagcccacggagcccuuugcgaccugcccuguccccuccgugcccugcccugcccuucccucucucccccuucucucucugcuccagccaugcaggucuccucacugcaggaccucuucaacaugccaggcgguccugcccccgggccuuugcaugggcgugccucugccuagagcucucucucacaucuuagcaagacuggcuccuuuucaccucugggcucaacgggaaugucaccuccucgaacaccucucuccuggccccugcugccucuaccucacccuucggagcacccgggaauucucugucugccggcuuccugccggcuuuccucugcagacagcagccuccaaggggccuggggagacccagcauggaacucgggcauuucaauaucuauuuuuuuuuuuuuuuuagacagagucuugcucugucgcccaggcuggagugcaguggcgagaucucggcucgcugcaaccuccgcccccuggauucaagccauucuccugccucagccucccgaguagcugggacuacaggcccaugccaccauacccagcuaauuuuuguauuuuuaguagagacaggguuucaccacguuggccaggcuggucuccaaugccugaccucaggugauccacccgccucggccucucaaagugcugggauuacaggcgugagccaccgcgccccgccuuuuuuuuuuuuuuuuuuuuuuuuugagacagagucucgcucuguugcccaggcuggagugcaguggugcgaucucagcucauugcagccucugccucccuagcucaagccauucucccaccucagccucccguguagcugggauuacagguaccugccgccacaucccaccacauccagcuaauguuuguauuuuugguagggaugggguuucaccacguuggccaggcugaagucgaacuccuagccucaagugauccuccugccucggccucccaaagugcucggauuacagacuugagccaccauaccggcuguuacuucaguaucuucugagugaguaacaauaguggcccugacacagccuguaagcgugggugucauuauccucauuuuccagaugggaaaauugaggccccuagagugagucggagccaggcuccuucccugcagcccugcacuccucuccucccagccuggggcaccuggaagggccccuguaccaagccugguggcuggaccuccuuccucccuccggaggugaccucauccccagacccugggcccgcccccagagaacuggaauugggaagugaaaccaaaaccagccucuccugcugguuucucuggaacuagggccugggaggguuugcgcagauuccugggguccuuggggaggucauccgggggcagagcaugaacuguggacuccagugagaaggucccuuccuggcuggacucccuguuccugcuggccagucuggguuaaccauuguuggggccaggcugccuggccuggggaccucgggcaagugacugugccucucuaggccucaguuuucagaaaacagggauaguggccaggagugguggaucauguaaucaaucccagcacuuugggaggcugaggugggaggacugcuugaacccaggaggucgaggcugcagugagucgugaucgugccacugcgcuccagccugggcgacagagcgagacccugucaagaaaaaaaaaaaaaggccgggcgcgguggcucacgccuguaaucccagcacuuugggagaccgaggcggguggaucaugaggucaggagaucgagaccauccuggcuaacaugaugaaacccugucucuacuaaaaaugcaaaaaaaauuagccgggcguggcggcgggcgccuguagucccagcuacucgagaggcugaggcaggagaauggugugaauccgggaggcagagcuugcagugagacuccaucucucaaaaaaaaaaaaaaaaaaaaaaaaacaaugaaaagaaaugaaacagagaaagaaaggaaaagaaaagaagaggcugggugcgguggcucaugcuuguaaucccagcacuuugggaggcugcagcggauggaucaccugaggucaggaguucgagaccagccugaccaacauggugaaacccugucucuacuaaaaauacaaaaauuagccgggcaugguggcacgagccuguagucccagcuacucgggaggcugaggcaggagaaucacuuaaacccaggagguugagguugcagugagcugagaucacgccacugccuuccagcccgggugacaaagcaagacuccgucucaaaaauaaaaaauaaaaauaaauaaaaaauuaaaaaaagaagagaaagaaggguagugaaaguuccugcccauggccaggcgugguugcucacaccuguaaucccagcacuguggggggcugagacaggcagaucacuugaggucagcgguucaagcccagccuggacaauauggugaaaccuugccucuacuaaaaauuuaaaaauuagccggcuuugguggcacgugccuguaaucccagcuacucaggaggcugacgcacgagaauccuuugaacucaggaggcgaagguugcagugagccgagaucccgcuacugcacuccagccugagcgacagagugagacucugucucaacaacaacaaaacaaaaaaaaaaaaaaaagaaagaaaguuccugccucacaggcugcugugaggauagaguucauguguggcaccagcaaaagcuccgucuauucugaaccacuuccugcuuccgcagcuucaaagugaggacuguuccuaccuuuuccacagcuguuucugcuacuuggaaugcgccccuccacacacugcuacccauccgucaaaaccucaaaguuaauguccuuccuucugaagcccauuugugccaucugcccacucacaggaguguuugugucugauucugagggucgucucgggauugugggggagcuccccaggacuuguuaaagggcaaagugaguccuuagccaccagccccagacuugggggugaaauacagaagugggugccauugccaggguaaccuucacucaagucaccugcucaggcaucaagagcggcugccugggcuucugcucccaacagacccuccugacccuccaggcccacccagguggcccccaccucucagcucccagggcaggugcccuccccgaggcggggaagaggggugacgguggacgccuugguguccgguuggaccaccugguucccugaggucugcuuuggaaaaacauaaagccuucgguugcuguuucuguuuguuuucuuguuuugguuuguuguuguuguuuuuuguuuuuuuagacagacucucgcugugucuggagugcaguggcgcgaucuuggcugacuacagccucugccucccggguucaaacgauucucccaccucagccucccaaguagcugggauuacaggcgugcgccaccacgcucggcuaauuuuuguacuuuaguagagacgggguuuugccauguuggccagguuggucucaaacuccugaccucaggugaggaggccucccaaagugcugggaugacaggggugagccaccgugcccggcccgcccagaaauuaucuuacgcgacugucaaagagcuuauccaacuauuaugaucaaagaggcauuuggggcccugggcuccgcucagcaaccaaucccaacguaaccacaaaggaagggacagccgguccccucccugucugccgccgccucagguaccccaggaauagccuggacauaggaaacaugaaacuccaguccccaagcugugccugcugcggagccugccacccucagaccacuggagauccacugccucuugcaaaaaaugucaucacccagauccuggguccaaccacccaucccagucauuguucccaagggugaggaggcacccgccugccccuccugccaccuggaauuccaagaacugagcaggauuccuggcccugccugcugaaaugccacaugugucccaaaugccaggacgcagccggcacuucugugagggcaagaagagcagggaaggaggccggcuaaucuucaggcccaggguccgggaggggagaggagggccgcugggaggcagcccugcagucuuaucgaugggcacuggggcagggugacccagcccaugacgccagccuccugcccucccaacagcccucucuaaucagggcagcucccccagaccuagggggucccugacccuggccagacagauagaggcaaugcaagaacagggcagagaccccugacccuccagucccacccaggcggcucccaacucucaacucccggagcagcacccucaaacugcugacgcaccagguugcccuggcagaacacacagagagagaggaggcucuagggggccugacugucccucagccauagcugucccaguuggucacccuaauagacgagcucaggcuagacagacugacaaaggaggcgcugagcagucaccaccaacccuccagaggguucaggguggcccgggggcucagacaaacaaaggcauucccacuagaaagucauguagucagauggugagggccccgcaggucagacagcagcucugaggcagacaggggaggcuggaccaagggacagacagaggggauacggggcaguuaaacagacagaugggggaggcucauggcucaggcagauagagaagcccugcacaguuggacagaugggggaggcacugcacagucagacagaugggggaggcacagcacagucagacgggggaggcucaggccauggggcagaaagacgggggaugcuggauggugggacaggcaggggaggcucaggagugacaccacagaggggccacuggguagucagacagacgggggaggcucaggccacggaacagccagaggggugaaaacucagcucauggggcagacaaacaggggagacuuaggucccaggcaggcagagagagggggcuggguggugggacugauggaggaagcucaggccaugggcacagacagacagacaggggagguucgggccaggggacagacagaggggugaaaacucagcucauagggcagacagauacauaggggagguuaaggccguggacagacagugcagggaagcucgggccacgggacagacagaccgaggggagacuccgauccugaggcaggcagacggcggguggugagucagagggaggaggcgcccgggucgcggagucucggaggggcugcccgacagguggcggggccgggacgcuuaccgaccaggugccaggccuugcgcgggccguagcgggcgcagcagcuggcggcgcggucggccucguagcccacgagcggugugcacagcccgucggccaccuggcccagcagcagcagcagccccgcgccgcgggagcuguaggcgcgcaccgagugcagguagagcagcagguaggugaaccacauggacgcgcacaggucguugaggaaguggcccacggcguagcucagccgcgccaccagggacagcggccgcggggacggcgccgcuccggccgcugggggucccgggcccaucgcggcgccgggcccgcgccccccacccccgggcuccgcggaggguacccuggccaggccuucuugggugccgugggggcaggcgccggggacccccaccacgcgccgggcaccccgcgucccgcucucuuacggccgcgcccucacccacguccgccgcguccgcccca

SEQ ID NO: 192177 - RNA, 13802 nt, Homo sapiens
ccacacaugaauccacguguuuaaugacagcgucacugcauuacaugagaaacaaggcuggucuguccugggagcucccccacccccuagcaugggcagaaccagccccaacacaaaccucacgccguccgccuggcccugcggcgguucccagucccaggaggagccucugaaggccacuguggguugugcacugagccagccaagcccugacgcccacagcgacaaggcggcucuuuggcaacugcgggcaggggcgggcaugggcgaaggcaggguugguuuucuuauuuaaaaaccuugaaacaguaagaccgugaccacuggaaauccacacugccacgugcaccagcacccccugcacaggcgcacagugagggguccgcgccccacccagacagagguggggagagucucuccagugaauguggaagaucgacccgcuugaaaugacggggcuuuaaaaccaggaccucaucccccaggagcaguggguggguccuggccccuccccgucuagccucaaacauuuccaggacuagucaacaaaaacacaaaacaaauccaaagaaaagucacaaauacauauguacacaugcacgccaaccccacuggggacagacaccaggauguugggauguggggaguggggaguggggguucccaagcacagcaggguggugggugggacccuccaaccccagcccgccccacccucuccacguccccaccgaugaaaugggaagggguggugggggggugagggggcagugcucagcucaggccccacuccccugccuugccucccucccugccugcugugcagccugggagcaugagacagagaagcagaggagccugggaagcuucucgaaggauggagggcgcccaccuccuggaccccuugggucuccuuggcuuccccacggcuguuggcgcugguggacaggacaggugaagacacaggcagccugggggcgggggccacaccgcugcuggccuccacaggacccagccacccagcaggcaugggggacgcaagucuugcgcagggaaggaggacgcuggcccugugagggcacguguuggcgaaugcacgaagacguggcaucuguugugcuccucuccagccagggcagugagcagguccggguucaguucuccuggggugauaaguccagagcagacauccuccuccagugugagggugacgcuuggccaggaugcacaggcccaucugaagcccacugaccgccgggcgauggccaugacacagaugcuuccagagagacugcugcuucgagcagugacagcagagguggcugcaaggaugccgugaagcccagguggggacugucucuuggauccacaggcuggcuccgccaguggccccgagccaccugcccaggccuacaugccuuggucuggccuuggggcuggucuuggguuugacaugguggggugcagccaugaaugggcaaccggggucucaggcccccaccaaucagcccuggcgucugguggucuguucugugcagacgugggcaguuccaggaagagcaugcggcuccggugggcaggugaugaacagacggaggcagugagggucccagggggcauccgucgcucugaguacagacggucugagccgggaccguccaaugugguucucgcccuuugggaagggagacagagccccugcugcugaggguccccgaccacgugcccaccccagauacugguggacaugguucacaaucaggcauuuaaugagacuccaggauccuccaggcccagcuccccgcccgcccagccgccuuccucgggggacaagcgcugggaaggcagaguccaugcaagcugaggagcugggguccuccgacucuggacagcugguguggcacgguccugcccggcagguuuaccggauccuggugaagagguugagcacagacacagacuccugcagacacauggggauggcagaugcgcugagccgcaggcccagggaggaagcugccuggaggguccccaaggcuuuggggcuugguccugaggggcugggaggugccaguucagccucggccugccacacugccccgacacaugacccagaauuugaggugagggaagcucggaagugggggaacccagaggaggguacgcccgaggacaguggggacagggacgacccugggacaggcuggggcgggggcgaguggcgcugauaccgacccacuuuaccuuugucgaacggguuuugcuaaagacguuccagaaccucagggucucgucuccagcaccagugacgauggccuccccaucaggggacauugccuguggacaggagggaagcaccccaugucucugggccucuaggugccucgggacagugcugggggacugaaggagaggggagcaaggugucggguggcugggccccccagacucuggagccaggagggaggggcaggcuggggccaccacaagcagaaaccaagguuggagccuuuuuuuuuuuuuuuuuuuuaauuuuaagacggggucuggcucugucacccaggcuggagugugcaguggggcaauccuggcuuacugcagccuugaccuccugggcucaggugauccucccaucucagccuccugaguagcugggacuacaggugcacaccaccacaccucauuuaaaaaaaguuuuguagagauggggucuugcuauguugcccaggcuggucuugaacuccugggcucaagcgauccucccacccuggcuuccugaagugcagggauuacaggcgugagccaccgcaccuagccaagguuggagcauuuuugcaaaaacacaaaggacgcccccuugcaagaggggcucaucaacucugcacagaugagggacugucagaugcgcggaugaaagcacagaacauguuuuucagggaagaaacaaaaucuuggcaagugagggcacguggggccaaggacgccuccuggcccccauccagccacgugcauacaguuacuguguaggacguucacagggucaucugaguggucagcugugaguugguuuuggcuuuccucuucaccccucuuuauggggaaaauaaacaaaugaagaagcuaagguccuccaggaggacagggccugcaccugcagggcuggggaguucgguagagcccauuccaacgcuggcaacacaaccagcaccagaugcccugccggccccugcugcugggucccacgggguuuuagaucugcacaccauccucccuaagaacacaggacagggugcucugggguggccauggcaguuuguccagaaucccggggcaccuugaagugccuggcgugaacucaccagguacagcacgcgguaggagugcccggucagcuuggccaccugggucagggagggguacuuccagacaaggaucugguucugugaguagccgugcgugcucaccuggagggcggagggggcgcugcggucggugaggggcaacgaggccgggugcuaugccugcugccucacaugcacccgccugagcccaugugagagcucagagccgccagccagcccaggaggagcaggggaugcugggauguggcucugccaccugagucugucuaggagguguggaggccacagguggaccccuccacccaccgccaaaggcuggagcccaacaaggacccaaacggggcccacagccccucugccccaccugcaagucacccccgagacuguccuggugacacgcccggaguggcuggagcaggccagggugcucaguggagcccgcuucauccugggccuccccucuaagcagaggcagccauaggagcuccccggcuccucacagagccgccagguguggcugcgaugggggcccagaggccccaagucuugccccaggugaggcccugaugaggcccaggggccuugccccccacaacucccugccuccccgcucggccucccucgcccaucucccuucagagcgacucugacccaucuccccacaggcugcucucagguggcagguaaggggccagcaggacgcacauccugaggccuggugggaggccgggccgcccgugcucaccagcucguuggcgugcuuggaccaggccagauugcacacuugggagcccgugucgauacacugcagugguuguccugucagcguguuccagaagcggauacagcggucagcugugccgccccccgaggccagcagcccgugcugauguggggaccaggcgauggccuucacggccgccaggugcuccguguacugcugcacggggcucaggcucgagugauuccagaccagcagcugggggacaggggcugugaggccggggcugucccagcccuguggucccauaggccgguccucacaggugugacgaccugcccuggcaccccaccccacacuccuccugcugcucccucaaggaccccugggggcacacacucgucacccugugccacagggcaggacuggcugagcaggaaggacaagccuggugcccugcugauggcuguggagugggccccgcgcccgcgcccgccccagcccaggcucuuccguuccugccagugugaggggugcggcuucuggugaaggggaagcccaggcucugggcggggguaccuuguugucguugccccccgaggcgaggagcugguggucuguggaccacuugagcccgcacaccuccugccgguggcccugcagccgccgcuccgacugcaguggcggggugcggaugucccucugcaggaucaugcggucgcggcucccggacgacagcugcucagcauuccaggccagcgccccuggaggccagguggaagcgggggugagccucuccugcccucgcggagcuggggccucagggagcucaccagccaugggacccgggcuccucaccgacgcgugccguguggcccuccaacauggacagcuucuucccugcggcugcgucccagaucugcacgaagcccuugugugugcccaccgccaccagguuccccuaggauggaaggcaugggcagagcaccggugucaggucuggcccggggacugugcccguccuggcguuggucgcgccaggcucucuccucaccagggcucugggacgguuucccuaacgacucucgaaugcacgucccuucggaagaagcauaaaccccccucagugcaugcugggguggcgggcacaccccgcacacacugcgccuggguuucucagaguccagccaagacucgguacguggaccuucccacauggacauuucacacagagggaaggagaaacugcagacacugagcuccagguuccacacaggcccaggagcugggcaacaugcguugcugucugcaacugacuuugaggcacaugaaaaccuaagauggauggagggagggugagcgcacacgccuggacacagugagcgguuacgagugcuaggggcagcccugggcagcucugggugaggggcacagacccuccccaugauaugcuucaaagcugcugcugagauguuuucaucauaaucuaaaauggaacuaaagcccacucgacccugaguggaaaauggaacuccaggggagcgagucccaggugggcaggucccauggaaggaacuggggcguuauuuccccacuggaccugccauccuuucuaggggccuggugggugccugcucaucccuguuacucccucuaccaggaccacacuaaggccggggacagugggggacacagaccuaugcuuggacacaggcgaccucaggccacgcacuagacccucugggucuucaaggcccccaacacugucaagagccccaucagaucucccaggugggggccaagcccucugcacucacccgcucagaccagcccacggaggucacugaguccccuuccacugagaggucacagagccgcgucaccuggaggcagaggucagugugagcuuugccgcuggucucgaagccccagucuauccauggguacauucaucccuccacugucucacccauccacucucauccacucucccauccaaucucauccacucucccauccacagucccauccacuuuuccauccacucacccaucugcucucccauccacucccucaaccacucucauccgcuuucccauccacucucauccacucucccaucugcucucccaucuacucaaccauccacucccucaaccacucucauccacucuugcauccgcucacccaugcgcucucccaugcgcucauccaugcgcucucccaugcgcucucccauccgcucucccaugcgcucucccaugcgcucucccauccgcucacccaucugcucacccauccgcucucccauccgcucucccuucugcucaaccauccacucccucaaccacucuccuccgcucucuccuccgcucuccccugcgcucucccauccgcucucccauccgcucucccauccgcucacccaucugcucucccauccgcucacccauccacucucccaucugcucucccauccgcucaaccauccacucccucaaccacucucauccacucuugcaucugcucacccaugcgcucucccauccgcucacccauccgcucccucaaccacucucauccacucucccauccgcucucccauccgcucacccaucugcucucccauccgcucacccauccacucucccauccacucacccaucugcucucccauccacucaaccauccacucccucaaccacucucauccacucuugcaucugcucacccaugcgcucucccauccgcucacccauccgcucccucaaccacucucccauccgcucucccacccgcucacccacccgcucacccacccgcucacccacccgcucacccauccgcucacccauccacucaaccauccacucccucaaccacucucauccacucucgcauccgcucacccaugcgcucccaugcgcucacccauccacucucccauccacucucccauccgcucucccauccgcucaaccauccacucccucaaccacucucauccacucacccauccgcucucccaucugcucacccauccgcucucccaucugcucaaccauccacucccucaaccacucucauccacucacccauccgcucucccauccacucaaccagccacucccucaaccacucucauccacucucccaucugcucucccauccgcucacccaucugcucucccaucugcucucccaucugcucucccauccacucaaccagccacucccucaaccacucucauccacucucccaucugcucucccauccgcucacccaucugcucucccaucugcucucccauccgcucucccauccacucccucaaccacucucauccacucucccauccgcucucccauccacucaaccauccacuuccucaaccacucucauccacucucccauccacucccucaaccacucucauccgcucucccauccgcucaaccauccacucucucauccgcucucccauccgcucucccaaccgcucucccaaccgcucucccauccgcucucccauccgcucucccauccgcucucccauccgcucucccauccgcucaaccgucugcucucccauccgcucucccauccgcucaagcauccgcacucccauccucucacccauccacuuccucaacuacucucauccacucucccaucugcucauccauccgcucaaccaucugcucucccauccacucacccauccgcucucccauccacucccauacacucucccauccacucaaacauccacuccccucaaccacucucauccacuuucccauccacucucucauccacucacccauccacucucucauccauucucccauccacucacccauccacguacccauccacucucccauccacgcacccauccacgcacccauccacacacccacccacucucccauccacucacccauccacucccuaaucugcucacccauccacucucucauccgcucacccauccacucucucauccauucucccauccacucucccauccacucucccauccacucauucacucucucaucacuccaggcccauggggucgcuggguuggucacugcugggaccuggcaagcucaagccugccacacacauacaggggagacacacacacacaggggagagccugcaugggacgagcagaggaugggaggaagcugcccagagcuacacggcuccugcugccgggagaggacgcucaaauggugagggcagggccuagaagggugugggacacugccagcgggagcagcucauaggcugcagggagggcgccaacccucgcucucccgaaacuacucgcauggcguuaucccugaaacccccaccccagcgggcagugucugcugcugcccugcaccagcaacccagucucccuguagggacuagcaggcuccaugcgcccagaggccacuccaggacagcggccacucgguggucauaguggccccugggcucagccaggcugggacaccugucucuucuucucuauagagcugaacagagauuguggcuccaguggggaccccaugcugccgcagaugccacugcuggcugggagggcaguggcugggagggccauggcugggaggguugggagggccguggcugggaggcccugacugggagggccauggcugggagggcugggaggguaguggcugggagggcuguggcugggaggcugggaggccccagcuaggagggccauggcaggcgccuggcucguacugaugcucccuggaucccgguggguacauugaggucugcugggagcuggggaggcccccaugcacaugcacaccccacgcagcacccaccuggcugguacaggcacuccacagguacacgcaggugccuagccccacgcugagcacauugagggacgaccaguccaccagauugagguagaagucguccugcagcucgggcgcguccagcaccuugaaggggaucuuggagaucuugcggguggguuuccggggggaccggagcagcuucuggcugcagaggcggccacguggcauccgugagccacggcacuugggucaccucuugcaaacgcuugggaagugucuccuucccugccagccccaggagcccaguccggccccuccaaucaccaccgccaccaugugauccuaaacccagggacagccccacaggccuucacccucgggugucuggcugcccuggccucccuuccacagcugugcuggcucugcuccccacaccuccuccaggcagcccuuccugacuacccugccccuugucugaggccaacacugccaggccauggugugcccucagcaaggggaucucugggcugcucuaggccuggacuacacuucuauuacugaccauggccucauggggggcuggggccccuccacucuaaggacucugggggaggacacagucacagcuccaggccacuaugcccugggaagcccccuucagccucgcccaccaggacccgcagggacagggcugcggaggaagcugggacccaccucuugcugcugacgggagacagggaguagggagggcugcggaggaagcugggacccaccucuuguugcugacgggagacagggaguagggagacacaucguugccgucaucggggcuggagcgcuuggugcuaagggaauacuguggagcgggggacaugccagcugagcgcacgcccaggccgcaggacccucagagccccccagcagcccacgcucccgguacagcucauagcccuaaggcaggugcugagacccuguguggagcagcuguaaaaaggcaggcgccuuccuggcggggacugcggaccccccaccccucccgcccucucucgagggacccaagccaggcuccgugugauccugccuuugagcucccggaucauguggacagaguggggcccugugggaggacccaguacugcccccuacgggcaggacccccaccggcuuggguguucgggaccccagguagcauugguguggggagaaaaagcccaacaggcugagccuggauuccucccgcacccccacaucccaguuuaccugcuagaccuccagccucagaucccagggccccugaccuggcuaaggaacagggucagggcgggggugcugagccguggcugggcccgagaaccgggcucggggaggcagagcuggugccugggagguggggggccggggaggcugcacugggagccagcucccggguggggggugccgcaggcuuaccgugaacagacccuucuucucaggcguggagggcugcagccugcgguccucagucugcggguccugcaccuucucgaugccggcacccagcagcucauucuugagcagggcagaguaggccaggccgucugcgggcaccaagcacagugaggcggggcaaggcagggugggggccugcagggcggaugggcugggacccuaaccuuugccguugucugagguggcguccuuggcuuuccgguucugacugggagacuucucauucuccugcaggcaggagagcagagagggaggggucgaggagcccgcuuguucccggcccuagagcaaggaggcugggaggggcccugggcuucccggggggucccaucuccugcccagccagccccucacguuaauccuguggaaguucacgcuccaguuggcuccggcucuggaggggaugaagcggucuccgugcuugcugggcgaggacacuggggagcuggcaggcgucaggguccgccgcaucucugugaccugaagggcaucagcagagggcuugcucucagcaccgagagccccccgagagugcccccaggccagccucucucagccucuggccacugagcaaagggggcuuugaucuugaaaacccaaggggugggccaggcgcgguggcucacgcccguaaucccagcacuuugggaggccgaggcgggcggaucacgaggucaggagaucaagaccauccuggcuaacacugugaaaccucgucucuacuaaaaauacaaaaaaucagccgggcgugguggcaggcgccuguagucccagcuacucgggaggcugaggcaggagaauggcaugaaccugggaggcggagcuugcagugagccaagauugugccacugcacuccagccugggcgacagagcgagacuccgucucaaaaaaaaaaaaaaaaaaaaaaaaaaaagaaaacccaaggaggggagccacacagucacucguggucacucauggucagggauuucugugccagaagccuccgggagaugccaggcccacgggcaggcucagccucccaacgcugccaggcaggaggguggugagggcagggccacgggacgggguggaguggcaggaaugggggccauggcggaggggacagagccagggagcacaagaccccaacugcccucccaacgcugcgcaggugccaugcauucaccgucucuagaugaucacagacgcaggccuugacggcacaagacacgcaacagcuguacccagagccaccugggaguguggcccucauccccaucuccugcugcccacaacacccgucuaacccuccaaccccaucugacuguccccgcgccgucuuuuuucuaugaggggucuguuaucagcugaccggugucccuaaaaggauacugugaaguccugagccccgcaaccugggaaugggacucugauuggacacgaguuucuugcagaugugauuauacucaagaggaagccauuagggugagcccugauuugaugacaagcauccucauaagaagaggaaaacacggacacagagacacaagcagaugguuccaggacagaugcagaggccagagggacguggucacagccacggauagcaggagcccccagaagcugggagaggcaggaaggguccuccccuggagccucgagaggaagcguggcccugcccacaccgugaccuccgacuccggacccccaggacugggagagguucugcgagugcugcgugggccccgucugcggccucucugguggagccccaggaaacacaggcuugcguagggucauauuccgucugcugucacaucucccugcccccagccugugacgcagucauggccuugacacuuuggaggguuccagggcugucucuccacagccuggcgcuccgucugggucugaaggugguucugugucauaaaguccaggcugugcugggugacugcggggcaggacggguauguggggagcucucccaaaacugccaaugcccgcuccucccccaucucccguucacaccccggccuggcugcauccgggagacuucgaagugcacuggauggagggugcuggauccucgcacugcgccccgcccucccacgcacugcugggccugcaggcucccacuguccuccuggcagccccgagagugcucuggagaccgagggucggcacuagggcugcuccugcugcugggcgccguggugcccagauccucucugugcacacagaugccccuguauuuaugccucucucucucugaaaucccugagauugcaaagacaccucuaauucuacgccacuuuucuucugcaguggcccugucccuuuaccaauggggacccugcuacaucacgcacgauccuggaucugccucccuggcucugcccugugggggccgcaccgcacagggggagaaggcggcuguggugggcucccgcaggucccgggacccaggcuuuggggucugaagcugaacaaagccuugaaggugagccugccccaggccuagcccaaugccugggcacagagguugcuggcacugagggagcugcgaugggacagccccuccccaaaggcccaugccccucagacccgucuaugcaggccagcccaugggggagggacucgggacaauggcaacuucgucuucgagaaugauggcuugggcgucuaucacagggcagggacugguggccguccaggcuaagccugaugcuauuccgacccaggcuucauguuguguagacagcaacaggaguuuggccccucagccccccgcaggagucggguggggaagcaggugagggauguggcugucacacagcagccaccagccccgagacccuguguggccaguggccugccuggagcccagggcaaggcaaacacggcugggcuggggaggcaggguggagcgcaaggaaggacaaagccagggccccccaaaucccacaggguuccagaugugccuggggcuuggagacaggaacgggucucccuaaaggcucugcaggccacccugugccucugcccaugcggccgccccagcuccaccacucugggccuuuugccuccucauccauccaagccccgcugggcucugacuauggcccuggggguggcggcaacccugacagcccaggaggcggaggccccgugugaccugggggacugggaccugagugguccguggggcuuuagugacaguggggacaccugaggcugcuggccagggcagaggcagcugggggagggggagccacaguggugggcagggcgggggcacucacgcguggcaucguguucucauucuggaugacgaucuggcgaagcaggcgccgcucauaguccugguccauggcgaggcagggcucggcccgcggcaagguuagc

SEQ ID NO: 192178 - RNA, 10120 nt, Homo sapiens
agccagcccaggcagggcgcugaaucggcacaaaccagucucacuucuuguaccgcaguggggagguuggagagaauuuuuucccaugaaagggcauacguugcccguccccuuccccgaagaacgcacuaggaauacuguuccugcguuugcaugagcuguggcaccagcaccgacucagccuuccgggccucccucaugcacggagccucucacuaggucucacccgcggcugcguuggugccguccggcacggucacgugggcgagaaaauggcggcccccagaccgcacugcgggcgucgcggcaggugaagcggugguggcagaggcgccugcgguuacuggccgggccgacggguccugagucuccagagcucggugaggcgucccggaggcggcgaucacgguguggggcccgggucuggcgggcgguggcaccgggagcgccucguuagggaauccggucucagggauucguugacuguggauggggcggguuaaggggucucgagucccggcgaucucuuuccucugggauuuuuuacaugaaagagugcccaccucacguccugaagcuccuaugucguacgguugggucucaaugguccccagugcccugccagcucgcacaggccugcccucugguuucugaugaccccucuuuaaaggugucacucuccuuugauggucaccugugcuuagguggcuacacugcccucgucaagcccaggcagccuugcugacgccacuguucaccagagagggcugccagcaugccauagccagccugucuugagaugaagcauccgccagguucucagccgaucuggaaagagaggggucccuucuccccuuggcuguguucuuuuauccuaagucauucaacaaagcguuggugguuuagagcccgacucuggagccagacuuccuggauuccuaacucuucacgcugcucccaagcaaguucccaagcacagucccaaacugugccucaguuuccucaccuguaaaauggggacaaucuuaguaacuaccucacaggguagugauguagaucgaaugaauuaaugaauguaaagagcauggagugccuggcgcguagcaaaugcuacauaagugucagcugcuauugucacgguugucguuuuuauuuuauuuauuuauuuugagacagggucuugcuuuguagcucagucuggaaugcaauggcacgaucucggcucacugcaaccuccgccucucgaguucaggcgauucuccuaccucagccucccgaguagcugggauuacaggcgcccaccaccacgcccagcuaauuuuuguauuuuuaguagagaugggguuucaccauguuggucagcuggucucgaacuccugaacucagauggucuguccaccucggccucccaaagcgcugggauuacaggcgugagccaccgcgcccagccgguuauuguuuuuauugaggcccuacugcgugcaggucauugcacuaagugcugggaauacaacagugaccaagauagacucagucccagccuucagaguucuauucuaaugagggauaagaccaaucacaagcaacuaaaccaauacuuuccaauaugauaucuaggagucuuaggcgccguggagaaaaauaaagcugaauaagugaaaagagauggaagaguaacauuguccauugugaucagggaaggcuuccaugaggaagugauguuggagacccaggaaagcaagaggaugagcacggguguuccuggaccaaacugagggucgggcugcuauuucucaugguccaauaacgagaugcagauuaacuggggaggaagagaguuuuuauuucuguaaccgguuacagggagaaggccuggaaaauaucgccagaccaacucaaaaugacaaaguuuuccagagcuuauauacccucuaagcucuccaucuacauguaacugagcauccaucuaaagacuuaaagugacuaacuucuuuuaaucuauaacuaagaucugaauccugaagacuuuccuuuggaaccucaguaaauuuacuuaaucuaaauggguccaggugcuggggugaucacccuuaucucaucuccaguggguccaggugcuggggugaucauccuuaucuugucuccugcuaaaucauggagguuuggggaguucuucagacacccaguaaaacuuguuucauccuaaacgggucacauuaagaauuccuucguuauuggcugggugugguggcucaagccuguaauuccagcaguuugggaggcugaggcggguggaucaccugagguugggaguucgagaccagccugaccaacauggagaaacccugucucuacuaaaaauacaaaauuagccgggcaugguggugcaugccuauaaucccagauacucgggaggcugaggcaggagaaucacuugaacccuggaagcauagguuguggugagccgagauaaugccacuacacuccagccugggcaaaagagcgaaacucugucucaaaaaaaaaaaaauuccuucauuaucuugucaugccuuaaggcccaggaaaggccugggcaaaacucuucaugggcuuuuguuacauuccagccuuuguaugagggcacuggcucuuuuagcuuuuaauguuuaacuuaaccacucagucagugcugaaacaguuauggaggccuguguuagugaggccuggccugcuacguggggacaucuagggaagaauguuccucauggagaucacagcaaaugcaaaggcccuagggcugcacugggccuggcguguuggaggaacagcgaggaggccuguguggcuggaguggagcuagagagggaagaggugaugggagauggucaugaagggccuuugggacugucaaguaguugagugaggaggcauaggaggauuuuaagcaagggagugauaugguccaguuuacauauugaaaguacuucugaaucuguuaucuaagcuguguaacaaaaauccccauaauggcuggggguaguggcugaugccuguaauccuaaugcuuugggaggcugaggcaggaugaucacuugagcuugggaguuggagaccagccugggcaacauagaagugagaccccaucucuacaaauaauaaaaaaaaaauuagcugggcaugcuggugugugccuguagacacagccacuaggaagucugaggcaggaggaucacuugagacugggaguucgaggcuacagugagccgugaucaugcugccguacuccagccuggcgacagaacaagauccugucucaaaaacaaacaaaaaaacauacuugguuaccuucaacaacaguaaacagugucgcacacaguugcucugggccuggcuuagcuggcuggcucugggucuggccucugguaaggccucaguggagacgcucuggggcugcaucaucugaagguucgcuuggggcuggacgagcugcugccagcccacuucucucacauggcuguuggugggagggcucaguuuuuugccacgugggccccuacaaaagacugcuugagcauccucacaacauggucacuggcuuccccuagagagagaacaaggaugagacuguugugcuuuuuaugcccuaaccuuggaagucuugcucuguuccaucuucuuggcauucacaugggucagcccuguucagagugggagaggacuauauaaagccuugaauauuggguggggaucgcuauauaaagccuugaauauuggguggggaucgcuagggccauuuugggggucagcugucccucuggcugcuguguggagagcagacaguggaggucauuucugauaggccuauaggcgagaggcagugcagagacugaggcccagagagggaaagcaacuuacggaaggcugcacagcuaguagggagguuggagcugagcuuucagcguagaugcucagguuggucaguggguaggaauuugccccacccagguccuaggaacagacaacgcacuggugaagggggcuucuaaccugggcucucauuuuucugccacagguucuuacauccccgcguccccagguuuagccugagcaggguuguggaaggccgggacccauugacagcacgauggugacggagcaggagguggaugccaucgggcagacgcugguggaccccaagcagccccugcaggcccgcuuccgggcgcuguucacgcugcgugggcucggcggcccaggcgccauugcauggaucagccaggccuucgaugacgauuccgcccugcucaagcacgagcuggccuacugccugggccagaugcaggaugcccgcgccauccccaugcugguggacgugcugcaagacacccgucaggagcccauggugcgccaugaggcaggugagcaccugucugugucccgggcaccugcucccuccugccucacuucuucaugaccccacguguccccuuccucacucaggugauaaauaucagaguggucaacugccccauagagcaccagauaguaaauaccugcagcucugcagccagacagcgacucaauaaagccagcgcaggucaucugucaccaaauggcuaaggcugugugcccagacaaccucaacugggcagggggcgguggcucaggccuguaaucuuagcacuuugggaggcccaggaagguggaucguuugaacucaggaguucaagaccauccugggcaacauggcaaaacccugucucuagaaaaaauacaaaaauuagccaggcaugguggcaugcaccuguagucgcagccacuugggaggcugaggcgggagaaucgcuggagcccgggaagucaagguugcagugagccaugaucgugccaccgcacuccagccugggcaacagagugagauccugucugugaaaaaacaaaaaacaaacuucauuuguaaaugcugagauuugaauuucauauaaauuccacccaucaggaaguacuaucccuuugauuuuuuguuuuaaaccauuuauuuguuuguuuugagucagagucucacucugucgcccaggcugggguacuguggugccgucuuggcucacugcaaccucugccucccggguucaagugauucuccugccuuagccucccaaguagauagcguuacaggugugugccaccacgccuggguaauuuuuguauuuuuaguagagauggguuuugccauguuggccaggcuggccuugaacuccuggccucaagugauccaccugccucggccucccaaagugcugggauuacaggcaugagccaucgcaccccgccuuaaacccuuaaaaguguuuuaaaaaccauucuuugcucguauaaaaacaagcgacaagccauagauccccaaucccuaauguauauuagauuuacuccacucauuggacacacauuuagugagcaccuacuguaugccaggcucugucauguaguaagagacaaaacagugacaauacagauacaagccgggcaucguggcucacgcguguggucccaacuacucaggaggcugaggcaggaggauuacuugagccagggagguugaggcugcaguuagccaugaucaugccacugcacuccagcuugggcaacagagugagacccugucucaaaaaaauggacuguucaggucgggugcauuggcucacgccuguaaucccagcacuuugggaggcugaggcggguggaucaccugaggucaggaguucaagacuagccuggccaacauggugaaaccccgucucaacuaaaaauacaaaaaaaaguagcugggcgugguggccggcgccuguaaucccagcuacuuugggaggcugaggcaggagaaucacuugaacccaggaggcggaguuuucagugaguggagaucgcgccauuguacucuagccugggucacaagagcgaagcucuaaaaaaaaaaaaaaaauggacuguuguagcgagggaccuagacagcgaaggagaccagugaggcagguaguuggugcgucugugccacugggacuguguuucuguaaccagugagcucauuugcaauuagcgcgugggaggugccugacacagagccuguguuggcgcauacgggacuuuucccggcagagggagccugccaggcaggugcacaaacgcaaaccgcaaccuucaggaaaggcaaaagccaccagcucagcugccucacaggcagggcccuugagcucgauucugagaaaauucaaggaacaucugcacccagggcucuacggggagccgccgccagccuugcuccgaccugggcuugcgacgccugcacuugcgccuguacccgaacccaccuaaguguagccccaguggccccaaauucuggagucuccagccggcaggcccggccuguuuugggaauuuuuuuuguuuguuuuuuugagacagggucucacucugucgcccaugcuggaguacaguggugugaucauagcucacugcacccccgaccuccuggguucuuggagcugcuugucagcugugaucccgaguuguagggauauacuugucucccugucucaugguacgggccgggaugggguccauuuugcucugagcggcagccaggugcgguuccaggcagugccuugcucuggggaggggaugcugauugguccagcggggagccuguaccgacugcugcuccaaucagccguggacagaggcggggcuuccccacaguggcagagcccugggagggguguccuccggucccagagguagccgggcauuuuccacacauccaccccaccaacaugagcucuccggcugcuucuucccaggggaggcccugggggccaucggggacccggaaguucuggagauccugaagcaguauuccucggaccccgucaucgagguaaccaggccccugcuugucucccugccagucucgggucccugggaagcccugcccagcccugccccagcccugaccuggagcagccucagacccuccccaucucugguugccagggcgaccacuuggccaaggaugccccagggaugaggaaggcgagggcgacaaucuggacagacacuugcugcgccccauuuggcaaaacggcgacaaccagcuuugcucacccgcuuccaucccgggccuugagccccugagccggccugacccccuuucucugaacccccacguccagucccucugccaagaccccucugaacccacccagugcccucuaccucugauaccuuguccuggcccaccagaccucuucagagaucuccugcuaccuuccaacauuucuucuuuuuuuuuuuugagacggugucucgcucugucgcccaggcuggagugcagugggcgcgaucucggcucacugcaagcucugcuucccagguucaugcuauucuccugccucagccuccagaguagcugggacuacaggcgccugccaccacgcucagcaaaucuuuucguauuuuuaguagagacgggguuucaccauguuagccaggauggucucgaucuccugaccucgugauccacccgccuuggccuccaaagugcugggauuacaggcgugagccaccgcgccuggcccaaaaaugaaacaaauuuuuauuuuauuaguuuuuucuuuauagagaugaagucccgcucugucgcccaggcugguguugaacuccugggcucaagcgauccuccugccuuggucucccuaacugcugggauuaggggcaugagccgcuucggccggcccgucauuccuuuuuguggcugagucacguuccgugguguggacggcccaugcuguguccacucacuguggcuggaugcuugaauugucucugcuuuuuagcuguuaugaguuaugccgccacggacaugcauguuccuuucuccccugccacuucuuguccacaucccaccccgacccucagucucuccuccuccggggcagccggggguacgugugacacucaauucugcuguucuguuccaugcuuaaagcucucacgauaucucaucaccuuuaggacaaaaucccaagcccuuacaguggcccgcaggccuuaccuggucagguggggccgcacauguuccuuuggcccucaccccucccgcaggguccugccucagggccuuuccaccgcugcuuccccauccccgggucuccaccugauucccucccuaagcuggcuuaggucucugccuccacaucaccuccucccugaggcccuccccagcccuccagucccccggucacucacaagucagccaccccugcuggcuuacuuccugccuggaaugauggguuagucacccugccagugucucucuccccugcuaagcugccaucccgggggguggggaagggccccugcgaccccccagggccaacccgcugccugauacccccuccccgcagguggccgagaccugccagcuggccgugcgcaggcuggaguggcugcagcagcacggcggggagccggcggcgggacccuaccucuccguggacccugccccgccggcugaggagcgugacguggggcgccugcgggaggcgcugcuggaugagucccggccgcucuucgagcgauaccgcgccauguucgcccugcgcaacgcgggaggcgaggaggccgcccuggcgcuggccgagggugaggaggggcuucuggggugggguccugggcagugccucgcugugagguucagugauggcaucugugcaguggggccgcggccugcccccgggaacggcaucccgggccuggccccaagcauuucccauggggccucuuaagaacccgugcaagcgucccucuugguccccauagcucccagcuuuucccgcccccauagcugcggucaguucccccgggcaucccuaaucacuggggcugggggcaggggugucuucaagguagaacaccccagguugggcgugguggcucacgccugucgucccagcacuuugggaggccgggaugggaagaucgccaggacuuugugaccugccugggcaagauagcaagaccccaugucuucgaaaagacagagcuccccuucccaccccuccuggccccagcgagugucccucuccccugcaggucugcacugugggagcgcccucuuccgccacgaggucggcuacguccugggacagcugcagcacgaggcggcggugccccagcuggcggccgcccuggcccgaugcaccgagaaccccauggugcggcacgagugcgcggaggcccugggcgccauugcccggcccgccugccuggccgcgcugcaggcucacgcggacgacccagagcgcguggugcgugagagcugcgagguggcucuggacauguaugagcacgagaccgggcgggccuuccaguacgcggacggccuggagcagcugcgcggggcccccuccuagggccccacccucacccggagcucccggaggacucuugagggccgcuccucccccgcagagcuuuggcgucuaaaccggguguguguaaaucggugucaucgcuugugucuugcugggcgcaugguugcugucccccuccuccgucugggaccgaggagcugccguugugcugugacucccugaguccccugacugcuccucggggccuggcgcagggcuguagcguggaaguuuccaggcuuggggugggacucugcgggaggcucugggaugcccggcucaggacaggggaggauugcgagggaagccaggggaggaucgcgagggaagccaggggaggaucgcgagggaagccaggggaggaucgcgagggaagccaggggaggaucgcgagggaagccaagggaggaucgcgaggggagccaggggaggaucgcgagggaagccaggggcagagcuggggcucugggaagaggcugacguuaugguggcuucagcuucacuaggaaugggacacagggucugggggccucugacucccccaccccgaggccuggguagggacagggugguggucccugagugggucagguagggcacaggggccagggagggacaagcagaccucagagcgcugcccagauggaauauuaaauuauuuuugccaagca

SEQ ID NO: 192179 - RNA, 27047 nt, Homo sapiens
uuagaaaaaagcgagccauaagucaaggccagaaaaaggcugccuuugccguugacaaaaggugagaaggugcgcgaaguguacggagggagagauguacauccccugauaacugugaaauaaaaaccauuuguuaaaaauaugaaaaaaaaaaaucuccucccgcgggcagaggccccggcccggacucggcagcgccacccgcccggcagccgcaggcuccguggaaggaagguccugccccgugucuccaucccgucucccugggccugggcgcucagaccagguuguacuccuugagguugagcugcaggaugguguccuucacggccgcgaacacgaagcggauguucuccgugucgguggcacacgugaagugugaguagaugaucuugucgcugucgggguucagguccacgaacaucuucaggaugaacucccgcgccgccugggcgucccgcuggggaccugggggagggcagagggugaggcugugccccagcccggcccagggcaagggacucgugggccccuuugucacucccaggggaugagcgaguaaggcccacggcccacccagcucgacccccagcccacugcaugccugacgggccgcagcuccccucccuccccaggugagcugcggugccaaucccacuguagccccagggcacuacugucacggcccaggccuccaaccuggggcucugcacccaccgcugcucccucugcucagcccucugccggccucuauccacucagcuccacagccacagccuuccagggcaggccucuggcauggcugcccugcgaaggcccagggugagaggagaggcccccagggcugggcacagagccuacagagcaggaacaguggcccccacccacccacggugccccugcugcagccaggccucagagacauccaggggcuccagcaggggcgcugcuucccaccggccaccccugccccuccaccacccuggacaaugcaggcgacccgcccaguaacuccugccugccccgguggaaaggccccuggggguguucaaggggcugcucuggggacuggugggacaggggucuaugccccagucccuuggccuccccccaccagggcucucugagcccacaggacaggcugcugggcaggggccacgugcggcuggagcaggugcagcgccccccgccacuccccugcccagggacagcagggcccugcgccugcagccagcggccgaggcuauaccgugugccagaccccucccucucgcugcacauccagaggcagggcacccugaggggcccucccgaagaugacacccgagacucacgggaggagcacagauccgggguggaaaugagggcgccagagcugcccagggccucacugugccuggcagggacagcucugaguggugacagcacuaacggcagccacugaccacacagacgagggcacacaacacccuccccuggccgccauccccaggcccagagagggcugggcaugugaagacccucagugcucagcugcccugacacaccccguggggcaggggccacguagggagggacggguccgagggugggggcaguagggcacagaggaggaugcagggacuaccaccaagguccccacggggcugcgcuggcagugugcgugaacccuuccugugagaccccucccauaugggaucaccuauacaggacacccccauacgacaacucccucccguacaagacccaccaauacaagacucccccucccauggugcccuccuuguacaagacuccucccacccgagaucccccugcccgagaccccucccacccgagaccccuccuguauaaggagucccugcauuaacagaucucccacggguaugagacacccgcgucggagaacucauucccguacaggccccccucauacgagaucucccuucccugagacuccacucccauacaugacaccucccaucagacgcccucccuuagagcucccggccuguaugagccccucucccauaucagcccccuccccccaguaaggcccugcccgcgagccccuccccaugccgcagcccggcgcaccaucgaacucggggaaguaguccaccaggugcgaguacaggaucuuguccuccagcagguccuucuuguugaggaagaggaugacggaggaguucuggaaccagggguaggugaugaugguccggaacagggcuuugcucuccuccauccgguucuggcgggagcgaaggcagagggaaucagaggggcccuccccacugcacacagcccaaggggcagcuggggggacccaggugaggggacccaggcuuggcagguggggaaggcccggcccccaacgcugccccugcucagggcagggcccaccucguuguccgacuccaccaggacuuggucguauucgcugagggcgacgagaaacaugauggaugucacguucucaaagcaguggauccacuuccuccgcuccgaccgcuggccccccacauccaccauccugaaaggacacagcgccaggacucagccaccuggcgccccaaggcccaaucugcaaucccaggacggcucccacccaagccccuccugccacaccagacugacaucggcuggagcaggaagagcccccacucuuagaacgggcaaggacgcucucagagagcggccgcaccgccuccaggggugaccaccgcagacccuucccucacuggcaaaggggccugagaccacugggcccagggaagcgggcgcuagugugggggugugagaacccagaggauucugggcgccagcugcugcgggaaccugcgaugggugcccagggacccuacaucuggcaucuggaugucacccugagcacagaagccuuuccccucacugggccagggacacagauguucaccaagcgucacucgcaggaguaaacacugaugccacaguugcucccugcagggacccuccagugacggcugcagagggcagaguugccgguauccuccuggggcagaagagcaggcgcagcgcccugccccgcguggugagcagcucaaccucacacucucaggccacgcacaggcgggagaaagaaaaucagcucagacgaugucugcgggcgugcguuccuuacgggacguuugccucuuucuacuugugacuuuucuaaguuuucuauaacgagaaaaggcacuuuggucuccuugaaagaauacaaaggcagaagcggagagugccccucaggcccuggccccaggccccagggaaggccggggucccugcaacucugccgaggagagcggggcugcuuugggcaugugaguggugaaauccaccuggucuggucugcgggggaguccagcaggcaccgguggaugacagaugugccaggugacucuaagggacaagagggcccgcaccagcagcuguggccaggcgggaggacagugggugugccgacaccaggccacagcccgucuggagcgcgaggccucuccugcacgccugcggcggccggcagggcugggauccggguccccccgugucuuguccccaccugagggagcaggagccucuccucacgcacugggacgaucccaccggccuucaaggccuccagcugcaucccacagcaccuggccggcccucugccagcgugugguggacagaggcggcuggcagagaaacaaugguggcagaggaguaggcucaggacgggggucugcacccggcacagagggcacagccgggccgggcgcgguggcucacgccuguaaucccagcacuuugggaggccgaggcaggcggaucacgaggucaggaggucgagaccauccuggcuaacauggugaaaccacaucucuacuaaaaaguacaaaaaauuagccaggcgugguggcgggcgucuauagucccagcuacucgggaggcugaggcaggagaauggcgugaacccgggaggcggagcuugcagugagcccagauugcacagcugcacuccagccugggcgacagagcaagacuccgucucaaaaaaaagaaaagggcacagcuggagcugggaagggccuggaagaugguggagagggggugacacacccagccugagcucagcucagggaggggacaggacauuucugacagaggacacagaggccugcgcuguuaagaggccagcguggggcugugaggggacauucaugccacaaccuggccuaugccuggcucgccucagcuguauccuggggucaugggccccgugugaauaaaaaagaagaaaaacuugaauucucguaacaauauacaccaucgcccauguccagagaggacaccgcagcuucugagggcccagcgccugcucggguccccgggaaccaucccagagcuuggcauuccuuggcuuguggccacauugcuccaucccugccuccaucuucacgccgcauccucccugccugcgcugggaggccgagcugggaggacggguggggagaacaggcagauggcaggggguggcacccccagcccuggggugggucucaaggcagggcucucgaggaaaaccccacagacuucccggaacccucacaauggccucggcagugcaccagcuggguggggacacccuggcagggaggcgucauucccucaugagggccagugccagggcgagcuugcacugcaggagaaggcacccgcaaccggagccaccgcgaggcccuccaggacagagccgucuagcgccccacacgcacgaacaccagaacccggggacggcucugaucuggaaacagggucugugcggaugucacugguuaggauaacgucacacagagguaggguggcccuggccaaggacagguuauaagagaacagaggcaaaggcgcaggcggggaggacgcugcaugaggaugggggcagggaugaggcaacccggccacaagccaaggaugccaaggaugccaaggaugccaaggaugcggccgccacuaggagccgagugaggccugggcagauccccucagccucagaaggaccuggcccggcccacaccugcaucucagccuucuggccuccagcacugggcgggaauaaggccugcggugggagucucacgcccgacaccagcagcccaggacaggcacgcauaaagccgggaccucagcgcuggagauguuauauggggccaggagacaggcaggcaggguccacguucccagggacagcagaguccagccagcugagcagccuaccagacacaggacccacugaggguccccagggagaacccggcucugcuggccggcccccagccacaguggaccuggagccccggaggcccagcaggauccgcaggggcagcccgugaagaacagaauccaccccacaccacccagcuccuccaccccagccuggagcccuccuccccacucagucccuaugaccccuccuccccucaaagccucgguccccacgaccccuccuccccucacagccucgguccccaugaccccucuucccugacagccucggccccuaugaccccuccuccccucacagccucagucccuaugaccccuccuccccacucagucccuaugaccccuccuccacucacagccucgguccccgugacccccccccuccccucacagccucggucccuaugaccccuccuccccucacagccucgguccccaugagcccccuccccuggcagccucagucccuaugaccccucccgcaccaugcggcacccccugcuccggccagcacuccagaccccagccccaugcuggcuccaaccaggcccccggcccguccuggaggcccugucaaauguccucccugccaggucucuucggcugccggucuggauggauguggccacgccccccacacccccacagcuccuucccuguguggcccuggcucacacauacuuagagauaaaucuuauccccugaccuggucaaacacacacugaggaugaagaccaaugggcuuucuuuuguuuaauaagacgaaacagggucucccucugucgcccaggcuggaguccaguggugccaucauggcucacuucagccucaaccuccugggcuugagcgauccuccugccucagccuccugaguagcugggaccacaggugcacacaaccacgcccagcuaauuuuuaaaauuuuuuuuagauaugaggucuggcuauguugcccaggguggucucaaacuccuggacucaggcgauccucccgccuuggccucccaaagcacugggugcgcaggcaugagccggcacaccgggcaaaugagccucucagugcccccuccccgccugcuguggcccgggcgguaccggaagaugauguucuccaggucgaaaggguacucgaugaugccgguggugggcacgcggacccgcagcacguccugcugggugggcagguagcccaagguggcgaugcggucaacgucggucagguagcugcaacacagcggugggugcucaggccggcugccgggggugggggggcaggacagggacacagcacccaaaccagcgggaggacggaaagccaccaggaggggguggaccgcgcacugcgccaccuacggcagugucugaagcagcccggagggcucgggccaauggagacccuggggucgggauacgagccucccaaccucuauccucucuggggucucaggggacagaaaugacccagcacaagagaaagucccaggacgaggacuccagcugguucgggggguuuguaguagagcuguccagagacggccaccaaggagggagacggugacccagggcaggggacuucccgagagaggccuggcuggccccagggaugaggcuucacaaacaagcgcaucauuaggagagucgcagcugcagaggcugcagaggucccagcagauccccgugcccgucucccugcugcucccuguacgugggugcggcacccaccacgagcaaugagccagugucuacacagcgcagcuacugaaguccacgcuugauuccggcuuccuugguuccccucaugccuuuuccugcccagcccucuggguugggacaguuucccguuuuugacgcccugggcaguccugaguggggcgccccucgaguggucugccugggguggggguuguaagaggccgggugccugcucagaccuuuccggcaccgcgaggaggcccuggcguuuuguuccaagugcuugguuaucugggcccucccacaaccucccagaggcagggaacacacagaggacgggcaggaggggcgggggacaggccugucccugucgccuuagggucucucccggugcugggggagggccggggccucugccugccaagcauggagggcagcagugcacagccugccacgcgggggccuccaccugcggccauggcccggccaccugucagcacacaagucacccccuaucccaggcccagagacugggagaacccugacaucagucaaggucacagccagucacuagugggagacguggcucuggggacgaugucccaggcaggagcgagacggcccagguugugucuaccucccaucccacggcccuccuaggagacccuggguuucccccacaggccacaggccgggcuccagcaccgaggguggccaggagcucacuccugacccagggagggcagcggcagggccaggcauacaagcaggccagugucacaccagaguccaccggcuccugccaaggcguggccccuccagggaucugcucuggucccuccauccggccagguggcccgggcccaccgcaucccugcccccggcgagcaggcagggggcaccacagacgccgcggaggccuucccgaagggucccaggcaccggcccgcagcugccguccccaggccgccagcggugcggccgcacuuacuacuuggcagagucggagagcugguacucgcgccugcggucguagcauuccuggaugcccggguccucccacagggucuugauggcacugacguacugaugcucgaagguggucaccuucuccacguccaccucccggaucaggagcgcauuggccugcgagggcgggcaggggagacgucgagagcucgcuggggccacacauccaccagaaagcuugugacggccccucuuccaggccucggcuggcccgggcggcauuccgcaggcugugcagucaggaccacugacaguuccgugugaacacgugucagaaaaacgcgaggccgccuggcggugugguuccuccgaacaaggccccacaagcaaagccucccggcggugcggucugcagggugccggggaggccgggcuucgauucacuucuuagagguggggaggggacgguguggggaacaagcacguguagaacacacacacuucaaacccaggacccacaggagggcagugcagcgccgagcacgaccaagcacgacgacagaacuaaccaacagccccagcacucgcugccucgaauucuccagacacaccgggaggcaggaagcccagucacaggacguugcaaccagcggcaucgccugcagugugcagcuccagacucgguuucugccccgccggcuucucucuuucguccgaaaaaugcuuaucaaacaucaucaagagcagauaccacacccggugcuaaggacggcguguggcccccgagcugccgcacucaacaguuuacauggugccccaacacgagccgccucccccucacggaacccugggcggcggguggcaucaggccccagcuugcugcccugucacaaaggaaggccaaccgcacagacacgugcuugcacacacaugugaacacccuuuggggcagacacugugggggggccauccuuuccccuccugaugcucuguguccccguccccggggcgcacaggccgacaugaccagccacaguuuggcugagggacuggggaggggacauacugggugggacccagaugggaaagaagggagccuugcccugggcucugggagccacggggcccucccaggccccccagaguggagacucagcccuugcuuguccccucugagcaacgcucccugccccggacuccgacuucagcccuccccuugcccugcccccagccucucaaucugggcugggauaagcacaccuagggggacuuggaaaaagagacacaaaccccaaaaaucccacucccuggaaacuuccagauuagacagcagcaaucugcuucugcagagagccagagagcacacccagccuucccgaccacacggacugucuccagcacucggcucugcugcugcugcugaagcaccaugggcaacauggcagaaauggguaugugccaauaaaacuuuaucgacaaaaucagucugcaguuugcagaugcguguuucagaagcugauggagaucuaagcccaaauaugaauauggacucucagagagggccacagcuggaagagaucacagcgggagacagggcaaguggcaaaccaagaucuaagggcaagagcccuaccccugaaagcagggcuacgaaagcgggaucaauggccccucagcugaaaggccccagggaggccacuggcaggagccacggcugcacggcugcugggccugccccauagggcggccacuggggcaaacucucuggacgcuucucagagggcaaagccagagucacccugggacccagcaauucugcucccaggcguagcaugcaacugagggaagggaacacaucauccacauaaacacacguccacagacggucacggcagcuccguucccaacagcccacacaugaaggcacucaaauguccuccaggggauaaaugggcaaauacgcggucccuccaugcacuggaacaugacucagccaugaacagggacgaggcucugacacaggccacuguguggaugcaccuugaggacgucacacucagugagagacgccggacacaaaaggccacauggcgugcaaucccauuucuaugaaauguucaggacagaccgauccacagaggcaggaaggggaugugugggugccggggcuggaggagggggugggagugacggccgauggggaaggggcuuccuuugagaaaaugaaaucuggaauccgacagcggugauggcugcacgacuaugcaaacauaucgaaaaccaccaaauuauacacuuuaagcaagugaagugcauagaaugugaauuauaacucaauaaagcugugauuuaaaaacagggcaucaaaugaccucuacuuuaucaaaaaaaaaagaaaaaaaaccagggcggaggccaggcaugguggcucauaccuguaaucccagcacuuugggaggccaaagcgggaggacugcuugagcccaggaguucaagaccagccugggcaacauggugaaauuccaucucuacaaaaaauacaaaaauuagcuaggcguggugaugcaccugcagucccagcuacccgggaggcuguggugggaucaccugagcccagaagguccaggcugugaugagccuugaccauuccacugcacuccagccugggcgacagagcgagacccuguuuucaaaacaaaacaaaacaaaacaaaacaaaaaaacagugugagaaggugagaaguacagccccaugggugagugucagggccgaaacgaggugccugguaggcugcucagccuggggaaggggccggaaccaggagcucacgcugcuuacucccaaggcgaccugggcgaguggcucaccucacagggccucagcuuccccagggccucagcuuccccacccacaggaugugggcgcccacagcuacuugggagggaggcuguggggcuuggccacgcaaugcccaucacaacucuccaguuggcccccaggaagucagcgguugcuguuuccauguccaugacaggaacggauggaugaccagggguagccugggccggccgggacccccggcauggccccacccuggcagcgcggccaccaugcucaccaccaagcccacagcugcccaggcgcuccccuccccaggcgcccgcgggcucaccuuguucugcucguacuuguagaggaucuugagcgucuccauggcccggaucauggccugcauggcggugaagauguucugguagacgagcuuggugaagccgcgcuuguccuccuccgaguagccggcgccguggaugaugcgcaucugcuugaugaacgugcucuucccgcucucgcccgugccugggggacggggcacgugagggcgggcggcagccggggccugacucucgugcugcugcccccucuuacccagacccugccgugcugcagcacccagcacaggaaaccaaggcacgugaggcugaccgucucuccaccagacgccacggccuccugacuccucggaaagaguuuacaaagcgcccuucccaucuuccaccaagccagggucuuacuggaaccaccccuuuuccagaaguucugcaaggacacacuuuccugggggccaauuguugguauuuacgucaaagaccacacggucucaggccaaaucaagucgcacggcaccggccccgcagcugggacugugcagcuccaccacggucacgccaguucaugaccaaugcucaccagagggacagcacacagacguggcggcggugcccugacagacggacucaccccaacggcaucucugcacagaccaccccaagggcugggcgcccccuuccccagagcuuugcucagcggccacggccacacugcccccugcgcaccaagcacccacgaggcucuccccucucccucuuggugcuguggcggggucagccaggaccguugugccugccacagguggcccugagcacaucccugaaccccuuuacgucuccacgccugccacgaccuugcuaauacccacaaugcuuccagagacgaguacgcuaccaccccaucucagagaugggcacacugauggucccagggccccagaggaugaaaaggauuagcaagucagccuggaaaaacuaucgggaagggggcccauguggccagcugucgcuccaccccagccuccagaugagccccccacacauucugggugacauggggguccucacuccagccccucuccugccucugccucucaccuggucaccuccugggcagagacuccgucuccccacuuuucuucacccucacacgcugggaugccaaugcuggguuuuccaguguguccacaaaucucugaugcucaucccuuccauacuggaaccuaauuccccuccccuugagcaugggcuacacuuagugaccugcuucuagcaaacagaaugugauggaagugacagugugccaucuccaaggccaguucacaaaaggcacaggccuuccuccuugcccucagucucgggucaggggcucugggguaggcagccgccacgcugugaggacccucaagcagcuucacggagaggcccacguggugaggaacugaggccucccaccaacagccacuagagggagccaacuugugaguggcuccuccagcuccaguccagccuucaaaugauguggccccugcuuggcugguauccugacuacaacuucugagagaccccaagccaggaucacucaacaaagugcucccacauucccaacccucagaaacuaucugaaauaaguuuuguuaauuuaaguugcgaaguuuuggggugaccccauuacacagcaauaguuaacuucuaauuucuaaaaagagacugccucaacucucuacucagguauuaaccuugcucaggcccccggugcccuagagacucaagcgucaccgcccccucccagcaugcccccagcccacuucuccaggcucgccuucaccacccugugucucugaaucuuccggcaccuccccacuuccacacacguccuacgcuguugcccucugcccacagugcuguuccaaucacagcugccuaaaggcugccuggugcugggacccagcucacuuccucucacagccucugcucuagaaagcccccaagccccaacacaacucucccuccgguacuuucuggaaccuuccuugcugcccaugguagauaucuuugcacaggugccugucgcaggaccccucaccuggcagcuccuagagaugagacaggcugcaugugucccacgguggccacagugcugccuucgggaggcccucgacaaagcccaggaacugcccacagcaccugagcucccuguggggggucucgcaaaacacccaacacaucccgaguggggagccccgguggcagcugccucuccccaguacuuuucucaaacacccugaguccuuuucagaagaaagaaaauugauuuugauugucucagguaguaauccaccucucagcccucaccucauccacaaaaggucaaacccacccaaguuccaggacaggaggagugagggugagugugaaggugaaaacaccuucuccccagagggacccccacacgcccuucccucaccgcgcccugaagagaagggcgguggcauggaggggaugcaaucugaggccagggauccucggccucagcucuacugaccggugcugaacccugggcccugaggggugcucagcagcaacccuggcccccacccacuccaucucaggagcacccccccgaauugugaccaccacagauguccccagacagugccagugucccaugggucaagacugcccccagaugagacucuaugucuaacaaaaugcuauuacaaaagauggcugcuccguguuuguuuggaaggguguuucaccuggaaacagcaaacacucacacacacugaaagccacaccugacacgagaccagcacacacugcaagccugcaccccagcacaggccccaugcugcaggcaggaggcgaggagggcccugcacucgggucagaaggcgccgccccuugguaacuuugcacccaagacacaaggucccucaggccauaaacaucucaacuaugaaacagaaaagcaagccucagcucucagcgaggaugccgggaagaccaagacggccgagaaggagucugaaacgccacaggucacugcccagaugagaacuggcucgguacuacuguuugggguuguguuuuguuuuuucagauggagucuugcucuguugcccaggcuggagugcaguggcgcaaucuuggcucacugcaagcuccgccucccgggcccaaguguuucuccugccucagccucccaaguagcuaggacuacaggcaugcgccaccacgccuggcuaauuuuguauuuuuaguagagaugguguuucuccauguugguuaggcuggugucaaauuccucaccucaggugaucuaccugccucagcuucccaaagcgcugggauuacaggcgugagccaccgcgcccggccuguuuugcguuuuguaaggaaggcaaaaaugacaaccacagcccuggcucgccaaggacccccauggagcucugcagaggcaauauggauacacugaugggggagggagguggcucacaccuaugcacccaggcaugcacacauacauaugcauuaacgugcauauaugcacacaaugcacacgugcacacccacacauacauguaugcaugcauguacaucagcacacacgugcauggugcacgcacacaugcauguacauguacacacacaugcagcccguacacagcuggguggcuggcauguuaacccaugugcaccacucccgcugggugaagccacucgugucucccacauaacccaccaaagccaggagagguugcagagggaggcaggagcccagcaggaguucugggccaccggaagccaagccaggcccagguggccccgggccucugguggcccugaggugcuggccacuguuaagcccugccguacagaggccaagggcgaggcucuggacagcacucaagccaggcaacgugacuacauuuggguuuucaagaugcuuuggucccagccugcuuuucaaaucgcccugucuccccgcgccaacucagcugcugccgccucccgucacacagcgucuuggagcugggacgcagggguccacacacaguggacccaaugucugaaugccuggguccugccugagaccucacaccccgcggcuggggcucaacauccagggcccuggucagcagagacucgcucccacccgaccggcagccauguggccccaaagccacagccccaacucgggccucagcccacauggcuccacccugacccagccugccccaccugcagccacacuccaccugaaagacaucugagcuggaacgcucuuuuggcuccaaaaucuucaacagcugcccacuggaaagaaaugccagcccacuccuccugagacaaugugugagccccuccgagaugccgccucacucuggacucguccacagccccuugccggcccucaucucccggucucaggccacugcagggcaccugccaggacagagccuucuguccacuccucaccgcacaccaagcaccacggcagcuuuacucguaaaagccaaaaagccaaagcuccagagacccuucagcaggugcacgggugcaaagaccccacgcacagaccgcugcucggcgcugggcaggaauggaccacugaccacaccgccaccccaagggcaacgcaccaaguggucccacccauagcaaugaaugucugugauccccccaaauuccuauguuaaaauucucaccccuaagacagugguguugggaggcgggaucagcuucuuccgccacggagcucuuggggggcucuuucaugagggcacugaugguuccaggagggaucccguccgcaugaggacacagcaagaaggcaccgcugucuaugaaccaggaaacacaaccacccccuacaccaaauccacagcgccgcugucuauguaccaggaagcacaacccccccuuccccccaaccccccaaauccacagaaccuugaucuuggacguccagccuccagaaccaugagacaaacucggguaguuuacaagccacugugccugcaguauugucacagcagcccgagcugacugagacggugacaaaauguuaggaaaagagaacacugcaggaagccagggauccagccagggguccggccaugaaagggcagcugggaggguccugcaggacagaugcugccuggccccugccuguggcaggggagcacgcacuccacgggugacgagucaaacccaacuucacaugcaccccucccacccucccucccugccacgaggccacacccaccaccggucccgcugugagacccccagguuccugccucagacugggucuggagcuggugagcucagccucccaggaggccgucgugggcacuggcagcugugugcgacccuugcuucagcaccagaguuaaauauaaacuaccccuuccaucagguccuuccccuucccaaacgcccggagaacccccacugcagaaauccaagagcccggcguucaggaagcgcccagcacccccacagcacaggcccuuugaggguggcucugccauucccuccucagugagguguggcagugcccgucugcagccugccucgccagcuuccugagcgcaggggcuguggcugcccugcccaccugcaucccuagccccuaugcagaaggcgcuguguacauguuuccugagcgaaccaaaugaaccuggcccugguccacagugcuggaucccucauguccccauugggucccccgcacuccagugcccgucaggauggaccugacugcaugucaccagccauggcuccugggagaauggggcccacaucucccacaccugagggagccccccacacaaccacaagcaaggugcuuugccugugcaagcaugguuccuggugggccugccacaggccgccccacaguggaccccagacgcuagggagccugcaggagguacauccucagguacacucagcacgccaccacuaggaggggccagaguccgcccacugcucccacugagccagcuuccagaggagaaaaccacccucccgacuggacccgcuggccaagaucuggagaggccaaccaggaggaacgaaguccgugccccagcuuccuuuuccccggugggaaaggaaaacggaagaaaaggaggcuccaagcgccacaagagggcgcagcccugacagcaggagcugggggcucauccgaugcucaagauucaaagccgggcgcgguggcucacgccuguaaucccagcacuuugaggccgaggcagguggaucauuugaggucaggaguucaagaccagccuagccaacauggugaaaccccgucucuaccaaaaaauuuacaaaaauggccaggcaugguggcucacaccuguaaucccggcacuuugggaggccaaggugggcggaucacgaggucaggagaucgagaccauccuggcuaacacggugaaaccgcgucuccacuaaaacuacaaaaaauuagccgggcaugguggcaggcgccugaaagcugaggcaggagaauggcgugaaucaggaggcggagcuuguggugagcugagaucgugccacugcacuccagccuaggcgacagagcaagacucuugucucaaaaaaaaaaaauuuacaaaaaaaaaaauuagcuggguguggcagugggcgcuuguaaucccagcuacucaggaggcugaggcaggagaaacgcuugaacccaagagacagaggugagcaaacauucuaccacugcacuccagccugggugacaagugagaccuugucucaaaaaaaaaaaaaaaaaaaaaaaaaaaaaaagauucaaggccgggcgcaguggcucacgccuguaaucccagcacuuugggaggccaaggcaagcggaucaccugaggucagaaguuggagaccagccuggccaacauagugaaaccacaucuccacuaaaaauacaaaaauuagccgggugugguggcaugcgccuguaaucccagcuucucgggaggcugaggcaggagaaucacuugaaccaggaggcagagguugcagugagccaagacugcaccacugcacuccagccugggcaacagagugagacucucucucaaaaauaaauaaauaaauaaauaaauaacaaauaaaaaguauauaaagauucaaguaacccaugaccccaguggcagggcugagaccugggagccgacaccugggagucagacuuccaggguuccaggcugcuucccgucuacgacgccugagccgagccccacagugcccaagacugugagaugugggccgagaagccaggaagcccccaccaggcugcggggaggccaggccagugcacacaccgggagcaaggccagagccacagggccccaccugggggauacacaugaccguuugucagcacccaugagaaggcgggugguggcagcccacgcgugugcaugcgugugccugugaucuuggcucuuggaaacagccaggaaaucuaacccugaccaagagcuguacugguggguguggggucagagccaggcaccaaccugacgcaggggcccgaggaggggcagcccuccugcagcggaggacggacgccccucauccagcuucacaaggggccucaugccugcuucgcuucagucucagaaccccaggagguagacagcaccucagcgccugauugacuggaggggaaacugaggcacggagaggacaagcugccucccugaagucacacgaccccuaauggcagggccugaagagacuucggucuccuggcuccgcagcuuauccccggcaggcagcccaggacgugcucuucugcuccagcacgcacccucaggcagggaggcaagaagacaagggggcgcccugagagaggaagugcacccggcucaccccgcugcugaggcucaagaaagagcugccccgaaacucacuaccccagguggggcaugacagccaggggcagcgauggcaggacagccucuggacuggaacccaaucccaucuccacagcagcagaguccccaggugccucaaaggugcagauacuaacugccccucgccggucaggggccaugccaccuuguucuguucccacugaggcuuccgugcagacuggcucccaagugggagugaccccaccccuccacuggaagcggauggugucacucacucauguuuucuacguuuuuuuuuuguuuguuuuguuuuguuuguuuguuuguuuuugagacagaaccucucccucggucgcccaggcuggagugcaguggugcaaucucggcucacugcaaccucugccuccuggacucaagugauccucccaccuuagccacccagguagcugggacuacaggugcacaucaccaagucuggcuaauuuuuugcauuuuuaguagagacaggggucucgucauguugcccaggcuggucucgaacuccuggacuugagugaucugccugacucggccucucaaaguacuuggauuacaggcaugagccaccgcaccuggccauacaaaauuucuaagcucccgucuccucacgugcugggucuucccacagccauuacugaagccccccgacagccugggagacugguccccagccuugugcagcccaucuaacccaguugugggcacuggccuggacaucuccaccugagggacagggacagacccccgccccugcccagcucacugaccaucgccaaagagugugggauaggaucacugaugggggaagggcaggaguccggagcccaggcccccucuccagacaucuacccaggccaccagcaagggccugaccggucaacccucgccgcauccagugggacuaaggccgagcaaaccaguguggcuggagaaaaggcugcuucauucaucccacagcguggacccggccccacagucccugggggcugcauucaucccacagcguggacccagccccaccacagccgugggggcugcacucaucccacaguguggaccuggccccacagucccuggggauuaagacaggcaacagaacagccacaucucugcaggccgcacaagucccgcucgguggcggggcccagcacccaucaguguggacacgguuaacaauagcaacagacacagcgcccuccaguuugaccacacccuucagccccccaccccacuccgucccugcagggccccugaaacaucagggugaccacacaguuugacagaagagaaaacggagccugggccaccggacggugcgguacccagaacaccaacuccgaggucagacagggacagaaaccugggccagcaccgucccuccuggagccucccaggccuugggguccccauguggacgccauccagggagcaccaccgcccaggguuacuccgcagcuuuucggugcaaagcagccagcaggaagggcagccacaggggacaagagggcucccuccccgcugucugccgcacuggccucagcucauuuaauccuuccacaauccuacagggggagggacagccuucccacgugaccgauggggaaacugaggccgggagagggaagugacucgccccuggcucccuccagagugugcccccacugccccgugcuggccagcccagggcagcccaggccacaggcaggacucagaaagaagcuucugagagccagcugcgcacuguccccggagaccccuucugcccagugcacaggcccacaggcagguggcaaccgagccugccccagcagagaccccuggcgugcaccagaccagccugcagggcauuggggaggugucgggccacuccucuccacuucccugcgugaucugccuucagucagccaaugacggucacucgccaagcaucucugagaccugcacagcucaaugacaugggcagggaagcaggggaccaaggacacgcagcugacgauggcgacgagaagggaagggggcugcuaagacacacgggucagggguccugcucccagggacacuaggcgaugucuggggacuucugugguugucacaacuugggggugcuccuggucugguguggguggaggccagggacgcugcucaguacccugcagugcccaagacagcuccaccccagagaacgauccaguguaaaacacccacggagccgaggcuggggaauccugaucaaggugucugugggcagaucccagaucccagaucccagggcaggaucccccauggagcaguuucucagagcacccaaugugugccacacacgccaggugcuguggacgcgacaagauaucaccacaccggcagcggaagcagcagccagcauuccguggguccccacgugcggcaggauggggaucaccaccgaguccucaccccaccgcccccugaggaaacugaggcacagaccugaagucccacaguuacaagaggcagagguaggcucugaaccugagucuccccaggccacguaccugauccggacaccacacugcucccaggcccugcagguggcccgaagacccacccaccagugcuguccugaaagcgccugucggcagacugcgggaggccaggcuggaccaggaacccccacagcagagaccaucggaggcuucugacccagaggcagggaguggggauggagggugggagacuggaccacagacaucuugauggcaggggagggauguggccaggcccagaugacagcgagagucuggauccagggcagccaauucuaagaccugccaggugcccuacagaugacagacauggugggaggccccccgggcgggaugcuccacacagggccuggcggcaggagcuacaugcaccugcaaccaccugcacgccagcaaaccggcacuuaggaucccgguucugcgaaaggacuuaauuucugccagauaaugacccugcacgugggccuucccagagccccuggccgccccuaaucgcauccaccgcucucagucacccaggugggcaagccauacaaggcuucccauccuccacgcacaagcuggggugcccaguggggagaacacagcccugcuggggacccagaaggggcgcugggucccagcugucuacaggguagggccgagcaggccccgcgagcgccccucuaagauccguccgacuccaccacacaccucuccaaccuccugaugccacggcguccuccccgugcugcccaggguccaggucccagacagagacaggcuccaccacaagacucagaaagugaaaccucucgugguuaaaucucggaggaaagcacuuccuccacucucacuacagcaccggcagagccgggcaggaggcucgggaggaagcuccacggagcucacagcuguggaacggagcuucccggaccaugcccgggaaaagcagacccuuucagccacaaucaucauaacugauuacauguaaacacaaaggacgugagagcaggcccggaccaaguccccacgucucccuggccugggcucgggcuugggaagucaagguuggacgaggccauccaagggcgcuuccugcucccagagucuucugggacacggcacagccacccugccaggcgccagaggccacgcuccacgccucccaacacugggccaacagaggcccggcccuucccguggggccaccgcaccccaugcuggaucccgggccuugucacugccccgugggggcuggcgcaggccggacaggaagccuccggaacuaaccauccugcuuuauuuagaaagccuggagccacuccggcucagccucgcuagcagccucaggcccugggaacaggcauucccauggaaguccccacguuuccaaccacaaaccugccacaaagaacuauacggggguccccuccacaguuuaccagugagacggaaaccuaacagccgagggcugcccgugauaggcagaagcccagcgggccuggggaaugggaacccagauccaagagcugcuggcagggccugcaagagcucuccaggccacagggcggaccccaggauggcggcggcgcggacggaggcgggagcagcgugugcacuaagugcgcaguacgugcuugccacuccuguacccauccacagcugucaccagcaucgacagaagugugcauagggacaaaccuggaauaccacggguauaaaacaauacaugcauucacauucaugcauacacugaguagugaauucacacacacacggcuuugacggugcuuagaaaaauacucuauaagcacucauggaaacuucugacaaaauaauuugcacucauuaucccucagcuuugccacgagcauuuuacguuguacgcuaccacacaguaaagggucucaaaugggggcaacgugccccccaagggacaaugggcacugucuagagacaucugugguuaucacgacuugggggagcuccuggcauggaguggguggaggccucggacacugcucagcacccugcagugcccagggcagccccaccccagagaccaacccggaccaaugugcacagggccccggggagaccuguuguacguaacggagaggcccaucugaggcgugaacagcacauuuuagccgccgcgggagaggcggcacggcagccggagccccguccagcucuagggcuccguaaggucccccccaccccgaaaacggggcacggaauguccucgccaggcugaccgaccucacaggccgugugcagccccagggaggcaguggaugagagcgagcagacgcggcguucuuccagaacaugcuccaccugguugcaaacccaggagucagggcagggcccuggagcccugcugccccagagccuggaagaaaccagcaccacccacauaaacgagacccuccugggccccagaugccacaggggugugguggcaggccccugccucccuccccgacauccacuccacaacgcuguacgggagccaugggggaggagggauggagcccccacugcuaaggggcaggggaggaaagaauucuagggagaggcagacccagcuuggcugggccuccugcggagugccaggaccuccacccagaggucucugaacauuccgugggccgcaggcgccauagccaccugcugcagcccaacagccccuuccuuccggggagccucggccccacccucuagcugcucccugaaaaacgggggcaaucgcaagcucggggcuggccuacugggagaguggaaugaguucccacaagcaggcagggagccugacagagguccccuccccugcacccugaggccccagccccuggaccucagguggucaaaguccucccagcaaggggcccuccagcugggaugcaagguugcuuggacgggaaguuuucugagggucugucgcaucagauucccaaaggggucccuggcuccaacaccuugggugugaagcccucccaacccccugacagccccggcucucugcguggcacugacaccaguccuccuugggucgcacgugagcucacaucuuccucacuguccuaucugccacgccuggcccugagccugacagcaaccucccgucuuacaggcugauaggggucaacuuucaggcucacagagugggagggggugggacugcagacacaggugcuccugcagcagacacccccgggccacaggcgggcacuggacagaggaugcgggaagggccgcaucacuuccagacuugcuccaagcagccaaggcggcagacacgggagccccugaccuucguccuugaaccccgugucaaucucaaguccaaagugcaggcacagaagaccgggugcaugcagggauggcggcggggguucuggaggucacagagccacagggcaaggccaucugguaagaucuuuaugacaccaguaauuccuaacuccccuccauccaaacaaaguccacgacccacuacaaaagccagccagugccacucugugcaaagugccaccacgcgggccgcacugcacauuuccuccaaacgugaggaccacggcucugccuacccgcggcccccuggaaagauggcccauuuuagaacccuuagguaaaucaaaacacaaguuuggggaaaaaaaucaggaaggcguuucauccaaggcaccucuguaacccgggacacggagggcccuaagaggcucacggcaggagaggcaacguguuccccacacaacaugcgaccugccuccuccccaagagccaccgccaccagcacgcccccuccuccgucaccgcugccucucacgcauuuccgaccuuccccaccgccccgcccccggcccaggagcuaaccuaggagcucgggagggcaggggcggggcagggcaagagcuucuguuuuguaaaccacugaaggggcccuuauuuggagugacaacacuuuacagcuggcccgacuggcucccugcagcaggugugccuuggggagaaggagguucaccagcaaaccuucuccaggacgguggggaggagccggcagguggggggcugcucucaacgaggacucagcguggcucccaccaggacucuaaggaagggggcgggggaggcugccgagauagcugcuugggacaacaagcaaaggcucccucaggugucaaccgccccacccucagcugagcggaacccugaggagaggaaagacugucuuuuucccacagggugcauuccagccaagaggaguacgggguuucccggaacaggaaggcaggagaauggcccugaagggaauguggggauaggggacacggaggagucuucggggggauggggggguguacagggccugcauggaggguacagggccugcauggaguguacagggcucugccuggagggaagggucaacgcggggcccugagcagugaggggugagugugcccuguggguuacagcccaaaggucuggcccugaagggguagcgagggguggguacuccggugggguaaggucagaaggucccugugcagggagggacuggucccuugagaaggaacagagggcaaauccugaagaguccuggaggcccaauguagacagcagaagcugggagcugaccuaggagugaucgggggccugauccagacaggacagacacaggcugacaccggagagucccaggugccaacaugaacaguuaaggcaggggcugaccccaaagaaaucaggggcccgcagcugaccccggagggucccaggugccgaccuagacagcaaaggcagggcugaccccagagggucccgagccgacccagacgacacaggcagggcugaucccggagggccccgccccgacccggacaggcagugaaggcacaggcagggcugacacucgagggucccgcgacccggacaggcagggaaggcacaggcagggcugaccccggagggucucgcgacccggacggcacaggcagggcugaccccggagggucccggcccgacccggacaggcagggcaggcacaggcagggcagggcccgcagccggcaggcccgggggccgcacucaccgagcagcagcagcuugagcucgcgccgggcgucgcgcuugucccgccgcagcugcuucucgaucucggcguugauccgcuuggacuccuucaccucaucgcucaggcaacacgccaucauggacuccagagucaucgucccggccccggccgacgcggccgccugcccgccgccgccccccggcccccggcccggcccuggccggagccgccucggccgccgcccgccgcggcccuccggccucggccaccggcccucggccccgggccggcccgccccgccucggccgccgccuggcgagccgccggguccccgcucgggccgcgccagccgcggacucccgcgcggccgcacucagcccgcgccgccgccgcagc

SEQ ID NO: 192180 - RNA, 49998 nt, Homo sapiens
ugcggaugugauagauacauuuuauuuccaccgagguccccugcccaucggcccccacaugcagcaggggaaggugugaagccguuggccagagagcagaugggauguacgguuccuaggcagggcugggaggcggcugcuaggaugucuguccuggcugcugauuccccugggagucuggacuucggguacaggaaggggggucaugucucaguagaccaccucauacacgguggccuucuugucccccgagccugucacgauguauuuguuauuucuggagaugucacaacucaggacugaggacgacuccuuggacugccaagggaagggagagagaaaagggcacagugaggcaugguccccacagaugggugugugggcaaggcuggggcggagucaggaacgggaggucaggacucgccuacagagugacguguuucuuuuuuugagauggaguuuuguucuugucgcccaggcugaagugcaguggugcgaucuuggcucacugcaaccuccaccucccggguucaagacacucuccugccucagccucccaaauagcugggauuauaggcgcccgcaaccacgcccggccaauguguguguguguguguguguguguguguguguguguguaauuuuuuuuuuuuuuugugagacagggucuaacucuguugcccaggcuagagugcaauggugugaucucugcucacugcaaccuccgccucccagguucaggcaauccuccugucucgaacucccaagcagcugggauugcaggugcaugccaccaugccuggcuaauuuuuguauuuuuagaagaggcaggguuucaccauguuggccagguugggcuugaacuccugaccucaggugauccgccugccuuggucucccaaaguguugagauuacacgcaugagccaccgcacccggccuaauuuuuguauuuuuaguagagacuggguuuccccauguuggccaggcuagucucaaacuccugaccucaggcgauccaccgccuaggccucccaaagugcugggauuacaagcgugagccaccgcgcccggcagagcgacuuguuuucuacagacaggugcuuuggagcuaaguccaaugggcagaacagggccuccauucccucaauaccaagagagauggaacugaagugcugcccuuucuggaagcucagagugggugugcaccaggcaugaugucacacagcacagcagagggccaaggcaauggcuuagaccagggaucagcaaacuucacaaagggccugguaaacauuuuaggcuuugccuaaagucuaaauaaguccaugucacauauucugggauuuuuuucuuacaacccuuugaaaauauaaaggguuggcacgguggcucggcgcuuccggaggccgaggcagguggaucaccugaggucaggaguuccagaccagacuggccaacguggggaauccccgucucuacuaaaaauacaaaacuuagccaggcaugguggcgggcacauguaaugccaguuacuugggaagcugugggaggagaaucgcuuuaacucaggagguggaggcugcagugagcugagauugcgccacugcacuccaggcugggcgacagagaaggacuccgugucaaaaaaacaaaaaaacacuguaccaaccaggacgggcauauuaaaaacacuguaccaaccaggacgggcauauuaaaaagacagccaauaacaaguguuggugaggaugcagagaauuuuaaaauuucaaucacugcugauggggauauaaaauuugaaaaacaggcugggugugguggcucacaccuguaaucccagcacuuugggaggccaaggcggguggaucaugaggucaggagaucaagaccauccuggcuaacacggugaaaccccgucucuacuaaaaauacaaaaaauuagccaggugugguggcggguaccuggagucccagcuacucgggaggcugaggcaggagaauggugugaacccaggaggcagagcuugcaguaagcagagauagugccgcugcacuccagccugggugacagagugagacuccaucucaaaaaaaaaaaaagaaagaaaaacagcugggcgcaguggcucacgccuguaaucccaacacuuugggaggccaagguaggcagaucaccugaggucaggaguuugagaccagccuagacaacauggugaaacccccucucuacugaaaauacaaaaauuagccaggcguggugguacaugccuguaaucccagcuacucgggaggcuguggcaggagaaucgauugaacccgggagguggagcuugcagugagccgagaucgcaacacugcacuccagccugggagacagagcaagauucugucuccaaaaaaaaagaagaaaugaguaagauggcaaauuuuauuuuuauuuauuuauuuuugaggcagagccucacucugucgcccaggcuggagugcaguggugcgaucucagcucacugcaagcuccaccuccuggguucaugccauucuccugccucagccucucgaguagcugggacuacaggcgcccaccaccacgccuggcuaauuuuuuuguauuuuuuuuaguagagacggguuuucaccauauuagccaggguggucucgaucuccugaccucgugauccgccugccucagccucccaaagugcugggauuacaggcaugagcgaccgugcccggcuggcaaauuuuaaauuuuauaauauuauaugcauguuacugcaacuaaauuuuagaaaaaccaacaggcuacgggcagaugaggcgaggccuccggcugaaauuccaaccucugcuuuaguaccugggcgguagggaggcuugcaggacccugaggagggguuaggguggcggggggaccugggggacagggacaggggcaaucucucugucugacccuggcauacccgggcacauggcccugccagagugggggcuccagaccgccgaguaccuggaaaaugcuggccccguacggcguccuccaggcguugagcagguuguccuucccggugcucacaaaccaccguccuuggggaaggagagcagcaggguucaaggagggggcacuaacgagagacccgggcugcagggggaggucggggaagcugggucugggucuggccucucccuuuuuuuuuuuuuuuuuccaagaaagggucuugcucugucacccaggcuggagugcagugguacaaucauagcucacugcagccuccaccaccuggacucaagcgcuccucccaagcagcugggaccacaggugugcaccaccacgcccagcuaauauuuuuauuuuuugccgggggcaguggcuaacacccguaauccccacuuugggagacagagguggcugggucacuugaggucaggaguuugagaccauccuggccaacauggugaaaccccuucucuacuaaaaauacaaaaaucagcugggcauuguggcaggcaccuguaacuccagcuacuugggaggcugaggcuugagaaucgcuugaacccaggacgcagagguugcagugagcugagauugcgccacugcacuccagccuggguaacgcagucagacucugucucaaaaaaaaaaaaaaauauuuuuuguagaguugggaucucacuaugcugcccagacuggucucaaacuccuggccucaagcgauccucccaccguggucuaccaaagugcugggauuacaggugugagccacugugcccagcccaaguuuuguuuguuuguuuguuugguauaagauaucccauguacuauuuaggauauacuuacacuaaugaaugauuuuuuuuuaaaaagagauagggucucacuguauugcccaggcuggagggcagugaugucaucauagcucccuacagccucaaaguccugggcucaagcaauccuccugccucagccucccucguaccuggcacuacaggugcgaccuacuggcuguuuaauuuuuuuguagagaaagucuugcuauguugcccaggcuggucuugaacuccuggucuugggcgauccuucugccuuagccucccaaguagcugaaacuacacacaucagcuacugugccuggcuuaaauuucuuuucuuucuuuuuuuuuuuuuuuuuuuuuuuaagauagaaucucacucuugucucccaggcuggaaugcaguggcaugaucuuggcucacugcgaccuccaccucccggguucaggcaauucuccugccucaaccucccaaguagcugggauuacaggcgcccaccaccacgccuggcuaauuuuuguacuuuuaauagagucaggguuucaccauguuggccaggcuugucucgaacuccugaccucaggugaucugccugccuuggccucccaaaguguugggaugacaggcgugagcuaccacacccagccuuaaauuugaaucucagauaagucaucaguaauuuuuaggacagguauaucccaaauacuucauuauuugguuuuuaguauaaguauaucccacacaccauuugggauauacuuguacuaacgauuugcuuuugaguauauaaaacuuaguauauaaauaacauuauuuguuauuuaucuaagauucagauugaauaggcacccuggguuuuguugggguuuugagggcgugccaccccgccccagaagacacaccgcaggaggcaaacuucagggacagcacgcagcucucguggaggugcagcugguauuucuccggcuugcggacgugcaggaucuccacguugcuacucuccauuccgaccgccagccaguccugguuagggcaguggcccagggagaaaaucuggggguaaagagggaagagauggggucacgagccccucuuuguuuuguguugagacagggucucacuccgucacccaggcuggagugcaguggcacaaucauggcucacugcagccuugaccuccagggcucaagagauccuccugccucagcaccagaagcugagacuacaggcaugcaccaucacgcuggauaaucuuuuuuuuuuuuugagacagagucucacugugucacccaggcuggagugcaauguugcagucucagcucacugcagccucugccucccagguucaagggauucuccugccucagccuccaaaguagcugggauuacagguaccugcuaguacgcccggguaauuuuuguauuuuuaguaaagacggcguuucaccguauuggccaggcuggucucaaacugccaaccucaagugaucugcccgccucggccucccaaagugcugggacuacaggugugagccaccaugucagccuacgagccccuuuggauauuggggggugcccagcaccaucagggguugcggggguggaguccaacauucucccucuucagcaccccccuagagaaaggcagcuggcccaggacugggaacacagcagacaacugcaugucgaaucauuaauauuaaucagaauuacacagaacccuagggcugcacauccauuaucugcucugagcgcacaacagcacagggaggagggagagaggagggaggagggacagagaagggaacagccaggcaaggacaaucacuccccuuaagcagaugauggaagcugaggcaguguccccucaaggucacagagcaagacuaugaaagaccaggccuuggccgggcucuguggcucaggccuguaaucccaacacugugggaggccgaggcgggcggaucaucugaggucagaaguucaugaccagccuggccaacauggcgaaaacccaucucuacuaaaaaugcaaaaauuagcugggcguggcugcaggcaccuguaaucccagcuacucgggaggcugaggcaggagaaucgcuugaacuugggagguggagguugcagugaccugagauugcaccacugcacuccagccugggugacagagcaagacucugucucagaaacaaaaaacaaaaaaaauaagacagaccaggccuaggagacagaacuucucacucuuagcuuggaauguuccuuuuugagacagacagggucuugcucugucgcccaggcuggagugcaguggugcaaucaugacccacugcagccucaaccuccucccaugcucaagugauccucccgccucagccucacaaguagcuuggauuacaagcaugugccaccacaccuggcuaauuuuguauuuuugguagagauggaguuucuccauguuggucaggcuggucucgaacuccugaccucaagugauccacccaccucggccucccaaagugcugagauuacaggcgugagccacugcacccggccucgguuugauuuuuaaaagauucaggguccuccaccucauuuuaagcacaaacaggaaucaggcucuguuccaccccaaaccucuuggagucucacuaacaagaugccuguggaaauaaccacacauuugcagaagagaagacuggagggcuucaaauguccucuccuggccauacagaaguguuucuguguaaagacgcauugggggacacccagugagcuaggagauauucaccaugggaucccuagaaauguucuuagcccaccuaagcuucggggccacgggauggagagcuguguccaccugcacuccugaaagagaagagcagguuggacauaaagagcuugggagggcaagcgcgguggcucaggccuguaauucccacacugggaagccgaggcagguggaucacuugaggccaggaauccaagaccaaccuggacaacacagugaaacccugucucuaccgacaaauacaaaaauuagccgagcaugguggugcguuccuguagucccagcuacucagguggcugaggcacaagaaucauuugaaccugggaggcgcagguugcagggagcugagaucacaacacagcaacucugucucaaaaaaaaaaaaaaaaaaagaggagcuucggaguuaggaguuagcuccucuuagguuucaaggaggaggggcaaaugagaugggucuugagggaugaauaggaguuugccaauuacagaaagaagagaaaggcauuucagccacagggaacaaaugugcagaggccucagagcugucccggaguauggugugcaugagaccagcccauggaaacccugaaugacagaagaaggagcucacagcugcccccaaagcagugagaggcaggaucuggggucacggugccugaagauucacucucuuugcccagcccugaggagcccccagcucuguccagccuguucaccauguccuucagcuuagacuccaccuucaauggggaucucuccaugcccagcuccuccuacaucaaccuccacucuguccuccuggccaguagcucccccaugguuaguccucaguugggaagugugugucccgcgcucucggcggcguccagagauuaaaggcuagaagaaccacccagcuacacgaggaaaggcacauauaaggguauggcuggacaaaagcagguggggaagaugaucugggggucucaguagccccacagcuuccuaugaaucagcucuuuuguguuccccuacaucuuuagagaguuacaggggaagccuguggaugugucugggggacaagaaagauggacaccacagcagaugggaguccuguccuguccugccucuggaagugggcaccucacaaggagaggaagggaugcuguauuccuagagcuuccaucccccuccugccagaaccgaacagcaccugggagcugaagucaugcugcugcagcuggcggcccucccgcaggucccagcagcgcaccguguuguccaggcccccuguccagagccgagugccguaaucggaaauaucaaugcagcuggcgccguccguguggcccuggaacugccuggagggagaagggcccaggcguccauccuggaauucgagcugccccagcaucgucccaggucacacuccuccacucccccugcaccgagagcggccgggggcuugcccaaggucccagcgcaccugccacccaccugaccauagucugauucugcaggucccagaccacaauguugccaucgcugcagcaggagaagcaaaccuuggcgucggggcugacggccagggcguagcaggcuggggcugaggaagucagcucggccuugauacggggggugggcgccgccaggucccaaauggacaaggugcuggccucaccgcccacgaucagacuccggccauccggcagcaacuugcaggaacgaauguaguugucucgguucuggggucggggagagaagcaggggcuggggguuggucccaggugaggucucuaggagccuagcucaacgugggggucucuggagcccaauguagccucauccugauuagccugcaagcccuacccugauuggcuggugagccccgccccuuugaccugcaaacacugccccaucugacuauaagcuccauccuuuaccuauaagccccacccaugguuggccugcaaacccuguccugauugucuugcaaguccaauucagauuggccagagccccaccccuuuggccugcaagccuugucccaugcgacuacgagcuccgccccucaccuauaagccccgcccuucaccuguagccccacccacggccagccugcgaacaccgccccauuggaacauaagccccaccccucaccugugagucccgcccacugucccaccccgcccucaccaggcagucgagcugggccacgggcgucuuggccccaggcuggcccacgucccacaccuucacacagcccuugccgcccguguacacaugcuguguggagccgcugauggugaccgcgcagaccaccucgccaugggccagcgugugcagcugccgggcgugccgcgggaugcccgcgccuaccagugcauccgaggggaagggaaccggcugcaucugcccguccgcagacacguggaaggaguaggcccuggagagaaagccggggcaugacccagcccugggcaccacgcccccgcacccgcaccugggagggcagggagacgccuuuguccugccuggcacccucugauguguuuuuuauuuuuuguuuuguuuuuugagagggagucucgccgugucgcccaggcuggagugcaguggcccgaucucagcucacugcaaccucugccuccuggguucaagcgauucucuugccucaaccucccgaguagcugggauuacaggcaugcgccaccaugccuggcuaaguuuuuuguauuuuuaauagagacaggguuucaccauguuggccaggcugguuuugaacuccuaaccucaagugaucugcccgccucggccucccgaagugcuagaauuacaggcgugagccaccaugcccagccugaugcguuuguuucuuuuuugagauggagucucgcucugucacccaggcuggagggcaguagcgugaucuggacucacugcaaacucugcuuccgggguucaagugauucuccugccucagccucccaaggagcugggauuacaggugcaggccaccacgccuggcuaauuuuuuuguauuuuuaguagagaugggcuuucaccauguugcucaggcuggucucaaacuccugacuucaaaugauccucccaccucggccucccaaaaugcugggauuacaggcaugagccaccgggcccagccucugaugcauuuuuuaaaguaauuuucucuguuauuauuuuguagagaugaggucuugcuauguugcccaggcuggccucaaacuccugguuucaagugauccucccgccuuggccucccaaagcacugggauuacaggagugagccauggugcucggccucugauuuaggaaaaaggcaggacaauguggucaaaggugauaugggacagucaguggguggcacaaauacacagggagucuagguugugguguggcgcaugguaaacaagcacuuaauaaauguucguucaaccgaggacccacaaagaaaccuugaguguuccagaccagcuagagggucuguccuaggagccccggccaccugugaccaguuaaaacacuuaaaugaacugaaauuaaauaaacauuuucaggccggcacaguggcucacaccuggaaucccagcacuucgagaggccaagguggguggaucauuugaggucaggaguucaaaaccagccuggccaacauggugaaacccugucucuacuaaaaauacaaaaauuagccggcggugguccgugccuguaaucccagcuacucaggaggcuggagcaggagaaucgcuugaacccaggagguggagguugcagugagcucagaucucaccaccguacuccagccugggggacagagcgaaacucagucucagaaaacaaaacaaaacaaaacaaaacuuuucagcuccucaguugcacugaccacauuucaaguacugaaagccacgcccagcugguggcgacuggguuggccagcagugggucuagaacacuuccaucacugcagaaagcucuguggacacuguggccagaucuccucugguggagccauccuggacaaugcaggaugcuaagcagcaucccuggccuccacacuccaggccaggaacgucuccucccccagcugugacaaccacacgugucccccgacaucgcccaguguccccuggggggucagagucuacuucuauggagagccaguggaacucugaguagcuuaugcaagagacuuuuuuucuuuuuucuuuuuuuuuuuuugagacugagucucgcucuauugcccaggcuggagugcaauggcacggucucagcucacugcaaccuccaccucccagguucaagugauucuccugccucagccucccgaguagcugggauuacaggugcccgccaccacguccggcuaauuuuuguauuuuuagcagagacaugguuuugccauguuggccaggcuggucuuaaauuccugaccuaaagugauccaccugccucagccuuccaaagugcugggauuacaggagugaaccacugugcccggcccacacaagagacuuucuagaagggaagcagggagaccccaaccacagaggguaagaccucagaggagguggggggcuggcccgggaccccaggcagggagccccacccugguacucacggcuuucccccagggaugcuggguagggaggaagagacggaugacccucggagauggggaugagacucaaaugccaucugugagaaugccaggggggugucagugaggcaggugacuccaacccaccucugugccaccccacgcccaccugccauaccccucucuguuuaucaccccuccccaaggcagcagagaugccuucucucugccugucacacuacagaugagagggcugagguuuucacuugagcacaccgacaccaaaaucucuauccaggaaauccuagaacuccacgguuccaaggauccugaaggguucuccauccaaugcccagacuggcucuaggccaggguucugaaaacuccagccccucccaggacaaaucugguccacugccuguuuuuguaaacagugucccgaggccaaggcccuacugcuccucuucaugcagcuuaaucgcuguugcguuuuuccacaaucagaagucuugcuuuguauuaagcuugugggacuacugagacccccagauugucuucccaugcauacuugcugagccagggcucccuucccuuucugcacucccuugucucuccuuguguaguugguuucuccucccggcccccagccccugggcccugcugacaccuccugcgcccccacccaaggacucaccacgggggagcguccguacaccacagagcugcugaccuggggggacagguggaggcugacguaggagcugggcacggagaggucuccguugagagugcugugggagcccaggcugaaggacguggugaagggacuggacagagucagggggcuccucagggcugagacggaagagucggggacagguuuugacgcccuggacccagaucccgccucccacugccuugggagcucccuggccuuucauuuagaguuuccaugugcugguuccacauuggccauagccugggacaccuccagaccucugcacuaucguuccuccaguggacacgacuuucucucucucuuuuuuucuuuuguuugagauggaaucuugcucugucgccaggcuggaguucaguggcgcgaucucggcucacugaaaccucugccuccuggguucaagcaauucugcugccucagccuccugaguagcugggacuauggccauucuccuucuuuuaauuggcaaacuccuauccauccuucaaaacccaggcccaccgagcacaguggcucacgccuguaaucccagcacuuugggaggccgaggugggcggaucaccugaggucaggaguucaagaccagccugaccaacauggugaaaccuggucucuacuaaaaauacaaaaauuagcugggcaugguggugcaugcccguaauuccagcuacucaggaggcuggggcaggagaauugcuugaaccugggagcgggagguugcagugagcugagauggugccauugcacuccagccuguguaacaagagugaaacuccgucucaaaaaaaaaggaaaaaaaaaaacaaaacccaggcccaauguccauuaacaucucagaaacauccuugagccuccccauugccaaccuccagcccugcccaucuuggguaccugccuugguaccagcccugacuauacagggcugugaguuuuggggucuggguccugucccuuuuugccaccugggaguuccuugagggcagauuccaaggccagcuucuuucaggggccccagaaccagcccagggccugaccauaaggcagaaaagaugagcacugucauuccucagauuacugauggggaaacugaggcucagagagguugggucacuugcccgaggucacccagcuggugaaugcccaagccuggucugaaacccaagucugucuggccccaaagauugucuuuccagugcacuaggcugaaacccccgacuaagccgcuuccacucuccaggccucaguuucccuacccgccgagcugacacaaugaggaacugcccagagggaggcagcgucuaacuugaagucacaaaaaggaccaaggcaaugaacaccaagccuggaaucccagcauucugccucuccagccccuuuuccuagaucuccccagagacgaggccugcuccagacaggcaccaacaggcaaggugcucaccgacgcuguccguggaaggugcuggcuuggcagcaagcuggcagaggugacuggccgagcugggcccggggguggaagcguccuggggcggggaggagucacaggauuuggaggcaggagugcuggcgggaaggucauucugcagagaaagggcaggacugaaggccaccaggcaccuggugucuuguggcccaacgaucugaucagaaacugggguugggggcggccagucgcagugucucacaccuguaaucccagcacuuugggaggcccagucgggcggaucaccugaggucaggaguucgagaccagccuggccaacaugguaaaaccccaucucuacuaaaaauacaaaaaaagauuagccgggcgugguggcaugugccugugaucccagcuacuugggaggcugaggcaggagaauggcaugaacccgggagacggagcuugcagugagccgagaucacgccacugcacuccagccugggagacagagcgacuccaucucaaaaaaaaaaaaaaagacucugucucaaaacaacaacaggccaggcgcaguggcucacgccuguaaucccaccacuuugggaggccgaggccgguggaucacuugaggucaggaguuugaggccagccuggcgaacauggugaaaaccccaucucuacuaaaaauacaaaauuagcuggacgugguggcgcaugccuguaauuccagcuacuugggaggcuaaggcaggagaauugcuugaacccgggaggcagagguugcagugagccgagaucacgccauugcacucuagccugggcaacaaaagcaaaacucuacaaaaacaaaaaacaaaacaaaaaaaaggcaacaaaguuacaaaguuauaggcugucaagauuugcaauucuuuuuuuuuuuaauacagggucuugcucucaaaacuaacaugaucagacaggcgcuguggcucacgccuguaaucccagcacuuuaggaggccaaggugggcggaucaccugagaucaggagaucuagaccauccuggcuaacacagugaaaccucgucucuacuaaaaauacaaaaaauuagccaggcgugguggcacgugccuguagucccagcuacccacuacccgggaggcugaggcaggagaaucucuugaaccugggaggcagugguugcagugagccaagauugcgccaccacacuccucccugggugacagagcgagacuccaucuccaaaacgaaaaacaaacaaaaggcacgaucauagcucacugcagccucaaccucccaugcucgagugauccucccgacugagccucccaaguagcuggcacuacaggcacacgacuccaugcccggcuaacuuuuuaaauuuuucauagagacaaggucucacuauguugcccaggcuggucuccaacuccuguucucgagugaucguccugccuuggccucccaaagcccugggaugacagggaugagccacagcacccagccacuguugagauucuugaacaacaaggaauuagaaacuccgggaugggcucguggagaggcagaccccacagcggcauauucccaggugaaggaagagugccuagcacacacugcaauccuccuugagcccccacagagagggaggugucacccagagcugucccuccccaaggagagcucugaggaaagcagcagcuggaccuccaucuaggggcaggcucuguuaucucggcuucaugucaucgccuccccugccuccccugccucccaagaaacuucgcauccuugucuugcgucugucucggcuucccaugacaccaucgcacaaacagugacagccacgcaacaccggcacccgcgagagaguggaugggacgacuguggggucagggaggaccccugagggcuucuccaauacaacggagcugacccauccccuuguaagguuuuucccgcagugggaggugggcacuuaagauggaaugggagccccaaccucuggcgguugccaugguaaccugccaggaagggaggccuugaaaccgggaggggaggccuagaaaccgacauacucuucccugguaaguguaggggaggggucuggagaagauuuggggugaggggagcugcaaaaggagcugaauuucuaaugcccugggggugcuuuuagauggcucacaugccuggcauuaaacuccaggagguccaacugaaaacuuguuccuauauuaauuaucuuuccuuccggggacaacaucucagcuuggggccggugugucucuaagcgccucuggaagggcucaacacaugcaggccugaguccagccuagcuggcugggcuuucacuauguuuauuuccaugggauuuccuauugauugcaagagagagaccugcuuuccauguaagguagugaauugccuuuuaaaauuuaucuacaaagcuucuuuacaaaguugccuuuuaauauuuacugagguucaacaaagucaguccaagcaggagguuuaaaaaaaaaagcacagggaaaggguggacaaugccagcccggcuggcugauuucucaucacugcccucugcaucaugggguagcgucugcuucggggcccccgggaugaauaaagugaguuucaaggcccuccccuccuccuuaccaggaugagcuccuuggcucuaggcagcggugagccaaggcuagaggccaaggaggcuggacuguccaccaggucccgacgggcaggaaugcagauggguaccuuuccgcagggggugguagccgggcuggggggcucugaggguugguccuggguuugaggaggugacguugagcagaguugaaaugagagggaaagaagagucccuucucuauccuccucccgacucccaccccaaucucuagaauggguacccaugacccaccaugggaagauuaugaaaucuucugcugccucaguuuacucaucuguaaaauguauuuuuuuuuuuuuugagucucgcuccguuacccaggcuggaguaauggcccacugcaaccuccgccuccuggguucaagcgagcacauccagcuaauuuuuuuguauuuuuaguagagacaagguuucaccauguuggucaggcuggucucaaacuccugaccucaagugauccauucgccucagccucccaaagugcugggaucacaggugugagccaccacgcccggccuguaaaauggguuuaaugauaggcucuacuccauaagcacccauagcgaggacuauauaaaggcuugguuuuauuuucccauugaacagauggggaaaagugaggccagggaagggggugucacugcccacaaaucacucagugaaccugggcuugaagucacucccugugcaguggagaggaggucggccagaggugucccggagucccugacgcuuccugaccccaucccagcugucccacagagcggggaaccaggauccccacuaccucuggguccucccaguccagaaaacccaccccuugcucugugcccagagucggggaagaggcuggaccccuggacucaccucguccaccaccagauuguaaucacucuugucuucgucgcuuuccugggggaagaugggggagagagcucauuguggucaugccccugccuccacacccccuauccgcuccucaggaguuggaggcaugagcccagccagcccuggggcaugacugggauucucagaccacugcacccguuugcucauagcagaagggaaggcugcacgugcccgcauccgggaaggauguggggaggcagggcaggugggcaccuuguggagaggacuuugaaggauguggacuacaugagugcccugugugacucccggcccucucaggccucaguuuaccccucugcauggugaggggagagccagagaccagcaaucauccuuaccgccuucauaaagacuccgccuuaauaaauaaauaaauaaaauucauugccaaagaaaauaagacuccaccuuaauaaauaaauaaauaaauaaauaaaauucauugccaaaaaaaaaaaaaaaaagcuauuagguaaaaaggaagauuuaaggcuucucugagaaacagcaauauuggcccacccugagccugccagucuccggggaucaaguugcagcugccccuguaggugggagaaggggcuccccagcuggccacagccccauuccccacauucggccuggccccugggaugcuagaguuggaaacuacaagugugcagccgucuggcaaugagaggaggucccagccucuaggagguggucagggaaggcuucuuguaggagguggcacuuuguuucuugauagaaaaauggguuucuaaaacauguguguucuagggaaagaaaacagcuggagcaaaagcuagagggugggaaaauggcuguacggccaagaggccgcagagacuucaagcaacuggaguuaagccuugcauuacaggaucuccucugauuggucaguacucugaguaguagggagcuaugggaggcuccggagugagagaauuauggccagagcugggcucuggaaggcucugaggggccaggcuggucugggccaugcacgcccaucccaguccugcaccugcccccacucacauaagguccugauggcuccuucucaucugcucucugcuucccgccaccaccagggccacucggucgcuccuccuccacgagacucucagggggcgagggagaugcacucugcggagagacaaaggccggggggagaaagggucagggcccugggcuccuagauugcauugugauccagccgagacugagggucccccaccauuauuaggguccggaccucaagcuucccaucugggaaaugggagcuuccaacggcugacucagugcuaagguuuuguucucucuucuguuuuguuuuguuuuugacggagucuugcucugcugcccaggcuggagugcaguggagccaucucggcccacugagacccccgccucccggguucaagcgauccuccugccucagccuccccaguagcugggauuacaggcgccaccaccacgcccagcuaauuuuuguauuuuuaauagagacaggguuucgccauguuggccaggccuaucucgaacuccugaccucaggugauccaccugccucggccucccaaagugcugggauuacaggcaugagccaccgcaaccagcgccuuacuucuucugcaaccucucugacaucuauaauuauuucaaaauuaaaccauuuuggccgggcgcaguggcucacgccuauaaucccagcacuuugggaggccgaggcgggcggaucacaaggucaggagauugagaccauccuggcuaacacggugaaaccccgucucuacuaaaaauacaaaaaaaaaaaaaaaaaaaaauuagccgggcaugguggcgggcacuuguagucccagcuacuugggagacugaggcaggagaaucacuugaacccaggaggcggagcuuacagugagccgagauugcaccacugcgcuccagccugggcgacagggcaagacucagucucaaaaaaaaaaaaaaaaaauuaaaccauuuuuugaaaaacuuacugacacagcucacaugacauuucuguuggggagcacccacagauauugcugaacggcugauggcuaggcgaacggaagugaggaugggaagaaggguccaaggucaugcauucauuuauuuaauuacccgaaaaaagcuggagguugaaauuuuuuuuucuuuugagauggagucucgcucugucgcccaagcuggagugcaguggcgcaaucucggcucacugcaaccuccgccucccggguucacgccauucuucugccucagccuccagaguagcugggauuacaggcgcccaccaccacacccagcuaauuuuguauuuuuaguagagauaugguuucgccauguuggccaagcuggucucgaacuccugaccucaagugauccacccaccuuggccucccaaaguacugggguuuuaaacacuacagccuucuggguaucucccacacagaaaggcuucaggaaaccgggcuauggaucuuguuuuuuuauuguugugguugcuguuguuuguuuuuugagacagagucucauacugucgcacaggcuggagugcgguggugcaaucucggcucacugcaaccucugucucccagguccaagugauucuccugccuugaccucccgaguagcugggauuacaggcacccgccgccacguuuggcuaauuuuugaauuuuuaguagagacaggguuuugccauguuggccaggcugcuuuugaacuccuggccucaagugaucugcccaccuuggccucccaaagugcugggauuacaggcacgcaccuggccugguuuuuuuuuuucuuucuuucuuuuuuuuuuuuuuuugagacagggucuuacucugucacccagguuggagugcaguggcacgaucacagcucccuucagccuuggccuucugggcucaagugauccucccaccucaggcucccgaguagcugacacaacaggcauggaccaccacacccagccaacuuuuuguauuuuucuguagagacgggguuuugccauguugcucagcuggucucaaacuccuggccucaaaugauucuccuaccucugccuaccaaagugcugggaucaaaggcgugagccaccaugaucgaccuaggucucauucugaggcccccaucagcucagaaccagcguuggccucccaagaauauaaaaagagucccagggugccacucacuuacccugcucggggcucucuccacugacagauugggaaugggauaaagagaaagaaggagaaagaaugaggcguuuguauccacggcgccagaggguacagcccuccaguuuauaaagccccccgcccccaccaccccacucagagucucucuacccuuccaacacccuugcaagugguggauuaucccuccccugcauucagaucaaugcccagagagggauagugacuugccucaagacacacagcccauugggggugauguugaaccccagggccuugcagccgcucucauugauccccucacacuuuacgaguuggggucuugcucuguugcccaggcuggagugcaguggcccagucacaguucacugcagccucgaguucccgggcucaagugauugucccaucucagccucccgaguagcugggacuccaggggcaugccaccaugcuuggcauuuauuuauuuauuuauuuauuuaugaaugagacagagucucacucugucgcccaggcuggacuuggcucacugcaaccucugccucccagguucaagcaauucucuugccucagccucccgaguagcucagauuacaggcacccaccaccaugcccagcuaauuuuuguauuuuuaguagagacaagguuucaccacguugaccaggcuggucucaaacuccugaccucaggugaucugcccgccucggucucccagagugcugggauuacaggcgugaaccaccgugccuggcuaucuauuuuuauuuauuuauuuauuuauuuuaauuuuuuugagacagagucucacucucucacucaggcuggaguacaguggcacaaucuuggcucacugcaaccuccgccucccagguucaagcgauucuccugccucagccucccgaguagcugagauuacaggcacccgccaccacuccugccuaauuuuuuuuguauuuuuaguagagaugggguuuucccauguuggccaggcugcucucgaacuccuggccucaggugauccagccaccucggccucccaaagugcugggauuacaggcauaagccaccaugcccagccugugcuugacuaauuuuuaaauuuuucauagagauggcgucuugcuauguugcuugggcuggccucuaacucccggccucaagugauccuccugccucggccuccuaaguaccugggaauacaggugugcaccaucccacccagcaaauuuuuaaauuuuuguagagacggggucucgcucuguugcccaggcuggucaugaacuccugggcucaagcgauccucccgccucggccucccaaauuguugggauuauaggcaugagccacuucauccccucacgcugauguuugcuacccuggacugccagucguccuccccagccccgucuccccagccaaugccaccccgugcugcccacucaccucuggaccccucggccuccacgcccgcacgguccuccuugacagccgccgccagcugagccugggcagccagggcuccagacagagcaagcagccccguagcacugccgcccaccagcccggcugggcggggggugaggggcacagggggugcguggugggacagcggcuggagcugcugcugcuagaaaggaggcaggaugggccggggcggggggcggcaggagcccagcgguccccagcccaagagguagacacaggggaugggaccuaagcacagcaugugccccugggguucccaggaccacuggagccaaggcccacacaccaccccagcuuuaacaccuccugggugggugccagggaccugggagugggcgucuccccauggcggggcaggggcuagagagacucaccccgaugaggcuguucagcucccccacggugaccugcuuggcgcguucuacggccuggagcaccugcugcugaugcuggcggguggaagggaucagguagaggguacauugagccccugcucaugcuagcggugcccuuggggaccugaccucuccccgccacccucucaucuuugccccgguacuucccauuucucuuuuaucuuuuucccucucacucucucccuuuccuuuuggaauuuugaaauaagcacacggagaaagaaaccaaaccuaagugcagguagaauaguuacaaaucaggccgggcaugguggcucacgccuggaaucccagcgcuuuggaaggcugaggugggcagaucaccugaggccaggaguucgagaccagccuggccaacauggugaaacaccuguaaucccagcuacucaggaggcugaggcaggagaaucgcuugaacccgggagguggagguugcagugagccgagaucgugccaaugcauuccagccugggugacagagcgagacucugucucaagaaaaaauauauauauauuacaaaucacagucucuccuuuggagcaucgaagaaccaaagacaucuggggcuggauuguucucuggggcggggcuguuccaggcacuacaaggagccgagcagcaucccuggccuccacccacuccaugccaggggcacccccaguugugacaaccacagacgucuccuggugguaaaacuacccccaagaaaaaaaaaacacugugauaaaucggcaccauggacccuucuccuagguuaaggaacagaaaguaccagacuccaggggcccccuacacucccugccaucagaacacccucccuccuccaccuucaugacaauaauuucuuuguuuuucuguauaauucugccuccuacgaucgccuuccuaaaccugcguggauuuguccguuuucaacuacguugugggcucauucucugaguucucuuuggcaucuggccucucagcauaacauuuuaagcuucuuccaugaugugguggguggcggcagcauauucagcuuucagagcugugggacucugcugcgagaaaauguuauaucugagccgggcgcggcggcucaugccuguaaucacagcacuuugggaggccaaggcagguggaucacuugaggucaggaguucaagaccagccuggccaacauggugaaacccuaucucuacuaaaaauacaaaaaaaauuagccagacguggcggcgggugccuauaauaccagcuacucgugaggcugacacaggagaaucacuugaacccaagaggcacagguugcagugagccaagauugcaccacugcacuccagccugggagacagagugagacccagucucaaaaaaaaaaaaaaaaaaaaaaaaaaggggggggggugcugagcguggugacucacaccuguaaucccagcacuuugggaggcugaggcagguggaucacgagaucaggaguucgagaccaaccugaccaagauggugaaaccccaucucuacuaaaaauacaaaaauuagucaggcaugguggcaugcaccuguaaucccagcuacucgggaggcuggggcaggagaaacacuugaacccgggaguuagagauugcagugagccaagaucgugccaugcacucccgccugggugacagagcgagacucagucucaaaaaaaaaagaaagaaagaaaauguuguauuuuugcuguuccacacagaagccacuggccauguguguggccaccaggcauuugacauguggcuggugcaacugaugaauagaaugauuaauuuuauuaaauuuaagugaauacaaguuuaaauauaaaauaaauuuaauaggcuuauuuuuauuuuuacuuuuuugagacguagucucacucuguugcccaggcuggagugcaauggcaugcucuuggcucacugcaaccuccgccucccagguucaaacaauucuccugccucagccucccaaguaggugagauuacaggugcgcaccaccacacccaacuaauuuucauacuuuuaguagagacgggguuucaccauguugaccaggcuggucuugaacuccugaucucaagugauuugccccccucagccucccaaagugcugguauuacaggugugagccacugcgcccagccuaaauauaaauuuaaauauaaaauuaacuuaauagauuucaggucgggcgcaguggcucaugccuguaaucccaguacuuuaggaugcuggagugggaggauuacgcuaguccaggaguuugagaccagccugggcaacauggugagacucccucucuguuacauuauacauauauacuuauuuaagccggagucucacucugucgcacaggcuggaaugcaguggcgugaucucgguucacgcuaaccuccgccucccagguucaagcaauucuccugccucagccucccgaguagcugggauuacaggcaccugccaccacacccagcuaauuuuuguaaaaaaaaauuuuuuuaggccaggugcgguggcucacgcguguaaucccagcauuuugggaggccgagccagauggaucaccugaggucaguaguucaagaccagccuggccaacauggugaaaccacccccccaccccaucuacaaaaauacaaaaacuagccggcaugauggugggugccuguaaucccaacuacucgggaggcugagguggaagaaucgcuugaacccaggaggcagagauugcagugagcugagaucgugccauugcacuccagcccgggcgacagagcaagacucugucucaaaaaaaaaaaaaauuuuuuuaaggaaaaaaauaauagauuuaaauauuauuaauaguuaaccuaaguguaaaugaucacacggggcuggugacugccguguaggauagcggaacaguaguauauuccacuguaugcacucugaggcugcuuguguauacacgcuccugaagacagacaucugggcugucuccaccaaggagguaucaggaugcggauacagagcucccaugggggugcaccuguguguggguguguguaggauggguuggaagacuuucuagaaagggccagagagugaaaacauuuucccucugcaggccagaggucucuguugcaacuaccaaacucugucacuguaaugggaaagcugcuggaaaugauauguacaugagugggcguggcuaugucaauaaaacuuuauuugcaaaaacaaguggagggguggagcuggcccucgagcugcaguuugcuaauuccuggaaaugugugccuuacucauuccuuucaacagucauuuuaccuaaucuuuuuuuuuuuuuuuugagacagaaucucgcuguguugcccaggcuggagugcaauggugcgaacucggcucacugcaaccuccaccccccggguucaagcaauucuccugccucagccucccgaguagcugggacuagcccagcuaauuuuuguauuuuuaguagaaaugagguuucaccauacuggccaggugggucucaaacuccugaccucaugacccgcacgccuuggccucccaaagugcugggauuacaggcgugagccacugggcucggccuaccuaaacuucuugcggcucuugccuuucucuagaccaccucguccccacuuuccgcugcagaugcucuuuauguucugugucuacacaggaccucuccccaccccaagcuuccagaaaucucagacucaguggaaucugaacaaacugagcaucuccccucuggguuugguccucaaggcaucaaggauccucccaguguauccacucugaaguagaacuaucuuucacgucucucugaagagagaacguaccacacagaaacagggacagugcaggcuggguacaguggcucacaccuguaaacccaacacucggagccugacacgggcggauugcuugaguccggggguucgagaccagcccgggcaacauagggagacccgucucuacuaaaaauacaaaaauuagccgggcgugguggugcacgccuguaaucccagcuacucaggaggcugaggcaugagaaucgcuugcacccaggagguggagguugcagucagccaagaucaugccacugcacuccagccuggguaacagagcaagaauccaucacacacacacacacacacaaaagaaaagaaaaagaaaaaagaaacagggacugugcaaagguacugaggaugaaaggaaccuggggcacucucagaagagcuaacuuuuuuuuuuuuuuuuuuugagauggagucuaacucucucacccaggcuggagugcagcggcgcaaucucugcucacugcaacccccgccuccugaguucaagcaauucuauucuccugccucagccucccgaguagcugggauuacaggcaaacaccaccaugcccggcuaauuuuuuuuuuuaaguuuuagcagagacaggguuucaccauguuggacaggcuggucucgaacuccugaccucuggugauccaccugccucagccucccaaaaugcugggauuacaggcaggagccaccgcaccuggccgaauuacaguccauuuuaaccauuuguaagugcacagcucagcagcauaaagcacacacacgguugugcagccauccccagcaccaucuccagaauuuucccaucuucccaaacugaauuucuguccccauaaaacucucacuccccguccccuccccaaccccuggcaccccccauucugcuuucugucucagugaaccugacgacccugggaccuccuaggaguggaucacccaguguuugucccucagugacuucuucuagcaagacgguaggguuaacuuucaucaggugcugaguaagcguacccaucaucuccagcacccuggguguaugagcucaucucaacuucacaccuacgcuacugaaaaaacagagacaaguguccugccugaggccacacagccaggauucagacccaggcagccaacuugcagggcuugagggggucagcucuaugccuugcuucccaucaagggggaaaacagcccccaguccucacccucagccaacaccucccuccaucccugcagccccugccccagcgggaugccuggccucagggcugcgggacuacugcagugaaaauggucucuauccgugcugcaggcuacgcggcagaaucagugccuggggcguccucgcccagaccuacccccucccgucuucuuccggcucccuuccccuccuccccccacccccaggcccacucaccuccugggucaggaaggggauaaucugagcgcagauaccgcucagacgcuucacaaucuccgccuggcaggaagcaaugagaggaagcuuggagcgggguagagauuugcaacccagcucuggacucccaggcggaccagguguuggcaaagccgaaggguuggggaggugacgcccgcaggugcacagagggaacucaggcuagcauggcaugggccgaggugggauucagagccccaccaggcugcgugcucagcugagcgaggcccaggguggccuggagcugggaagaccagggcugagguccuacgagucacagauacaccacccgccagacgcacacccgccagggauuugcaggaggcagacgcucagacacccaacucagacgcagacacucagaggugcugggcucagcugaaacaaaggaaaggggccuccgccuggagucccagauuccagccccggcuuggcccacgucugucccaggcaaggccccuuucuuggucuccuccgcuucccaggacugaucuaccagcuggggaugccuccagguggagaucucagcacgccacacucaagggaaggauuucaucuggagagggucugggcccaggugccccaaagaggcugagcagacgagaaggcguguggguggggaagggggcgggcauacaauggccacggacuuugccucugccugaguuacaggugugcugugugucuggcgaagucugugucuccuauucccaccaggaggguggaacugggaucccagggugucccgcaccccauaaaggggggucuauugcguggacccaugggaccacgccaugcuucagcagacaagcccccuccugcccacaucagaaccaacagaacccccacacaugcaggaaagcaugccagggugggcaaccccaggcaccccacacucccagcccacccccuucuccuucccagccaccgggaagucccaauacaagguucugcucauugauucuaauauucugauagaaucuaggagcccaugaagcucagaaguuugggaccccucucaucccuuuagaaaccacuggccagucucaggaucucaggauuaagcauggaccacuaaagucaauuuuagaaucuuugggucuauuggccgggcaagguggcucacuccuguaaucccagcacuuugggaggccgaggcagguggaucaccugaggucaggaguucaagaccagccuggccaacauggagaaaccccgucucuacuaaaaauacaaaauauuagccaggcaugguagcaggcgccuguaaucccagcuccucgggaggcugaggcaggagaggcgcuugcacucaggaggcagagguugcagugagccaagaucaggucauugcacuccagccugggcaacaagagugaaacuuugucucaaaauuuaaaaaaaaaaaaaaaaaaaaaaaaucuuuaggucuaucucagaaccuugagaucagaaguucgggaauagccucagaaccuuuuaacacaucucagcacauagauaugauaaucgcagaacccugaggucuaucucugaacccugaggucaaucucagaacccugaggucuaucucugaacccugucuaucucagaacccugaggucuaucucugaacccugaugucuaucucagaacccugaggucuaucucugaaccuugagaucacaaguucaggaacaccucagaaccuuuuaacacaucucaguacacagauaggacaaucucagaacccugagguuuaucucugacccuugaggucuaucucugaacccugaggucuaucucagaaccuugaggucuaucucagaacucugaggucuaucucugacccuugaggucuaucucugaacccugaggucuaucucaggaccuugaggucuaucucagaacccugaggucaauuucagaaauuugaggucuaucucagaacccugaggucaaucucagagcccugaggucuaucucagaaccuugaggucuaucucagaaaacugaggucaaucucagaaccgugaggucuaucucagaacacugaggucaaucucagaacccugaggucuaucucugaaccuugaggucaaucucagaacccugaggucuauuucagaacccugaagucugucucagaaccuuggaucacacugagaagcuccagaagaggcucagagccuuacgacacuggagucaaucucaaagcccugaagacagccacagaguuuugaggucuauuuuggaguaguggggucacagucugaaccauggcaucaaauucagggccuggagaacaaucuuggaaccuuccagccaaucacacugagaccaaucucagaagcuucaaagcagcaacagaaccugggguccaucucaaaacuucagacuuucuggguugaaagggaccucuaagaguggccauccagcucccuccuaggacagaagucacuuccacagccucccuggccuggcugcccugccucugcuaugugcccuccuugauggggaugccugguggccccugcccacugccugcaucucugcuggacgcuccaacugcuagauacugucuucagaaggugggacucauuuuccuuccacgaggcugaaaucugucuuccuggucccagaugggcccucugugaccucugcggagauuucaggaugagacccguguucccuaggucugcucuggccccggcugcccacucuggguccuucucagggcuuccagacccccacccucccuccugaacacgcguaaccccaacccaguuaccugcuuaugcauuucaauguugagcccguacgacaucucauaauacugcaaaggaaaaaccaaguaagaacgucuaggguggagaugggugcccuccuccagauaggugaugccagggucuuccaagaguccccagguucaggggaaucacagcaggaagcagagccccccccagcuccacggggucccagaggaggaagcgggggcucugccuggaagggcccccucuacucuccccagagaggcagggcagguaggaaguguccagaggcccuggcccgacagagacucccaucaggcgagggguccucccugucuccccauucccagagcugggaggacccuccuagagagccugaaaucccaaccugcccaauguacagacggggaagacgagguucggaguggggcagggaccuaccccagaguccaccgugacucaaagcccugcccgccucuccccucacccuggcaucauaagugcccucaccaugacauaaugucgcugcauuuccgucuucucgcuggccagcuucucacauucuagcuugaggcugagaagaagagagagggcaaggggcucccacccgccccaugugggccggcuuccaaagugagaggcuggaucucccccucccgacuuccuuacagaccuccccccaccuccugucccagucccuccccgccccuuccugggcuccaaaugccccagcucugacuguccccagaccccucugcaccugcgcuuccaccuggaggccuuugucgcgcccccccuccaaccgggagccccuccuccccgcccuauaccccggaggccucgccccgccccggcgcccaggugaacucccgcggccccuggggcggccccccucaccugugguauugagccugaagaaacuggaauucuucuuugaugcggucgcagaucuccaagaucgagaacuugaagggcuggccggacuggagcggggucuggggggggugugggggaaacgucagggucugaguucccggacacugggggcccccuccccgcaguccgcacucaccgggugccuucccuggggguacauccugccgauccgaaaagccccccaggcgccaccagagcuugaugauauggaggcggcaagagugggggaggcugaaguggggugguggggaggcugcccgaagaaagagggaggagggagaagcggcgcggggcaagggacccuggagucccuggcgcgcccccaagcgcgcgcgcccggggucgugggagccccuccccggguuggggugcgcggggcgagcggggcgggcaggggcagcggccggggcgggagcgcggcgagggcggccgcggcagccggcgcagaaggucgggcgcgccgcggccggguuucgguggcggcggcgcgggcggcgggccccgcgcggagccgccucccuccggcggggcucggccgggagccgcgggcugagccgccuuaagguggcgccgccgcccccacgcgcccgcggcccgccccgcgcccacccccgcgcaccgccccuccccgcgcccgcgccccccccggcccccgggcacccgcccccuuccuucagucccugggccguuggggaaacugaggccggguggggaggcgcccagugccuuaaaacaggguccccacccccucccggaggggcgggagaagaaaaaccagugaagaaauucacaccguguuacccaccgugggagcgggggggggggcuugcggggagcggggaccagucuggagucggaaauggcuuuucugagcaagugacauuggguugagauugaagggucagcaggacgcagccuugccaagcgcuggcagggaacccugccagaaagggaaucucacagcaaacacugcuucccagaucaugccgggcccucgcccucugggggccucaguagucucugcaaaaggucagggguggugcgcuaucuuuaggguuuaauuuuuugcagagauagggucucccuguguugcccaggcuggaguacaguggggcaaucauggcucacugcagccucgaacuccugggcucaagcgauccuucccccucagcuucuccaguagcugggacuacaggugugcaccaccacgcccagcuaauuuuuuaauuuuuugcagagauggaguaggggggcgucucacuauguugcccaggcuggucuugaacuccuggacucaagccucucucuucggccuuccaaagugcugggauuacgggcgggagccaccgcacugggcacugcacuuaaaugagauagugcaugaacgcugucagccucucccuacacagagcaaacuuccacagaugggaauuguguuccuacugccaucaccaguggacugggcugucuccccucucagacuggguuucuugaaggcaggagccgugucccacucagaacuggaagaaccacagcucugccaucagacucaagucucucccacggcaaaggcuccagccccgaccagagaccacagacauccagccagcauccuucaggcccacccggggagugggaaguucuuauucucuuuggagaaaccucaggagagguuugugaagucaaucaacaaacguguacuaaaugcauacuguggaccacacacugcuguagacacuggggcacagcugggaacaaaacagagaaaaauccaugccccuugaugacacuuggacuuguguccuuaggugaucgaguaccuaaugguaccuaaggguuaggguuacaaaaacccauuuuguacccuuacaaaagggcacaagagcccuuaucaaugggccagggguggugggucaugccuguagcuccagcacuuugggaagcugaggagggaggaucgcuugagcccaggaguucaagaccaguguggacaacaccgcgacaauacaaaaaaacauuuuuguguuuuuuguaucucuacaaaaaauacaaaaauaauuagccaggcauggugaugcacaccuguggucccggcuacuuggggggcugaggcgggagauaccugagccccagaaggucaaggcugcacugaguugagaucacaucacugcacuccagccugggugacagagcaggaccuugucucaaaaaaaaaaaaaaaaagcccuuaucaaauuuaaagccaucguuuuccagcccacagauauuuacagagcaccuaugacgugucaggcauccuuccaggcacagggauuguaaggguggauaagggagacagaucccugcccucucugaguuugugggaugugagugacaggcuaggcagguucacagcuugguaauuaugggacuauuuguacagacagaggaagaguuuagagggcagugauagagaugaacaaaagcaaaccugcuuauguggggugucugggagaggacccuugggggaggguagccuuggagaugagaccugaacgaugagguugggcagcucugggaagggaggaaaagagacacagccugggauaaagauacaauuguguguguguguguguguguguguguguguguguguguguguguaguacucacuagcucccuauugcccucaaaauaaauccaaacucaucucucuucccacaaggcucuucacaaaacucuuccccuuuuccccuucaccaucucuuuauguuuuguuuauuguuuauagagacaaggucucacuguguugcccaggcuggucuugcauuccugggcucaaucgauccucccaccucggccucccaaagcacugagauuacaggcaugagccacugcacccggccagccagcuucaugaucucaacuccggucauuuucgcccucacucacucugcccaagucacacuggccucacaccaggcacaguccagccucagggccauugcacuuucuguucccuguaccuggaaugcuuuucccuugcuucuuaucauucaagucucagcucaaaagcuaccuccucagaacggccccuccuagccacccauuucaacagcuucugcccaccccguuauuuucacacucuccauccuauucucccucucuucccagcuccuaccauaguguguggcuuuuuguuuguuuuuguuuuuguuuuuugagacggagucuugcucugcugcccaggcuggagugcaguggcgcgaucucggcucacugcugcaaccuaugccucccggguucaagcgauucuccugccucggccucuggaguagcugguauuacaggcucccgccgccaugcccagcuaauuuuuuuuguauuauuaguagagacggauucaccauguuggccgggcuggucuugaauuccugaccucaggugauccaccugccucggccucucaaagugcugggauuacaggcgugagcuaccaugccuggccuucgguuuuuuuguuuuuguuuguuuugagacggagucucauucugucgcuggagugcaguggcgugaucucggcucacugcugcaaccucugccuucugggcucaggugauucuccugccucagccucccgaauagcugggauuacaggugcccaccaccacgccuggcuaauuuuuauguuuuuaguagagaccggcuuucgcuauguuggccaggcuggucgcaaacuccugaccucagaugauccacccuccuuggccucccaaagugcugcgauuacaggcuugagccaccgugcccagcccacaguguguuuuggaugugaguauguuuacucggagguuguucgcguccuuguuugucucccucaccacgaagaaggcuguggagggacugagccugucuaggucucugcggggccuggcacacaguaagugcucaauaaccagccuaaagccagaaaccgccggccacacucccugcuuggaaauucucacaaacagggagcgccaucauucuacgcugucaagaguccgugauuccagguucuugggggucugugaagugcugauuccaaacccuuuccggcagguguuucacugcuccugggaggccaacaucuccccugccuggaccuugagcauacaugguagccucuguccucauugucugcaacuguccaccccacaucuuccuucuuguugguuguuuuuuuuuuuugacggagucaugcucugucguccaggcuggagugcaguggcacgaucucggcucacugcaaccuccgccucccaguuucaagcgauucucuugccucagccucucaaguagcugggauuacagaucucggcucacugcaaccuccgccucccagguucaagugauucuccugccucagcuucucgagcagcugggauuacagacauacaccaagccuggcuaauuuuuuuuuuuaauggagucucacucugucgcccaggcuggagugcaguggugccaucucagcucacugcaagcucugccucccagguucacaccauucuccugccucagccucccaaguagcugggacuacaggcgcccaccaccacgcccagcuaauuuuuuguauuuuuaguaaagacaggguuucaccauguuagucaggauggucucaaucuccugaccucgugauccgcccgccucagccucccaaagugcugggauuacaggcgugagccaccgcacccggcuaauuuuuguauuuuuaguagagacaugguuucaccauguuggccaggcuggucuugaucuccuggcaggcgaucugccugcuucagccucccaagugcuaggauuacaggugugagccaccgcgccccuccagaucuuccuucuucugccuaagccccuggcucuggaaacccaauggcuccuucuugaccuccauuacaaugcuugcucagagcagccucaccucccucugcggggcucuccuguccgggcggcccucuucccucucuaagcacaggugugguggcucaaacuuguaaucccagcacuuugggaggccaaagaggccaggaguuugagaccagccugggcaacauagcgagacccaacccccaccccccaucucuacaaaaaguaaaauaacaaacguaggucucuguccuuccuuagcccggucacuugaaugucaacuugacucacaccucuggcuuccagggcucugagacaccgccucucccuccaggcuucagugaccgccucgugaggauggcugcaagcucuggcaccaccuccgguuccuacucugagacccagcccuguggguccagccaccaacugggcaucuccccuagaggucccccagaucucagacucuuacccccugcuccuaucaggguucccacacacaucccccagauacucuaaaccagagcaucacccuagcccucuauucccaacaccuggccugcaacccuccuccguucuccccaccccagcagcccccacccugaccaggccuuuguccucucucccaucuggaccacagccaccuccucccucugagcagccuuuguuuuuggugaucuucaauuggagccuggcccuccuucccucaaacccuccccuggcucccuauugcccuagggauaaauuuccagcucuucacccuagcacuggaaccucugcaacccugccccagccagcuucaccuuccuccaccagaucacaccacacccccaacccccuccagccacccuggccagaucaccuaauuuguguccuuucuuucccaccucugagccuuucccugcuuguuaucucuuccuggaauucccucccccuccuuuuaugccuggagaaaguccauuuuuuucaaggcccaacccaaaaacugucuccugcaaaagccuucucccccagccuccugucuucuucgccuccugucuucuccauacgcgcguacacacacacacacacauacacacacuggauauaaacugcuugguguugguggauaaauggauguuuagucuacgaacaccuccacaugcugcaagaggcuggauuccuagagaagauccagcccuaggccuuccagggaggggcucccagagcaucugguggggacagagguacagggacacguacccucccagggucacauagggucagugucagcacaggagcgagcuaaggaugaaggcagagccgggcgaggaacaggggcauugcccggugagugagcugaggcucccuagagcaggggaucuuuacccagcagucuucagaucccucuaacaggcacacugcaccggggaggguaaauacagauuuguggauugcccgagaagccacaagaccacacacgcacacaggaacacaccccaucccuuagugugugauccgccaggaaggaggaguuuuugcucugggcagcaacauccccaacuuugggagcagcggguggaauuuggggagacucugcugccagcaacugugugcauacuggggaacccuuggccgccugugacuccauaacuccccaaaauaccacauccggccagagcaggaagcagggaagcaaccugccaggcguguuccaacguggguagaguccccagcgacuucauuugccacgcgggacuucacggacccccucuuugcgccucaguuuccccagcugcaccaucagggaagaagcugccagaggggaaaaggagcucagccgccgaucucccccuucccauuacagagaggcucagccccugguuccuggcuaggguuuuacguuguggauguggguuuacggaaaaaaaaaaaagggaaaaagcugagaagcugcgcugggaccccggauugcucagaccaccuuaaaucagccuggccgccccagcuacuguggaaauuccuuucuccgcggugguuggcugggggcgccagccaauccgcucgcgacgcucccacaugggucagugacgucacauaggaaacuggccaauggggauuaggagaccagcaaccaauggcaggaggcacugggaucaguagggccaaucggaaggcagcucggcgcucccggcgggguuuggcgaguguggccccccucccuaggagaaucugagacccuaguggacgcccgagcucgaccggauuggaggagggggggcuaaggcuccauuauuauccagaaacaggggaaagcgagucacccccaagccuggccuaucuccccuucaaaacaagggacccucgugcaauaugcuaccagcuagcuggcggagcagagguugcaucuuucucccuauuucacagauagguaaacugaagcaaagaguaguuaagucacgcuggacgcccggcgaagagcugaagcucuuacccgagccugggggcuccaggaacggucucaguuuuacccccaggugggggggaugggccuauagguagucagggguggagggggguggugcugggccuugugccucaguuuccccgagcguggaagcuggaggagagcacggguuuucagaaaaagacuacgauucccagaagcucccgcgcggcucccgcccaggcugucaaucaaaguaacguggguaccucuccggcccgcgcucucccgcccgucgccucccucccgccagcucccgcucccucccugccggcucccggcccggcgcgguauaauuacagcccauugauccgacccgggccgggaaagcggcucccucggggaggccaagccuuuggcuuccgacaccgccaaccucugccuaccgcccccuccagccgaacugccgggccaccagccaggccuguccccucccgcuggccccgggcucgcgggugaccucugagccucagcuccccgccacgcuuggcggugugccccccggaaaaaucacacacacauuuccuuccacccaggaacaugaggagccaucucccuagaaccuccagggccucucuuugagccucaguuuacccagaugcacagugagauugcuggacaaaacuuucaugaaacccauacuccgugcuguucugccugggagcagccagggcugaccuugguggaaacucaaggaggggcucccaaguuugggaggagggggagacagcccagcucucucagaaccccuguggucgggguugggguuagggaggaucagagcugggggugggagugggggcaggcucagccaggauuuagcgcccccauugggaaguugggauagcuuucuagauguugggugguaguauuuaauagauguuggggcagggcgugguggcucacgcccguaaucccagcacuucaggaggccgaggcaggcggaucaccugaggccaggaguucgagaccagccuggccaacauagugaaacccggucuuuacuaaaaauacaaaaauuagccggacaugguggcacgcuccuguagucccagcuacucaggagacugaggcaggagaauugcuugaaccugggaugcagagguugcagugagccgaguucgcgccacugcacucuagccuggacaacagagugagacucugucucaaaaacaaaaacaaaaacaaaacaaaacaaaaagauguuggguuucgguauuuaagcuaggguuuugcagaaugcauaggaguugccucauuugagcagugccuuuagauuacccuaacccuaaguggacagaagaaagauggggcagccuuaagcccuuuccugugacagagugagccuugggcucugaccccuagcuuugcuguguggaucugggaacaucccccagcugugaagugucggggagguagauacccccuaggguuagaaggccccugugccuacuuucgcauggguccugaagucacaguggguucugaccagcaggagucagggccugggagcccgugguaggaggcacuaggauuggcugaggggcucaggaacuccagccucucccugaguaagaacugggcggcugggggagaagucccagagugacaacggcucagugccaggcacguuuacucugcuuggguuuccuugucuggaacacaagauuaauaauagaaucuucaaauaaggccuauaaaguacuuacaauaaugcauaguaggccgggugcaguggcucacaccugugaucccagcacuuaguugggccaagauggguggaucaccugaggucaggaguucgacaccagccuggucaacguggggaaaccccaucuauacuaaaaauagaaaaauuagucgagcaagguggcacacgccuguaaucccagcuacucaggaggcugaggcaggagaauccuuggaacccagaaggcggagguugcagugagcugagaucacaccacugcacuccagccugggggacagagcgagacucugucucaaaaaaauaauaauaacaauaacaauaauaauaaugcauaguaaaugcuccauaaaggguagcuauuuguacucccaacauuuauuuuguccuuauuauuauuugagacaaggucucacucugucacccagucuggagugcagugccaccgucauagcucacugcagccuugaccucgcugggcucaagccgucuuccugccucagccuccggaguagcuggaaucacagguguguaccaccacacucagcuaauuuaaaaaaaauuuuuuuguagagacagggucucacuauguugcccagacuggucuucaacuccugggcucaagcaguccucuucccucagcuucacagagugcugggauuacaggugugaaacacuguguccagcccccacuauguccuaaaggguccuucucucccacucuccccucacgcuccacaucuaugcuaugcauucuccauugcacccacauccuugaugauccauugaaaugugaaucagggcugggcgugguggcucacgccuguaaucccagcacuuugggaggccaagauggagggacuaccugaggccagagguucgagaccagccuggccaacauggugaaacccugucucuacuaaaaauacaaaaauuaaggccgggcgcaguggcucaugccuguaaucccagcacuuuggaaggcugaggcgggcggaucaccugaggucgggaguucaagaccagccugaccaacauggagaaacccugucucuacuaaaaauacaaaauuagccagggugguggcgcaugccuguaaucccagcuacuugggaggcugaggcaggagaaucgcuugaacccgggaggcggagguugcagugagcugagaucgcaccauugcacuccagccugggcaacaagagcaaaaccacgacucaaaaaaaaaauaaaaauuaaaaaaaaaaaauuagcugggugugguggcgggcaccuguagcugcuugggaggcugagacagaauugcuugaacccgggaggcggagguugcagugagcugagaccgugccauugcacuccaggcuggccaagaagagcaaaacucuauccuuuccccacuccaaaaaaaaaaaaaaaaaaagugaaucagaguccaucccucccuugcucaagaaccuuccauagcucccuauugcccucaacauaaaauccaaacucccuaccucugucuaugugaucugacuuccaucgccucccuccucucaccuccucccacuucucccccucuguuccagccacacaggccuucucccucuuccucaaaccagagucuagccucaagaccucugcacugcauugguuguucccucugccugaaccacggccagccuuucucuuccuuucagaucaaacaucacauccuagagaggccagccuggcuagaguagcuccccuccuccuaccugcucagcuucccucagucuuccgaggccucguggcucugggaacacauacuaucugcucccuccuguguguacggucugcccaggccccaacacaccaccggcuacacuguauuuauugggagaguaaguggacaagcccauagagggauagagccucaccaaggucacccagcaugacggacgcgaugccagguccccugcuaaccugcccagcgcuaacacaaccuguaggggucagcugagaucgcagagaucacacuaccuccagaggcugugagacccagugucacugaugugcaagccuggguucaaaccccaccuccgccacugcgucacugugauccuguacagugggauaauuauagaaacgucucauugagucaucacacgaucaaauagcucgauagaugaaaaggccccgaccguuauuauugugugggagugugugcggcccagcggggacaauuuggggugcggaagcagagcuggggcuggcaccacagacaaaccccauuuuuaagccccuagggccuucuggucauugcagcaaccccaucacccacaccacguguaaccccucuguacccaguuggggguucacccuccuaggaucgccauggacucccgucucuaucuccacccucccuccuucccuggagagcucauugcugggccccaaacucgcccagccuggucccccuggaaggcacagcacagauggggguugaacaaaccccuggccgcauggcccaaucugaaucuucuuuuuaacguuuguuuguuuuuuuuuuaagacagucucgcucugucgaccaggcuggagugcaguggcucgauuucuguucacugcaaccuccaccucccggguucaagugauucuccugccucagccucccgaguagcugggacuacaggugcacaccaccaugcccggcucauuuuuguauuuuuaguagaugggguuucaccauguuacccaggcugguuucgaacuccuggccucaagggauccuccugccucggccaccugaagugcugggauuacaggcgugagccaucucacccggcacagcauuuuguuuuuuguuauuguuuuaagacaaggucucacuccgucgcccaggcuggagugcagugacaugaucacggcucccugcaagccucgagcaaaauccucccaccucaaccucccaaguagcugagaccacaaucgugcaccaccacgccuggcucauuuuuuuagauuuuguagagauggggucuugcuauauuaucgaccucaaucugaaucuuccucauccaguuucugguuugcagugagaccuuuuaaccccuguggaccuccguuugcucaucuggaaaaggggcaugguacugucaccaaccccagaguggcccuugaugacagccucugcugccauuuauauauauauauauauauauauuuuuuuuuuuuuuuuuuuuuuuuuuuuuuugagacagagucuuauucugucgcccagacuggaguacaguggcgagaucucggcuuacugcaaccuccaccucccaggcucaagccauccuccugccucagccucccgaguagcugggauuacaggugcgugccaccacgccuggcuaauuuuuguauuuuuaguagagaugggguuucaccauguuggccaggcuggucuugaacucuugaccucaaauuauccaccugccucagccucccaaagugcugggauuacaggagugagcccccgcgcccagccugccauugcuauuaucacugggcuaccugguugauauacacaccauggcccuccgaauuaugggcugagagcuugcccugugauggguacagugccgccuccaggcuucgccaccgggauucccucugccuggagcacccgccccucccugagagccaccucccaacaugggcucuugcugucaaacccuccucggcucaaaugucaccuccucagagaggccuccccuccucuccugggccaagcagccccgucucucucugucaccaacccuugcuagauuuuucuuccuaccacuugguguucucugcaauggucuugaccuauuuuccaaaccuuccccaugacucugugagcuccacgagggucgagaggcgcuccgucuggguccgugauacccaagccuggcacacaguaggcgcccaauaaauacaggaaugaaaggcccgcugcugccccagguugguuuuucuuccccaccaauccaguugcugggaauugaggcuuugggggcagccaggcccagagaggccuagggaccugcccacggucacacagccacgcgcuccagcugggagcucuguggcugccuuugcggggggccccgagucccaggguugggcaggccuagggcagggucgcccgcccccuccucccgcggugcugcgggggaacccaccauuagccacgcgggcccggcccagcguguuccccgacaggcccgggcaggcccagcaggggagugaggggauugcggggaguagggggagcgcagggagcguggggaccgccccuccccgggacccgagaaggggguguaggagggaagaggagggggaggaggagagaauggaggaggaaacggagggacaaagggggaggcggcaaaggggaggggaggggagaggaggggagaggaggaggcccccggguggaggggacccuguggaggggcagggaggaagggggggcggugaggugcgggggaggggcagaggggcggagguggcgggagagggagggggcggaggagggacgggcuuucaggccuggcaggcucccagcaacugcgggagggguaagggggccugggaggacggugggccugggugggugggagagguuugcagggggaggucagcggcugggggcgggagcggggacggggaugguagggagggaggcgccaaugaagagauccagggaagguuaggggacccaagcuggagacuuugaaggacagagggagaagcccagagauggcagaaagagggagacgagaccaucagagacccccgagacagagggggcgaggcgagggagauuguuggauaaucuguuucaaaccugaguucuauuugcuucauauuagggguuugucccuucuccccaaguccccagagauccuauguagaagcuguucucauuaagcaccaaacaguuaaguccauucuccaguacuagcucggaagucgguuucauauucgacuuaacaauuuaaaugaaaggaaauuuuuuuuaacggcaguggggacuuggagaaggagggggacaaagacagacauuacccaggagagaaaguuagaggggaauccuaggcccucagaggggaaaccaggcaggggcgguuucagcucccuucucuaguuuuuaauuaauuuauuuuuuauuuuuuagagacaggggucucacuguguggcccaggcugcucucaagcuccuggccucaaaugauccucccuccucagccucccaaagugcugggauuacagccaugagccaucuugcccggcacagcuuuuuguuuuuuguuauugcuuugagacaaggucucaccgugucgcccaggcuagagugugguggcaagaucacggcucccugcgaggcucaagcaauccucccgccucagccucccaaguagcugagaccacaaucguacacuaccaugcccggccuggccucaagcaaucuuccagccucggccugccaaagugcugggauuauaggcgugagccauggcacccggccccuucugcagcuuuuuuuuuuuuuuuuuuuuuuugagauggucucgaacgccuaaccucgugauccgcccgcuucagccucccaaagugcugggauuacaggcgugagccaccgcgccaugccuggccucugcagcuuuuaauaucagaaaacaucuaccugggaccugcaucaugggucgcaccuguaaucccggcaguuugggaggccaagacgagcggaucauuugaggucaggaguuugagaucaaccuggccaacauggugaaaccccgucucuacuaaaaauacaaaaaaaaaaaaaaaaauuagccaggcaugguggcgggcgccuguagucccagcuacuggggaggcugaggcaggagaauggcgugaacccgggagguggagcuugcagugagccaagaucgugccacugcacuccagccugggugacagagcgagacuccaucucaaaaaaacaaaacaaaacaaaaaaauuagccaggcaugguggcgggggccuguaaucccaguuacucgggaggcugaggcaggagaauugcuugaacccagggggcagagguugcagugagccaagaucgcaccacugcacuccagccucggcgacagagcaagacucugucucaaaaacaaaaaacaaaacaacaacaacaaaaauacaaaagguagccaggcgugguggugcaucccuguaaucgcagcugcuugggaggcuggggcaggagaauggcuugaacccaggagacagagguugcagugggccgagaccuugccacugcccuccagccugggcgacagagacuccgucucaccaaaaaaaaaaacaaaaacaaaccaaaacaccuaaguggcacaggggccuccucgugacuuucugccucaguuuccccuccagccugccccccuggugucccauggaggaucucgauaaucgcacaucugggugugccgccccuuugcugcucgaacaccauccauggcucccuaugccccagcuccuggccuguagggcaggcaggauucuacagggcuggcccacauccacccaucucacuggcuucucugcccuuugcuuuuuagagaaggauucccgcucugucgcccaggcuggagugcaguggcacgauuucugcucacugcacccuccaccucccggguucaagugauucuccuuccucagcuuccugaguugcugggauuacaggugugcgccaccacgcccggcuaauuuuugucuuuuuaguagagaugggguuucaccauguugcccaggcuggucucaaacuccuggccugacgugacccuccugccucggccucccgaagcgcugggauuacaggcgugagccacugugccuggccuucacugccauuuucucacuuucuucccuaaucgcuacacaccuacugugugccaggcaugauucuaggccccaggaucuauaguagaaacccaaaucagacaaacucucuucgccaaagucauauuagaguggagaaaagcaguggacaagagaauauuuguugggauaaauugugcggagcaaaaaaugcugugaagauaaagaaugcagggaaagccgggcgcgguggcucaugacugucaucccagcacuuugggaggccgagguggguggaucacuugaggucaggaguuucagaccagccuggccaacauggcaagaccuugucccuacaaaaaaaaaauuagcuggaugugguggugugugccuguagucuuggcuacuuaggaggccgacaugggaggaucaccugagcccgggagguugaggcugcagugagcuaugauagcgccacugaacuucagccugguugcccaggugagaccuugucucaaaauaauaaaaauaaagaaugcaggaaaaagugauugugauggggaugacugaaguaggaacagcguguuccaggcagagggaaaggcccuaccugggaccaugcgugaacaccuucagccacagggaaggugccaggaagggucagacugaggcagugacuacggggcaggggucgugagccuccaaggucagcccugccucagccaauccugcugcaccccaacucugccuggaaucggucuuucaaguccuuccuccucccccaccagucagugaguccagaaacuucuuucucuuaaaccaaaugguuaagauccuggcugggugcaguggcuuacaccuguaaucccaacacuuugggaggccaaggcgggcggaucacuugaggucaggaguucgagaccagccuggccaacauggugaaaccaccccccaccccaccccgucucuacuaaaaauacaaaauuaaccaggugugguggcgggcgccuguaaucccagcuacucgccuguaauccugaagcaggagaaucuugggaggcggagguugcagugagccgugauugcaccauugcacuucagccugggcaacaagagugaaacucugucucaaaaaacaaccaaucaaaugguuaagauccugaauuuccugcauuugaauccagauucccuggcucugugaccacuuagagccucaguuuccuuaucuguaaaacagacccuccuucagagagaauccuuugagagauccaauuuucacuguaccacucaagcacugcuggaggcgugauagauguucaggacaacacagccgguauuacuguuguuaucuuuaugauaucuuugccuuccuaauuagucugguugccccuaggggggcaaagaggucccugagcagccagcaggagacucagcuacagcccugacuuauuccugcccuugagcaauguucugauguccgugggccucaguuuucccaucugcaccaugggaagagagcgggaucauuucuagcucccuaauuccaccagcacugcaggugcagcuuuuauuuucucccccaagacugccugaagggcacacagagggacggagaaggcucagcugcagacaauucagccagcgcaggcaccuggccggccugacugugaaugucuaaugcguccuagcuuuagcuccuauuccccgcuccuuuuccuccaccccuccccgcccccaaccgggcuggggauggggaagggggauucuguaagugcucccacccucugcuggaggccagagccuggcccuuuggggugcagauggggggaaauggaggauuucagaccccggaguccccaguccccugacagacacccccccaccccccaccccaccuccgcuagaguccugccaccggggccugugggauucuccucccuccacugagaaccauuguguggaugggggcaaucgaggcccagcgggcaggggaucuccucaccugcuggaacgucccucagaaugggggaggggggcugggagaaugguggggucggagaaggggagagccuuggagaaggggcuuccagaggaaacaggguguuagagcgggagagguaaccagaaaggaauaugggcccaccccaguccucucugcuccccucuggucccauccaaggagcugggagcaucgcugugccucccccuccucccucuccuccucccccuccucugccucccccuccuccucccuucccucccuccuucucccccaccuuccuauucuucccucccuuccugcuauuuucucucccuccucccuccccucaguuuucuccccacgccccucccucucccuccccucccucccccucccuccacuucccuccucucucuccuccccuccuccuuccccucucccccuccucucccuacccccgccuccccgcuguucucuccccuccccucccccuacccucccccguccuccgccucauuaggcgcggccgcggcgcggggcccauuagccgaucaauuagccgaggucgcccgcggcgcagucguuaagcgcggggcggccgcggcggggagggggcucggagcccgcgccuccgcccgcccgccccggcuucccggacccgagcacgcccccccaggacgccuccugccacccgccccccagcgggccccgggacccuccccaaacccugcgggggccugggagacccccggaucgcaggccaggccguggcugaguaggcaggaccccuucuuccgagaagaccccuugugggggugucgggcuugugacccccccccaggcauccuucugcugccagcaacaucaauaucaguaauacuuacuauuguuauuauuauuauuacuagcugacacucuugagcccuugcagaaguucuaauucucaguacaauuuuc

SEQ ID NO: 192181 - RNA, 17647 nt, Homo sapiens
aaauggcccccggugggggaaggaggaguuuccucuuggccugaacuuggcugaccuccgcagcuuccgcccggugagggacgugaguugccaggcguguucuagggggcuggggggacuccaggauucccggccggggaaggggcugcaggggcguggaggggcaggacugaggcaaggaagaagcugggugcugcagcagggauggagguggagagaggucguuucuucugucugaugaauuccgccuaaugcaccuggcuaacuccuagucauccuucaaaaccccuuucuagugaucucccugcgcuuuaggaaauugucucaaaacuaagguugagcuuuggcgaccuucccugggcucccccgucccugacugcccccagcagggaguguaugugcacuauccaccccagccuccuagggugaggccugggaggcaaggcucaguucuuucuggguccccgcccccaugaaucugggcagcuggaggcauugauaagugaggacaggaccuagggaacgcaugggagaaccgcaggauugggucccuggagacuuaccaaacugggaggugcgggugggguaacgggugccuugcuucccuggcacugccuuauuuucugucccucaagaccugccgucuccuuguuguuuuagacucuggcuaaagucuuggaggcuacugccuugaagaugaccucuagggaccagcccagacccaagggccccccgaaaagcacuucggugaggagggcauguggugggaucagcccucaagggaaacccgggcccaaugugguucugccccuuuuccaccugugaccugggcuggccccgcccaggccucgcagcugaagacaauacuggucgcugcuacacucaagacaggugccaaggagccguguuuuuuaaaaaaaauuaaguguaggcuggacacuguggcucacaacuguaaucucaacauuuuuggaggccgaggcaggaggaccacuugagcccaggaguuugaaaccagccuggacaacguagugagacccugucucuguaaaaaauaaaacuagaagaaucagcugggccuagugacgugggccuguaguugcagcuacuugggaggcugaggcagaggguuggcuugagcccaaggaguuugaggcugcagugaacuaugauggugccacugcacuccauccuuggugacagugagaucccaucuaaaaaaaaauguagcaucuaaucacauaugugauaaaaacacaggaacacaucauguauuugguugauguuuuacaagcaauccccgcucccugcacuuugcgucccagagaugaccauuuguaaauuuaggcucucagggcugagcagacguuuuuuuuuguaaaggagucagaugagggauauuuuguuuugagacuuuaugauuuuauuauguuugagacggagucucacacucaccucggcuggaaugcaauggcgcaaucucagcucacugcaaccucugccucccggguucaagugauucuccugccucgccucccgaguagcugggacuacaagcaccugccaccaugaccaccaaauuuuucuuguauuuuuaguagagacuggguuucaccauguuggccaggcuggucucgagcuccugaccucgugaucugccugccucagccucccaaagugcugggguuauaggugugagccaccacacuuggccaagagacuuuauuuuauugagucuugcucuuguugcccaggcuggagugcaguggcgcgaucucggcucacugcaaccuccaccucccagguucaagugauucuccugccucagccucccgaguagcugggauuacaggugcgcgccaccacgcccggcuaauuuuuguauuuucaguagagacgggguuuugcugaguugcccaggguugucucaaacuccugaccucagguguucugcucaccucggccucccaaagugcugggauuacaggcaugagccaccuugcccggacuuuuauuuuuaaaaauauuuugugcuucuauuuucaucacaagaauguggugaacauuuuagacuuuaggccaaagugcaaaauggaagaugcucuuuacugaaauaagagaggccgggcgcggugguucaugccugucauuccagcacuuuaggaggccgaggcggguagaucaugaggucaggagguugagaccagccuggccaagauggugaaaccccaucucuacuaaaaauacaaaaauaagccagguguguugccgggggcgggcgggggaggggggcgcgggcgcauguaaucccagcuacucgggaggcugaggcaggagaaucgcuugaacccgggaggcagaguuugcagugagcugagauugugccacugcacuccagccugggcgacagagcaagacucgguuuccaaaaaaaaaaaaaaaagcaaaaaccacaauuacuuuugcaccaaccuaaugccuaugccauguugagguggagaccgggggucuuggguguuggagcauuguaaguuuuauguaaccuugcuuugaccuuuccagccuuguccugggaucucgaacucugagagcucuccgacgcugaauuaucagggcauucuaaaucggcucaagcaguuccccaggugagagcaauuccaggggccggaggucucacgcugggaaggagccccaccuggccucucucccggggguccuagugaguggucuagaggcugcuggcccaagagccaggcucaggaacaggaagccaugcagauacccagcauggagaacccggcaauacccaucccagcuuuugauuaaacaaaauuaccaacaaauauuaaaauuuugauuuuccuguucgacauggauuuguuggcauucaauuuuauuguugaaaaauacugcaacggcuggguaugguggcucgcaccuguaaucccagcacuuugggaggcggaggcgggcggauugcuugaggucaggagaucaagaucagccuggccaacauggugaaaccgcgucucuacaaaaaauacaaaaaucagccaggcuugguggugggugccuguaaucccaacuacuugggaaacugaggcaggagaaucucuugaacccaggaggcggaggguugcagugagccaggaucacaccauuacacucaagccuaaggcuacagagugagacucggucuuuaaaaaaaaaaaaaaaaaaaaguacugcaugggcugggugcaguggcuugcacuuguaaucccagcacuuugggaggcagaggcaggaagaucgcuugagcccggaguucaauaccagccuuggcaacauagcgagaugccaucucuuaaaaaauaaaaaaaaucuagcugagugugguggugcacaccuguagucccagcuacucaggagacugaggcaggaggaucaucugagcccaggaauuggaggcugcagugagccaugauuguaccacugcacccuagcccgggcaacagggugagauucuguuuaaaaaaaaaaaaauugaagaaaguggcggggcgcgguggcucaagccuguuguaaucccagcacuuugggaggccgaggugggcggaucaccuggagucagggguuugacaccagccuggccaccauggugaaacacuguuucuauuaaaaauacaaaaaaauagcugggugugguggcaggugucuguaaucccagcuacucgggaggucgaggcaggaggaucucuugaacccaggaggcggagguugcagugacacugcacuccagccugggugacaagagugagacucugucucaaaaaaaaaaaaaaaagaauauacugcauuaaaaucuuacugaacuucuugacacugccuuaaauuuggcuucuggagccagugccuuccagcuucauugagacccucccuagggguugaggguggggcucacucuggggagggaguccugaagccacaggucuuccagccuguccuccuucccccucagguuuucuccucauuuugcugcggaguuggagagcauuuacuacucggugagccagacccaggcagccccaaccaaggagggccccacugggacaagcugaggcccugguuucccggcccugccuccugagugcccuagagagguucuuuuccgccaagcacugugccucacgccuguaaucccagcacuaugggagggcgaggcagguggaucaccugaggucaggaguuggagaccagccuggccaacauaguagagacccugucucuacuaaaaauacaaaaauuagccgggcaugguggcaggugccuguacucccagcuacucgggaggcugaggcaggagaaucgcuugagcccaggaggcagagguugcggugaacugagaucacacuguacugcagcccagguaacagagcaagacucucucugaggaaaaaaaagguagggaccauacaucaguguaguaagaaaguaaaagagaaaacaaggugaaaacaaaaauuuaaggugggggaguaggggccagagagguagagcagcuugcccagggucacacagcauucacacccggaccaccucccgaugggaucucuguuuucccuuugcagcugcacaagauccagcaggauguggcagaacaucacaagcaggugggugaccaggagcucaggggugcggcugucccuccaugaaaggcaugagaaagcacagaggggggccgggcacaguggcucaaaccuguaaucccagcacuuugggaggccgaggaggguggaucacuugaggucaggaguucgagaccagccugaucaacauggugaaaccccgucucuacuaaaaauaaaaaaauuagccaggcgugguggcgggcgccuguagucccagcuacuugggaggcugaggcaggagaauugcuugaacccgggagguggagauugcagugaggcaagaucguggaacugcacuccagccugggcgacagcgagacucugucucaaaaaaaaaaaaaaaaaaaaaaggaggugggggauggugaagacagaggacgagggguaggucaugcugagccuugugggccgugggaaggacuugggcuuugaccccaagggaggugggagccauggaggacugcuggcagaggagggacaugcccugacuuggaagcccccgugauauuaguggaggccccauaucuuggggagcaucuccuguccugucucugagcugcuuccaagagagggucaguccugcuccuuccgcucccugggccccugcgcaaccuagaugacccuuugccggucaguugcuuuggacagagagagccugugauggggcaggcacccggcuguguuccccugcgugucugaguguucaaugaggggccauaugacaugggagugaggggagcucugcaugggagggggcgcccgggcucccaucucccagcccagggcgccuggcccaagcagaaguacgccuuccagcccugccuguccucccgccaccuggccuuuucucccaggcgcuggcaggauuuuccgccugugccagauguaacuggcaggggcccagggccgugucugcaacuuagcagggccugggaggaggggggcagcgaagggaacagggugagggggggccaggaagcaaccaaaacaugguuauucauucagcagauauuuauccaucaccuccuugccaaauacuguuguagaagccaggaaaauagcaaagaacgacgcagagcuucccacccuuggggcgaguggagccugguagauggaguguuaggggaugagggcugggcaaggcgggggauggaagagagcagccccaaggggauuggggaggccagggugggcgaggguugcaauucaggguggucagggaaggcaugcgagaaggugacaucugagcggaggcuuaaaggacaucaaagaggaaguguggcugucugggaugggagggauauuucaggcagagggcacagccugugugaaggcccugaggcaggacggugccuguuguguugguccugaaggcacuacgaggaagcccgcauggcuggagcagagugagaggaggagggggggagggcaggccacgcauggcccugugagcuucagggaggacuugggcuuugaacccugagggagggaggugggagccauggagggcuucagacagagggcaggcccuggcuacugcggagaggacagagaagaaggaggagggaugagggcagaagcccgggaaccaguuaggacaguccagguguggaaugcugguugcuuagugaugagaaguaauugaauaauuguggacguguuuugggaggaacuugaccgcagcugcugagcaucaggauacgcagggggugagggcuccagagcaaaggagccacuucgguugcagccagacccaggagggucccugcccagcccccacugcagggggccccaggaucccuggcagcccagccuggccugugguccugggcaguccgcuucccccacccgcugcuuccaguuccgggcuuucccagccgccucgcugugcuuucaaaaucgccaucagcacagcccccuccuccgacagcccgccugccacucucccccgggagggcugcuagcaggcacaagggagccacacuuuucaugcugagcgcauuaaagugccgguaaauugcgcauuaacgaggcggggugaauuggagagggcuccccugggauuugcugcugcugggcgggcucagcugggaaauccaucacuggcugccccaggaggcaucagccuggaguccccccccccccgcggggcuccgauggagggucuccccucccggccccucccuccgccguccugcuaaggaaacagacagguagccuuuuuguagaaaaaaacuuaagagauaggaucacucgccuugcuuucuuuuuuuguuguuuugacggaucaugcuccgucucccaggcuggagugcagugggaggaucucagcucacugcaaccuccaccuccuggguucaagugauucuccugccucagccucccaaguagcugggauuacaggugugugucaccaugccuggcuaacuuuuauguuuuuaguagagacaggguuuugccauguuggccaggcuggucucgaacuucugaccucaggugauccgcccgccucagccucucaaagugcugggauuaccggugugagccaucgcaccuggccaauuucuuuauacuuugaacauggcuacuagacauuccauaugcaugacuauauuuauguauuauuccaauucuacuuguacuggaugguauugaucucgauuuuauucuguuuacugagaaacuacauuuaacuucgggauugacaguggucagauggcuugauuuuuguuguuguuuguucguuuuaaauaaaacaccagacugggugagguggcucacgccuguaaucccagcacuuugggaggcugaggugggcagaucaccugacgucaggaguucgagaccagccuggccaacauggagaaaccccauuucuacuaaaaauacaaaauuagcugggcaugguggcgggugccuguaaucccagcuacuugggagccugaggcaggagaauugcuuuaacccaggaggcagagguuacagugagcagagguggugccauugcacuccagccugggcgacagagcaagacugucucaaaagagaaaaaaaaauuaccacugacuuguuucuaucaauucuccccagcagguaacccucaguuucuuaguaucuuuccaaaguuuaagcaaauuaaaacgucuuccucaccuagggagaccuagguaugcuguuuugcugcuugaagccuuuuuuuuuuuuuuuuuuuuugagacaagucucgcucugucacccaggcuggagugcgguggcaucaucucgcaucugggcucacugcaagcuccgccuccuggguucaagccauucuccugccucagccucccgaguagcugggacuacaggcaccugccaccaugccuggcuaauuuuuuuuuuuuuuuuuguauuuuuaguagagauggaguuucaccauguuagccaggauggucucaaucuccugaccucaugauccgcccgccucggccucccagagugcugggauuacaggcgugagccaccgcacccggccugcuugaagucauuugaagcaaaguguggugguggucagguuuucuuuuuaaaacaucccaaaaagaguagcuggggccaggugugguggcucacaccuguaaucccagcacuuugggaggccaaggcaggagaaucaucuuaggucaagaguucaagaccagcccggccaacauggugaaacccugucuccaccaaaaauacaaaaaucagucuguguaguggcacacgccuguaauccagcuacuugggaggcugaggcaggagaauugcuugaacccaggaggcggagguugcagugagccgagaucacaucacugcacuccugccugggccacagcgugagacugucucaaaaaaaaaaaaaaaaaaaaaaaaaaaaaaaaaaaaaaagauauaugccaggugcgauaggccggaugcgguggcuuaaaccuguuaucccagcacuuugggaggcacacgugggaggauaguuugaggccaggaauucaagaccagccuggccaacauaaugagacucccauuucuacaaaaaguguauuuaaauuagcugagcgugguggugcauaccuguaaccccagcuacucaggaggcugagaugggaggaucacuugagccugggagguugagggugcagugagcuguaaucgcaccacugcacuccagccugggugucagagugagaucuuaucugcaaaaaaguagaugaaggcugggggugguggcuuaugccuauaaucccagcacuuugggaggcugaggugggcagaucaccugaggucaggaguuggagaccagccuggccaacauggugaaaccccaucuuuacuaaaaauacaaaaauuagcugggugugguggugugcaccuguaaucccagcuacucaggaggcugaggcaggagaaccacuugaaccugggaggcggagguugcagugagccgagauugcaccacugcacuccagcuugggugacagagugagacucugucucaaaaaaacaaguagauugauauaccuucuucuacagguggggauaaucaugcuguaggauugcaaacccuuaacugcaacaacauuuaacuguuuugcugccaaccuccuucuagauaggaaacgucuuacagauuguggagagcugcagccaacuccaggguuuccagucugaggaggugaguuucugggucuucaaggaggggaggggacaggcuugggugaaggcucauccucaaagcucucacugccuuguuccugccgggccaggucucaccugcugaaccagccagcccugggacgccccagcaggugaaggacaagacccugcaggagucgagcuuugaggacaucauggccaccagguccuccgacuggcuccggcggccuuugggggaggacaaucagccggagacccagcuguucugggacaaggagccuugguuuuggcacgacacucugaccgagcaacucuggcggauuuuugccggcguccacgaugagaaggcaaagcccagagacagacgugagugucccugagggugagggggaaggggcagccacaggcugcgucucaggggcugugcagugaacccugcuguucucucugucccccuccuccucuccguugucauggugacagagcaggcaccaggccuggugaguaaacaaccucagcucuauccagaggggugggcuuccgggcaggcgguugggcucccccaggucagggcacugggguuccugugggauuugucuuccuuccauccugccccucgggucccccgggggggacuugggugauccaggaggcuauacuggaguagcccaggacccacagcccagggcuuccaggacccuauacccugacucucucucugcaacucugccuggacccgcagacaggaccccaggcagcugacaagcccugugcaagcugcccaggaauccgaggucuucugguccuaacaggcaggucagcaggccugaugagacuuuuccauuuuccaggggcaggaaagcaaggcaccaggauccugugacccaggaacagacccauguccugaagaugccuccaguaaucccagcgggcaggggccgaccgacuccaggcgggauggggugggggcauccugugcugaggagccaaugcaagccgcuuagccccucuugucuccccacuagcccccaggccaccugaggccuccuccagucccccugaggguucccaagacaggaacacaaguuggggugugguccaggugagacccaggcccgagcugguagcccagcgugaaggcugcccagggugggguagaggaggugggcacagaugugcggggaggcugggggcagcugugaucucccccgccugcaggagccuccuggaagagccucucgguuucuacaguccauguaagugucugcacuguuugcuuuugggcggggugaggggcagcgggaauuccuuccugucuauaccucuguucccgacacauagaggggaacagagguguaagacuuucuuccccuuuucccaucacuacucugccauccucuccaacagccgcugcagaggcuggguagaaaagugcaguguuaggccgggcgcgguggcucacgccuguaaucccagcacuuugggaggccgaggcgggcagaucacgaggucaggagauugagaacauccuggguaacacggugaaaccccgucucuacuaaaaauacaaaaaaaauuagccaggcgugguggugggugccuuuagucccagcuacucgggaggcugaggcaggagaauggcgugaacccgggagguggagguugcagugaguugagaucgcgccacugcacuccagccugagugacagcaagacuccgucucaaaaaaaaagugcaguguuaggcucacaggaucgccgccccaacacugggcucaaggcauuuggggaagacuuuuucauggaaggggaugggguguagcuguguuagaacuggaugcagauugucccaaccuuguggagugaugcugggagaacccagguggggcaaagaaggcuuuucuggggaaggagcauaauagcuaggaccauaaaggaugaauaggaguucuuccuccuggggcaaagcagucuaggaagaaggcagaaguauguggagggcuguggcaaagggacaauacuugaaggaauaugagcaggacauugaggggagucuagaggguaaaacaaggccugagagagggaccccaaaaucugaaaaagaagccccucuaggccuugauguguggcucccacugggcaaaggggcucacaagcaggucaguuaccccaaggccuccccucccaagauccugggacccugaggacuuugaagaugcauggaagaggccagaugccuugcccgggcagucaaagagacucgccgucccgugcaaacuggaaaagaugcggaucuuggcacacggggagcucgugcucgccacggccaucagcagcuucacgcggcacguguucaccuguggcagaagaggcaucaagguguggagccugacuggacagguggcugaggacagguucccugagagccaccugccuauacaggugaggacggccuugguuuccagggaugcagggcuucugggaacaggggguuugagguuugagucuggcagagcccagaucguggagagagggcuuccagggaaaaggggcauaauagcuaggaaccuaaaggaugaauaggaguucgcucucaugaggcaaagcaguccaggcagaaugccacggggggcgacagcucacagugacucugcccaucccagaccccuggggccuuccugcgcaccugccugcuguccucaaacagcaggagccugcucaccgguggcuacaaccuggccagcgugagcgugugggaccuggcggcgcccucccugcaugugaaggagcaguugcccugugcaggucucaacugccaggcccuggaugccaaccuggaugccaaccuggccuucgccagcuucaccagugguguggucaggaucugggaccugcgggaucagaguguggucaggugcguuuggggggugggaaggggaagcauccugugccagccuccuguggccaccucugcccaccuuacugcuaccaccucugcccgccuuccugccaccuccugaaccugggauauagcacucucccagccaaaaccccuugcccccuugaacuuggauuugagaaaguuuagaggugcggacuugaaucuuggcuggacugcguuccuugcagcccagggcauuuuacuuuuugucugccucaguuuccccaccuggacacaggaugugacagccccaaacucaaaggcuuguuagagggcaaauuuguuguaaaaauauaaaacagcaggccaggccuggugccucaaacauguaaacccagcacuuugggaggucaagacgggacaaaugcuuaagcccaggaauucgagauuaaccuggguaaugaauaaaacgaauuuauucuauuuuuauuaaauagaauaaauuuuauuuaauaaaaauuaaauagaauuuuuauauagucuauuuaaaaauauguauauauaaauuggccgggcgcaguggcucacgccuguacucccagcaguuagggaggccgaggcaggcagauccacgaggucaggagaucaagaccauucuagcugacacggugaaacccugucucuacuaaaacuacaaaaaaauuagccaggcgcggugguggguaccuguagucccagcuacucgggaggcugaggcaggagaaucccuugaacccgggaggcggagcuugcggugagccgagaucugugccacugcguucccagccugggcgacagagcaagacucugucucaaaaaagaaaaaaaaauacacacauauauaaauaaauauauauauaaauacauaaauauauacauaaauauauacauaaauauauacauaaauauauacauauauaaaaaacagucugggugcggugucucacaccuguaaucccagcacuuugggaggccgagguggguggaucacuugaggccaggagcucaagaccagccuggccaacauggcgaaacccccucucuacuaaaaaauaugaaaauuagccggcgugguggcacaugccuguaaucccagcuaccccggaggcugaggcaggagaaucgcuugagaagcggaguuuguggugagccaagauggugccacugcacuccagccugggucacagagugagacucugacucaaaaaaaaauuuuacauacauacauacauacauacauacauacauacauauauguauacacacacacauauuaaauauauguaaauaggcugggcaugguggcucaugccuguaaucccagcacuuugggaagccgaggcgggcagaucaccugaggucgggaguuugagaccaggcuaacauggagauaccccaucucuacuaaaaauacaaaauuagucaggcgugguggcccaugccuguaaugccagcuacucgggaggcugaggcaggagaaucgcuugaacccaggaggcagagguugcagugagcugagaucgugcugcugcacuccagccugggcaacaaaacgagacuccauuucaaaaaaaaaaaaaauacguauauauauauauauauauacacacacacacacacacacacacacacacauauauauaauauauguauuuauaacauauaagauaucuaucagcauauguuugcaggaagcaauggcugacguaaaauacagcacaccacccgcccggcacuauuccccuucccugcuugaagggauuccuguagaccugccucagagcucggguggacucaggguggaagaggcaaggggaggccuaggugaggccaaggggaggcccaggcggacggagaagggaggcugagggcugggaggggccggcacuagauccugugucuguuuucugccaacuuugacacucugugcaggcagagauuuuugggugguggcacugucccuuucaugcccaaauguagugacugguguuuccgggggcccaaaccucagagucuugaccugauugccucccgaugucccuucuggccagggaccucaaggguuauccugauggagucaagaguaucguggucaagggcuacaacaucuggacuggggguccggaugccugucugcggugcugggaccagaggaccaucaugaaaccucuggaguaccaauucaagucucaggugcggaggccgggauggggucugcuuggccaggcauccucugguccucagauuaaaaaaugagguugaggccgggcuccguggcucacgccuauaauccuagcacuuugggaggccaagguggguggaucaccugaggucaggaguuugagaccagcguggccaacauagugaaaccccaucuccacuaaaaauacaaaaaucagagcugggcgcagaggcucacaccuguaaucccagcacuuuuggaggccgaggagggcaaaucaccugaggucgggaguucaagacgagccugaccaacauggugaaaccccgucucuacuaaaaauacaaaauuggccaggcaugguggcacaugccuauaaucccagcuagucgggaggcugaggcaggagaaucgcuuaaacccgggagguggagguuguggugagccgagaucgugccauugcacuccaggcugcgcaauaagagcgaaacucugucucaaaaacaaaugagguuggccaggcacaguggcguaugccugcaaucccaccacuuugggaggcagaagugggaggaagacuugagcccaggaguuugagaccagccugggcaacauagugagacccuguuucuacaaaaaauaaaaauaaaaauuagcugagcaugguggcacguaccuggggucgcagcuaguugggaggcugaggugagagaauggcuugagcccggggaggcugaggccacagugaacugugaucauaccagugacuguaguccagccugggugacagagugagacccugucucaaaaaaaaaaaaaagggggggaggcgggugggggggggggaggaugaacucugggaaggaaaaaagguagugguucuaagucucacugaugcuccaaacacagagaucauuagaaauauucuuugcaggccgggcgcagugucucacgccuguaaucccagcccuuugggaggccaaggcggguggaucauuugaggucagaaguucaagaacagccugaccaacauggugaaaccccgucucuacuaaaaaaaaaaaaaaaaaaaaaaaaaaacagaauaauuagccaggcaugguggcgcaugccuguagucccagcuacucaagaggcugaggcgggagaaucgcuuaaaccccaggaggcagacguugucguaagccgagaucguaccauuguacuccagcccggcaacagagcgagacuccgucucaaaauaaacacucaugcuguaucaggugcaaaguagggaagacucuccauuuuacacaccaacaaacugaggcacagauacgaaguugcuugucccagggcugcacagcuaggaaggggucagucacccggccuccaggauagguccccaggcuccugccugcuuccugggccaggcugggaccuaaccagguuccucccuccccacugcccauuaccuagauaaugagccugucccacagcccccaggaggacugggugcugcugggcauggccaauggccagcaguggcugcaaagcaccagcgggagccagcggcacaugguggggcaaaaagacagcgucauccugagcgucaaguucucccccuuugguaagcggcuggcggaagaugaggggacuccccugcagcccccagccucccacaagaccccaccuaaugccagcuccccacccaacccucuaggacaccucagaacccuucuguagcagaaaccaauuuuggggaugcucuuauaguggaaugagggagggaagggggugggugccugggcccuuccuccccacccgccccaccggcgcgguccgccuccgcccuucccccuucagccacugguguccccaugagcccggggaggcugaggccacagugaacugugaucauaccacugacuguaguccagccugggugacagagugagacccugucucaaaaaaaaaaaaaaaaaaaaaagguggguggggaggaugaacucugggaaggaaaaagguagugguucuaagucucgcugaugcuccauuucucccaggccaguggugggcaagcguuggaauggacgacuuccuuggcgucuacagcaugccggcggggacaaaaguguucgagguacugcggugggcugggggcaggacccggggguggccccaaagggaccagccugggcaacacagcaagacccugucuccacaaaaaacuuaaaaaguagccaggugugguggcucacggcuuuaaucccagcauuuugggaggcugaggcaggaagaucucuuaaguguaggaguucgagaccagccuggccaacauagugagaccccaucucuacaaaaaauaauuagcugagccgggugcgguggcucacgccuguaaucccagcacuuugggaggccgagacgggcagaucaugaggucaggagaucaagaccauccuggcuaacacggugaaucccugucucuacuaaaaauacaaaaaauuaguugggcgugguggugggcgccuguagucccagcuacuugggaggcugaggcaggagaauggcgugagccagggaggcggagcuugcagugagccaagauugugccacugcacuccagccugggugacagagacuccaucuaaaaaaauaauaauaauaauuaaaaacacuuuuaaaauuaaaaauaauaauuagcugagugugguggugcacaccugcggucccagcuacuugggaggcugaggcaggaagauugugugaguccaggaggucgaggcugcagcaagcugagauugcaccacugcacuccagccugggcaacagagcaagacccugucuuucuuugaagagaugaugcuucaugcuugagcugacagguggagaccaggggugugugagcccuaccccagcucacugcccacugcccccccuccaggugccugagaugucuccagucacgugcugugacgucucuuccaacaaccgccucguugucacaggcuccggggagcacgccuccguguaccagaucaccuacugaggggccucgcugcugucaucccacuccggcuccucuuuucauccccccccuuccccccccccaacaagggggacaugguggagggaagcgggaaggcucuucuguggcaucgcacgaucuagucugugguguagacuggucgccaucacguguaauaaagcacccgggaaaggcagagug

SEQ ID NO: 192182 - RNA, 8491 nt, Homo sapiens
gcuuccggcggaagcggccucaacaagggaaacuuuauuguucccguggggcagucgaggaugucggugaauuacgcggcggggcugucgccguacgcggacaagggcaagugcggccucccggaggugagcgcgucugagggucccgagcaucgcgccccagggccgcgggcugggagcggccggauggcaggggggcauugugggaauaucagggggcacugaggcuagacaaugggagggacuucccagugaggaaggggcgggaagugacgccccugcgcgccgggggacgccaacacgcccaacucuguggucacccugucggggcugaucggggagagaggggauguaguuccaggaagaggggacgacaggcgcaaagggaggugggaauaaacacaccuggagaacgauuaggccugggagguuuccagagccgggccaggacggggcucaaaugccaggcuggggaguuggcacuuuauccugagggugauggggaaggguuuugcccuggcgaggggacuggacagaaugugccagaaagaucccuccagccacucagaggggaaguggagggaucggcugcccccuccacgcacugugggacuuuggggaagucacuucccuuuugggucuccaucuccaaacuuucugcaaacgaggugaagauggccccauuccauaaggcuggcccaugcauucugacucaugcauuuaaugagcgcugauggugugcgcccguccagaagccccacucuucacugcugcuguuagucacuuuauuauuauuauuauuauauuuuugagauggaguuucucugucgcccaggcuggagugcaguggcgcgaucucggcucacugcaaccuccgccuccuagguucaagcgauucuccugccucagccuccugaguagaguagaugagacuacaggcaccugccaccacgccuggcuaauuuuuguauuuuuaguagaggcgggguuucaccauguuggccagucugcucuugaacucuugaucucaagugauccacccaccuuggcuucccaaagugcugggauuauaggcgugagccaccauacccggccuguuagucacuuuauuccaccaacauuuauagagcacuuacuguagcucaggcacuuucuagguacuaaggccacagccaggagcaacacagauuaaaaaccccuccuucuaguaagggagacugacuagggguugcauggaaaccaguuggccaagggaggcaucacugucacugaagugacaucuaagccacaaguuacaggaggugagggagggagccauguggguaucugggggaagagcauuaaaggguguggcccugaggcgggacugugccuggugugauagaggaacaaggaggagaccuguguggcuggagcagagugaggcagggagagggaggagaagagggcagggagggggcaagggagguagugcagggccuggugggccgugggaagggcuagggcuuugacaaggcaggugggaggcauggaagguuguaggaagaggaggggcaugaggacaagcugccuuuuccaauccauuuuccucccucaggcaagacagggacagcucagucuguggcucgugcguggccuugccacuugggggaacuguuuugaccccuccgucugcucucuccccccacagaucuucgaccccccggaggagcuggagcggaaggugugggaacuggcgaggcuggucuggcagucuuccagugugguguuccacacgggugccggcaucagcacugccucuggcauccccgacuucaggucugugauugugcaggggaagucgaggcaaggccuaccaggcugccagaggcuucccugcgagccacacacaucugggaaugagaacacauccaucugcuuuccuccuggauguguccuggguacucccuuuaagaugugucccuuggcugggcaugguggaucacaaggucaagaauuccagaccagccuggccaauauggugaaucccugucucuacuaaaaauacaaaaauuagccaguugugguggcacacaucuguagucccagcuacucgggaggcugaggcaggagaauugcuugaaccugggagguggaggcagugagccgagauugcaccacugcacuccagccugggcgacagagugaggcuccgucuaaaaacaaaacaaaaagaugugucccuugucacaaccagcauuccacucaccucauuggccagaacacggucaccugaucacaccuggcugcaaggguugcugggaaauguagucuuucauauuugcaagcguagccaggugugguggcaggcaccuguaaucgcagcuacuuggaaggccgaggugggagaaucgcuugaacccgggaggcagagguugcagucagccaggaucaugccauuguacuccagccugggcaacagagccagacuccaucucaaaaaaaaaaaaaaaaaaaaaaaaaaaaagccaaggcgugaauuucuccuccuucuccucuuccauaaccugcuguggcuccccauugccaggcaguguagaguucugaauaccuugugcuggaagcugaagcccuuccugccccagcccugaaucaccucuccaacuucagccccuccugcuccugcugcagcccccaaaacacuugcauuuucuccuaaacucaugggcucuucccagcacccaggccuuuguuuaccccuucugucugaucuucccucucacccuucaagaaacugcuuagccuccuccaggaagcccuuccacgugccccagggcccccaccuccacggggcuuccccaggcccagguaccuccucugauccaggcuugacucuuggggccagaggaucuguguccaccugucucccccaagaucaagggcuucuggagggcagggcuugggcccaugugagcaucgucgggcucauugcagcagcaguguugguugaauagaauaagucauuuuugccuucgugugaauucaucucucucucucugccucucccucucucugucucucuccaauucugucucugacuugcuuugucuuuaacucuuuaucucucugucugugucuuguucuaucccccucucccuguucuugcaacucacccucuauuucuguuucugauucccucucucugucucccugucucucucugucuccugauuuucucucucuccaacuuucucucuauaccucucugauucucccucugucucuuuuucuguuccccucuccccguccaucucucccggccugccaccuucagggguccccacggagucuggaccauggaggagcgaggucuggcccccaaguucgacaccaccuuugagagcgcgcggcccacgcagacccacauggcgcuggugcagcuggagcgcgugggccuccuccgcuuccuggucagccagaacguggacgggcuccaugugcgcucaggcuuccccagguaacacccuggccccgcccccacaaaagagcuuggggccccacaaaccguguuugcauuuuuagggggagaguccccuuuuccugguucuauaagauucuagcccugaguucuuggcccaguguguggagaucucugagucccauggcucagagcugucccggcugaggccagaggcagaauuucccucgagauggggcuaaggggaggagagcugucagggucuagaaguugcaguuuguuuuuuguuguuguuguuguuuuugagaccgaguuucguucuuguugcccaggcuggagugcaauggcgugaucuccgcucagccucccagguucaagcgauucuccugccucagccucccuaguaacugggauuacaggcaugcgccaucacacccagcuaauuuuguauuuuuaguagagacgggguuucuccauguuggccaggcuggucuugaacuccugaccucaggugaucugcccgccucagccucccaaagugcugggguuacaggugugagccaccacgcuuggccuguuguguuuuuaauauccaucuuuauuaaucugacacuaaacgugucugacacugaagugaaccugugcucuggggcaggcugauuucccaauaaaaguguggcccuccccugccccucuuugccaggucucaccccuggggcaaccaaugacagccaggucaguuguugagacgaggagcucggcagccaggggugaggggugaggaagagauuuuucucugcuuauaaaagcaaacgaggggccgggcaugguggcucacaucuguaaucccagcacuuugggaggccgaggcaggcggaucacgaggucaagaguucgagaccagccuggccaacauguugaaaccccaucucuacuaagaguacaaaaauuagcugggcgugguggcgcaugccuguaaucccagcuacucgggaggcugagucaggagaaucgcuugaacccgggaggcagagguugcagugagccgagauggcgccacugcacuccagcuugggugacagagcaagacucugucuugaaaaaaaaaaaagcaaaggagggucagguguggugacuuaugccuggaaucucagcacuuugggaggccaaggcgggcggaucaugaggucaggagaucgagaccaucccggccacaugguaaaaccccgucucuacuaaaaacagaaaaauuaggcuggguacaguggcucacgccuguaaucccggcacuuugggaggccgaggcggguggaucacaagcucaggagaucgagaccauccuggcuaacacggugaaacccugucucuacuaaaaauacaaaaaauuagcccggcgugguggcgggcgccuguagucccagcuacucaggaggcugaggcaggagaaucacuugaaccccggaggcagagguuguggugagcugagauugugccauugagguuguggugagcugagauugcaccauugcacuccaaccugggcaacaagagcaaaacucugucucaaaauaaauaaauaaauaaaauaaagcugggauuggaucucaugcuucagggccauucaaugucucgguuucuuccauuauaaacugggaauuugaauuccugugcuucugaccuggugacaucaagagguucccauaugcucucggagggggacgggcauuuugugaguggaaagggcuucccguuaucuaagguggguucagccuuggggguuaaugauuccuugggcucagagagguugguccacuugcccagagaugcacagcagaugaaugguggagccaggagcuagaagagccagaaagaaggaguugaucaauguugugggagaggaguccgggaagccuuccuggaggagaggggcuuagcaccagcuccaaagccugggcauccagggauccuuucccaccaucaagccucuuccugcucuucccacagggacaaacuggcagagcuccacgggaacauguuuguggaagaaugugccaaguguaagacgugagugccaccugggugcaggggugggggcucugccagaggggguugggggucgaauccgaugucccagagacccagaggguauggggggacugggguguggcccuccuggggggaucugggggcgugucucccucuuggggggauauaaggaguaugucucccuccuggagggauuuggggggcaugucuuccuccuggagggauuugggggggccgugccucccuccugugggggguacauccguguccuggcacugcuguagcaaccugccacagaugagcagcguagaacaauagaaauuugugaucucacaguucuggggaccagaaguccaaaauccaggugucugcagggccaugccccucugcaaccuguaggggaggauuuuuccugccuuuuccuggcugcugguggcagccagccacccuuggugguccuggaccuacagccacaggggccuucuuaucucuguguuucuccuuuuuuuugagacagucccgcucugucauccaggcuggaguacaguggggcaaucucggcucacugcaaccuccgccucccggguucaggcaauuauucugccucagccauccaaguagcugcaacugcaggcgcccgccaccacaccuggcuaauauuuguauuuuuaguagagacgggguuucaccauauuggccaggcuggugucgaacuccugaccuugugaucugcccgccucagccucccaaagugcugggaugacaggcgugagccaccacgcccggcccaguauaacgauuaaagucaggaaaaguaaaguggacaucgccuucucuaaucccgaauccagacucggccugucgcccccaugcuccaauuguuccuguuucuccugguccgggaucccaugcugggucuugucucucgagccccuucgucugucugggacaguuuccugcuuuguuuucugugcuccgggcaccgagcagcaucccagcccguuauucauggaaggcuacucguuccgugucgcugggugcuaguucuggucaccuguccaccccccaccucccugggagaacgucacccuagaaacagugcgagagucacccaugggagcucaccuggucccauccucccccuuccucccugacacaggcaguacguccgagacacagucgugggcaccaugggccugaaggccacgggccggcucugcaccguggcuaaggcaagggggcugcgagccugcaggugagccacccccacccaugcccugggcuccaggggaggcugcgaggccccugaggacucuccucagcuuccucauugcaggggagagcugagggacaccauccuagacugggaggacucccugcccgaccgggaccuggcacucgccgaugaggccagcaggucugaccccccacccccagggagcccaugguggggcggggcgggacgacagcagaaacacagccagcuccagcaugggacaguggcugaggcucacaggcagugaggggaggcuuccuggagcaggugggccaggccaggggcugcacacacgcacucacacacacucgucaccucauggcucugggugggugcuacacaaggaaaccaaggcuuccgccaggugucuccucuauccagugcugcccagccgggaggugaccgagccagggucccacccuagguguccaagcucuuaccacacugugauacuccccggaagugucuaagggcccgcccagaucaaugaccccgccaacggaccgcagaggagggcagggcgggaucccaaaggcugacucgggaguggggcuggccuugaccgccccggugagcacagauggccuaggugugaaccggcccccagggcuggcucgggauguuggcaggagcagggcaucaggcucagcccacgcuccccggccccaggaacgccgaccuguccaucacgcuggguacaucgcugcagauccggcccagcgggaaccugccgcuggcuaccaagcgccggggaggccgccuggucaucgucaaccugcagcccaccaagcacguaggugucugagccuaccccugcccagggccaccaugcacccucugucccccacgccugacccgucccgccccucggcaggaccgccaugcugaccuccgcauccauggcuacguugacgaggucaugacccggcucaugaagcaccuggggcuggagauccccgccugggacggcccccgugugcuggagagggcgcugccaccccugccccgcccgcccacccccaagcuggagcccaaggaggaaucucccacccggaucaacggcucuauccccgccggccccaagcaggagcccugcgcccagcacaacggcucagagcccgccagccccaaacgggagcggcccaccagcccugccccccacagaccccccaaaagggugaaggccaaggcgguccccagcugaccagggugcuuggggaggguggggcuuuuuguagaaacuguggauucuuuuucucucguggucucacuuuguuacuuguuucuguccccgggagccucagggcucugagagcugugcuccaggccagggguuacaccugcccuccguggucccucccugggcuccaggggccucuggugcgguuccgggaagaagccacaccccagaggugacaggugagccccugccacaccccagccucugacuugcuguguuguccagaggugaggcugggcccucccuggucuccagcuuaaacaggagugaacucccucuguccccagggccucccuucugggcccccuacagcccacccuaccccuccuccaugggcccugcaggaggggagacccaccuugaagugggggaucaguagaggcuugcacugccuuuggggcuggagggagacguggguccaccaggcuucuggaaaaguccucaaugcaauaaaaacaauuucuuucuugca

SEQ ID NO: 192183 - RNA, 41461 nt, Homo sapiens
guggccuggaggacucauuuaagaaucauguguugaguaccuacuuuguacugggcacacuggagagcaaaggugguaccaucuaugcccugguggcugcggguggacacaaacaugugaccagguaauggugacauggugugguuggggugcaaugggugaugcagagggcacagggcagugagggggcucacaggaggcaccugacccaggcugggggcauccgggagggcuuccuggaggaggggauguugcagcaaagaucuaaaaagugagugagccgggcgcaguggcucacaccuguaaucccagcacuuugggaggccaaggcagguggaucaccugagauugggaguucgagaccacccugaccaacauggagaaaccccgucucuacuaaaaauacaaaauuagcugggugugguggccuguaaucgcagcugcucgggaggcugaggcaggagaauugcuugaacccaggaggcggagauugcggugagccggagaucgcgccauugcacuccagccugggcaacaagcaugaaacuccgucucaaaaauaaauaaauaaauaaauaaagagugcaugagucagguagagccgguuggggugacaugaaguacagaaagaauguuccugguggggggaacagcaagugcaaaggcugagaaagaggaagagcauggcuccuuccagaaacugaaaucaguccagugaugauagggaagaucgugggugucuucccgccagagccaguuggccaacaggcaguccgcugccagccugucuccucccucggcucauccccggcccccuggggcggccgccugcucagagccgaucaggugucagaguggagcggcuggagcugcucguggcccagcugggaguggguaaccggagccggcagugggcacuguggccgggagcucggggcacuggagcugcaggagguaggggaggaaggaggugggagaggcccaggacggaggauccccuuauggccccaggccccugagcccuuguaugugggagaaagaagccgugcugaguccuagccaggcugcggagcuacccagguacccugacacacacaugcacucguucacccacgcacuucccacuugccggccugugcccugccuagcuuccuccaaggcaggugcucaacaucccacccggccaucaggcccuucuuauuuaccaucaccucuuccagcaagcagcuuccuaaauuuagcaggcguuucucccucccccaagcccacggauugucuucucccaagcagccugugaacuccucuguugggugucuuauuacccccugcuuugggugugauugaauccuccagucagagguagaagaaaaaaggguagguagugagugaaugggcaccgguggagggguagaugaauggauggguggguggauggauggggggcgaauagguggauuggugguuugguagaugggugaauggguagauguauggauggauggguggauggaugaaugggugggugauugggcaaauggauggagggauggauaaguggauggauggauggauggaaggauccauggauggacugguggguggguggauggaugcacugguggguggguggguggauggauggauuggugguuggguggguggauggagggauggauaaguggauggaugaguggauggguggguggguggauggguggaugggugugugauugggugggcagauggguggauggauggaugcuugggcagauggauggaugggugguuggguggauggaugaagggauggauaaguggauggauggguggaugaguggauggaugaauggugggaguugguagguguuuggguggguggauggaugugugggugaaaucugauuaaagggugaugaagaaccaugagaacaugaauuggguggguggguuugugggugguggccagugggugguuauacagugcuuaggugggaggauggauguccaggugagugcauaggugguaaaugcguggaaggguggcuuggagaauucacgaguagauagguggacagguagaggccaugccaaccccuacuccuugguaagaggcaaauacagauucuccaucacagaaaucccuuucacacauagggccucacagucacaccccucaaaaaacacacccccucaagauaggccugccugaccuccgugccugcccaugcggaacguagaacaggcccagguggacagaagugcacgugugcacacgccccacacucaacgucacacacaugcaugcagccauugccccagaccuccacccacuaugggugaauugcugucacauggagguucccucugacuauguagcaaacaugccucugugcugagagccgucagcccuggcuucaguccccagggagccccugacuguugaaaaggacagaaucagcccagacccuuccagcccauggagccaggggugaggcagaggcagagacccagccaggguaggcgggaacccaauuuggggaguuagaucucugcuugggaacaagaggcaaagcugauaagagcaagggauuuuggaacugggcuuugaaggaugaguaggaguucagagaagaaaaaagaaaccauucuaggcagaaauaacugcacagguaaaaguuaggagaccagaaaaggcuugaucuguuuggaccgcaggaaauaccagugagaugcauuuaugaagccccucauguuuggccaggcucuguguagggaccaugcugaaaacugaccaugaguuggucaagaaaggaucauuucugucacuguauagaugagggaaguaaaacagagagggcaaguaaacugccaaaggacacacagcagguaggagauagagcaggucugugucuugcucuaggggccaggacuggucaggaaggaggaagcgguccuuuugaggagggcgaggcaacggacccugccgcccaccaggacuggugucccucaccuuacccccacccuugcccuccucagguggccuguggagaggagaaacacagggcaccaacuaugaagacucucagggcgcgauuuaagaagacagaggugagugugaggcccuagaugcccgauacaccccugcaacuucagccuucugucuccuggggcuuggcugaagauccacccuuucauuccaguacccaccucuucuccuuuccucucugcugcccccuagcgucaugaccuccccacugcuccccguacaagcuuuccagcccaggccuuuacccaggcccuaguccgcucuccauggaauuccuucucgccgcauugccaccaaucagacccuccuaauuccucacaauuuggccccaguaccaccuccccguccaaucuccgcucuccccggccacaguaaccccuugcuuuuccaaggacccacuuucccgaggauccugaucuuuugcuuugguguguguguacucagcacauauuuauauagcaggcgcuguuccaggcacaggggaaucagccagggaauagggcaggcaaaaauccuugcccucguggagccgaccgcugaguacgggagaugaacacgaaacaagauaaauaagugacaauguguauuuugugucgcaaagacagacaaagcaggaaaagggaauugaagcauucagggcaggggagguggcugcaguuuuaaagaggguggccagggaaggcuucccagaggaggugguauuaaagcaaagauuagaaagggaaggggagggcugggcgugguggcucacaccuguaaucccagcauuuugggaggccaaggcaggcagaucacgugaggucaggaguucaagacgagccuggccaacauggugaaacguugucucuacuaaaaauacaaaaauuagcugggcacgguggcgggcaccuguaaucccagcuacuugggaggcugaggcaggagaauugcuugaaccugggagguggagguugcagugagcugagauugugccauugcacugcagccugggcaacagagugagacuccaucucaaaaaagaaaaaaaaaagaaaaagggaaggggagugggggagagaguuugcaggaauugcauuccaaguggcuggaacagccagugcaaaggcccugagguagauccagcugucuucucuugcauccgugucuuuggcuaugaacuccuagaaagacaugcuucuuccuccauuguccccauucuucucagcccccucaagucccuguggcggccaauucagggcacagauggggaggaugaaagggagggcucaccuccagggacaggcaaucagccuuccugagcaccucuuugugccuggccugggugggcaagcuugacuuggagccuuuaguuuucguaucaugggauacaacauccccaucugguguggccuggagaaaucagggagucugccuggaggagguggcaccggagcagagccuggaagaauagggaggauuuagagaagugaaggcaggcacgugaggagcggggcacggaccuguguggguaaagauucggaggcuggaccaggucugcuugaugcacaggcauaacaggcagauucucuuggcaggagcagagagugcgagugagugggagcucaggaucuuugaaagccauuuuugaaaagccaaaaagagaggccuguggaacaagccuggauuucauuuuuuauuuuauuuuauuuuauuuuugagauggaguuucccucuugucgcccaggcuggagugccguggcuugaucucggcucacugcaaccuccaccucccggguucaaguaauuuucuugccucagccucccgaguagcugggauuacaggcacgcaccaccaugcccagcuaauuuuguauuuuuaguagaggcaggacuucaccauguuggccaggccggucuugaacuccugaccucaggucauccacccgccuuggccucccaaaaugcugggauuacaggcaugagccaccacgcuugguccauuuuuuuuuuuuuuuuuuuuuuugagacagagucucuuucugucacccaggcuggagugcaguggugcuaucucaaccgacuacagccuccaacuccugggcucaaacgauccuccugccucagccucccaaagugcagagacuauaggcgugcaccaccacacugggcuaauuuuuauuuuuuguacagaugggguguagcuguguugcccaggcuggucuuaaacuccuggccucaagcgauccuccuaacucccacccagagugaugggauuacaggcgugagccacugcgcccagccaagccugggauagaaucagguggcucugaguucaaauccuuccucugucccugguguccugggugacucuggggaugucaugcccccucuguggcuuccuucaguuguuugggcucauuugauuugauuugauuucauuuauuuuugagacagagucucacucuguugcugaggcuggaaugcaguggcacgaucucugcucacugcaaccucugccuccugaguucaagcaauucuccugccucagccuuccaaauagcugggacuacaggcgccugccacuauggcuggcuaaauauuuuguauuuuuaguagagacaggguuucacuauguuggucaggcuggucucgagcuuccgaccucaggugauuugcccgccucagccucccaaagugcuggaauuacaggcgugagccacugcacuccgcccauuuuauuuuguuuuuaaacuauuuauuaauuaucauguacccauucauuucauuauucauuuuuauuuuauuuaaaacauuuuaauuuaauaucauuggauucacuuuauuuuuuuuaauuuuucuuucuucuuuuuuuuuuuuuuuuuuuuuugaaggagucucacucuguugcucaggcuggagugcaguguugugaucuuggcucacugcaagcuccacuuccuggauucaagcuauucuuuucuuaugccgcagccucccaaguaggugggacuacaggcacgcacuaccacgcccagcaauuuuuuuuguauuuuuaguagagauggguuucaccauguuggccaggcuggucucaaacuccugacuucaagugauccacccaccuuggccuuccaaaggguugccauuauaggcaugagccaccaugcccggcccuaaguuuuuuuuuuuaagagauggggucucacuauguuguccaggcuggucucaaacuccugggcucaagagauccucccgcuucagccaaguagcugggacuacagaugugcaguacugugcccggcuuauuuauuuucauuuuuguugauuuuugagcacuauaaaaaauauaagaugugcuuugcaggugucagcucauuuaauccucaccaccguguuaugaggcaggagcuuuuauuaucuucauuuuauagaugagggagggaagcccagagagguuaagacaccugcucaaggucacacagcuaggaagugagacacaagccuucccccagggcugcguuacuaugaacaugauuggccuggaggugggaggggagugcauugauugaaaagagaauggguggagacagacagcgggagagaaagaggugaaaaacgguccauuaacugccuacaaaauguggcauugggugagcuucauucacuguggagugauccuaaaauuuuucuucccacguggacucaauuccucgaugauaguugacccuugaacaauuacagcccacccuccugcacagucaaaaauccauguauaggcugggcgugguggcucacaucuguaaucccagcacuuuggaaggccgaggugggugggucacgaggucaggagaucgaggccauccucauuaacacggugaaaccccgucucuacuaaaaauacaaaaaaucagccgggcgugguggcgggcgccuguagucccagcuacucgggaggcugaggcaugaaccugggagguggagcuugcagugagccgagauggagccauugcacuccagccugggcaacagagcgagacuccgucucgaaaaaaaaaaaaaaaucuggcucggcaugguggcucacgucuguaaucccagcacuuugagaggcagaggcgggcagaucaccugaggucaggaguucgagaccagccuggccaacauggugaaacccccucucuacuaaaaaugcaaaaauuagccaggcagccgggcaugguggugggcaccuguaaucccagcuacucaggaggcugaggaaggaaaaucucuugaacccaggaggcagaaguugcagugagccgagaucacgccauugcacgauugcccagccugggugacagagcgagacuccgucucaaaaaacgaacaaaaaaauccauguguaaguggaccugggcauucaaacccauauuuuucaggggucaacuccugaaugcuuuuuuuccccaagcauuccucagaaguaguagccacugguaaaccaagccauaugauugcuuaauuuccaaagcauaguuauauuuaauauuuaaguaaaucuuucaagaaguguggguggcuaaaaaagagauaccucauucgggauguggguguguuuugauauguuugcaaugggaggggucgggacaaagucaaaauuggauggggacaggauagguguuaaaaccucagacgggugugagggccucugagagugucuggagcuggaggggccugagguuagcccauagccugggcuggaacuguugcagcagaugggaggccuggcuguugcugggaagcugcagggccuccauccuccccucccagagcaccuugccauccaucccuccaccugcccuucuccaguuucgcagcaggcagccggagucaaguucagcuuuuguucagcagccccgagggaagaaagcaaacacccaugacugcaggggccaggccccccccuccugucacugggaccuuguguuccgugucuucuagccacugcuaccccucuccuccucuccuuagggcacucuccggccuuuccuggucccuaacaccggcuuuuucuuauuuauguauuuacuuuuauuuuauuuucuuucuuuuauuuuuauuuauuuauuuauuuauuuuugggacagagucucgcuguguugccaggcuggagugcaauggcaugaucucggcucacugcaagcuccgccucccggguucaagagauuauccucucucagccucccguguagcugggauuacaggugcacgccaccacaccuggcuaauuuuuguguuuuuaguagagacgggguuucaucauguuggccagguuggucucgaacuccugaccucagaugauccgccugccucagccucccaaagugcugggauuacagacgugaaccaccguccccagccuauuuauuuauuuauuuugagacagagucuugcucuguugcccaggcuggagugcaguggugugaucuuggcucacugcaaccuccgccucccggguucaagggauucuccugccucagccucccgaguagcugagauuacaggugccuaucaccacgucuagcuaauuuuuuuuuuuugguauuuuuaauagagauggguuuugccauguuggccaggcuggucucaaacuacugaccuccaaugagccauccgccucagccucccaaagugcugggauuacaggcgagagccacugugcccaaccaacaccguuucuuucuuuggggucccaacaguuggcauugcuuacucugaucccccuugggcuguccgugggccucaguguuuccauccauaaaaugggaguuaccuggagcuguucacuuggggcuucacugaccuccugccuuuacuuuagguuucaggaaaaucucccaagugggaagauugggguuucuagagagucacagacuccauacaucaaugcuuccuggaaaguccucuuucucuuucugucuuuuuucuuuuuauauuuuuauuuuuuacuuaaguaugcauuuuuuuuuuuucagaggugaggucuuaccacguugcccaggcuggucuugaacuccuggccucaagcgauccucccgccuuagccucccaaagugcugggauuacaggcgugagccaccgcgcccggccaggccucguauuuucauuuuucaccgagcccugcaaaaccuauagcugguccugcauggaauacagcagugacuaagauagacaaaaaucacugccccugaggaggugacauucuaagggagagaucaagaggaaacaagcugggcgcaguggcucacgccuguaaucccagcacuuuaggagaucaagaugggaggaucacuuaagcccaggaguuugagaccagccugggcaacauagcaagaccccaucucuucaaaaaaaauucaaaaauuaguuggguaugguggugugugccuguggucuccaguuacucaggaggcugagaugggaggaccacuugagcccaggaggucgaggcuacagugaaugaugauuguaccacugcacuccagccugggugacagagcaagacccugucccaaaauaaauaaauaaauaaaaauaaaaaaugagaguaaacagaauauuuuuaaaaagguauguaguaucuuagguggugauaagaggccuggcgcagugacucacgccuguaaucccagcacuuugggaggccgaggugaguggaucacuugaagucaggaauucgagaccagccuggccaacacagcaaaaccccguaucuacuaaaaaauacaaaaauuagccaggcgugguggugggcaccuguaaucccagcuacucaggagucugaggcaggagaaucgcuugaauccgggaggcagggguugcagugagccgagaucccuccacugcacuccagucugggcaauagagcgacuccaucaaaaaaaaaaaaaaaaaagacaacaaugaaggaaaaauauagcuaaagaaagggcugucagagaagggcucuuggaagaggcaucuccaagaguggacagcaguaaagaaagcagccaugugcacgguggggcaggugcuccaggcagaaggagcugcacuggccaaggcuuggaggugggacccagcuguuugaaggacaagaaggaggcuacuauggcagcauggauuacaccgagggaaauguaaauggagaugauggcaggcgcgguggcucaugccuguaaucccagcacuuugggaggcugaggcgagcagaucaccugagaucaggaguucaagaccagccugucaacauggugauaccccgucucuacuaaaaauacaaaaauuagccaggcaugguggcgggugcguguaaucccagauacucgggagacugaggcaugagaaucacuugaagccgggagguggaguuugcagugagcagagaucaugccacuguacuccagccugggcgacagagcgagacuccgucgggagggagggaggaaggaaggaaggaaggaaggaaggaaggaaggaaggaaggaaggaaaaacuccaugaggucaggggucaggcacuggcagaguggggcugcucagagaaggguuagcaaauuuuuucuuaaaaggccagaggauuaauauuuuugguuuguggugcagaccagccucagcucugccauugcagccugagaauagccuuugacugucuacacuuuuuucuucauauccugcauguggcauccaacgaucuacaaaugaaugggcagggcuuggccccgaaaaaacuuuauuuauggacacugaaaugugaauuguuuuguuuuguuuuguuccgagauggagucuggcucugucacccaggcuggagugcucucagguuacugcaaccucagccucccacuuucaagcgauucuccugccucagacucccgagcagcugggauuacaggcgugcaccaccgugcccagcuaauuuuuguauuguuaguagagacgggguuucaccauguuggccaggcuggucuugaacuccugacuucaggcgaucagcccaccuuggccucccaaagugcugagauuguaggcgugaaccaccgcaccuagccagaaaugugaauuucauaucauuuuucacgugucaggaaggaugauucuuauuuugcuuuucucuccccccuccaacgacucacacguguaaauaccauucucuacggaaacaggcagugggcaggaucugggcugcugugagcaguuugcauuuuaagcugagugaggucucuggaggcuuuugugcaggagagaugagaucugaugcagguuuaggaagcugccucuggcugcugggggagaagggacaaggggacaaggucagaggcugaagaagaaagaugcaucccagaggcagaaccugcagugauggggcuagacuauggugguggccguggaaggggugagaaggggcagaacaggacacagugugcagccagugggcuuggccgguggaccgaguguggggcaagagagaggugucacggugaugccagggcuuggaugaagccuggagggcugacaguauccaugguacacaccucagugggcuccgaggggcauuugcucugauugauugauugauuuuuuucagauggagucucgcugugucucccaggcuggagugcaguggugcgaucucggcgugagccaccgcgcccagguuuuuguuuguuuguuuguuuguuuguuuuuagagagggagucucacucugucacccagguuggagugcaguggcacgacuucugcucacugcaagcuccgccucccgggugcacgccauucuccugccucagucucccgaguagcugggacuacaggcgcccaccaccacgcccggcuaauuuuuuguauuuuuaguagagacgggguuuugccacguuggucaggcuggucucgaacuccccaucucaggugaucugccugccucagccucccaaagugcugggaugacaggcgugagccaccaugccuggccauuugcucugaucuuguauggcauccaggaggacaaguguaggagacaguuggaaacugaagcccugagcugggagauccguuucggucucuucucuggagaagcucagaggaccuccccacccccaaggguggaaggagagaagaguuccaaggacacccuccuucccaaaugccugucacuuuccauuuuccugccuugguucccacuccucccuccucuuguccaaacaugucuaagagggccgggcgcaguggcucacgccuguaaucccaacacuuugagaggccaaggcagguggaucacgaggucagaguucaagaccagccuggccaacaugacaaaaccccgucucuacuaaaauacaaaaauucgcuaggcgugguggcgugugccuguaaucccagcuacucgggaagcugaagcaggagaauugcuugaacccgggaggcagagcuugcagugagccgagaucgcaccacugcacuccagccuggguggaagagcaagacuccgucucaaaagaaaaaaaguaaaagucuaagaauaaucacggaccacaccgacguguaaaugcucaaugcucacccagcccuaagccaguggucaaugugucaauggagggacacuugccaguguugggauaucugugguugucacaacuuggagugcuccugguguggaguggguggaggccagggaugcugcucggcacccugcagugcccaggacagccccauucuagagaaagauccagccucaaaugcccacagugcuuccuuggugccuguccuauuaucuaucucauuuaaccguugagaaauugagagggagaauuucagagagggaaagcgauuagcucaaggucacacagcaaggaugauauaaccaaacggaauucaagccccugucaccugucugcugcgucguugcucuuaaauucuggcucuggaagaccucgguuuuguuguuguuguuguuguuuuaguuuguuuguuuuuguuguuguuuauuuguuuugcaguggagucucgcucugucacccaggcuggagugcagugacgcgaucucggcuuacugcaaccucugccuccaggguucaagcgauucuccugccucacuuccugaguagcugagauuacaggcgcccgcuaccacaccuggcuaauuuuugcauuuuuaguagagacgaaguuucacuauguuggccaagcuguucucgaacuccugaccucaggugaucugcccgccucggccucccaaaguuuugggauuacaggcgugagccaccgcgccuggccuccagggcuccuucuaaaaugccaauuaccugcaagggucuuggcugugccccagagucuccaggccugcgaaugcugcguggcauccagugggcgcucaauaaaugcuuacugcuugaaggagcaucucccccaaguguucaucugaugcauguuuguggagcaccugccaugggccaggcacuggggacgcuacagugacagaaaggaacccaaggccccuccucuaccggaggagccgugggucccaggaguggcggaaauugaccggaaauggcuagagaaugucagagcugcgccgggaccagcuagcucuuucugugaggaacgagucacaguuuuauggugcgcuuacuguaugcuaggcacuggucgacugagugcugccagguaguaccuuggcauccucccgguaacccuccgcaguaggaacuauuuauuaugaaacccauuuuacggaggaggaaggagaaguccaaaauagguaagucuguuggcccugucauauagguaggaaaggcuggggcaggggcggggugcuggauucaaauucagguguguaggauugcagcuccccaguggcgaaugaaugaaugaaugaacgaaugacugauugaaugaaugaauggaugaggcaaugagugaaugaaugaacgaaugggcgugccaaugaaugagcaaaugagugugggaaugaaugaaugaaugaauggugcgggaaugaacaaaugaaugaauggguggugaacaaaugaaugggugagugaacuaaugaauggaugaaugggugagccaacaaauggaugaacaaaugagugaguuaaugaaugcaggaaugagugaaugcaggaaggaauggugugggaaugaauaagugaaugggucauauaagaaugaaugaaugaacaaaugggugagaccaaugaaugaaugaaagagugagcaaauaaaugggugaacgaaugaacgaguaaaugaacgaaugaaugaaugaaugaaugggugagcccgugaaugggugaacaaaugaaugagugaaugaaugaaagggugagcgaauaaacaaaugggugaaggaaugaacgagugaaugaacgaaugaacaagcgaaugaaugaauaagugaaugaacgaaugggugagugaauuaaugcaugaaagggugagcgaauaaacaaaugagugaaggaaugaacgagugggugaacgaaugaacgagugagugaaugaaugaacgagugaaugaacgaaugggugagugaacgaaugaaugaaugggcgggccggugaaugaaugaacgaaugggcgaacgaaugaaugagugaaugaaugaaagugugaguggcgagagcccugccggccgcguggaggugcgaggcugcggacgucgcgggcccggaggcaccugcgcgcccuuggccgacucggaggagguggagauggacgcccgcggguccccuggagaugcagccggcggccugcgcuggugagggagccgggcccccggcgccgcguccuccucauccuccaggcgacaaggucaggaggggccggggcggcgccccuucccucagcccccagcccccagcccccuaccugggucuucccauuccaucccgugggggagggggcuggcgaggagggcaagggggagggggcggcaccagggagggcgggaccgggcgggcgggcggggcggggagcuccggcagcgcccagccccgcccuccggccgcuccccgcggucccuccagacccucuggccgccgccuccucuuggaaccccgugcgccccccgcgccccgcgccccggacgccaugaagcagcugugucugugcgcagccgccuccuucgcgguagggcccggggagggggcgcaggagcgggcggggcgcggguaccuccucuccccucccuuccccguccccggcugaccuggaccacccccccauuccagacccgggaaagauggucggcggcggggggugggggggaacagagguuggggcagcuuuugggggaauggaagagacauuuggggagacauguggacacguuuuggaagacucuuugaaacaaauggggacauuuaggaacauuuagagggcauuggggggugcaguuuugggaaaacauuuuggagacagauggggucauugaggggacaacuuggaagcuauuuugggagagccgauuuugcgaagagguaaugauuuggagaacaguuugggagaacauuugagggauguuuuuggaggauauuuuugggacaugacgguaucauugggaaggaugguuuuacagaacacuucaggaauuugggggagacauuucguaaugcauuucaggcuauaguguugaggggagaagccucgggauguuuaggggacagugguggcauuucagggcaguuguggauaaacagggcagaggaugguccugagaggcauuuaaaggggacuuuuagggguucagaugggacuuuggaggguaguuuggaaaagacucauggauccauuugcugggggcgauguugcagggguggcuuucacuaagggaugaauugggggacaacuuuuuuuauuguacagagugggucuugcuguguugccuaggcuggucucaaaauuccugggcucaaaugauccucccaccucagccucccaagcagcuacaggcaugagccaccaugccccgcugaugauuuuuauuuuuuguagagacgggguccuacuauggugcccagguuugucucaaacuccuaggcucaagcgauccucccaccuuggccuccccagaugcugggacuacaggcgugagccuccaugcucagcccaggggacaacguuuuggaaauagaugccagggggcugcucaggggaugaugcugguggugggcuuuuguuggacaacuggggugaugggccugggggcagaugcugggggucgcaggcuugggggacacugucugaggacccccucgcccaggaccaccucccccugcagcugcggcucagccccacugaccuuggcuccugcccgcccugcggccccugccccaucccgaagccggcagccagaggcaggcgccaggcaagugcccaggggcagguggugagagcccggagccccugucgggggcguggggaggggacagcagccaacacugccccacgcacuucugggcgugcccugcagagucaagacuggggcaagagugacgagaggcugcuacaagccguggaaaacaacgaugcaccucggguggccgcccucaucgcccgcaaggggcuggugcccacgaagcuagaccccgagggcaaguccgcgugagugcccgcgacccgggagugagauggcugagggguggcaaccuugcggcugaacccuugucucucaccuccagguuccaccuggcggccaugcggggugcggccagcugucuggaggugaugauagcucauggcagcaaugucaugagcgcggacggggcagguacugccagcugggccccggggagggaggaggaacuaagcccaggugcccagccugaggguccagccagacccugcucccaggucucaauguuccccgcugaaaaaaggggaggcucccucuggugcuccuccccugcccccagggagacacacaggggcauguuaggaugggguggccaaagauagagacuguggcuggcaccgagcaaagccaguggacagcuuguggauggggagugacuaggauucagguauugguucaguuggauggggaaguagcuggcauggggaaguagcuggggcuugggggauagcugcaaaguuucugggguuuuguuguuuuguuuuucuuuuuuggggggagggacagggucucccucugucacccaggcuugagugcaguggccaugaucucagcucacugcagucuccauuuccugggcucaagggauccccuccaaccucagccucccaaguagcuaggacuauaggcgcacaccaccaugcccaguuaauuuuucuauucuuaguagggauggggucucccuguguugcccaggccggucuugaacuccugggcucuaagugauccuuccaccucagacucccaaagugcugagauuauaggugugagccaccaugccaagccuggggaaguuucuagaaagugacugaggcagaggaagaacuggggcuugggagauaacugggaccauuggacgaacuaagcuuugaggugcaucugggauauaggaguauccgagauaaaggaagugacugaagggaacugcuuggaguuuggaggaggaacuggauucaugggaguagcugagcuugcaaaguaucuggggcaagagaauaacaaguagaguuuggggauaucugagguauaugggauagcugggaucuaggaguagcuggagcugugggaguagcuugagcucuuggaguagcuggguuacgaggagaacuuguauguauguaugacuuaacuggagaccuggggggaauaacugagauaaaaauguguggccaaaaggaguaguuggggcucaggaggcaacuaggcauggggacacagucaaaucugaagcuuuagggucacaggcauggugggcagggaauauggaauagcuggggauucauggagcaucagacagggacagaguuggcauuuggaagaggaaggguauauggauuggcaagaacauauacagcaacuguggguugugaagggcagagcugaaacuuugguguaguggacccuguagaguaucuggggacauggggaguagcugaggcaauagggcuugaggaauagguggguguggacagucgcugagaugggauugucuggaauacagacuagccauggcuuagagagucucuggguacagggaauagcaugguuuugagaaguaccugauggccgggcaccauggcucaugucuguuaauuccagcacuuugggaggcugaggugggaggaucgcacgagccaaggaguucaagacgagcuugggcaacauagcaagacuccugucucuacagaaaauacaaauaaauuagccagacaugguggcacuugcuuguagucccagcuacucggaaggcugagacaggaggaucgcuugagccuagguguucaagccuacagugagcuaugaucacacugcacucuagccugggccacagagcaagauccuuucugcagggaaaaaaggagagaaauacuaggguuuacggacuuugcuagacucagaaacucaucacaaguaguugacauggcuuggggagcagcugggagcuacuugaauagcuggagcuccaguaaaucuucuuuccuuccccagguuacaaugcccuccaccuggccgccaaauacgggcacccacagugcuugaagcaacuacugcaggucauuuacugucuuaucucagcuacucccuuggccccuacuacuccugaguuccagcaauuccuugaacccccagaugcucuaugaauccuagauauuccuuggccccuuuuacuccagaacccuagcuacucccuggauaaccagguacucucagaccauccacaugcuucuccuauuuaagauguacucccaagccaggcgcgguggcucacgccuguaaucccagcacuuugggaggcugaggucggugaaaucgccugaggucaggaguucgagaccagccuggccaacacagugaaaccccgucucuacuaaaaauacaaaaaauuagcugggagcgguggugugugccuguaaucucagcuacuagggaggcugaggcaggagaaucccuugaacuugggaggcggagguugcagugagccgagaucaugccauugcacuccagccugggcaacaagagcgaaacaccaucuaaaauauauauauauacucccaaugccagguauuuccugagcucuguuucuccccaagcccuggguccuuccuuagccccagacacucccagaguucccagccacuccucaaauucucagcugcuucucagcucucagcuauuuucuuuucucaccaauuuucaugaaaauggagucccuugggggccacggaagggugaggcugaaguauagcagagcccaggguagggaaggcaguccuagagaaaucaggcagcaagaaggauggcuccgccucaaaggacucgccccauccccaggcuuccugcgugguggacgucguggacagcagcggguggacugcccuacaccaugcaggugggugcagcccagcccugcccugaccccgaagcccagagggugcuagacuuggggguuauucugcccagggcccuagggaccugaccugcugugaagcuuccugucuccuccuuucuuucuuucuuuuuuuuuuuuugagacggagucucacucuguugcccaggcuggagugcaguggcaagaucucagcucacuguaacauccaucucccagguucaagcaauuuuccugccucagccucccgaguagcugggacuagaggcaccugccaccacaccuggcugauguuuuguauuuuuaguaaagacgggguuucaccaugguggccaggauggucucgaacuccugaccucaggugauccacccgccuuggccucccaaagugcugggauuacaggcgugagccaccgcuccuggccuuccuuuucuuuuuaugagauagggucuugcucuguugcccaggcugaaguacaguggggcaaucauggcucacugcauccuugaccucccggguucaaacgauccuccugccucagacucccaaguagcugggaccacaggcgugcaccaccaugccuggcuaauauuuuaaauuuauuuguagauacaggaucuugcuauguugcccaggcugaucucaaacuccugggcucaaaugauccucccaccucggccacucaaagugcuggaauuacaggcgugagccaccucaccuagccuccuccuuuuuuucuugacauagaaucucccucugucgcccaggguggagugcaauggcgcaaucuuggcucacugcaaccuccaccucccagguucaagcaauucuccugccuuagccuccugaguagcugggacuacagaccuaugccacaacacccaccuaaaauuuuuuuguauuuuuaguagagaugggguuucaccauguuggccaggcucaucucgaacuccugaccucaggugaucugcccgccucggccucccaaagugcugggauuacaggcgugagccaccgugccggcccuucucccuuuuuuuuuuuuuuuuuuuuuuuugagguggagucucgcucugucacccaggcuggagugcaguggcgugaucucggcucacugcaagcuccgccucccggguccacgccauucuccugccucagccucccgaguagcggggacuacaggcgccugccaccaugcccggcuaauuuuuuuguauuuuuuaguagagacgggguuucacuguguuagccaggauggucuugaucuccugaccucgugauccgccugcucggccucccaaagugcugggauuacaggcgugagccaccgugccggcccuucuccuuuuuuauuaccuacugugugccaggcacuggagcccaucauaaaucccgguuacccuuugaaccacaggcuauuagcccauugcacagaugaggcuugaugaggcuuaaugaggcugucacuuguccgcagcagguaaaucguagggaauccaggucgucugaccucaaggagcagucgaauguacuccugggcuuugugaggaugaggagaggucccuaggguuuaauuuccuuuguggagccccuaggagauaccaggaaaaccauagcuccaggcagcugguacccucauaaucaccuaauccaaacuccuucccagagggagggaaagggacccaccgacuugaaccagaacucagcccccgaccuguccgcuguccccgugaaauucaggcauggcuuucgcugacgacucaagaaacaucuguucuuucggaaacucagaauaaaauagggcuuuggggguuuuagucacugggugagaauucucugcaguuggaguaugcugccaccuaguggcggcaaugcuucuggucacaauauaggaguccguugguuuuugucacucaacaguuaacugagcacucugggaggcccaggcgggcagauuagcagaggucaggaguucgagaauagccuggccaacauggugaaacccugucucuacuaauaauaaaaaauuaaggccgggugcaguggcucacgccuauaaucccagcacuuugggagccugaggcgggcggaucaugaggucaggagaucaagaccauccuggccaacacggugaaacccugucucuacuaaacaaugcaaaaaauuagccaggcauggaggcaugugccuguaaucccagcuacucgggaggcugaggcaggagaauugcuuaaacccggggaguggagguugcauagagccgagaucaugccccugcacagcccgggcaacagagcgagaccccaucucaaaaaaaccaaccaaccaacaacaacaacaaacaguuauugaguaccuacugugugucaggcaccguucuacguguuguagauaagguuugcagcaaucaaaaccucauacugccucagacauacagcagguauucaaacagaguuuguugacugaaaaauggauuuuugugcuuaaucagacuggaugucaaccugcuggaauucauacccagggauuccagagaccaugcccuugugucagcugcacagccuccuggggagccucccuguuuccacucugguccugggcaaauggcaguaggagggaucucuuaaaauauaaauagacaggccaggcacaguggugcacgccuguaauccuagcacuaugggagucagaggugggaggauugcuugagcccaggaguuugagaccagccugggcaacauggcaaaaccccaucucuacuaaaaauauaaaaauuagccaggcgugauggcucaugccuauaaucccagcuacucgggaggcugaggcaggagaaucgcuggaaccggggaggcggagguugcagugagccaagaucacaccccugcacuccagcgugggugcagagggagacuccaucucaaaaaauaaaaauaggucgggugcgguggcucacgccuguaaucccagcacuuugggaggccgaggcggguggaucacgagcucaggcaaucgagaccauccuggcuaacacggugaaaccccgucucuacuaaaaauacaaaaaauuagccgggugugguggcgggcgccuguagucccagcuacucgggaggcugaggcaggagaauggcaugaacccgggagguggagguugcagugagccgagaucgggccacugcacuccagccugggugaccagagcaagacuccgucucaaaaauaaauaaauaaauaaauaaauaaauaaauaaauaaaauuaaauaaauacauaaacacauaaacggggccgggcaugguggcugcagccuauaaucccagcacuuugggagccagaggcaggaggauugcuugaaccuaggaguuugagaccagccugggcaauauagugacauuccauuuccauaaaaaauuaaaaaaaagaauuagccaggagugguggugcacgccuacagucccggcggcagauugcuugagcccaggaguucaagaaaagccugggcaacguagcaagacccugucucuaaaaaaauaaaauaauauaauauaaaauaaaauaaaaauuagccaggcacgguugcacaugccuuguagugugggucucauuccuguaaucccagccccuugggaggccgaggcaggaggaucacuugagcccaggaguucgggaccagucugggcaacacagcgagaccccgucucuacaaaaaguauagggaaccacagugcuugggacuggcagucggcagaccuagauccuagaucugacucugccucuuaccccagugggugaccacuggccugguugggccucaguugcugcaucuguaaaaugcaaaacuugccuuuguuacaaauuccucagggcacaugggaauuucucaugaaauaaaggagcagggucacacccaggcagaaagugcccagaaaaugucgaagucucacccuaccccuacucuucccccuuuuguuugucuuccuuucuuuucuugguuuuugagacaagaucucacucugucacccaggcugguuugcaguggugccaucaugguucacugcagccuugaacuccugagcucaagcgguccucccgcuucagcuggggacucccuaguagcuggggccacagacacacaccaccacacccagauaauguuugcuuuuuuuuuuuuuuuuuuguagagacagggucucacuguguuggcccagguuggucucaaacuccagaacucaagcgaaccuccugccuuggccucccaaggugcugggauuacaggguugagcuaccgcaccggacaaccuuuucucuuuugcagcggcugguggcugucucuccugcucagaggugcucugcuccuuuaaggcacaucuaaacccccaagaucggguaagcuucugggaucucuucagggaagauguuaugcuugagguaugcugccaccaaguggcaguaucucaggcacccuuugaaagucugagaaaguuugaggugaaacucaagggcaguuauauaggcuucugcaccucccgggggucaguuucucaugccaucgcaucccuccuccucccuaccagucaggcgcaacaccccucauuauagcagcucagaugugucacacagaccugugccgucuccuacugcagcaaggggcugccgcgaacgaucaggaccugcaaggcaggugagcaucuccccucccagccaguccacccuaugcugugugaccuucggcaagacuuaaccuaaguaagacgaucuagccagccuccucuucccagccuggccugggugcugaggugggcaugggggcuugggggauguucucaucuccucaguagcccccuccccugguaggacggcccugaugcuggccugugagggggccagccccgaaacaguggagguccugcugcagggcggagcccagccgggcaucaccgaugcgcuggggcaggacgcggcucacuauggcgcccuggcgggggacaaacucauccugcaccuucugcaagaggcggcccagcgccccuccccacccagcgguaugcaagccccaccuccccaaugcauuugcuucuuggcagcuucuugucacuccccuucucuuuaucgugaauaguuucaagguacccccgauuggcugcauucuaggagguccuagagcuuacccaauucuacucagaacaguuucaaggagccccagggcauuuagaguagucugggagggggucugcuucugcuuuccugggucaucuguacaguaagaacuuugccuguccuaagaagggcacccccugcugggcaagguggcucaugccuguaaucccagcacuuugggaggccgaggugggcgaaucacuugaggucagggguucaagaccagcuugaccaacauggugaaacccugucuccacuaaaaauacaaaaauuagcuagacgugguucaagcaauucuccugccucaccuuccagaguagcuggaacuccaggugccugccgccuaagucccucacgccuggcuaauuuuuguauuuuuaguggagucgggguuucgccacguuggccaggcuggucucaaacuccugaacucaggugauucacccgccuuggccucccagaaugcuaggauuacaggcaugagucaccccauccagccuauccucucuuuuuaacagucccaagucccucucucagcacucuacccaagcgccagauuucuaccuuaaacgcccugauucuuggggaaaucgggagcccccuacaagucccuggggcccaccaaugcccuuccugggccugggaacagaaugccugacccugcuucccucucuccccagcccucacagaggaugauucaggcgaggcgucaucucagguauggaccccuaagcagugaaggagccccuccucccugcauccacacuaacuucuccccugccccaagcucugugagaagagaaggaaguuagaccugggaaaaccuguuuggaaagaaugcuaccuucaggguaugcugccaccaaguggcggcagugugcucagccuaacucccagaacugggugagaauacuggauggggccaaauuauggggcuggggugggagggcaguggggacugagguuguugaggguuggugucuucggggaaggaagcagaucuggccucuuccccucuuucaguuuuuuuguguuuuuuuuccccgagguggagucucacucugucgcccaggcuggaguacaguggcucgaucuuggcucacugcaaccuucacccccuggguucaagcgauucuccugccucagccucccuaguagcugggauuacaggcacccaccacaacuggcuaauuuuuguauuuuuaguagagaugggguuucacccuguuggccaggcuggucucaaacuccuggccucaagugacccacccgccucggccucccaaagugcugggauuacaggcaugagccacugagcgcgaccccucuccuaguuuuuuuuuuuuguuguuguuguuguuuguuuguuuuguuuauuuuuugagagauggagucucgcccugucacccaggcuggagugcaauggcgugaucuuggcucacugcaaccucugccucccagguucaagugauucuccugccucaguuucccuaguagcugggacuacaggcgugcgccaccaugcccagcuaauuuuuuguauuuuuaguagggucgggguuucacucuguguuguccaggcugcucucgaacuccugaccucaagugaucacccaccuuggccucccaaagugcugggauuacaggugugagccaccgcgcuggccccucucccaguuuuaaagcaucucuguuccacagaggagugaaaacgugugggcaauguggucuagcuggggaaagaacugagagacagagaggagcagagaguaaagaguaagaucuggaacuuacagggaguuggucuugucugcgcuuugcugggauaaguaagcggcaggaggcaggggcugcugguuccauguucucaggaagucaggccauggcuggggcuggcuggguugguuuacugugggggaggcuggcauggccccccgaucggcccccuucacucucucuccccucccuucccagaacucuauguccagccauggaaagcagggggcccccaagaagcggaaggcgccuccaccucccgccagcauucccaugccggugagagaugcucugggcacgggaggaggcauggggagcccccaggcacggggaggggcucuggcugagaccugggauggggcaaccuuaggccccaucuaaaggccgugguggggaggggaacaggaugaucgagaugccuaugaggagaucgugaggcugcggcaggagaggggccgccuccugcagaagauccggggccuggaacagcacaaggaacggaggcagcaggagguuaggaggccucggagauuugggcgugggccagccuggguggggucaaugcaggcaugaagaucccccuacuuuucucccaccuucccuccuccaucucucucccuccccacccugcugcagccaccugggccuccucgcuguuccuccaacucgccaggcgcaguccugccucagggccuuugcaccaccaguguccucugccuggaaugcucuagcgcaguccugccucagggccuuugcaccaccuguguccucugccuggaaugcucuagccccagauggccccacagcucuuuaccucaccuacuuuaugcaguaggcuccucgccaaagacacuucccaugcccacuucccaugcccacuucccaugcccacuuucuucaaaauuguaacaucaccccccaccacccccccggccaacucgcuaguucacuuuauuuuuuuuuuauuuauuuuugguuuuguuuuguuuuugagacggagucucgcucuuguugcccaggcuagaaugcaaugguacgaucucggcuuauugccaccuccgccucccggguucaagcgauucuccugccucagucucccaagcagcugggauuacaggcgcccaccaccacauccagcuaguuuuguauuuuuaguagagacgggguuucagcacauuggccaggcuggucucuaacuccugaccucaggugauccucccgccgcggccuccuaaagugcugggauugcaggugugagccaccgcacccggccucuuuaucuccauuugcaucacuugcugcuauugggcaugcaucuguuuuauguguguccacccauuugacugugagccugcgagggcaggcauggcugauggugccugggucacaguaugggcgucgucaauauugauugggugagugaauauucaagugaguguaugaaugaauggccaaaaccaggucugccccauaagaggcacccaguaaaaacuuucuggcugggcacgguggcucacaccuguaaucccagcacuuugggagguugaggugggcagaucacuugaggucaggaguucgagaccagccuggccaacauagugaaacccugucucuacuaaaaauacaaaaaaaaaauuagcugggcaugguggcaggggccuguaauuccagcuacuugggaggcugaggcaggagaauugcuugaacccgggaggcagagguugcagugagccaagaucacaccacugcacuccagccugggugacagagcaagacuccaucucaacaacaacaaccacaacaacaacaaacaaaaacaaucuuguugagugaaugaguggauggaacggugccuggcauacagcaggugcuuaauaaguacauaguaauuguccagaauggugcauacuggcacacacagcaggcacuuaauaaauacuuagaaaugaaugacuggucagaauggugcaugcuggcacacaguaggugcucaauaaauacugagugacaggucagaacaauagcuggcacaaaguaggcaccuaauaaauaggaaugaggccgggcgcgguggcucaugccuguaaucccagcauuuugggaggcugagacaggcggaucacgaggucagcagaucgagaccauccuggcuaacaccgugaaaccccgucucuacuaaaaauacaaaaaauuagccgggccuguuggcgggcgccuguagucccagcuacuuaggaggcugaggcaggaggauggcgugagcccaagagacgcagcuugcagugagccgagaucacaccacugcacuccagccugggggacagagugagauuccaucucaaaaaaaaagauaaauaaauaaauaaauaggaaugaaugaggcucaacauacagcaggugcucaauaaauauuuaguaaugagugagcaggcagaauggugccugguacacagcaggcacucaauaguaaugagugagcgggcagaauucaguaggugcugaauaguugcacguggaaugcgugaaugugcauggaauggaggcuaugaagcaggagguggggcagggaggccucuugcccagauccaaaccccugucccuguuucucccgucaguccccggaggccagcucccugcacauccuggagagacagguaggugggaagguggggaggagccgguccuccugcugcccagccuuuccucccagaggcagcugagccuccacugcugcucccaggugcaagagcuacagcaguugcugguggagagacaagaggagaaggagagccugggacgggagguggagaguuugcagagccggcugucccugcuggagguaggagcagugaugagucagggcugggcuggggcugggucggggaacuucucuccuacagcagcgacaagacagucacaccagugcaugcacagccucacacacgugcaaacacacgcaccagacacaugcacccacaaacccacagucuuggcugggugcgagggcuuacgccugucaucccagcacuuugggaggccgaggcgggcggaucacgaggucaggagaucgagacuguccuggccaacauggugaaaccccgucucuacuacaaauacaaaaauuagcugagugugguggugcgcgccuguagucccagcuacucuuaaggcugaggcaggagaaucacuugaacccgggaggcguagucugcagugagcugaggucgcaccacugcacuccagccugggugacagagcgagacucagucucaaacaaacaaacagucccacagucacaugcacccaugcacauuuacaaaugugcacagacacagaaaggaccuuccuuucuuccccuucuccuuccuuccuucccucccuccuuccuuccuuuccuucuuuccuuuccuuccuuccuucccuccuuccuuccuuucuuuccuuccuucccucccucccuccuucccuuccuuccuuuccuuccuuccuucguuuuccuucccuucuuucuuccuuuccuucuuccuucccuuccuucuuucuuccuuuccuuuccuuuuccuuccuuucuucucucuuuccuucuauccuuccuucuuuuuuuuuuuuuuuuuuggacagagucucgcucugucacccaggcugggaugcaauggugugaucucgguucacggcaaccucugccucccugguucaagcgauucuccugccucagccuuccaaguagcugggucuacagcugcacgucaccauguccagcuaauuuuuguauuuuuuggggaguggggaggauggaguuucacucuuguugcccaggcuggagugcaguggugcaaucucagcucgcugcaaccuccgccucccugguucaagugauacuccugccuaccgcagccucccgaguagcugggauuacaggcgcacaccaucacacccggcuaauuuuuguauuuguaguagaaaugggguuucaccauguuggccaggcuggucuugaacuccugaccucaggugaaccgccugccuuggccucccaaagugcugggauuacagguaugagccaccacacucagacccagaaaggaguuuucucuaagcauacgcauccaugcagggauggauaaccacucucuaugcacguggcggagcaugguuaacagcaggcacacccacaaacacacaguuuacagacacgcaagaaacaacguccaagaacacaucaucacacacgcaugcauugcacgugcacccgucuugugcagucacacacagacaacaugcccacaaauacauacacaugcaacaaauauuucuuuuuuuuuuuugagacagggucuuguucuguuguccaggcuggagugcgguggcacgaucauggcucacugcagccuugacuuucccggccucaagcaauccucucaccucagccucccgaguagcugggaccacaggcaugugccaccacaccuggcuaauuuuuuucuuuuuggagagauggggacucacuauguuccccagucuggucucgaacuccuggccucaaguaauccucccaucuuacagguauaagccaccaagccccaccaguauuucugaaaacacacaauuaugcaaacauguauacauauagaaaaccauacacacaaacacagagauccacaggcacauucaaaacacaaccacacauacaccagacuaaaacucaagcaugaagccggaaacgguggcucacgccuguaaucucagcacuuugggagccugaggcgaguggaucaccugaggucaggaguuugagacuagccuggccaacauggggaaaccccaucucuacuaaaaauacaaaaauuagccgggugugcuggcgagcuccuguaaucccagcuacucgggaggcuaaggcaggagaaucgcuugaacucaggaggcggagguugcagugagccaagaucacgccacugcacuccagccugggcgacagagcgagacucucucaaaacaaaucaacaaaaagucaugcauguaaucucacauagucacaggaagggaggggcccccaacccacaacacuauacccacacguauggucacaaagacacaccuccagccagcucuuugcaugccaaauggauacugucgcauccacucucaugcagacaaacacacccacagguaaccacagccugccccgaguccccucacccaggagggaaacgcccauggcacauaggccaggaagcugggggaugcuggcauacaccaugcaucugauaaggaguuaauaaccaaaauauguaaggaauuaaugcaacucaauacccaaaaaacaaccuaguuuuaaaaaugggggcaggcucgguggcucacgccuguaaucccaccacuuugggaggccaaggcggguggaucaccugaggucaggaguccgagaccagccuggccaacguggugaaaccacgugucacuaaaaauacaaaaauuagccaggcguggugguacaugccuguaaucccagcuacucuggagguugaggcgggagaaucacuugaaucugggaggcgaagguuacagugagccgagaucgugccauggcacuccagccugggggcaaaaaaaaaaaaaaaauagggccaggcacaguggcucaugccugucaucccaacacuuugggagacugaggcaggaggaucgcuugaacccaggaguucgagacuagccugggcgacgugacgagaccgcaucucugaaaaaaaaaaaaaaaauuaaaaauuagccaaguaugguguugcacaccuguagucccagcugcuuggaaggcugaggugggaggauuguuugagcccagagguuggaggcugcagugaacuaugaucgcaccacugcacuccagccugggugacagaguaagacccuggcuccaaaaaaaaaaaaaguggcacggggaguggguggcaaaggacauggaaggugcucacuaaauccuugugggccaaaugcagccaucuggugcucgugggagacauacagguaugugaacagcccaguccccacuggagucuugguggggacacacgggggcugagagcagaaccccgagcuggacucugcucccuccccccagaacgagcgggagaauacuagcuaugacguaaccacccugcaggaugaggagggugagcugccugaccuuccaggugagcccccaccuccccacgcacucccagccgccuuguccccuggggcccuggaagacggagccucugggugugggggaguuugaagcugggagggagguuuguacucauccguuuuuuaaauucugcuuggcugagccugcccugggaacccugauccaccacuccagccccccaccuccugucccccuguggcccagguccccagggccugacucugcgucccccuccaggggccgaggugcugcuguccagacaacucaguccgucggcccaggaacaccuggccucgcugcaggaacagguggcugugcucaccagacagaaccaggaacugauggagaagguccagguagggaaagugaggcuggggacagaucugaggaccuagggcugguucccugaggucagggugggcagggaagguggcaaggcugcccuguguccccacggucacaucaacuccugccagacuccugccccccacuccacuccccagauccuggagaacuuugagaaggacgagacacagauggaaguggaagcuuuggcagaggucaucccucuugcccucuaugacucucuccgggccgaguuugaccagcuacgcaggcagcacgcugaggcccugcaggcccugaggcagcaggagacacgagagguccccagagaagagggggcagccuguggggagagugagguugcuggagccacggccaccaaaaacgggccaacccacauggagcuaaauggcucaguggcuccagaaaccaaaguuaacggagccgagaccauagaugaggaggcugcaggagaugaaaccauggaagccaggacuauggaagcugaggccacgggagccgaggccacgggagcugaggccacaggagccaaggucacagaaacaaaacccacaggggcugaggucagagaaauggagaccacagaagaagaagcaaacauggaaacuaagcccacaggagcucaggccacagacacagagaccacgggaguggaggccauggggguggaggccacaaaaacaaaagcagaggaagcagaaaugcaggccuacggagugggugcugggcaagcagagcccccagucacagggaccacaaacauggaggccacgggcucuagggccacagggauggaauccacaggagucagugccacagguguggagaacccagggguagaggccacggucccggggaucucugcuggccccauccuacauccuggugccgcagaggccucggaaaagcuucaaguagagcuggagaccaggauccguggcuuggaggaggcucuccggcagcgggagcgggaggcagcugcggagcuggaggcggcccuggggaagugcgaggccgcggaggccgaggcaggccggcugcgagagcguguccgcgaggccgagggcagcggggccagcgggggcgguggcggugacaccacacagcugcgggcggcccuggagcaggcccgggaggaccuccgagaccgggacucccgccugcgggagcuggaggcggccucggccugccuggaugaggcucgggccagccggcugcuggcggaggaggaggcgcggggccugcgggccgagcuggcccagcgggaggaggcgcggcuggagcagagccgggagcuggagguucugcgggagcagcuggccacggccagggccacgggggagcagcagcgcacggcggccgcggaacugggccgggcacgggacgccgcugaggcccgaguggcugagcugccugcggccugcgaggaggcgcggcagggccuggccgagcugcgggaggccuccgaggcccuccgccaguccguggugccggccucugagcaccgccggcugcaggaggaggcccuggagcugcggggccgggcagccagucuggagcaggaggugguggccacgggcaaggaggccgcccggcugcgcgcggagcuggagcgggagcgugugugcagcguggcgcucucggagcacgaacgcaucgugggcacccugcaggccaacguggcccagcuggaggggcagcuggaggagcugggacggcggcaugagaagaccagcgcagaggucuuccaggugagcagggcuggucaccacccgggccccacccccauuggccacguggcggccuguuuuagccccgcagccuugagguguuuugaacccaucaguuuuacuugaacagaccuacuuuauuuuauuuauuuauuuauuuauuuauuuauuuuugagauggaguuucacucgugucgcccaggcuggaguguaguggugugaucucagcucacugcaaccuccucuuucccgguucaagugauucuccugccucagccuccggaguagcuggaauuacaggcaccugcccccacgcccagcuaacuuuuguauuuuuaguagagaugggaguucaccguguuggccaggcuggucuugaacuccugaccucaggugauccacccaccucagccucucaaagugcugggauuaugggcaucagccuccgcaccuggccuugaacagacauuugacccugcagccauccugaccucuuggaauuuuccacuuguguuuucucucuuucuuucucuuuauuucuccuuccuuccucucucuuuccuuucuuucuucaucccccuucccuccccccuuccccuucccuuccuuucuuuuuuuuuuuuuuucagacaggguguggcucugucugaaaagucacccagucacccaggcuggagugcaguggcacaaucauagcucacugcaaccuccaccuccugggcucaaguaauccucccaccucagccucccaaguagcugguaccacaggugugcaccaccaugcucgucuaacuuuuuaauuuuuuguaaagacaggguuuugccauguugcccacgcuggucucaaacaccugagcucauggccgggcaccguggcucacgccuguaaucccagcacuuugggaggccaaggugaguggaucaccugaggucacaaguucgagaccagccuggacaacaucgugaaaccccgucucuacuaaaaauacaaaaauuagguuggcauuguggcacgugccuguaaucccagcuacuggggaggcugaggcaggagaaucgcuugaacccgggaaguggagguugcagugagcugagauuacaccacugcacuccagccuaggcgacagagcaagacucugucucaaaaaaaaacaaaaacaaaacaaaaacaagcaaauaguagccaggcaugguggcaccuguggucccagcuacuuggaaggccgaggugggaggaucacuuaagccugaaagauugaggcuacagugagccaugaucgcaccaccgcacuccagccaggagugcagguccggagcaacagagcaagacccugucuuaaaaaaaauccaaaaacaaaagaacaaaguagaaggaucauaugaauucuggggucuagcaucauuggagucuuaguguccugagagucaugcgugggcuugggccacaggugcagcgugaggcccuguucaugaagagugagcgacacgcagccgaggcacagcuggccacagcagagcagcagcuacgggggcuacggaccgaggcggaaagggcucgccaggcccagagccgggcccaggaggcucuggacaaggccaaggagaaggacaagaaggugggugcccccucucccacacucagucagggaggcauccacucagcaaagguuggggccaaucuacgaagguccucacugcaagggccuuggaaaaucaacccauuuuccagaagggaaacugaggcucagaaacggaaggggaccugguuacagccucugacaagucagacacacacaggcugcuguuccagguaccaauuauaaccacaguuacauuuauuuuauuuuuuuacuugagacggagucucgcucugucgcccaggcuggagugcaguggcaugaucucggcucacugcaaccucuggguucaagcaauucucgugccucagccucccgagcagcugggauuacaggcaugcgacaccacacccagcuaauuuuuuauauuuuuaguagagaugggguuucgucacguuggccaggcuggucucgaacuccugagcucaagugauccgccugccucagcccccaaaagggcugggguuacaggcgugagccacugcgucugucuccacaguuacauuuauugagugcuuacugcaugccaggcccuguggacuggaugcauuuagucacauccaguucucacaggauaggggcuuuuauuauccccauuugaggaaacagaagcacagagaggugaagucacuugccuaaggucacacagccaugcagucuuucagcuggguuuguacccacguucccacguuucguuccuaaacaauacuaaugaugauaacaacagccuccagguguuagauugggaauuuuucacacauuaccuuuuuuuauuguuguuuuguuuuuuucugaggcagagucuugcucugucacccagacuggagugcaguggcgugaucuuggcucacuguaaacucugccucccggguucacgccauucuccugccucagccucccgaguagcugggacuacaggcgccugccaccacgcccggcuaauuuuuuuguauuuuuagcagagaugggguuucaccauguuagcugggauggucucaaucuccugaccucgugauccgccugccucggccucccagagugcugggauuacaggcgugagucaccgcgaccggccucacacauuaccauuuuuaaucuuccugcaacgcuaaaagccagaaagcuuuuuuuuuuuuuggcagagucucacuuugucacccaggcuggagugcaguggugcaaucucagaucauugcagcuucgaccuccuggguucaagcgaucuuccugccucagccuccugaguagccaggacuacagguuacaggugugugccaucaugccuggcuaauuuuuuuguuucuuucuuuuuuuuuugagagaaaguuucacucugucgcucagggugaaguacaguggcaugauuuuggcucacugcaaccucaccucccggguucaagagauucuccugccuagccucccgaguagcugggacugcaggcgagugccaccacacccagcuaauuuuuguauuuuuaguagagacuggguuucaccauguuggccaggcuggucucgaacucccgaccucaggugauucagccucccaaagugcugggauuacagucaugagccaccgugccuggccuguuuuuuuuugcuuuuguuuguuuguuuguuuguuuguuugguaagagaugggguuucaccauauugcccagguuggucucaaacucuugagcucaagcgaucugucugccucagccucccaaagugguaggaugacaggcgugagccaccgcaccugguuucagaaaguauuuuuguccccauuuuccagauaagcaaaccaaagcuuuaagagaugaagugaguggcucaaagucacgcaacaugucacuggacaggagacgagacacccagagucccaggcgcuucagcauaaagaaugacccagccucgacucacugugggaccuuagaccagacacuucaccucucugagcuucaguuuccccucuguaaagggagggcaaaauugcaguuaggaugaugguuuaucuguagccugguuucuucccuugcacacuguggacauaggagcgggaucauuuccugggcuggggccaucugggcauuguaggggacugagcagcguccuugaccucuacccacuccaagccaagagcuccuccaagucgugacaaccacagauguccccacacaacacccaguguccccuuggggggcagaauugccucaaguugagaaccccagaucuauaguaauaauaaggcccggcauuuauugagugccuacuguugacuaggcacaguuuaaacuuaaucucugugcaggaucacagcaacuacuaaguuaagaacuauuggccgggcgcgguggcucacgccuguaaucccagcacuuugggaggcccaggcaaguggaucaccugaggucaggaguucaagaccagccuggccaacauggcgaaaccccgucucuacuaaaaauagaaacauuagccagauguggugaugggcaccuguagucccagcuacucaggaggcugaggcaggagaauugcuugaaccugggaggcggaaguuguagugagcugagaucacaccacugcacuccagccugggcaacagagcgagacucugucucaaaaagaaacaaacaaaaacaaaaaaaugugaaaaccaaccuuagcuuguggguuguauaaaaacaggcuguguugguaaccauaagcaucuaaaauauaaauaaauacaauuaaaacaggcugugggccagacguggcccucaggccagaguuugcuaaccccagggacgggaccuucccuugaaagccuuuaucccuggccucuuccugcggcugcagagagguccucagcccccagcucugggcuuagggugaucgcugacagcaccugcacccucagaucacagaacucuccaaagaagucuucaaucuuaaggaagccuugaaggagcagccggccgcccucgccaccccugagguggaggcucuccgugaccaggugaaggauuuacagcagcagcugcagguaaggacugggccacgcaggggccaggggaccaucaggguggaggaguccaaauauuuaccaaucagcacagcgcaggugggaaucccaggagaggggcugggguaggcaggugggguccacaucacaugcacggcauggccaggaaauacuuccuuuauuuuuuuugagacagggucucacuccaucgcccaggcuggagugcaguggcacaaucucagcucacugcagccuccaccuuccggguuuaagcaauuuucaugccuuagcguccugcguagcuggaauuacaggcacgcaccaccacacccagcuaauuuuuguauuuuuaguagagauggaguuucaccauguuggcaaggcuggucuugaacuccugggcucgcauaagccucccaaaacgcugggauuacaggcauaagccacugcuccuggccgcccucugccuuuuuuuuggacauaggaucuugcucuauuaggcuggagugcaguggugcaaucauagcucacugagcagccucaaacuccuggccucaagcaguucuccaccucaaccucccaaagugccuggccauacauauauauauauauauauauauauauauauuuuuuuuuuuuuuuuuuugagccagucucacucugucacccaggcuggagugcagugacacgaucuuggcucacugcaaccucugccucccggcucccggguucaagugauucuccugccucagcuuccugacuagcugggacuacaggugugagccaccuugccugggaaauuuuuuguuuuuuuugagucucacuuugucacucaggcuggagugcagugcacgaucucagcucacugcaaccuccgccucccggguucaagcgauucuccugccuuagccuccugaguagcugggacuacaggcaugugccaccacucccggcuaauuuuuuuuacuuuuaguaaagacgggguuucaccauguuagccaggguggucuugaucucuugacccuguuauccgcccgccuuggccucccaaagugcugggauuacaggugugagccacugcaccuggccaauuuuuguauuuuuaguagagacgggauuuuaccauguugguccaggcuggucuugaacuccugaccucaagugagccacccaccucagccucccaaagugcugggauuacaaauguaugccacuaugccccgccauauuuucauauuuuagcagucggccaucaacguacaggcuuggggugcaaagggugcuuuuugguguguuuugcucaguggggaggugcuccugcucuucugagcgccccuuccucaugcccacaggaagcugccagggaccacuccagcgugguggcuuuguacagaagccaccuccuauaugccauucaggugaguggcccagcuccuggguacccgguggcuuugggcauaccacuguugcucucugagccucaguuuccccuucuguacagugggaggcuggucuggggagagguucguggcaugugggagccccccugugugcauuucccuccuggcuggcuuggucuaugggagugguggagggacuuggggcagccauggaggguauacucagggucuuccucuacucccccaacccuagggccagauggaugaagaugugcagcggauucucagccagauucugcagaugcagagacuccaggcucagggccgcugagaaaggccaggcccaguggcuacacugaccacacccacgcagggaccucaccccccugcaggccccuugcagaccggcuucacuuggcuucacuuggcccuauccaggcccaugcacuuggagaccagccugguucccugcccgaccacccccagcuggcuccaucaccccaccuggucucugcacgcacacacuggucagucuggacccgggccgugacugccccucccccaccaccggagacugugauucccuguguccuccacauccagacgccagcccaggaauaaaggcauucugugcacaggg

SEQ ID NO: 192184 - RNA, 8408 nt, Homo sapiens
ucaccuguuucuuuucagauaauuuauuugacuauuucuuuuuuuuacuugcuggacuguccaaaacuucaaucuugccuuuuccaccuucagaauugggaagcuuaauguuaucuauggugacuucagaugggaugcugucaucuucgucuucugauucugaacuguucucugaacugucuugugaacucucuucugaacuguccacuucuuuugaauccgacugauucaucucaaacaaagccacauccugcaaaaaguaguggacaggaaaucuauuucagagcaguuccuuaaaaagucguaauaaaacaauauugggaagaaccaacauucagcaaacauauugaaacauaaaggauaagaauuugguuuuuuuuggagacagagucuugcucugcugcccagacuggagugcaguggugugaucucagcucacugcccccuccgccuccugggcucaagcaauucuugugccucucagccuccugaguagcugggacuacaggugugccccaucacauccagcuaauuuuuguauuuucaguagagaugggguuucacccuguuggccaggcuggucuugaacuccugaccucaaaugauccacccaccuugcccucccaaagcgcugcaauuacaggcaugagacagcacaccaggccacaaggauaagaaauguuuuuaauacaacauggcucuuuuauauuuuuaguuaccagggucugucauaaugaugauuuaaauuuacucuaagugucuaaaauaucugcuacggcccaauucuauauacccuaaacacauucaacaacauucuuucagcaaauacuaacaugaguuaggcacuacacuagguacuagagacucaauaacaauaaaaaaaucaaaacaaaccccucgcuuuggugaaauuuacauuuucaggcagagaccaguaaauuacaaccugcaggccaaauccugcccaccgccuacuuuuguucagcucacaaaguaggaauguuuuuucuauuuuuaagugguugggggaaaaaaauuaaaauacugcuauucacgaaaggugaaaauuauaugaaauucucauuucagcacccauacacagugacgcacugcucuaauugagccaauaagcgaucacucggggccuucuguuggaacuguugagagagaaaucugaguugcugacucuaaggcugaagcugcugauaaaccagaaaccuaccacagcugggggaagagcaugcucuagauuaggucaacauuaggaaagcagaaccaagagacagagcggcugaccacugaggacacugagcaccuggauccaggugcaccugaaaucaccaauccuggagguuuuuuuuccccaauaaaauguuuuccccuugcuuauucauguauguauugucaguggcugcuuucacacuaugacagcagaguucaccagucacaacagagacaguaaggcccacagaaccuaauguauuuacuaucugaccucuuacagaaacauuuguugacucuuguuccagaggcgaaagaaaggcaauaaacaaauacauauaaagcauaauguaggguugugaaaauauggaaaaauaaagcaggauaaaauaauaauacagcuaucagggaaggccuccugaucaggugacgacugaaaagaaacagagggagucgaaauggagaaaucuagggaaaagcauucuaccugagaaaaccgcaggggagaagaccggcugcagugagacuggugcuggagggcaguaaaugaggacuguguaggagauaaggucagacagagcagcagugcccaaccucuuugguaccagggaccaguuuuguggaagaaaauucuuccacggaccuuggcagggauguuuuggggaugaaacuguuccaccucagaucaucaggcauuagaaucucauaaagagcgcacaacaaccuggaucccuuacaugcacaguucauaauaggguucacgcuccuuuuggaaucuaaugccacugcugaucugacaggaggcagaacucaggugguaaugcgcucucacccaccgcucaccuccugcugugcgaccugcuuccuaacaggccacagaccaguaccaguccacagccuggggguugggaaccucugagauagagaacugcaggcaggaucauauggacccuuugaaggacuuaguuuauuugaaacgugaugggaagcccccaggucccaaacugugugaacaacggaccccagggaaggcacagugaacgcaggaaaaccugcuaagaaauugcugcaauacuccaaaggagaggccauaauuaccugggccaacaaagguccaaaggaacugcagagguuguacaaagugguuggauuugggaucuauucuggagggagagcugaauagaauggcuaaugaauuagauauuauuaacaauugucucagcuugguccagacacagauauuauaaacggaauuccacugcagaaacaagauaugaguauaaacugagagaacauuuuugcacauagcuuauguaaucaauugcucucuuccacacaucauuuauuuuugcauacucaauaaaucaggcuaugauuaccucuuuuggggcuuggacagaaaaaaacccaguuaggacaucgaguaaauuaaugcuucagaauaacaaauguagcauuugacuuaggaaaaaaaaccuuccugugacaucauaugacuaaaaugacuaaaucauaaaaugacuauguaccuauacaacauuggaaacaugagcuaacaccaggaaaaugaaaacuugaaaauaaaauggaaaaguucucuucuucuuaggugacaggcagaccaguaauuucaccauaugaaaacaaagcauaguuaccauuuguauaacuuuacuaugaggcccaucaauguuuucaauauugaaacgaccagguggugcagcugccauuucuuuucuuagcuuuucauuugcccgugccaucugugggagaaaugucuguaccugguccaauacuguggaaaguaaauacagcauaucaacauuuaugcuaguaaauucugaaacccaggauuuccuauaaacacuucugaauugaguauuaauaauaacaaccauaauuacauaucuuuuaguucccuucauuuaaaaacccuccauccucuucugaauaaaacaguaggacuacacaauccagcaauuguuucacaaauguuuuauguuucucauauauccccaggacuguaaacuccuagaaggcuggcauucaacaaauaguaacuaaauagggaggcagugugacuuaacaguuaagagcaccagguucugaggcuuuaggguacgaauaacuagguauguacagaauccuaguucuaccucuaucugaauuaccuugggccaguuaauuaaguagugguuauuucugccuacccaacauacguucccuuucuucugauaauauaacccuggcuuuccuuuuaagcuugugucacucuuagucacucuugccccucaccccauacaugccuacauccuccauauccuuggccacuguaccaugcuuuaguggcaucacagugacacgcugcucuagucgggccaauaauagaucacucaggaccuuuuguuggaacuguugagagagaaaucuuucugagugaaugacugaguuggcugaauauaaggcugaagcugcugauaaacuggcaacucuccacaccugggggaagaguacgcucuagauuaggccaauacccaggaaagcagaacuaagagacagaguggcugaccucugaggacacugagcaccuggauccagaugcaccugaaaucuacugugccuggaguauuuuucccccaauaaaaagagccaacauaauuucuuuuuuugcuuaaggcaaucugagcuggauuuuagucauuugcaaccaagaauccuaauuaauacauuuaauucuaccucuugaaaccucagcguacuaauccauaaaagaggagugauaacugucagucacugugccaaauacagagcagucaacaaacaaggauauuuauuuucucucucaaaagaggcccagcacauaaccacgcauauaacagacucucaaaacuuauguaacugcuauggcuacauaacagaugacuaaaauguccagcguauggaagaagaaaagaaaauaguggccaaggucaaguagacgaccucuauuuguaaaauaaggugcuggaaggacucccuaagagcaugcacacaaauaaagcccgacguaauagugaauguuagcucucauuccccuucagauuacagaaagagaaauuacuaauacaaauaaagguauuucucuguccucagauuuaaauauauugcuacagauagaaaaucugguacugcuuuuguuuccaacuaaugaaucaaguagagcaaaacaaguaccaaaaugugcggccugaacugugauccucagaagccaaauaauuccgugguacucuaggagaguauaugcugaacccugaggcuaguccagucgugguucuucuaaauuaaauaauacucaacacacaacaccauaauauucaaaauguccaacaucuaauaaaaaauuagcaaacaugcaaauaaacaggaaaacauaauccauaaagaguagggaaaaaagauucagaaaugaugcagacgacagaaucagcaauaagaauguuaaaacagcucuuagaaauauacuuuguauguucaaggaagaaaagaaaagcacaaacacaaggaaagaaaaaaagauguaaacagucucaaacuucuagagauggaaacuguaucuaccuugaaaaaauacauuugauagaauuaacagauuagacaauauagaagaauagugaacucaacgaaaucagcgauagaagcuauccaaauugaaacacacaaaacauaagacccaaacaaacaaucaaugagcugugagacaaccucaacuggcaaaauuaggugucauuggagucccuucaggagaggcgagacaggagcaagcaacaacaacaucccuaaaaauuucccaaauuugauaaaaauuauaaacccauagauccaguaaguucaacaaacccaagcucaagacucacaaagaaaacuacaaagggcacaucaccauaaaaucgguaaaaaccaguaaugaagggaaucuuaaaggcagccagagaagaaaagaaacaccauauucaugacacaaaaugacaguagacacuggcgucagaaacaaugccacugaaaagaaaguguagugaugucuuuaaaguacuggagaaaacagaaaaagcaaaaaaccacacugucaaccuagaauucuaaauccauuaaagcaucuuccaaaaacugaaagcaaaauacuuucucagacacacaaaggcugguaagucuaucuccagcagagcugcacuaucaagaaugauguuuacaauaagaaaccugauuuuuuaaauguguuuaagauuugaauaggcacuucaccaaagacauacaaauagugacacaugaaaagaugcucaacauuauuagccauuagaaacaaauuaagaucacaacgcgauaccacuauauccacacuagaacagcuaaaauuaaaaaggccauaccacauuuugguuaggaugugcagcaacuaaacucucauaccuugcugguggaaaugcaaaauagcaauuucuucuucguaaaaaaaaaaaaaaaauuacaccuucuauauacccgcaauuccacuccuagguauguaaucccucaaaacaaaaaccuauauccacaaaaacugguuuuuggaugggcagccaccauauggucauuucagcuauuguagauuuagugcuacaguaaugaugcuacaguuaaauucuccuuucagaguacucaugauuucuuaguuuauugaugugauaccuucauuaccuucaugcuuauuuacauuguuuuuauugaauuuuugccuuuuuuuaauauuaagagugaauuacauagagggcauucguguaauaaagucugagugugggacauacuuaugaaugugcaguacagcaauacuacagaauaauaaagagaacuggccauuaugcuguauucuaaguaauauuuaucauuuaaauaauuguguccaauucaaugggaugugguugugguuuuccauccauauauauuaaguuugaggcucaguaaccucuaaauaaauuugccauggagauuaacaauuguuuuugacuucccaaaauucaacccacaagcaauuuuucacgaaaaaguuacccucuuaaaguagagaaauaauguaagaaguuccauucuguguacugacuuuaucauguaaaucccaaguaggacuuguuccacuggacuaucugugguuugauaccugacaaugaaggcagagaccgucccacagcuuaaucagacaaaacucagcauuagagagggugagagaggggaagagguacuuacagggacuccucucuauccgaacuguuugaagaguggaggucuuucuggacuuagguugggaguugaugagcaaccugucccauauaccugaaaauacagacacacaaacacccuuaauuuacuacagcauaaaaaaacaaaggcccaucaguaagccucucacaugaccagucuuaagacuugacuguccacacucccccaaaauuuuuuuuuuaaaggagaacuccaagcuccauuacaacauuuuaauucuuuauguacagccagccaccucuccuuucuuacaucugucucauucaccucuaucaccaauggcagguaauaaaugcacaccaaucugcacuuuucuggaucagaaauucauuagcagacaaacgugggucugcaaugacagaacggaggaaacaguacagagcauaacaaugguuaagugaagccagaaaugguuacuaguuguguaacacugggcaacuuaccugaucuucaagcauuuguuucuucauuaguaaaacaugcuugccugguauuuccccuucccugaagacguucaacccaaggaaagcagccuuuuggggauuuugucacccacucuaccuuuccagccucauuucucacuacucaaaucaucccaacucucuaucccaucagaguuccaagaggggaacguacaaaacucaaggcuuugcacacccuauuucuaauacccggaaaaucccuuaacucucugguuaaaaaacaaauccuguucaccugcaaagcagagccgcaacaaacauccauugaaugccuacuacuuaaggccuacuggauucgugaucagagcacagagucuggagccagacuacuugaauucaagucccaguuuugcuacuuucuagccacaugaucuccagaagguaaauuaccuguaugauaaaucaugucucagguuccucaacuauaaaacagagauaacagauuuucugcaaaggguuguugugaggauuagaugaguuaguuucuggggcauacauaguaaggacuacauaagcuuugguuaucauuauuauacuuccuucggaaucucuggguucucacaaaaccuuuucuucaagcuaguauuuacugacaacaugcccaagccuuuuuaggcauucuccuccucacaaaaauucuacaggcauuacuacuaucaccauuuuccaaaugcaaaaacugaggcuuagggaaugaaaauaacucuaagucccaccaguuaauuacuaguggagcugggauucgaacucgugcuuuuaaauucuaccuauagugucugaaaugcuguguggauuuccuggaugcaugucucccucuacaagacagcagcacuaagggguggucugugugggugugaaagagguagggacuguuagcauaauauuacuccgcuucccccuaucagccaacugcuccgacccaggcagccaaaccaaaagcccucccuuccccaaaagaacucgagagcuucccagcuuccagggcagggcagaugccuggcagcggcgccuggcagggugggcgcucacuaccuugcagaauauaagaaccacuagcuggggaaaccauuccgggcccgcagccgggugcccgccccaaagcccccaccccugccgcgggcagggcacgccggagccccgcagcaguccccggggcuccccucgaggguacggagcccgggcagggagccaccggccggcucccaaacugcaccggccgcgccuccucugccgcacgugugcggcccaugccgccgucacccguccgucaccuccgcggccgucgcuucccgccgucagcagcuccuuggacacugggacuccugaggaaucccgggugggcgacgaacaacucgggcuagccuugggcuugccauggaccuccaugcuucccucaagccugcacucucaggcccggau

SEQ ID NO: 192185 - RNA, 24713 nt, Homo sapiens
guugcucaucugcugcggcgcuggucgcgccugcgcuuugguucuuggaaggcggugcucugagaagccggacuacgcggcagcggcucuucaaagcggagccgggaguuuuugcuacaguuuucgccaccaugagucgcagcuauaaugaugagcugcaguucuuggagaagaucaauaaaaacugcuggaggaucaagaagggcuucgugcccaacaugcagguaaggcaggagagcaaauggcggggccuuccgugcuccguccccggcccggccggcguccacugcgcccucuggaccuccccugaccacuggguccgccccggccccuugcagaguuucccucaucccguccuucuccccucacgguucuggggccgcccaaccuguuccggcaccaccucccgccaggagagguccccgaaccacgaggacaagcuaagugcgguggauaugggaaucuaaauaaauacgaaauugggguuuccaaagcguuuucacagaucagucucauaaacguaucgugagcuguuuuacguucacagaaacuucagugaucuuuuccaggguggaacagccagccccagguucauuugcugggacuggaauucaccuccucugagucaugcugguuauuuaaauaacguuuacaaaccuuuguucacuaaaccagguuuucagcauucaguaucgcauguugguuuuuaauaaagcgaugucauuucuugcaguagcgcagggcagggccuguuugauuuuaauauucacuucacagaaggaccucgaggaucugucggugacauagcuuccucuacccaccuaggaagaagcucagccaggacuugauguccgguuuacuucuuugacgucccagauggagacuugagggcucaggaucaucagauaguuugaaagccugggcucuguaucucucggccuucaucaccaucugugcucauauuuuuauuaaugugaaaaaagaaaacguuuaugaaguuuugcaacguauuuuuaaauaguuuuugaaaucccugaaggugccaaguaaaugcuucaaagguuuaccgucucgucucacgucuugguaaacagcucccaauagucacuccauucuuuuauucagaaucaaagcuuacugaguuucccuuguuggcaagucacuuacacugagggaagaaaaagcgcacggggauaaaucuguguucuguuugcuguuuggccacuuucuuuguguggaaaccguuacccugaaggaaggaauagaaaaucuaacauagggagagcgcagugguucauggccuguaaucccaacgcuuugggaggccaaggcgggaagauccuuugugccuaggacuuuggagaccugccugggcaauauagugggacccugucucuacaaaaaaaauuuaauuagccaggcgggguggugugcaccacagcuacucaggaggcugaggcagggggaucgcuugagccugggagaucuuggcugcagugacccgugaucauucuaaacugcacuccagccuaggugacagagugagucucaaaaaaaaaaaaaaagaaaagaaaaagaaaacaccaugacaugauuaucuguaggaucuaauaacacagacugucauugucuggcagguguucugacucagccuuugaugcacacacugcugcucauucuaucuaggggcaagucucauuuugcuaggcaguucugguuuaaguuuguauacagcacuuuacuaccaccuuuccuuugggaauagagacuuggaauguuaaugcauugcucuuaaaacgcuauugacuucuaagcgugaauugugcuuccauaugagagcagugaauuucacacagauaaucaucuguuacuaaaucuccauuucucccccaagacccacauguuggacuaaaaauuucucuuuauucccuuaaaacacucccuucccaucuuuacgucauuuuugcguuuaguuccuagauguucugcugcgccagugaugucucuugucuucaaagaaccagcucuacaggaucucugugaaaccucucccagcucccuagacuguugaggcacuuccucaucagauucuuccauagcacuguguacuuaauguuauggcacuugcuucauugcacucugauauucuuaucagaauauaagggcuguacuggcugggugcgguggcucacgccugcaaucccagcacuuugggaggcugagaugggcggaucaugaggucaggagaucgagaccauccuggcuaacacgugaaacuucgucucuacuaaaaauacaaaaaauuagcugggcgugguggcgggcaccuguagucccagcuacucgggaggcugaggcaggagaauggcgugaacccaggaggcagagcuugcagugagccgagaucaugccacugcacuccagccugggugacagagcaagacucagucucaaaaaaaaaaaacaaaaguauauaagagcuguauuguguacugggagcuccuugaaaggaagaucuuauauucuuucuaucuccccuagugcccaggacagugcuucaugcauaguaaauccucaguuaauguuuggugaauuaauaaaugugacccuuaagaaauuauacuggaaauauuuuccaucaguggguauuaaauuguuauuuaugcaauggugaugaagucaucuuucugauaaaaacuacauucaauugauuaaguguuaaaucuuugguucuccauuacuggacagcucuuucacaauauuugaccugugauaaaaauguucugcucuuuaguguuacauaaguaugucguccauugccuucugugugcugccucuauugucaagcuuuaaaauuauagauuuuuuaaaaaauuauauagcuuucagaacugagcacacaacuacguagcugcauguuaaauuuuucuucucacuauuuaccuaacuagagauuuguaagucaccacuagagcacaauaaaauguaauuugcuauuggcuuaaacacagaauaaacauacuagguuagaugacuacguuuuauguuuagaauuggacuuuuugauucauuugguuuuuuuuuuuaauuuucaaaaaaccauugauauuuuugaagcuugaggauuaagaccuuugggcuuugugagaguauaguuggaagauuuuucuuuaucacaaaaagaugcugaaucuguugaauucuuaaaugugguuuugaggguaugagaauaaacaaaacaauuugugaacauugcagaauuuuucuuaagguauauuuuccgaugggagcagcucguagucuuugauaggaaguuuucugugugcuuaagguaacgugaaaguguuugguaaagaguaaagcacaguaaauauugcauacagugcauucuguccagugccuacacuugccgcgcauguacucagacauugcuuuucacuuuccuugguacuagguugaagguguuuucuaugugaaugaugcucuggagaaauugauguuugaggaauuaaggaaugccugucgagguggugguaaguacauuagaguuucacuuguguuaguacgguagugccuucccuguggccugaaaaaguggcaacucaaauaauuauaauucugaaauauugucaaggagugauuacaacuuaaaaguaagaccaaaagcacuuacuuauuugugaucacauugucagccaguuggcguuauagaacggauuugaagcuccaucuggaauuugaagcuggguagaacuuguuucucagcuaaccuugaacaauaauagcaagugaccuaccauuuguuuugcacuuacuauauuccaggcauguuacuaggugcuuugcagagauuaucucaugcaauacuuacagugacucuaaaaggagcucccuuccaucuugcaucucaaacauccuucuaggcuuuguugucuuaguagcccuaaugacuaccucuucacguuauacagucuaaaaacaugaauauaauucaugcuaaaaaucaaguguguugucuuuucuaauacccaauuuuugucuucagguguugguggcuuccugccagccaugaaacagauuggcaauguggcagcccugccuggaauuguucaugugagucagaguucagaacuuuaaucauuuauauuucuuaaaguccauugaauggaugaauggccaugccugauaguggugucauuuagacaaugaccuuuggacagccagacauaaccaugaagccaggcucaguggcucaugccacccgcaacacuuugagagaccaagauggaaggauugcaugagcccaggaauucaagacuagucugggcaacauggcaagacccugucuauaccaaaaaaauuagucaggugugaugucacaugcuuguugucccagcuacuuagaaugcuaagugggaggauugcuugagcccagaguuccacacugcacugagccaugaucacgccacugcacuuuuagcguggauggcagagugagacccugucccuaaaaauaaaaaauaaaaggaaauaaccauggaccuaaagaaauaauugaaucuggaugguauuucaguuucugaaugcauuuggcuagaaucuguaaguguuaagaaccuucgaaguaguuuuuguguuuuguuucuuaucaugguaacauuauuccuggaucagugcaccaccauuguaaguuucauuguaaguuucacuucacuguuucaauguaaguuucauuguaaguuucgcuugguuguaaguuucacuuccuaugcagaggaucauugaagaagaaauggcaagaaguuuaaggguuagcacugagggggaggaagagaggacagcauagcccccaccacaguuuaacauucauauucuaucagagguagauguugaaaauggaucuauucggcagacauuuuugaggucuucuuuaugccaguuaccauguugggcacuugguagagggaaugaaaugguauggcuuguguauauaaggaaguuguuagugucuggguaucuccauauauccuguguuugaccugcauucuuccugggucaggguccuuuucuaggcuccacauguaggaagucuacaguauuuauaccaucaaauggauuacauuuggcugugauuacuuaaacuaaugaccuauauaaaucaguuauuuuccucuucuuaaccugacaaaccaaaguuugucagugucuuaagauuauuuuuaaaauguaauaguacauuaaacuuaguauguguuacuccuauaucauguuauuuugaggcuuuucuguuuuguauuuccuuaauuaacauucagaucuuauaaaaaaguuuuuuucucacuguauuuagcuuugugauuaggaguucuuacuauuuccaugcauauagaagauuuugugaaaacacagucuugauuuagggaaagcuucagccugcaaccuguuugagaaucagugucagguccaucagggcauccaggguagcaggucaagacacuuguauuucauuuucuaauucuuuuucagcgaucuauugggcuuccugauguccauucaggauauggguuugcuauugggaacauggcagccuuugauaugaaugacccugaagcaguaguauccccagguaagaucacuguggacaucugcuguuaaguguguagcauuggccgggcacgguggcucacgucuguaaucccagcacuuugggaggccgaggcggguggaucaugaggucaagagaucaaaaccaucuuggccaacauggugaaaccgugucucuauuaaaaauagaaaaauuagcuggggguggugacgcgcaccuguacucccagcuacuugggaggcugaggcaggagaaucacuugaacccgggaggcggagguugcagugagccgaguucgugccacuguacuccagccuggugacagagcaagaccccaucucaaaaaaaaauguguguagcuucucucuauggaccauagccuuugugaaacagagcacuucucuccaugugcaugacucagucucaucauguucugucauuuuucuuugauauuuacuggaaguauugcuuguggauacugagaggcuauuacaacuucaagcaaagcauauuuuuauugaaaauuuugggaggcuccuaccaaacaucaugguauucagacuuuggcuacaaaacaaacuggcaauuuuuuuuuaucuuuguaaaucaguuaccucguggacagaucacgucuaauaauguuaaugaccacacaguauuaguagcuuagaugaguucagcuguguaaaauauuuagaacagugcuaagcagguagaacauauucaguaauacuaucauuguuauucaaugauaacauugaauauacagaagguugcauacgccuucugcugugguuauggggugcuuucaauaaacauucuauaucagaaguaauaucuuugcuguuaaagagugugaauuuagaaaugaaguuuaaaugacaucuugagaguucuguuucuagcagugguggacuagguuguuucagaccaauccccugcugaaaauaauuagaaaggcuggguaaaaaauuuuuucuuaaaucuguuugaaggcacagaaaaucugcuaaggcaguaagaauuugcgaagucaagaucuagaggaaaagaagaaaaaguuccagauaugugagcccuacauguagggcuguuuggaggugacugcaaauuucagucaguaagaauauacaugauuugaaugauccaauaacaaacuugacacgugaccucuaauauacaugugugguuguguguguguaugugcacuugcauuguaguacagccaagcagugcagaguauacauuuuuuuucaaaugcacacaguuuaccaaaacugaccacaugcugagcgguaaagcaggcaucaaauuucaaagcauugaaaucauauagaccagcaguccucaaacuuuuugcacucgggaccacuuuaguaauaauuauugaggauuaaucucagacucuuaucaauguuuaccuuauuagaaauuaaaacacauuuuuuaaagacaagaauauauaaguacaugucucauccauuagaacaaagauguuaugucauauagcuuuugagaaaucucacuguacagucaugggagaauaugaauaaaauagacaaauaaugucuuaguauuauaaaaugaaucuuacacaccugaaauggucuucccccucacccccaccccagggucucuggaccauacuaaagaacccacucauauaagaggauauuuucugaccacaguggaauuaaauuagaaaugguuuaaauaaaaacuagaccuagcacuuugggaggccaaggcgggcggauggcuugagcucaggaguuugagaacagccaggggcaacaugacaaaaccccgucucuaaaaaaaaaaaaauacaaaaaauuagccgggcaugggggcaugcgccuguagugccaguuacuugggagggccaaggugggaggaucacuugggucuaggaggcagagguugccgugagcugagauugcgccacugcaguccagcaugggcgacagagugagacccugucucaaaaacaaacaaacaaacuagaaaaacuuugggaggccaaagcaggaggaucacaugagaccagaaguuugaaaccagccugcacaacauagggagacccccaucucuacaaaaaguuuuagaauagcuggguaugguggcgcacaucuguaguucuagcuacugggaaggccgaauccagagaaccaccugagcccaggaaguugaggcuacagugagcuaugaucacaccgcugcacucuagucuggcaugaucucaaaaaagaaaauccauauauuuggaaauuaaguaguauacuuuuaaguaacccaugagucaaaaacaaaacuauggaaaugagaaaauaacuaauguaaguagaaaauacuugugucuaaaaauugacauugaguuaaguaaaggacacccuucuaugcuauuggagggaguguaaauuggcacagccauuaugguaaacaguauggagauuccucaaaaaaucgaaaauagaacuaccauaugauccagcaauugcaucacuggguguauauccaaaggaaaugaaaucaguauccaaagagauaccugcccucccauguucauuguagcauuguucacaguagccaagauacggaaacagccugaaugcauuauucaaccuuaauaaagaaagaaaucaaucuuuuaaaauugaagggaaaagacagggaauccugccauuuacuacagcauggaugaaacuagaggauaugcugagaaauaggccagacacagaaacgaaaauacuacaugauuuugcccauaugugcaaucuaaaaauguuaaacucacagagagaguagaauggugcuaacaggguggauguuagaguauacagaauuucaguuuuaagaugaaugaguucuggaaaucuaauguauaacauagugacuguaguuaauaauaauguauuguauuguauuacuuuuaauggcaaaaagcacaauuacuuuugcaccagccuaauaccuauagucccaggcaauucagaggcugaggugggaggauagcuugagcccaggacuuggaggcuucagugagcuaugaccuagccugggcaacaaagcaagacccugucucuaaaauaaaauauuguguacuugacauuuucuaagaaaauaaaucuuaaauguucucaccagaaaaacagaaggggaaguaacugugagaucauaaauagguuaauuagcuugauugugauaauuacuucacaauguaaauguacauuguguacaccuaaauauauacagguuuuuuuuucuuuuuuuuuugagacggagucucgcucuguugcccgggcuggagugcacuggugcaaucuuggcucacugcaagcuccgccuucuggguucacgccauucuccugccucagccuccugaguggcugggacuacaggcacccgccaccauaccccgcuaauuuuuuuguauuuuuaguagagacgggguuucacugcguuagccaggauguucucgaucuccugaccucaugauccgcccgccucggccucccaaagugcugggauuacaggcacgagccccugcacccugccaauauauacaguuuuuauuugccauuuauuugccggucaucucucaagcugaggagaaaaugauuuaaaaaauacuuauaggcuggaugcgguggcucauaccuauaauuccagcaucuugggaggccgaggcaggaggaucacuugagcccaggaguuugagacuggccuaggaaacauggugaaaccccaucccuacgcauaauacaaaaguuaaucaggccugguggcacacaccuguagucccagcuacucaggagacugaggugagaggauugcuggagccgggaagucgaggcugcugugagcuaugauuacuccacugcacuucagccugggugagagaacaagaaccugucucaaaaaaacaaaagucagccaggugugguggcucacgccuguaaucccagcacuuuaggaggcugagguggguggaucaugagaucaggaguucaagaccauccuggccaacauggugaaaccccgucucuacuaaaaauaaaagaaauuagcugggugugguggcgcacgccuguaaucucagcuauucgggaggcugaggcaggagaaucacuugaaugcaggaggcggagguugcagugagccgagaucaccccacuguacuccagccugggcgacagagugagacuccgucucaaaaaugaaaaauaaaaguacuuaugucuaaaauuuugaggucacuguuaauguccuuuuugaauggaaacaugcagccuuaaaugcacaaauugggaaagaagaaaggcuggaauaucagugacccuagaaagcacaacaaauuauacccuaaaaaaguagaaagauggaauaauuaggaguaaaauuagugaaauggaaagauauguuauagaaaggaccaagaaacgcaaaaguugguuauuugaaaagacugaaaaaauucaugaaccugugaaaacaguggucaagaagaaaagagaggcauauuuugaucucuguuuuacauguuacucaauguucauugcugccucccuuguccauaaagugccuuuaguguguauguuacuuuagauuaucuuggugucaucaagcuuuacucagcaaagaaccacuuuguugucuacuuuaaaacauaguuaucuuuaaaagaauggguaucuuuauaguuccauauuaauggcgagaaacugcagguaacagugccuuaccagcugguuuugcuaacuuuucucuauuuuguagguggugucggguuugacaucaacugugguguccgcuugcuaagaaccaauuuagaugaaagugauguccagccugugaaggagcaacuugcccaagcuauguuugaccacauuccuguugggguggggucaaaaggugucaucccaaugaaugccaaguaagagcacacguuuccaguacaugguaugggagggauaauaaccacaugaccuucagcuuccuuuccagugcaguacacuugagagaugaggauuguucaguuacuuuucaggaaguaguaagaacuguuuuuuuaagcaugagguacagcccauuuauuggagacauuagucaaccgauguuauaacagccuuugacauagaguaguauuuauaauaacaucauauccaccaacguuuauugagcacuuucuauguguaaggugcugagcaucauaucauuucauccagacaauaacccuauuaucuucccuaacuuacaagaaagaaaacugagguuuagagagguaauaagcuuagugccaggugugguuggguuuacagaaucccaacacuuugggaggccaaggcaggaggaucacuugaguccaggaguaaaagaugaaccuaggcaacauagaucucgucucuaaaaaaaaaaaauuaacuaggcaugauggcuugugacuguagucccaccuacucaggaggcugaagcagaaggaucccuugagagaccaggaguucaaggcggcagugugcugagaucucaguacugcaccccagcgugggcaacagagugacccugucucaauuaaaaaaaaaaaaaaaaaaacuuaguaggugauaucaggauucaaaccaaagauccuuugacuucagaagcuguauucugaauccuacugccuuuugucauuaagccuauuuaaccccaaccuuccucuuugaaugauagcacuggauguguucuuugguaaguagaggauuaaauauaaugcuauaguguaucucucagauggccauagauuuuaccgugucauagcuuaugcaaagcagugcacccuaaacuuugcagaguacuucaguagcagaauagugugcuagcuauguuucuuuaauauuuugcuuuauccuucaaauuuaugugaacuuugcauuauaauuaauagaaaaaaauguuuuuagcuguuacuuguaauguuauuuaacucccccuaaccaaaaaaaauaccuaaguaaaaucaauauacuuggaugaugcguggucugugauuucacaugaucccugacaugcagccccaauuugaaaagcauacguggaacacacaaauuccaaacaucuuuauaaacauuuuagauaggaauuuugucuacuaauacugaaaugggucuacucugggcacacugccuauggggugacccugcucugcaaggagcaguaaaaaauaauaacaaaaugaaauaaugauagugaaaugggcugucaucugggguaguggggagagaacauugaaaaguguaguuuuuccuggcaguguuuuagaagagagcuggaccuuggaugaagauuaaagcuuguacccucuaaggguuuaauguacguguaccucagcuucaaaauggaggugccguaagccacucagaacuucugugaagaugggaaaacagcuuaaaauuuaaccuguguugccugaggaauucuagauaccuucauuuauuugaccguaauucauaaaugauuaagguguguaccugguugaauuagucguuagagagugauagcugauuaagguuacagaguuguuguuguuguuuuuuguuuuguuuuguuuuugucuguuuaaucacuaccucauggaauucaggaucagagaggcaaaacugaauauaaaaaagauuugaaaauuaacaaggagcaguauaaaugucaaguagaacuauaaugaugucuaauagggcauuuaucauuuuauauuggaauuauuuauaugacugcauuccucaaaaaaccaguuacugagagcuuaaacuuuguaucugacucaaggcuuggaacacaggagauaguaaaugucgaguuuuucucugcccuuuaaggauguggucauccuuagguuuugaucugccuuugcugugagaugacuagcaccuuuuauacuuauccagagacuuggaggaggccuuggagauggggguggacugguccuuaagagaaggguaugccugggcugaagacaaggagcacugcgaggaguacggaaggaugcugcaggcugaccccaauaaaguuucugcaagggcgaagaaaagaggccuuccucagguaacucacuuuggaggggcaacauguuaauuuuuuuuucauauuuuguuuuuauugggggaaaaaaaucuauaucuuacauuuagcaaacauauucccagguuuuuuuaugguauaucaaaaaauacaaauuuguuuaugcuucauuuuuauucuaaaaaaacuaucagggcuggaugcgguggcucacaccagcuuugagaggccaaggaggaagguucgcuugaggccaggaguucgagaccagccugggcaacauaagaagacuuagucucuacaaaaauuaaaaaaaaaaaaaauuagccaggcaugguggcacaugcaaguaaucccagcuacucagaaggcuaagacaggaggacugcuugagccuaggaguuugaggcugcagugagcugugaucacgccagugcacuccagccugggugacagagcaaucaggagcuugcaaauguucauaaaauaagaaauaaugaauuagaagugaaugggagaaaaauagaauauguuuaucagguucauacgucaaaauuacauauauacauauuuugacagucuacagaugguauccaugagauaagaauauacuagauguuugaaauuacagcuaguugugaaggcuuugccacuaauucagugugacacgugggcaagacugucuucucuggaucucauuuucuuauggaaaacugggaugguuaaaacuaggcaaccucuaaagacucuuccagcacugacauucucuaguucucuaaaucaucuauuaauauuagcuguaguugugguauauguucuuucaguuauaaauaaugguggauguccaugaacucauagauguuucaaaaucauuugaacuuggaccuugucuaagagucaacauuuaccaacauuuaucccaaaauuugacucuuugugauguuuaaaauaucccaugaaccauuuaaaagcuugauuuuuuuuguuuaugaagcuuuuuuuaaaaaauuaauuuauuuacuuuaaguucugggauacaugugcugguuugugacauagguauacauuugccauggugguuugcugcaccugucaguccaucaucuagguuuuaagccccacgugcauuagguauuuguccuaaugcucucccuccccuuuccucccacuccucgacaggcucugguaugugauguuccccucccuguguccauguguucucauuguucagcucccacuuaugagugagaacccgugguguuugguuuucuguuccuguguuaguuuuuuauauguguauaccaagcauauaaugauauaacaaaauucaggagcuagucuacguuauuuuguuguguagaauauuguaaaugaaacacuucuauagcuuaggaauuuuuuuguuacugaaacacuauuuguauguuuauuuuguuguuaguuuguuuuuaucuuuuugguuuuuaaauagauuaaaaaaaaaacuggaauaaaaacuaucuuaccagacauuuuuacauuugcaguuggggacccugggagcaggcaaccauuaugcagaaauccagguuguggaugagauuuucaaugaguaugcugcuaaaaaaaugggcaucgaccauaagggacaggugugugugaugauccacaguggaagcagaggcuugggccaccaaguagccacagguauauucuagacuuugugcuaaaauguacauuuuaugggcaaccagauagaaauuuaagagcgaaaacucugaaauauacugcauggguuuuauccugaguccucaacaauuaaauaacuuggacaaauucacugggccauaacuuucuugucuaaaaaaaugaguauaauaguuauuucauauagaauuaucauggaaaguuaauaauauauguaaagcacuuaauguuugacauuaguaaacacucaauaaauguuaguugcaguuauuguuauguuuacucuuaugaguuacuaucuggccaagaaagagcaagaaauguguaaagaguggaauuuaugaaauaggcuuucauuuggcagauuauguaucauauaccugcucugcaacaguagaugugaugguggauuugcugaugaaagaggcagauacuuugcacucaaauugucucaugaaguaaaggucauguccauuuaaaagaaaaaauaaauauuaaaagguagcaauuaauuauauaggagagucaaacaaaacacauuuaagaaaaagauuuuggagauggcuucauggacccaguguugagcuggaucucacaguuuggacaauuacacacaaagacuggugacaaaggcagcaugaacaaaagcaggaagcagcgaaauauuggauagguccuuuuggauagcuuggagggugugugaaauaauguaugaauugugacgguuacuacaggacugaaugaagcgggaugaacgcagaaaugaaaacaaaaaacaaaagaaacuuuuaaagaaggagucaggggcuucuugcuucuagugagcuuccacagcccuuuguauuuauuggguagaaagagcagggaggaggagguaacuauuggucagcugcuugauugaucccagguucauauuauugcuaacaggcuucacaugugccugucacaagaaacacuugugccuggggcguggcugcccucagcauuccuucugggcaacagacgcaguugucagcuugccagcaucuugcauucauaagaacaguuugcuguuuacucauagccuccagugguauacugaguuguucacgacccucauucuuucggccuccaacagcgaaucaaugaaaagguauauagaugccuggaaauuguuauaagcuuaaaauuccauguuacagaucagccucuaguccauuuuauugugugagaauuuaauaauuugugccagccugacccucuagacuauuuaaccuagcagauguacgaagugucaacuaguguuucagaacauuccccugaguacuucucugcauuuugucauggauuugauuaaucaugaaggcaacaaaauguauuuugcuacuacuauucccaugcauucacauauugagaaaggaguaaugaagaccaucuuguggcuauuuguuuacacaucccauucucuuucaaguuccuagagggcaaauguugacuuugugucccacaaacugucacugcacucugaaagauucucaaguacgucuugacugagcaaauagaugaacucagaaacacauuaaagggaaaguuggcuuucauuggguuuuuuuguggaaugaauuugaauguagccuaccuuucugcaguaaaucugaacuguucauuuaagggaaagcuaacugguuuggacuuuguggcucuuguuccagaugcgcugguagcuauggagaaggccaugaagagagacaagauuauagucaaugaucggcaguuggcuugugcucgaaucgcuuccccagagggucaagacuaucugaagggaauggcagcugcugggaacuaugccugggucaaccgcucuuccaugaccuucuuaacccgucagguacaguagaaguugcucuucuguuccgagucauucaugaugauguuaagugcuuuaaaacauagugcaguccaggcuggacacgguggcucaugccuguaaucccaacacuuugggaggccgagggggggcggaucacaagguuaggagauccagaccauccuggcuaacacggugaaaccccgucucuacuaaaaauacaaaaaauuagcuuagcuggucgucguggcgggugcauguagucccagcuacucgggaggcugaggcagcagaauggugugaaccuggaaaguggagcuugcagugagccgagaucgugccacugcacuccagccugggugacagagugagacuccugucuccaaaagaaaaaaacaucgugcaguccagucaaagccuaugguguuugguuuuggaaauucacauaguuaacuuucaaaauaccagagaaguguccaagguuuugguguugucuuaaacuaaaucaucagaguaucaggcaugagaaaugagagcagagaaucaaaauuauuccuagaauuugucuugaacagcauagagaauaaaagugccacugacuaagauucagaaggcugagaagaagcaauuuugaaaggugggaucaaaaguugcccagcagcuuuucaacuaaagaugaaaaugaugugguggcauuuccuguguggucuaaaggacagcuuuuguccuuuacgugaagauaaucuuacggcuacuuuugaacuuuuaaaucuuuuacucccuucagaacagacuaccugaaaccagugagaugagucacgaagagcugaacauaaguccugaaguucuggcugcuuuuaucuucuguguuuucuccuaggcuuucgccaaggucuucaacacaaccccugaugacuuggaccuacaugugaucuaugauguuucucacaacauugccaaaguggagcagcaugugguggacggaaaggaacggacacuguuaguacacaggaagggauccacccgcgcuuucccuccucaccauccccucauugcuguugauuaccaaguacguagcucuacguuuguaguuuuaagcagugggggcacgauuuagauuguugcaaaugugaauuacauuuaaaacgaaaagcagcaauugugaaaagaaaauacucugucacucaugagaacagugauucccaaucuucucugaagcaguaacuccuucccccaucauuugugcuugcgguggugccgugugcuauagcaagugcugcaggaaguguauuuuacuccacuaccgugaauugaggccuuugaauuaguggaagacaggaguaacucaguuacagaagacagaguaaacucagucuguuucauuccuccuguccucuuggugucuggcugugguggaguucgaaagaccccauagucugcuugcuccuuuuacagaugagaaacccaaaacagagaagacaagcaccuugcucaggauggugguucuagcaacacuucucuacacuuuuggauuuugcuuugcucuuauuuugacucuucugcauuuuuacugguccucagauuuucacucucguccucuuccuuccccuccgauuuaucaaagaaucaaaguacuaucuuaauauaguuuacuagccgcgcguuuagaagucuggguuucuccggccgggugugguggcuuacgccuguaaucccagcacuuucggaggccaaggcgggcaaaucacgaguucgggagaucgagaccauccuggcuaacauggugaaacuccgccucuacuaaaaauacaaaaaauuagcugggcauggcagcaggcgccuguggucccagcaacucgggaggcugaggcaagagaauggcgugaacccaggaggcggagcuugcagugagccgagaucccgccacugcacuccagccugggcgacagagcaagacucccaucucaaaaaaaaaaaaaagaagucuggguuucuccuacaauccuacagugcaagagaaaauuuaaauuuuaugcauaaaaagccuauguuuuucugaauuuuaacauguuugauuuaugugcauccucagcucacuggacagccagugcucauugguggcaccaugggaaccuguaguuauguucuuacuggcacugaacagggcaugacugagaccuuuggaacaaccugucauggagcgguaaggaaaacagaaacuuccuuagaaaugcucucuucaguuuagcuaugguuuuccauuuugacugguaaauguagcugauugaacauuaacagaguugagacuugggccuaucaugucuuguacuucaaauuguuccccauaauguauacuauuuagugaacugacuggggucaccuaguaucucugccucagugagaucugguaggguuagggaccguuucuuaucucugcaaguccagaaaauccagacugggaaauugucacacuagcugagcuuacugucugguuuauaagugauagaacuuuaacugaugcaaauaucacaguugaucucagcgacugacuggaccugcuccuuuguuuaauuugccccuuccuauuguguagguccacgcaagauuggaaggauaggcccuauuugcaaauuagagcccauguacagucuacacacacacccauuucaaaacacugccucucaucuucuaagcccaggggucaggaaacucuucccauaaagggccagaccguaaauauuuuaggcuuuugggaccagauggucuguguaccagcuauucagcuaugccauuucagugcagaagcaaccuuaaguacuguguaaaugggcaaugcuguguucuaauagaacuauuuuaggccaggcaugguugcucacacuuguaauuacagcacuuugggaggccagggcaggaggagcacuugaagccgggaauucaagacuagacugggcaacauuagcaagacaccgucuccacaaaaacuuuuuaaauuagccgggugugguggcacaccuguagucauagcuacucaggaggcuaaggcaggaggauugcuugagcccaggagauuaaggcugcagugagcuaugauuaugucacuucacuccagucugggugacagagggagacccuuucucaaaaaacaaaauaguuuauuuuaaaaagcagguggugggccauauuuggcccauacaccguaguuugccggccccuuuucuaagccauccagaguguugagccaguguugaaaugggaaagagaaacugucuagaguaccuucuccuaggacagaccuucacaaauguauuuaauccuacuuuuuuuucugauuguuucucauuucuagcugccucccaacuccuaauuuuaacccaguaguuuucaacaaaggagaucccccuaccgccauggggacauugacaauuucuggaggcuuuuuuuauugucaugguuuagugggaguugcuauuggcauuuagugggucuuagaggcgagggaugcugcugaauacacugcgcugcgcugcugaauacccugcauaggacagccucccaacaaagaauucuccgguccaaaaucuaaaaggauaugaugagguuuaaaaggccuguuaccaauucgauaaaguaaaaaagauguuuuuuuaagcuccuuuuuagugugagagaaaaucagggaaagggcuuaucaucuuaggguuuaaaguaaaguucauuccuuucccauucuagggccgugcauugucccgagcaaaaucucgacguaauuuagauuuccaggaugucuuagacaaauuggcagauaugggaauugcgauccguguugccucacccaaacugguuauggaagagguaagugaaauuuugauaaauacaugaauauuuauuguuccccauuuguaauuuguuccagucuacagagacagcaauuuaggguguuacuaacagaaauuguuuggguuauuuuuuuuuaugaccucaauuuuggcuuaucuuccuuggauuagcuuauuucaguuuuauguuuucauuucuuuugguuaaaauuacgagccaaguccuuaagaaugauuuuuacuguucauuuauagucuccaucuacauauuaagcuuuucaagaguaguuugagcugacucuuguuuuugcacaauuguauacuuagguuucaauuugaaagcaaauuugaaaaaggaaggcauaaauguuuggagaaaguuuuauuugauucacaggagaacagauuuuguuuaaauucuguauauauguuuacauauauguacauauuuaaauuaaaagcaauauaauuccuuaaugauuuaagagaaaagaaaaacagucauccaaaaacucaaugcccugacacaguuauuaccuuaucuuuuagaauacuuauuauugucggccgggcgugguggcucacgccuguaaucacagcauuuugggaggccgaggugggcagaucacaugaggucaggaguuugagaccagccugaucaacauggugaaaccccuacuaaaaauacaaaaauuagcugggcauggugguggacacccauaaucgcagcuacucaggaggccgagacaggaaaaucacuugaauccgggaggcagagguugcagugagccaagaucaugccacugcacuccagccuagaugacaaaguaagacuccgucucaaaaaaaaaaaaaaaaaauuuacuuauugucauaguuuuuuccuaaaugcuuuuuuuaaagcuagucuuaauuauaguuaagaaacauucuguaguuauuuuuaaaauuuugcacauuauuauaaaauuguuugugucacuuuuuaaaaucauugcugaauauuccaccagcugaguaccuuacuuucugccuguaguggacauuuaaguagcuuccaaauuuuugcuacuauaaauuaaauuguaaugagugucuucaugcaugaagguuuuuuccaguuguuauaguaauuagaacaaagucucaaaaguggaguuacaugguggcucaugccuauaaucccaguacuuugggaggccaaugcaggaagaucucuugaggccaggaguucaagauuaguuuggccaaagauuagccagguguaguccuagcaacucaggagacugaagcuggaggauugcuugagcccaggaccuugagguuacaguaagcuaugugauuguccagacuuggugcaaagcaagacccuaucucuaaaaaaaaauaaggaaaaaaaguggaauuacugagucagaguaugacaaagacuuauuuuuuuuaauaacaauucauuuuuccccugaucuuaagaauacaugguuaauuuaaaagauuuggaauauacuggccaggugcaguggcucaggccuguaaucccagcauuuugggaggcugaggcggguggaucacaaggugaggagaucaagaccauccuggcuaacacggugaaaccccaucucuacuaaaaauacaaaaaauuagccgggcgugguggcgggcgccuguagcucuagcuacucgggaggcugaggcaggagaacggcgugaacgcgggaggcggagcuugcagugagccgagaucgcgcuacugcacuccagccugggcgacagagcaacacuccaucucaaaaaaaaaaaaaggauuuggaaaauacaaaggagaaaacagaaaacauuuagaauucaaucagccagaaauaauuacaguuaaaauuuggauuuuugguuuuuugguuuuguuuuguuuuuucaccugcaacacgugauuauuugauucacuuacucagcuaacacguacuaaccauccgcuauaguuagguacuguucuauaugcuagagauacugcagugaacaaaagaaacacgagucccuucguuguggagcuuuccaaauaauaaaacauacaguguguuaaugaccaugcaaguucuaugaaauaaaaagcagggaaaggugguaaggaaaggugggaagggguacaguuuuaagcagguggucggagaagacuucagugaggugacaguagagcaaagaccugaagagagagaggaaacaggcuaccugggcaucuggaggugagcuuucgaggcagagagaacagcaagcgcaaaaucugugagcugagguuaugaaggaguguucaagaaacagcaaggaggccaggcaugacaagagcaagccagagggagaugaggucagagagguagggggcgccagagcauuuggacuuuugcuuuuacucugauuaaaaugaaaaaaccuuggaggauuuugagcagaauagugacgugaucugacaaauguguuugcauguugaugagaagaaucuacaagagaaauuaaugaugcagaaaagagggaggaaauugcuggagaaguguccuugaauagaugagaggagauagagucugauguacaaguggaugggguuggucuuugcuaggagcacagauaauucauccuuuauaaaaggagagaagaagcugagcacaguggcucacaccuguaaucccagcacuuucgggaggcugaggugagaguaucgcuuaaagccaggaguuugagaccagccugagcuacaaagcaagaccccaucucuacaaaaauaaaaaaaauuaggcacaguggcacaugccuguagucucagugagcuaugauugugccacuggacucaaccuugggugacagaguaaaaaaauaaaaggagagaagguauagauacagauauguggggaagauaaaguuagcauguuuaugaauauucuggcugcuucuauuuuuuucaguguauuacauaguaaggucagcaagugagagugggaucugagaaaagguaugaaauauucaucuaggggagagacagucauuggcccaguggaauuucaucugauugccaggagcuagaaaucgccaaguaguacuggggagugauucaggcucccacagauaacuacagccaaagguaguuugugguacgauguaaugacugcaagauucaaaacuaggagugccuagggagaacgggagaauagaaacaaccaugaaagccaggagcacaccugucccacuucugggaccaauggcaugaccugauuuggggaaaacagcagucaccauucagaaaguuggagaugaaagugguauccucgggaaagauccguguuucaguaaaacaagaaggugaagggaacauucaaagaagaagggagggaggggauuuugcuccuucuggaaggaguuccagaggccacagugggaaaguuucagaaacuggaagggaaugggagaugggauagaaaaggauauuauguacagaaccguacgggaaucagcauggauggccuaagcuuguauugacaggaaugaagauaaagugagugugugaugagauuagugcuaaugguggcaaggcuguguggguaggauggaauggugggaauguugcuggaaagucacagaaauugucugugaguguagguacacauagauacccacauauacaugugcacacaguuuuacuuuguuuuauacauauaugaauuuuauaacuuacugugaagguacuacauguucauuccagaaauuuugauaacugcagaaauauauaaaggaagaaaauuaaaauugccaguaauucuaccaucaagagauaauuaucacuaacauaugaugguugggugccguuucuuccaaucagguucugguguguguuuuauuuacuuacauuuacuacauuuccuaguuauacaaguaauacauguucuuuaaagacauuuugaaaaauacagaaaaaaaaaaaggugaaaguguuuuggaaaucagcacugaccaacaucaggcuuacuucuuuuuuaaauuuuugcuaauuucauaggcaaaaaaaaacucucuguauuauuuuagugugcauuuauuucaucacaagugaaguuuggugcuuguaaagacuguguuuucaguggacuuguacaauguuuaaauuccucuccugcaggcuccugaguccuauaagaaugugacagaugugguaaauaccugccaugaugcuggaaucagcaagaaagccauuaaacugagaccaauugcugugaucaaaggauagaaccuuggacagcagggcugccugacaccaccaacccucucugaaguggaaguggacugacaugcucuucugacaucagacucaaggcgggacaaguugcaaagugugcagcuguaacugcucacgccaaaauggcugauggggaggcugcugcuuucaggggcccgugcuuguaaaauaaccuuccaggaagaggcacauugcccaccuuuggaaagggaggaauaugccuucuccuugguuguuccacagaguuuuaggaaaaucuguuagggauggguagaugucaaacugccuuacgcagucauacugaucuuuagccaucagauugaucuucuucacaccaagcucuguuuacauuccgagaggugucaugaagaaaguucuguucaauaagguuuuggaauguuuccuuuc

SEQ ID NO: 192186 - RNA, 179434 nt, Homo sapiens
gccauuuuuccuuucugaaggcaggucucaccuaucuccugguucgaucuaggaaaaaggaaaggaagggauuuaaaaguaaacagugaaaugagaaagaauucacugggaguuuaucaaacuaaguuaaaauagcuaagucagccugacaggugcuuggcacagagaaggagcaaauauuuccucaugaugcuacaacauuuaguaauuuuuugucuuggauugguuguacaaaauuucugcuccccagcugaaaccacagggcagguaagaggagacuuacauauuuuuuucauuuguuaauugucaugauauguucaaaagcuugucguuuuccucuguuguuauggguaaagggugaaaucuggacuuuauaaaauacagagaauguuuuuggagacuaaguccuaauugugaugcaccaucuuuccgaaggugugcuaacccacuuguugcucuuccuguacugaagcgccccgcugcuguugggaccucuaaucuuagugcuaacgauccucuuuccagugcagcuguuggcgucuuguuuuucauuuguucuaguagucucauuacugugaauaucuaccaucccaucuuccugacuagaaaauaacuauggcuguggagagauggucuggggaauuccaggguggauaucucacuaaggaacacaaguaucagaaauauuuccaaaaucaucaggccuucacccuuucaucucuucugccuuccacagagcuguaguaaaaguucccagggaggucuuaccaguagccccuaugaaguacaucagcacaccgaacccucaagcaagcucaccgaggugucaucacagagugaggccagcugucagugagacaccaugugauuucugauccaucaagaaugaaucuuaaccaugauucugcaccugugccaggcaaauuuuuaucaacaccaauuuuauuacaguuggcugcaugcucugauaauguuuucaugaaaauaugggaagauggccuaauggcuaagugcuccagcuuugaaauuugguaggggugaguuugaacuguggaucucauuuuucuguuuaacaaauaggucugaggaucagucaugaucguccacagcuguuugacccugagcacguuuuuuaaucucuucaagcuucagucucgccccugacagugcuccacaaaugguaguaauuaucaucaccaucaucaucuucuuaaucaccaucaucaucaucaucauuaucaccaaguguuugcauucacacagaaaucagaccuuaacuaauuuaaauaagcugaauuuacuuuucagagaggacaacuuugucaauacuguaugagacagacaaugagccuuuucauuugaaaagggcaauuugaaggucaagauguuucuuaagaagaggguuuuaaaucuagcccacaaagaaagaaaagacaaaguacuguaaccccacauacuuauccaaaugugaaacccucauguaaagaaaagcuugcuuucaaaaaaaaugugaagguguccugacaauuaaaggagguuaauucaaacucuaucuaaguguagcuuuuguuauuacucaauaaagaaccuucuagugcuauuuugguucaugaugaucaccaaaugaaaacuccugguaaaaauagaaauuucaguuuucuauacuccacucaggugcaggaaagagaaagggcuaaucaaggaaucacaagaccaguaacucacagggugaccuugggcaagucacugcaacaccccucaccucaguuuucuuccagcuaaaaugaggaugaugauaccugcccuacuuaucuucagagcagugaagaucaaauaagauaauaccuuugaauggaugcauaaccaauaaucguucugaagauguaaaguuucuuuuuaugcaggcuuuauauauuucaaugaacuuagaagcaguggugacauuuccaccacgaccaaccuauuauuaggcccguggaugagcugugggauaauacagaagcaugagacacaauccugcccaagaagaagccuaccucuuucugcucuguccuauggccuagagcaaaccuguucaaaaagcagggccucaaaauguguugguaaugucuuuuuugauuggcagguccuuucugccuucccaggaaaugccuggauuagacuccuugcccuggaaaggucaagguuugggguucaagagauccuaccccuucucucuacuaacugcucuaugcucaguuuuaccucagcauguuggcacagcauauuucuaagaguuuagcaaauaagaaucaggugucuuuuaauggagugcaaaaaccaacaaaaugugcuccacugggccagccacaggaagaguagaaguugagaaaaggaagaaaaaugaaugugguuuugugaaagagguggugugaaacagggucuugaaggauaugguucagcagcccagugagaacauggcaguuaggagaggaaacaggcacaaaggugagugaagaguuacagcagccagcauucaccaccugugauacuucagacauuuuugccaggaaauuugcaccugcuuaagugaccgucaucauuuaaaggucucaauaaccucaagagugguuauuaauaucuccucuuuauaggugauggcaaaggguaagcaauucauucaagauuguacacuuagcaagauauagaguuugacuccaaacuuaggucuuuugauccccaaguuuagucucucuuuguuguacaaagcugcuccaucuuaagcuugaugaggaaaugaagaaaaguugaggaaagggaggcaucucucggggaggaucagccucggcauuaugagcaacaggggauccuaaagagugccaaauugggucuggaucauucaauuuaguaguuacauauccaccaccuuauguugcuaaauaacuguuucuagcacaucugauuuccccaauucauuuguuuaaucaacaaauauucacugagcacugcuaugcaucagauacuauuuuagggcuuagguacaacaguggacaaaacagagaaagaucccugcucucuggaagccuacuuuucaguuggauuguaaucuaaagauugcaaauaucucugaaauaguaacuguauccuccacggcacuggcacagugcuggcuccagagcagacauuccuguggaaucaaugaugaaagaacauccuugagaucugcugaucuaugaccaauugaccuugaauaaccugcuuuacaaauuuuucacuugagaguguauucugccauauauuucagguuccccacuuggauaaauguggguaauaacauuaucuuaccuugcuagauuucagacucuaucucagguauggcaaauguaugguacaaacaguggcucuuauuucaccuacagccauggcagacauugcuuauuaaucucaauacucuuuccagauaagauugaaaggagcaaaccagucauuaccaaucaaccuuaucaccaucccugacguuccauugagaugauuggagacauuccaguggagaagauuggccaugcuagauguuuugcaagacucugauaacaggaauuaauguucuuuuuuuuaauauuuacacaggcaagaagaugugauaggaagucucuucuuacaauuaggaccgagugccgauccugcgcucucaaccuuggagucaagugcccggaugguuacaccaugauuaccaguggcucuguagggguucgagauugcagguacucaugagaaaauaaacgugauggaacuaugaauccaacuugaagcucccugucucaaaaacugcaaagcauuuccaugacuuuucucuugcucuaagacaauaagcccaaacuuagguaacucacaauuuaugaacuuaagucuaaaauauauaaaauauauauuguuggccagguguggugguucaugccuguaaucccagcacucugggaggccgagaugggaguaucacuugagaucaggaguucgagaccaaccuguccaacauggugaaaacucaucucuacuaaaaauacaaaaauuagccaggccugguggcaccugccuguaaucccagcuacucaggagcuugaggcacgagaaucgcuugaacccaggaggaggaaguugcagugagccgagaucaagccacugcacuccagccugggugacagagugaaacuauaucucaaaaaauaaaauauauauuguuauucauucacauuuuaauacaaaauugacuuauuuuguauugcacauaaacauucucuuuucauuuugccuguauuuugaaaaucuggguuuuauuuaauuuggaaagaauucuagucuugaauguguuaaaagccuugagugugauagucaucucuucagcuauggaccuugauacuaauuagaagucgaagaagggggaaagaugaauugcagcaugguugcauuuuauguaaacuuugcauucuugaagaccucuugggauucaaaacucugauaacucaaggcuaauucuggcaaaggaugacaagugguucugcucacuagcuaaugggugcagccauggggcucaacugcaaaugcaauuuguauuugcgcagccuguuucuuuagaaauuagauaguacucaaugaguuugcuuuuaauuccggauggaaggauuuuuuuuuuuauuuugcaugaaaugaaaucuuaacacuauuauaucacacuauuuuaaauucacauuugcuuaaugugaccacacuauauucuaaaaucaaaaucaucauuuuaaauaaaaguuucccagcauuaacuaaccuagaauuagcaagcaguggguaucaucagaugggauaacuuuuaccuguuccuccuuuuggagguuagauucuaauacgaugauugaaguucguaugauacgugauuaaugucucugcauaaucaggacuuguaacaccuugauugcuucugauucuuucugaaaaaagaaaagaaaaaaaaauuagcaagcauaugcagcaguuaacacucaauugccaaagcugaaaacuuuuuuguacuggcuacuuuuuuguucauugccaagguggacacuugguuauguuccaauacacaaacacacaagcacacacacacauacacacacacacaggauaaaacuuuugcauucagaaauguuuuagauuuaaugacuuuggucuaucauucaucuaugcuggaacaaacucaagauugguucuuuuguuuuauguucuuucguucuguuugaaaaucacuuuauugagauauuacugacauacaaaaaccuggacauucuugauguacacaacuugaugaguuugaagauaaguacaauccaugaaaccaacaccacaaucagugucauaaacauacucaucaucuucaaaaguuuucuccccccucuuuuuugugauaagaacgcuuaacauaagaucuccugucuuugcaauguuuaagcauauauuauguuauuguuuaggcacuaaaucucuagaauguuuucaucuuucauaaccaaaacuuuguacccugcaaacaauaccuucccauuuucucauccuuccaacccuuaacaaccaccauuccacucuauuuauauuccucauauaagugggaucauauaguaucuguucuucugugucuagcuuaucucacuuagcaugauauccucuagguucauccauguugucgcaaguuacaagauuuccuucuuguugagggcugaguaauauuucaguguauguauauaccacauuuucuuuauccauucauccauugauggauguuuauguugcuuccaugucuuggcuauugugaauaaugcugcagugaacaugagagugaagagaucucuuuaagauccuaauuucaauuuuuuuggauauauaaccagaaguaggauuaauggaucauaugguaguuuuauuuuuaauuuuugaaggaccuccauacuuuuuucuacagcaguuauaccaauuuacauucucaccaacaguguacaguuguucccuuuucuccacauccuugccaauacuuguugccuuuuguuucaugcuuuuuauaauaaccaucguaauaguugugaggacguaucccauugugguuuugauuugccuuucccugguguuuagugauguugagcaccuuuuuauacaccuauuggccacuuguauucuuucaaaauuaguuccugaagggauauuugguccugcccuuggacucuccuucugcccaccuucgugaagaagugucccugccaguauucucaaccauucaaaaaaagucaacucuauccccaacuugacuguucguaaaguaugugacugugcuauuaaucagcuguauuucaaggauggguuugagaggacaaccuugaauucaucaucauguuauucuuaacagcagcccaguugaaagaaauggaaagaaacaacauuuaugaaggauugucucuagauacacuaagucuaauccuagaauaagccaugccugcagagaucccuuuaaauagacaauaguguuuaaccuccauagaauuguuauuccagaacuauaucucagcuggcacuagaaacucuucuaaggaacucaucauuuuaucuccuacaaggauauugugggaaauguuccuugcugcauuauacugccuuugccacaggcauuucuacaucugcaauaucuccaauaaauaugcuaagccugagcaauggguuugcuuuaaauccacacauacugugcauuuuguaacucaugaucucucccuuccugcauugacugcuaggauacucagugauaaguuuuagguauacuucuagcaugugccuaagccuuaauauuuauuucaucuacuaacuucacuucugauaucacuuuagauauuucccccguauguucauuguucucugauuuuuucauccaguucuuacaauuaaaaauaaucauaauuaaguuuuaugcuaccuagaaagccaaauguguuccaucuagauauuuuuaacuguagauaaauauuaagaccuaaauugaaagcuaaggcaauucuaccaccuagaguaacugcauugcucuuaucguggguuaauguccucucuuuacccuccaagguacaccuuugaggucagaacauacucucugucucuccccggaugccgccauauuuguaggaaggacuaucuccaaccucgguguuguccuggccgcuggggcccagacuguauagguaaguggcacaaugcuuggacuuugagacuugcuucuugguaucucauuugguagaaaauugagaugaaggaagcccaauaaaaagaagaauguuaacauccguuuguagaaauuucuguguuagucuauauguagaaaaucuuucuugcccuguuagcuuucacaaagcaaucugcuuuacugcugauagagaucucucuuuaaaagaauucccuuauaagccagaaaaagggacaauugaaaggauacccauuuuuauuuuaaaagauauuugcaaaagaaaggaagucaaaaccugggcuauuaggacccccaaauacaauuuucuuuaagaagaaauuuuguuacaaugucucaaagacuguaguuauuguuuggcaaccaaaauaauaauuaaauauucuaaaaauuugucuuaggauggaauaucaaacuuucaagugguagauuuaagacacaucaggguaaagaaacuguguaaaguuaauuguguagagaugcaaauacacauauacauaaaaauuaauucugaccagguuuuacuguaagcaaaacuacuagcaaagucugaaucaaugguauaguuagauuucugcaaucaagcauagcauuugauagcugaaauugaacuuuuauccuuaguauagauacuaacacucaaauagugacugagucauuucuaccuguggaaauuauguaaagucuucuuuuuuugguaggaaaaaaucagguauuuuaauuuaugaauuugcaauucauuccccaucuucuuagauguaaugaaaacaucuccuuaggauccacauaaaaggagagauugguucucuuuugcuuuguuuuuuuuucugauuaaaguaauacaagcaaauuauauacacuuguaaaguuuacaaagguauaaagaaagaaaaaauaucaauuuguauucugucgcauauaggaaaccuuaaauauuuuggcauguuucagucuuggguuuuuuuccauauaacuuguaaauaguugaauccauacuguauguauaaugucuuuuggguuuuuuguuuguuuauuuguguuuuuaacuaacgauuaaaugaauaaaugcuuguauuuacucaauauugcugacauuagguaccagagagguacucagcuuauauuaccagauguaauuuuuaaaacaaaucuuugaguuagacauuuuuauccccauuuugccuaugagaaaucagauuuuaaaauuauauuuugccaguuuccuuuggacugguaagugauaaagcaaauucaaguucaaaguugccuggcaccaaagccuaccucuuucugcucuguccuacuguccagagcaaaccuguucaaaaagcagggccucaaaauguguugguaaugucuuuuuugauuggcagguccuuucugccuucccaggaaaugccuggauuagacuccuugcccuggaaaggucaagguuugggguucaagagauccugccgcuucugucuacuagcugcucuaugcucaguuuuaccucagcauguuggcacagcauguuucuaagaguuuagcaaauaagaaucaggugucuuuuaaagcaauuaacucuguuaaucaaauucagugucuuuuaaagcaauuaacuccgacuuccagauuuuaagaacauuuuuugugccaaauguggucaugaucaugucuaguucucauagacauuuugauacaauagaaagaacuuuuagauuugcuuuucucuuucuaacccacaaaaacaaaucugaugcuaaguuacuaaucagaaacauugaagacaaggaacggcuuugucaaagaugcaguacaaaagucagcauguccgacauaugaaugucagaaaacagccaggagggcaaaagaacacugggccagcagcuagaacuucaucccaccauuuacugguuggggcaagugacuuucugccuacuccuuauucuccucaucugucaaaugggggcuaaaaguccuacuuuacaaaacuguaguugagauuuuaaaacacuaaccuaggugauaagacuuggcaaagucuaugacaaaaagaaggaauuuuguaaguguuuaaugaauaaaugaaugggugacucaaagucaaaauagaccucugauaaugaaagaugaauaaaaugacacuccucugaacccuuuuuuaacaguggguaacucuuaaagcaugagcaggcaaaaaggauucaagaucuuuuagcagguuuaugccaucacacugugcuaugugcagaccaaugaggcaagguccacaucuacaaccaaaagaguccaaaaagguagcugggcaugguggcaugugccucuaaucccagcuacuugggagacugaggcuggagaauaacuugggaggcagagguugcaaugagccaagaucaugccacugcacuccagccuggguaauagagugagacccuaucucaaaaaaaaaaaaaaaaaaaaaaaaaagaguccaaaagggcucuuugaauguucaaacauuuccuucaaacaggccucaaagccagggaagcaaaacaugaaaacugaggccuggacauuauuucuacuguccuuucacuggggcaaaacgguacuccucuuuaucuucaucuuccaaacacacuagaugucucgaaaggcuuccuuccuuuggcuagggaaaaagauaaaaccucuacuuggcaguauauuuuaccucucacauuuuguggugaugacaagcaaaaccuugacuaucacuuuacauuuccguaaggauaaggccauuucagagcugcugacgugggucuauccuucuuucugaggaagcacauucccaagcuccagaauggccuuguuuccaaagcaaauggaacauccacuuccuuuuuaaugcauugacaaauacauucauauguaacacuucuggguuauuucaaaaauuaauauaucucacucaaauugggaaaucacccuauggucaacgcugaaaacuuggagaagguaaagaagcgcaaugaaaaaaauuacuaucaucuucuaaaauuaagaauaaagcaugaauucucacuuggggaaaaaaauaauauuaucuugacauaaggaagguauuucuaccugaauguaaccugcuucucccuaauuaaaauuuauacuacuuuaucaaaugugcacauggagaucuuuccucauuagcacaaaaauacauuucuacuuugaaacuuaaucaugucugaacagccgauauucuauuugggaugaaaucgauuuuuuaauuugaacaucuuacuuuuuuuuuuauucugccaugaacguuaauggauuuguguaacaacucaaaguaauggaaaaugaacaugugcaaaggaguuacacccaaacucaguuguagacaaaacaaucugauuauuucaaaaagaaauagucuugauuuuucuuuuuuaggucaaugucaucaaauuaucuaaauuuauuuuuuauaucauguuauuugcauuuccaggccucuuuuucuuucucacugcauuuuucuugccauucacuacccagguuacaaauaauagaccacaaggauuugaaaccauccuuuuaggcauuuccuuuuuugcucugagugacaaauaaugcggaguucacuuaaagaacauauuucacuucaguuucccaggcagacaaauccaacaagagcuauaaauggaauauugggacauauuuucugccuagcacuguucaccaagcuuuuaaacaaagguggugacauggaauaggcaccucuagaguuucuuaggagauaaaguuacagagaagucccuggucucuuguggggcaggaaguguauuaucuuccuuuaaagaaauagaccagcugauuugcugacagcuuauaaugguaaagccuccugcauuaggaaagucaggaugcaagagaccaccagaguaguggugacccaaggaaaugugauaaugaccuagaauagucuuaucagcuucuugagcaucacaaugcauuggaaaccugcccuuauagcaaauuauauaauaugucuuucaagcaucauugcuaagaaugucaauuuuaccauaguuuucucuaaugggggccugagaugauagaagaugauaugaaaagcaggaaauaaauuacacuuuuucguuaaaaauuuuguuuaaaaaccaaaugagcuguuuucauaaauuguuaaaacaaucuauccaggccauaaaaugaggauuccucauacccccacauuccugcuaccuuuucucccaaguuccuuccagcguuggccagcucauaaaaaaucaagcauuuauuaagcaccuacuauaugcugcguacaaucagauauaugauagaccccauucccaaucacauguaugauaagucccuauccccaaggagcucacagacuaaugagggaaauugacaugggagcagaggaguaaaaacaauuguaccugugagcccaggugaggacacugggacuuugaggaguuuugcagccugcccaaagagaaccagcuaacaaguguggagccacacaccaggaaacagggacugucucacugcagaccccaguucuaguucauuacucucuccugcuuuccaaaauaccuggaauauugggacauauuuucugccuagcacugugcaccaagcuuuuaaacaaagguggugacauggaauaggcaccucuagaguuucuuaggagauaaaguuacagagaagucccuggucucuuguggggcaggaaguguauuaucuuccuuuaaagaaacagaccagcugauuugcugacagcuuauaaugguaaagccuccugcauuaggaaagucaggaugcccaaagcccaccccuggaauucuugcuuccaccauuagcugggugccugcucugccugggguugguuccaugacaccugagcucccuucugagaggcagcaugguuuuacaguaagauugcagacuccagagucagauuuccuggcuuccauucccagcuuuauucuauuucaguucugagacuuacucccucugcaggguugccagauuuagcaaauaauaauacagggcacccaguucuauuugaauuucagauaacuaacuaaucugcaaacaauauuagggauguacuuaugcuaaaacaauauucauugccuaucugaaauuuaaaucuaacuggguauccuguauuuuaccugguaacccuauucuuugguacuaucuuccucaugaugcuaacacacccaccuuccaaagacugcacugaggugagcuaguauguggaaagcacuuaagaugugccugguggaugguaagccuccagaacauguugguuagcauuucugucuuuuguguuucucagaucaccagugggccucuuuauuucagggaguguuuacugacuugauuuuauauucuaaagugcugaccuguuauacucugccuucaggcuuaaggacucaaauucuuaaguuaggccugauugcaaugccaguuccaacucuuaacgaccauguaaucuugggcaaauuaccucgcuucaguauucuuaccuauaaucugagugaugaagauaauaauaccuuccucauuuagaugugaaaaugagaaccuacaugaaaagugguuggcaauaguacaugcucaauaaauucucucauuaagcugauaacuaauuuccuacauaguuucagcacuuugguaaggacauuucuguacaucucauuucuuuguguagcuuauggucccauauguguauuguuuuucucaugauugucugccuuucuauggguggacccaaugggucacacugaugucucaggccacagcaaaggccugugcuugaggaguguaaagaaggugaucucuuagucagcuacaguuugcuacaacaaaauacuauagacugaguggcugaaacaacagauguuuguugaaugagagaaagagagacagagggcacucuagugcuccgguuuuccuuauuuuuauaaggauacugaucccaucacagagacuccacccugaugguuucaucugaaccuaaacaccucccaaaggccccaccugcaaacacuaucucauuggaggucaggggcuucaacauaugaauuuagggagacacaaacauucaggccauaacaauaaguauucaccuuggccuuucguccauugggucacaagccacuaggcaagagggcugggccagggugaagcaccuccuauagagaaaaccucacauccauugcagaauauuugauguuguggcucaagaaagcccccaggagauagcauauccagccagcauaugccuucacccuuugcacagcuacaggcagacaccugaagaacuguggaacuccugaccacagcaagagacaggcacauuccuuccuguccuggcuaaauuuuauuucacuuucuugugaaaauaugaagagaaauuauugccagcuuugaagauaauaguaagcauucaacaaauguugaaugaaucaauuaaaugaauguaaaaucuaugcaaaauauuauaaguaguccauacagagaaacaaaauuacaagccagagcugaaugggaauccuuaucucugagccuaguggcugugaccuuguuaccaaaccuugcuaggcuucaguuuccucuuagauaacaacuucauaaggcuauugugaggauuaaauacugagauagugcacguaaugugcuuggcaugcuacccagggucuacauugcuaaaauaacagcaacaacaauaaagcaagggcagcacaaaagaggaaaaaaaaaagggggagucaagaaaccuuuaaaggggcugggcgagguggcuugcgccaguaaucccagcacuuugggaggccaaggagggcagauaucuugaggucaggaguuugagaucagccuggccaacaugguaaaauuucagaucuacaaaaaauacaaaaauuagcagggcauggucgugggugccuguaauccaagcuacucgggaggcugaggcacaagaauugcuuaaacccgggaggcggaaguugcagugacccaagaucgcgucaaugcacuccagccugagugacagagcgagacuccaugucaaaaagaaaagaaaaagaaacccuuaaagaccaagcucuggcuucuggaaugugcucagcaaugcuuugcuagauggcuauuugaaccugaagaaaugccuccugaacauuuauuuucuugcaacuauauuaaaacauucaaauugaaagauuucucgauugaaaguaggaaauuauauaacuuaccuuguguuuaaaaauagacauuuaugaaucuagugucugaauuuguuuuccuuuccagugagaauaaacuauagaaaaggauguuucuaaggucuaaauagaaauggaauuuaaucaaucauuuuuuggauauuaauugccuuuuccacaccagucuuugagacacaugaucagugcuaauagauuuuuuaaaauuuauuaucaugauuugcauacaguaaaacucaaccuuuuaaguauacagcuauucaagcuuugacaaaccugaagaguuguguggcaaccgccacaauuaagauagggaacaguugcauauccccccaaauucuguguugucaagcccuccuucaacucccaaucccuggaaaauacuaaccuguuuucugugucuauaauuuugccuuuaugucauauaauuggaaucauacaguauguaaccaguauguaccuuuuuaagucuuguuucuuucccuuggcauaaugaauccgagaugcauccaugucauuaccuguaucaguaguuucuuuccuuuauaauccuuugcaguacuccauucuguggcuagacacaguuuguuuagcuauucacuaacugaaagacaucuggguuuguuuccaguuuggggcaauuaagaauaaagccaccacggacaaucacacacagguuuuggggugaauguaaguuuucacuucauuuugguaaauaccugggagcggguguccuggauuguagaguaaaaauauguucaacuuuauuagaaacugccaaacuguuuuccaaaguaucuauauuauuuuucauuucuaucaacaauguaugaggaguccaguuguuuggcauccuugcuagcaauugcuauaaucagauuuuuuauagccacucuaauggauguguaguggacuugcauuuuaacccauuuuaauuugcauuuuuucaugcgcuuauuugcuauuuauauauuuuuuggguuguuuguuuucuuauuauugaguuuugagaguucuuuaaauauuuaagauauuagaugugugcuuuguaaauacuucuucccagucugugucuugucuuuccagucucguaacauugccuuuugaagagaaaacauucuuaauuuugaugagguucaaauguaucaugcuuuuauagauacugcuucuuguaucauaucuagaaaucuuugaccaaccucauaucacaaagauuuuuuucuauauuuucuucucaaagcuuuguaguuggcuuuacauucaggucuaucauccauuccaaguuaauucuuuuuuuuguuuuuguuuuguuuuguuuuguuugagauggagucucgcucuguugcccaggcuggagugcaguggcgcgaucucggcucacugcaagcucugccucccggguucacaccauucuccugucucagccucccgaguagcugggacuacaggcacccgcaaccacgccuggcuaauuuuuuguauuuuuaguagagacgggguuucaucauguuagccaggauggucucgaucuccugaccucgugaucugcccaccucagccucccaaagugcugggauuacaggcgugagccaccgcaccggccuauuccaaguuaauucuuguauauuguuugaaguauggaucaagauucauuucuuugcauauagauaauuucaaaaacuccagcaacauuucuugaaaagaugauccucuccucauaaaauugccuuuggaccaucguagaaaauuaauugauugucuauguacaggucuauuucuggacccucuauucuguuccacugauguauaugucuauccuuccaugaauaccacacugucuugauuacuaugguguuacaguaagccuuaaaaugaaguaguguaaguccuccaacuugaccuuuuucaaaauuauuuugcuuauucuaguaccuuugcuuuuccauucaaguuuaggaucaauuugucaauuucuaacaacaaaauaaguccuccuaagauuuuaauucgaauuccauuaaaucaauagaugcauuuagggagaacugacaucuaaaaauauugcuuccuccugugcauaacgaccccguagcucuccauuuacuuaggacuucuuuuauuuuguuuaucacuguuguauaaauuucagcuuacaaauuuugcagaauucuuaucagauucacaccuaaguucuucauggcuuuugguucuacuucuaacaguuuuuugaaauuucaaucccuaauuguucauugcuaguuuauggaaauagaauugauuuuguauauugaccucauauccugagaaauuacuaaauugauguguucuaauaacuuucuggagauacuuuggaauuuucuccauagacaauaauguugucugugaauagacaacuuuauuuauuuauuucuaaucugcauucauuuuaugucauuuuuuaaccuuacugcucuuaccaugauguauuuaucaguuuuguauauugcuagguucaguuggcuauaauguuguuuaaaaauuuugugucuguacucauuggggauguugguguauaguuuucuuuucuuguuauguauuugguuuuggaaucgggauaauaaugcucccuauauugaguaaacugagguauauucccucuucgauuaccuggaagaguuuuuguaaaacugauauaacuucuuccuuacaugugagauaguauucaccaacaaagccauuuggcauggaauuuucuuuguguaaaggauuuuaaccuuaaauucaauuucuuggauauaagaacauucagguuaucuauuuccuuugagugagcuuuccuaguuuuuuacuuucaauacauuuguccauuuuaucuacauucucaaauuuauuggcauaaacuuguucauaauauucauuuauuaucccuuuaaugucuacaagauuuguagugauguccccucucucauuucugugauugguaauuuucaucuucucuuuuuuuucuuauuagucuggcuauaaguucauccauuucauucaccagcuuuugguuucauuuauuuacucuauugcuuuucuaauuuuuauuucauuagccacugcacuuuauaccuccuaucuucugcuugcuuggguuucaugugcuauuauuuuucuaacuucuuuaccuuaaguuguaaguuugagucauuauuuaaaaacuuucuucuuuucucauauaguauuuauuuagugcaauaaauuuccuuguaagcacugcuuuaagugcaucucauaaauguugaaauguuguguuucaauuuuauucaguucaaaguaauuuuuaauuuccaucuugauuuauucuuugaaaucgguuacuuuuauguauaauauuuuacuuccaaauagaauaauuuuucacauauauuccugcuauuguuuccaaauauguuucuuuuauucagugaaugcaaauuaagauaucaaauuugugagguuaagcuaauaccaugcuuagaaggaaauuuaucauuuaauucuauuguggucagaacacauacauuauuugaauccauuuaaauuuauugacuuguuuuaugaccuacaauaucuccugucuuugcaacuguuucaugugcucuugaaaaauagguguauucugccaccuuuagaugccguauucuguaaaugucaguuaggucaaauugauuaauaaugccauucaagucuuuucuauacuuaauaauuguuuauuuuuauuuuuauaagaaauaugauucaauauccuuaauaauuuuaagacuacuuguucuauugauuauugagagagagguacugaaaucucuacucuaacuguauauuuaccuauuucuccuugcaguucaaugaguuuucguuucauguacuuugaaaaucucuuauuaggucaauacauauuuaugauuuauguucuguugaugaauugauuccauuaacauuaugaaaugaacuucuuuauaccugguaaaaauauguuaauuugaaaucuacuucaucuaauauuaauaugagcuacuucagcuuucuuuugacuaauguuagugugcuuuuuucucuccuuuaccuuuaacauaauuguauauuuaaaauauacaauuuuguaggcagcauauaguuagggucucuuguaggcaacauauaguuaguuauugcccuuucaacuaauaugacagcccaugucuuuuaauuaagguuguuuaaaccauuuauauuuaaugcguuagguuuacauccaucaucuugcuauuuauuuuguuuguucuaucuguucuuuguuccuuuugcccucuuuguuugccuucuuuuguauuaauuaauucuuuuuuaggauccucuuuugucuccuuuguuggcuuauuagcuacacccuuuguuuuuggcaauuuuuuaaauguuugcuuuaagguuuauggaauaaaucuuuaacuuaauacagucuacauuuaacugauauuacaccacucuaugcacaagaaucuuauaacaauauacuucuauuucuacacuccuauccuuggugcuauuauuguuauguauauuacuucuauauauauuagaagccccacauuauauuguuaccaauuuuuccuuaaacaaugaaccauacuuuaaaugauuuaaaauauuggaaaaauauauuuuacauuuaaccacauaaugacgauguccagcauucuucauucuuuuauguggauacagauuuguaucugguauuuuuuuucuuccugaccaauuuucuuuaacacuucuuguagugcaggauaucuagugauuaauucuucuaccuuucguaugucugaaaaaguccuuaucuugccuuuguuuuugaaagauauuguuguauauagaauuuuaaguugacaauuuuuuugguuuugguaauuuaaagauguuucccugucuuuucaguuauauuguuucuaauaagaucugcuggccaggcaugguggcucauaccuguaaucccagcacuuugggaggaugagacagguggaucacgaggucaggagaucaagaccauccuggcuaacauggugaaacccugucucuacuaagaauacaaaaaauuggcugggcgugguggcacacaccuguagucccagcuacuuggguggcugaggcagcagaauugcuugaacucgggagguggagggugccgugagcugagcuuaugcgacugcacuccagccugggcaacagagcaagacucugucucaaaaacaaaacaaaaaacaaaaacaaaaacgaaaaaaaagaucuguugucauuguuaucuuuguuccucucagcauaauaaauccuuuuucccuuuggcugcuuuuaauuuacuuuuuaucacugguucuaaggaauuuuauuauaguguguaguuuucuucauacuauuugugcuagguauucuuugagcucuuggaucuauggguuuauacuuuucaucaaauuuggaaauuuuggccacauuuuuuuuucaaauacauuuucucccuuccuccuuuucagagacuccaguuauacauauauuaaaauguuugaaguugucccacaacucacugauggucugcucauuaucuuucagucuuuuuucucuccaugcuucauuuugguuuuuuguucuuuuuucuguuuuuuuuuaauuauacuuuaaguuuuaggguacaugugcgcaacgugcagguuuguuacauauguauacgugugccauguugguguguugcacccauuaacucgucauuuacauuagguauaucuccuaaugcuaucccucccuccuccccccaccccacaacaggccccagugugugauguuccccuuccuguguccaaguguucucauuguuuaauucacaccuaugagugagaacaugugguguuugguuuuuuguccuugugauaguuugcugagagugaugguuuccagcuucauccaugucccuacaaaggacaugaacucauccuuuuuuaucgcugcauaguauuccaugguauauaugugccacauuuucuuaauccagucuaucauugauggacauuuggguugguucuaagucuuugcuauugugaauagugccgcaauaaacauacgugugcaugugucuuuauagcagcaugauuuauaauccuuuggggauauaccuaguaaugggauggcugggucaaaugguauuucuaguucuagaucccugaggaaucgccacacugacuuccacaaugguugaacuaguuuacagucccaccaacuguguaaaaauguuccuauuucuccacauccucuccagcaccuguuguuuccugacuuuuuaaugaucgccauucuaacuggugugagaugguaucucguugugguuuugauuugcauuucucugauggccagugaugaugagcagugaugaugagcagagccucgcucugucgcccaggcuggagugcaguggugcaaucuuggcucacugcaagcuccgccucauggguucacgccauucuccugccucagccuccugaguagcuaggacuacaggugccugccuccaagccuagcuaauuuuuuuuuuguauuuugaguggagacaggguuucaccguguuagccaggauggucucaaucuccugaccucgugauccgcccgccuccgccucccaaagugcugggauuacaggcaugagccaccgcgcccagccuaugauaagcauuuuuucaugugucuuuuggcugcauaaaugucuucuuuugaggagugucuguucauauccuuuguccacuuguugaugggguuguuuuguucuuguaaauuuguuugaguucuuuguagauucuggauauuagcccuuugucagauaaguagauugcaaaaauguucucccauucuguagguugccuauucacucugacgguaguuucuuuugcugugcagaagcucuuuaguuuaauuagaucccauuugucaauuuuggcuuuuguugccauugcuuuugguguuuuagacaugaaguacuuucccaugccuauguccugaaugguauugccuagguuuucuucuaggguuuuuaugguuuuaggucuaacauuuaaguuuuuaauccaucuugaauuaauuuuucuacaagguguaaggaagagauccaguuucagcuuucuacauacggcuagccaguuuucccagcaccauuuauuaaauaggaaauccuuuccccauuuccugcuuucgucagauuugucaaagaucagauaguuguagauguguggcauuauuucugagggcucuguucuguuccaauggucuauaucgcuguuuugguaccaguaccaugcuguuuugguuacuguagccuuguaguauaguuugaagucagguagugugaugccuccggcuuuguucuuuuggcuuaggauugucuuggcaaugcgggcucuuuuuugguuccauaugaacuuuaaaguaguuuuuuccaauucugugaagaaagucauugguagcuugauggggauggcauugaaucuauaaauuaccuugggcaguauauccauuuucaugauauugauucuuccuacccaugagcauggaauguucuuccauuuguucguauccucuuuuauuucauugagcagugguuuguaguucuccuugaagagguccuucacaucccuuguaaguuggauugcuagguauuuuauucucuuugaagcaauugugaaugggaguucacucaugauuuggcucucuguuugucuguuauuggaguauaagaaugcuugugauuuuugcacauugauuuuguauccugagacuuugcugaaguugcuuaucagcuuaaggagauuuugggcugagaugaugggguuuucuagauauacaaucaugucaucugcaaacagggacaauuugacuuccucuuuuccuaauugaauacccuuuauuuccuucuccugccugauugcccuggccagaacuuccaacacuauguugaauaggaguggugagagaggacaucccugucuugugccaguuuucaaagggaaugcuuccaguuuuugcccauucaguaugauauuggcuguggguuugucauaaauagcucuuauuauuuugagauacgucccaucaauaccuaauuuauuaagaguuuuugcaugaagggcuguugaauuuucucaaaggccuuuucugcaucuauugugauaaucaugcgguuuuugucauugguucuguuuauaugcuggauuaugauuauugauuugcguauguugaaccagccuugcaucccagggaugaagcccacuugauaaugcuggguaagcuuuuugauguguugcuggauucgguuuuccaguauuuuauugaggauuuuugcaucgauguucaucagggauauuggucuaaaauuaucuuuuuugguugugucucugccaggcuuugguaucaggaugaugcuggccucauaaaaugaguuagggaggauucccucuuuuucuauugauuggaauaguuucagaaggaaugguaccaacuccuccucguaccucugguagacuucggcugugaauccgucuggucauggacuuguuuugguugguaagcuauuaauuauugccucaauuucagagccuguuauuggucuauucaaagauucaacuucuuccugguauagucuugggaggguguaugugucgaggaauuuauccauuucuucuagauuuucuaguuuauuugcguggagguguuuauaauauuaucugaugguaguuuguauuucugugggaucgguggugauaucgccuuuaucauuuuuuauugcaucuauuugauucuucucucuuuucuucuuuauuaaucuugcuagcggucuaucaauuuuguugaucuuuucaaaaaaccagcuccuggauucauuaauuuuuugaaggguuuuuuaugucucuaucucccucaguucugcucugaucuuaguuauuucuugccuucugcuagcuuuugaauguguuugcucuugcuuuucuaguucuuuucauuguguuguuagggugucaauuuuagaucuuuccugcuuucucuuguuggcauuuagugcuauaaauuucccucuacacacugcuuuaaaugugucccagagauucugguauguugugucuuuguucucauugguuucaaagaacaucuuuauuucugccuucauuucauuauguacccaguagucauucaggagcagguuguucaguuucuauguaguggagcgguuuugagugaguuucuuaaucccgaguucuaguuugauugcacuguggucugagagacaguuuguuauaauuucuguucuuuuacauuugcugaggagugcuuuacuuccaacuauguggucaauuuuggaauaagugcgguguggugcugagaagaauguauauucuguugauuugggguggagaguucuguagaugucuauuagguccgcauggugcagagcugaguucaauuccuggauauccuuguuaacuuucugucucguugaucugucuaauguugacagugggguguuaaagucucccauuauuauugugugggagucugagucucuuuguaggucucuaaggacuugguuuaugaaucugggugcuccuguauugggugcauauauauuuaggauaguuagcucuucuuguuaaauugaucccuuuaccauuauguaauggccuucuuugucucuuuugaucuuuguugguuuaaagucuguuuuaucagagacuaggauugcaaccccugccuuuuuuuguuuuccauuugcuugguagaucuuccuccaucccuuuauuuugaggcuuugugugucucugcaugugagauggguuuccugaguacagcacacugaugggucuugacucuuuaugcaauuugccagugugucuuuuaauuggagcauuuagcccauuuacauuuaagguuaauauuguuaugugugaauuugauccugucauuaugauguuagcugguuauuuugcucguuaguugaugcaguuucuuccuagccucgauggucuuuacgauuuggcauguuuuugcaguggcugguaccgguuguuccuuuccauguuuagugcuuccuucaggagcucuuguaaggcaggccugguggugacaaaaucucucagcauuugcuugucuguaaaggauuuuauuucuccuucacuuaugaagcuuaguauggcuggcuaugaaauucuggguugaaaauucuuuucuuuaagaauguugaauauugucccccacucucuucuggcuuguagaguuucugcugagauauccacuguuagucugaugggcuucucuuuguguaacccgaccuuucucucuggcugcccuuaacauuuuuuccuucauuucaacuuuggugaaucugacaauuaugugucuuggaguugcucuucuugaggaguaucuuuguggcauucucuguauuuccugaauuugaauguuggccugccuugcuagauuagggaaguucuccuggauaauauccugcagaguguuuuccaacuuaguuccauucuccccaucacuuucagguacaccaaucagacguagauuuggucuuuucacauagucccauauuucuuggaggcuuuguucauuucuuuuuauucuuuuuucucuaaacuucucuucucacuucauuucauucauuugaucuuccaaucacugauacccuuucuuccaguugaucaaauuggcuacugaagcuugugcaugcaucacguaguucuugugccauaguuuucagcuccgucagguccuuuaaggacuucucugcauugguuauucuaguuagccauucaucuagucuuuuuucaagguguuuaacuucuuugccauggguucaaacuuccuccuuuagcucggagaaguuugaucaucugaagucuucuucucucaacucgucaaagucauucuccauccggcuuuguuccauugcuggugaggagcugcauuccuuuggagggggagaggugcucugauuuuuagaauuuucaguuuuucugcucuguuuuuuuccccaucucugugguuuuaucuaccuuuggucuuugaugaaggugacguacagaugggguuuugguguggauguccuuucuguuuguuaguuuuccuucuaagaaucaggacccucagcugcaggucuguuggaguuugcuggagguccacuccagauccuguuugccugggcaucagcagcagaggcugcagaacagcaaauauuggugaacagcaaauguugcugccugauuguuccucuagaaguuuugucucagagggcuacccggccgugugaggugucagucugccccuacuggguggugccucccaguuaggcuacuugggggucagggacccacuugaggaggcagucuguccguucucagaucucaagcugcgugcugggagaaucacuacugucuuccaagcugucagacagggacauuuaagucugcagagguuucugcugccuuuuguuuggcuaugcccugcccacagagguggaguauacagagguaggcaggccuccuugagcugcagugggcuccacccaguucgagcuucccggccacuuuguuuaccugcugaagccucaggaauggcgggagccucucccccagccucgcugccgccuugcaguuugaucucagacugcugugcuagcaaugagugaggcuccguggacguaggacccuccaagccacgugcgggauauaaucuccuggugugccguuugcuaagaccacuggaaaagcgcaguaucagggugggggugacccgauuuucaagguuccaucuguuaccccuuuccuuggcuaggaaagggaauucccugaccccuugcacuucccgggcgaggcaaugccucgcccugcuucagcucacacuaggugcacugcacccacuguccugcacccacugucugacaauccccagugagacaaaccugguaccucaguuggaaaugcagaaaucauccgucuucugcgucgcucaugcugagagcuguagacuggagcuguuccuauucggccaucuuggaacccucuccucuucauuuuguauaguuaauacugcuugucuuuaaguucacuaaucuuuuauuucucagucuuuaaacugcuguuaauucuauaucuuguauuuuuauuuugaacauuguauuuucauugguagaaguucaauuugguuuuguuuauaucuuucuucuuuuuuaacuugcuuauuucucuaccuucuugaauacauagaguacaguuauaauaacuauuucuaaaucuuugucuacuaauaauaucauauaugugaucucuggguugguuucaauuaacugguguuuucccucaguauuuaugccuaguaaguuuuauugaauucagacauugcaaauauuacuuuguugggugcuucuuauucuuguacuuuaaaaaauucuugaacuuuuuucuguguccauuuugagguguacccuguguuagagauuuguugccauugacagagggcugaaggcauagaguggagcucuuugagaauuuuaagaagaaauaauaugaauuuuagcaccugguggauaaguuuacagaauuuucuuucauugcaacauaccuggugguacaauuuaggagcuaaguuuccugcugaccucuagccacuggaggcuauaccuuuuuaccaaaauaaccuaacugcugauuagucaaaguggcuuuaagucaguguacaaaaucucccuaugaacagcacuggccuuccaccagcugcccagugcuacagguuuuucuaggcaacuagaaaacaacuucuguuguuucuaggcaagucuuguuccaguuaaguguucaggaacuuucuucuugcuaaguucauccacaucagaaccuuucugaagcaccagaaacauugccuaguguccagcugauacaccacacaaccaucccaugcaaaggcacaucaacucauaggcauugcuucccagcagccuccuaggcauaaaaaccuucacuuccucucuguuuaggacauucuacauaaauuugucgagcacacccagugguucucaaauauuaauguguaguggaauuaccugccaugccuauuaaaauguucuuuccugagucuuacaccagggaaucccuauuugguagguguuaagugucagguuuugcauaaaauuguagcagguucuuauugcccaaggggaugaaauuggacugaaauucagcccauucucagcuugccaaaccguacacucuagugugggccugguauaccaagaggaaggggcaccuucaauuuauuuuaguuucaucugcuuucuaagccuagugucuguggggauauauccacaagagcagugaggguagggaugauuuuucuaauuugcacaaaggcugucuaugcccuggcauauuaguccagggcuuccaaaagggagaugucagacagggcuagagauacaagagauuacuuagaggaaacaggugugaugaaaaaaaugagaagaaagccaggagaagcagagggagacaccaaugcaggucugacccuugugaacaagagagggagucaaggaaaguuggauggaaaagcuuuagacuauauguaggucugagaaaaauugguaaagcugauggggaguccucuagccaaaaucacccacagaggaagccugcaucuuaaaggagugggccugcccuggcaucucuaccaugcucagucauggacuagaaggagucaugagaaguguagucucaugaaaaaauaguagauuucaagguaauuaugcuucugaaguuggagaucuaagaggugcuuguuaauggcucgcauacuguauuaguccauucucacacugcuaugaagaaauacccaagccuggguaauuuauaaaggaaagagguuuaauuggcucacaguucugcauugcuggggaggccacagaaacuuacagucaugguggaaggcaaaggagaagcaggcaccucuucacaggguggcagaacagaguaagugcaagcaggggaaaugccagacacuuauaaagccaucagaucucgugagacucauucacuaucacaagaacagcacgggggaaacugccccaugauccaauuaccuccacagggucuagcccuugacacauggggauuauaauucaagaugagauuuuagguggggacacagccaaacuauaucauauaccuaaugaggagggccuuggaaaucugccuuuguaaaaguuccccacucccaagggauuccaaacaccuuguccagugaaucacccuuagaggaacaccugccuaaauuuuuuaaaagaaagguauauuaacugucccuaaggaagaagaauguccagacuuccuaaacacaaggucacacucuugggagcuuggauuggggaagcucuccaauuccucucugaucaguguagcccagagcaugguuauauucucaacaaaugacucugccccauguucugccacauguguuauaacaggaaugagcugaguggaacaggcaccaagaugauggaagucaaaucugccucagaggcagggucagggaaagggucuuugaaggugggaaaagcacaaguaaggaauggagagaaaggccugucuagaagagcagggaauagucuguuuggcugcauggaaagagugcaagauggggagauaaguugguuccaugcuuggaggaacagauucaguggaaugugaguuugggagacugggauuuaggcaucauugccugaaaauguaaaaauaccugggaggacauuucugcaagguggcacugauugcugagucucaggcuucaggaggcccuguguuguucugagcaagcccagaaggcaaacugggugucacccagagagcuccuuguacacccauuucuggggagagguacagggaacaagagagggaaauaguuggggagcugucacuaccuuccuagcucugcacagggcuggcccuggcucccaaaacaccaucucagcucaagaggggccuccuauaaaaagcaaauagaagaacuauuugauggugaacgauuuaugaagaugcucucuuagcacacuuugcucaacaauaugagugaacucaaauggcugaguugguuuucagauuggcucccaaguguuuaccuggucccugcuugauucagcucucucccuuccucuacauccucaccuccugcugcucauccuuagacaaagaccaaaaucuuuaacaaggcccuuucuucaugaucuagcuuuugccaucuguugagaucagaucuaaaccaacugggccauucagaacuagauuauuuuugguaaauauugguaaguaacaucaaguagaugaagugaugagagcucuagaucucuuccccugacaacccuuaucccaguccaucaaucaguauuaccggagugucuguuaaauccacaacucucuccgcacuagacugguaggaucauggaaauaagaaccaagucuguaugcucacugguaaauaucaaagaucuuagauggucggauucaaacaaguacgaguaauuuauuuccugaguguuuuaacuguuacaauaccaaucugaaaaaacaaaaccuaaagaagauccacucugaauaauagcaacuaucauucguuaagcaccuaauauuuccaaucccuacuacaaccuaccuagaagacaguaugguccccacauacaccugaacugaaucucagagucaggcauugacuuugccaaaagcaaaggguuauaagcaaagaguuuagcugggauuugaacccagaacauucugacugcaaugucccagcuccucccaugacacaaucgcaucgcauuucaugccacuacuagccuaguuggugagagcaacccaaaccaaugucuugcuuuucgaauacuuaugaauauuagcuacccaucaguauuucucccccuucccuugccccacaaacaugccuguuaccugagcuguuguccuggggugcauaccugccugauaaugguggauguuagugauaaauggugcaguagauucuggagcaucuuuccagguuuugagccuggcucugccacugcuguggaaauaccacagaucaaaaugggcaauuuagacugugucguuuacuaauauucuggaugcaggaaggaaauggaaggagccccagagaaaaccaucuacagauggauaugacucccaccuccauaguaccugcauguuaugaauguucuucuaaagaacuagccuaguaacuuaauggagcccccagggucucuuucagagagcugcauuucuuagugcuuagaagucucuuucuucaagaacugcugcuauggucugaauguuugugucuccccaaaauucauauguucauaccuaauccccaaugugauuguauuaaaagguaaaagucuuugggaggugauuagguccuaagaacagggcccuuauggaugggauuagugcccucauaaaagagaccccagagagcucccucaccccuuccaccaagugaagauacagugagaagucaccaucuaugaaccagaaaacaggcccucaccagacacagaaucugccagaaccucgauauuggacuucccagacuacaggacugugagaaauaaacuucuguuguuuauaagccacccagucuaagacauuuuguuauagcagccugaauugacuaagacaacugcauuuuuauuuuccacggaugcugauuucacaugccacagggaagauguauggcagaaugagcuguggcacaggaaagcuuauggcaaaggucuuaugugauggggaugagagggaagggacagcaggaagguggucacuucaguagaggaaagcuaagugugucuaucauuaccccuugccagcugggugacuuuggccaagucacuuaaccacucugugccuguuuccucaucuagaaaguauggcuaaaaauaagauuuaacuucagaggauugcugugaguuguaaacaaaugcauccuuuauuauuauugauauggcuuggcucuguguccccacccagucucaccuuaaauuguaauaauucucacgugucaugggagggacccagggggagguaauugaaucaugggggcgggccuuucccaugcuguucucaugauugugaauaagucucacgacaucugaugguuuuauaaagaggaauuccccugcacaugcccucuugccugcugccguguaagacgucacuuugcucuuucuuugucuucugccauaauuuugaggccuccccagccauguggaacagugaguccauuaaaucucuuuccuuuuuaaauuacccggucucaggcaugucuuuauuagcagcaugagaauggacuaauacaauuaucuagaacuucccgucuugugggaggcacuuaccuugcuaacuuaaaugggggaacauuucaucuugccucauucacacagacacauuucauggucauugcaugguuucugcuuggugcuugcagguccagauuucuaauuuaaacagucagagcucauccauauuggcaauaaacccaggucaacucagcacucaaaguguagaacaacagcaaguauaaaaagaaauagaauuucuuuucauccucaucacaauaguaccuuaaacuucugucacuugccauaauuuuuaauucucuauuugauugugggcauuguaauuucuggcuuucuagcuaaaugucccccugccccaccaugaaauauaaugcuuggcacauauuaggauauucccugaauguuuagugaauguccucuaauaaauguccauaaaagcuacaauucagaucuagaauaucacagaaguacaaaaauuuaugcacauuaggaaucagcuuccgaauaaaaucuaaauuccuuugcuuaccauacuaggcacuucauuaauuggccccaacugucccauuuuaccucaucagcaacgccccccgcccccgccaccccacaacucucacacccagcucccaaguccccagccccauaaaacucugucauucccagaacaggucaugcccuuuuacaauuccaagaccuuguacuugcuauugccucuuccugaaauauccuuuccuuuuaagcauagccaauuccuacugcaccuucaaaagccccauuuaaauaacuccuccucagggaugucucucgggcucccuaaggcagcaucaauaccucccuucucuggacucccucaauacccugucuagcacaccuaugaagaggccuggccuuagucaagccaagggcugagcuuaaaguccuagcuuuacaacuuacaaacugugagaccuugggugaguauaugcaaccucucugaaacugucuuuucaucugcuaaccagcaccaauagcaaccaccccugaagguugcaauaggagugaucuaauuugaucauugugaaguguauagcaaacucucaagaaaugguagauagugugauacuuucuaauacagcacaugaccacauugcaauucaccuguguuuacuccugccuuuucuguaaaacccuagaugacaccaacagguucugcaauuauuucuuaucccuggcaacuagcacacuuaguagguguuuaagcgcauccuugcagaaugcuugugugcagucacgaaugaauacaucugagcuguuugauucccuagagugcccagguggagcggggucacccugcaauggcagaggcaguugugcugaaggcauggaaggaaauggaaccugcuccugccaaguaaguucaaaaauguguucuuccuuuccugguuucugcuccccaucuucuuaccuguugauccuccuuaaacacacacacacacacacacacacacacacgugcacacacacauauacagcgaaguucuuaagcagugaagguauuaauuuuuuaaaaaugugcaauuugcaacaaaaugaccauuuauagccugggggccuuuaggagagucaauuaacugcucagucuuaagcauauccacuuguaaaaauggguuugaggcugggagcaguggcuuacgccuggaaucccagcacuuuaggaggccgagugggggaggaucacgaggucaggagaucgagaccauccuagccagcauggugaaaccccgucuccacuaaaaauacaaaaauuagcugggugugguggugggcgccuauagucccagcuacucaggaggcugaggcaggagaauugcuugaacccaggaggcagagguugcagugagcugagauugugccauugcacuccagucugggugacaagagcaagacucuguccacccccacccaaaaaaaaaaguuugaaacaguaucuauguaauaacauuuguugaaaaaguaaaaugaggccauauaugugaaaauacuuuaugacacuauauaggacuauagaaauugcugucauuguuaauauuaauaaucacuauuagcagacaaaccuuauggugcuauccucugcauccuuugugaaccguuaggcuuaccgguucaagauuuucuuuuaccaguugaagaauuucuucguuaucucaugaaagugacuuuuugcacauuucaagcccugggggauuuaaauacaaggaaauccuucugaaaaggauugagcucaacugucuucagaaaugcaaaacugagguugggcagguggcucacgccuguaaucccaguacuuugggaggccaaggugagcagaucacuugaggccaggaguucgagaccaaccuggccaacauggugaaaccugucucuacuaaaaauacaaaaauuauccgggugugguggugugcaccuguaaucccagcuacucgggaggcugaagcaggagaaccugggaggcggagguuucagugagccgagaucgugccacugcacuucagccugggugacggagcgagacucagucucaaaacaaaaaugcaaaacugaaagcauuuuccuuucccccuugggcaaaguugggauauggcugcuagcacuugcuaucuauuuauaucuuuggacugacaaagcagcuuucuccugcagagcuucagacccuuaguacaaaaugacauggggauuaaugcaugcaaugauaacacaaauaaacagaaagaagaagcuccaggauaggcacagagggaaaauauauuugaaaaacaaaugcugaguuggaaauccaaggccuuccuugguaccaugggucaccuugggucuaaugucaaccaccugggguguuuugcaggaaggguuugguggaacagccugugaaaccugugcugacgacaacuuauuuggacccagcuguucaucagguaugucugauuuuuguguaaucaccacauuuguaaggguugacaguccaugagaaagauugcuccuugaggagaaaacacugaauaguuaugugugauaaaaaagaaauuucagcagaauuaaauuuaaaggaguuuaaucgggcaaugaacaauucaugaaucaggcaguuucuggaaucacagcagauucacagagacucagugaagccaugugaugaaagaagauuuauagacaaaaaaagggaaaugacauacagcaaucggaagugagguacagaauggcuggauugguuacagcuuggcauuugccuuauuugaacacgguuugaacacucagcaguauaugaaugauccaaguauggcugcugggauuggccaaaacucagcuauuguuacaggugcauacuccuaaguuagguuuucaaucucaucuaccuauuaagcuagguugcaauucauccacaaggacucaaauauggaaguacagaguccuuaucaagucaugauuaguucacuuuaacauguguaaccaagucuacauagagaaaacaaaacaacaaagcuguuaaaugcagucauugaaaacagagacaguguuuccugagguucucagcccuggcaugugcagucagcuacuccccggaaaugcuuccacccaucuuuaugauucccucuccccaggcucuaggauuccaccacugccuguucuuugccugcccagcuuuucucugggcucuuucuggauccuggucucagcauagauccauaggcuuccaauuaaaccgugggccccaccuaauucuaaugguucccuuccuuuugggaguucacaaauaauucccuaagguggucagugauuguugcuccaaauuaaagaaacaaauuugagacuggcuuguucacucucuuauuuuuggcugcccccagaaguagacucugagauagagauuugaguaacaaguaguuaguuuauuugaauggugaucccaggaaacacgaggaugugaggaaguaauauggggaaaauaaacaggauguuauuaagccaggugccacugugaaccacuggagccugaugccccagggagcucugggggucggugcagaacacacagcucagucaucucaccugaggggaaaggagccauaguguggugggcagaauaacggcucccugaagauguccacauccacauccaaaucccuagcaccugggaauaugguaccuuacauggcaaagagaaguuaagguagcaaauagaauuaagguugcuaaucagcugaccuuaggauaagagauuauccuggguuaucugggaaggcccaguguuaaucacagggguccuuaaggauggagaagggaggcagaagaggagugucagaguuacgaaauaugagaaagacucgauccgccaauuucuggcuuugaagaaggaagagccaugagccaaggaauguggguggccucucgaggcuggaaaaggcaaggaaacauguucuccccagagucuccaaaaaggagcacaacacugccaacaccuugauuuuagcacagugauuuuggauuucugaacuucagaaauguaagacaauaacuuugugugguuuuaagacacuagguguguggcaaugaguuacagcagcaacagggaauuaauauacauagucaaguggggagaguuuuucacucccugccacuuagaguguuuauagggagcacccaggccaagcgcucguccuaagguucacacaaaacccucaggcuaagagcuguggauccuggaaguuagcuggaaugcucacaaucgcagucaguaaggucuaaagaaugugggcaugguagaaacagugucugcuagauccacgucucccaaaaaggaauauauuggguagcuuuuugccaacaccacuugggcccugacuuucguggaaaaauuaaacucaguggaaaacugcuucgauucaaauauuuuuggcaagaaaaccuaugcacacacaacacaucccacccccauaaguuugcaaacucuguaauaaguuuuaucugcaauugcagaggcauugccuuguucuaauccauaagguccucuuaggcaggugcugugguaucuuuaucuccaguaccuucuacgugcugccugccugguagacacucacuacacuguuuuuggaugaauacaugagugagugaguauaugacuaggugaaucaaugaaugaauuaucuagcuugcuccagugauguucuccugacccagaagcaugguuuuagaacccaggcuuuagacucagacaagguuucagcucuaggccugcuaaucauggagacauagguaaguuuaugaagcaugcuaucugugacuucaucuguaaagauagaaauaauauugccuccuuuagagaggauuuaaugggauaagugcauaauaaauguuaugauuauuauucccuagcauccccuaaucauagguguuucuucacccacugucccauagagauuauuucauaagacuguuagcaaaagcaaauuuaaaacagauauuggagcugggcucaguggcucacgccuguaaucccaacacuuugggaggcuaaagcuggauccguugaggucaggaguuugagaccagccuggccaacauggugaaaccccaucucuacuaaaaauacaaaaauuagccgugugugguggugcgcaccugaaaucccagcuacuugggaggcugaggcaagagaaucacuugaaucuaggagucugagguugcagugagccgagaucgugccaccacugcacuccagccugggugacagagcaagacuccaucucaaaaaaaaaaaaaaaaaaaaaggauauuggugucccguguguuuuuaaaguuaaacauuacauuaaaggacagcaacuaaaauguaaucagucaacuauauagaaauagcaugucuccucccaaauuuacccuucccugccauuuaagaauuuaaaucacauaggcuaaauaaauauugaaaugggaaggaguaaauaaagcauccagcguugcuuaguucccaagaaagccuaguaauugucuggagaugacaaauuaggaagaagacccauguuaucuccaagacacugguguugguuacugaugagcacagaugcgcagggaaauucccaacauuuccaaauaaaggaaguauccucccuucacacuuaguguuguggagaaagggcaagugaaagggagaaugauggucucaacaccuaaauuuuuuuuuuauacuuuaaguuuuaggguacacgugcacaacgugcagcuuaguuacauauguguacaugugcaauguuggugugcugcccccaguaacuugucauuuaacauuagguauaucuccuaaagcuaucccuccuccuuccccccacccacaacaggccccagugugugauguuccccuuccuguguccauguguucucauuguucaguuccuaccuaugagugagaacaugcgguguuugguuuuuugucccugcgauaguuugcugagaaugaugguuuccagcuucauccaugucccuacaaaggacaugaacucaucauuuuuauggcugcauaguauuccaugguauauaugugccacauuuucuuaauccagucuaucauuguuggacauuuggguugguuccgagucuuugcuaucgugaauagugccgcaauaaacaugugugugcaugugucuuuauagcagcaugauuuauaauccucuggguauauacccaguaaugggauggcugggucaaaugguauuuccaguucuagaucccugaggaaucgccacacugacuuccacaaugguugaacuaguuuacagucccaccaacaguguaaaaguguuccuauuucuccacauccucuccagcaccuguuguuuccugacuuuuuaaugaucgccauucuaacuggacaauaccuaaauuuuuaaauaagaaaacuggaaacuuaaacugagacccaagagaaaaaccuccaagcucuggauuccaauagaacuuucugugaugauagaaauauugucuguuugcacugucccauacaguagccacuagccacauaugacuauugagcaccugaaauggggcuagugcaacugaggaguuaaaauucaaauuucacuuaauaucauuuaauucaaauuuaaauagccacauguggcucguggcuaccaaauuagacaucauaguucuaggacguaacaauuaagagaacaggcuuuaaacucagccugaccauaguuugaaacagacccuaauugcuguguuaccgagggcaagcuauuuaaauucccuaaaccuuucucaucuauaaaacaggaauaauaacaucuauuucuugggauugacaacacagcaaagcucuuaguauuaugucacaagcacucaaucaauggaaguauuaagugaggacaaaaguaauccaacagcaagcaagucacggaugaaugaauggaugaaugaaugacucagcgaugccuggucauuucccacugacaaggacuauggagacugcaaaccuuuucauccaggcaucuacugggugccaguguugugucauccaaugagauguuggucccgggagguggccauucugccuguaaguaggacagcucuauuaggugcaguuuauuuuuaacacuggcuguaaucuucugugggggcacucuccuaccagacugcuuguugguuuagagauaauuucgagcugcaccagccaaagauuuucaucucuguggccagugccccagccugcucagugccuccuucccagcuagccagauugcaaagcccguuuucucuaacaugauccccaaaucaaucacacaaccauguacuguuaagaagagucacuaguauuugcugggcaccugcugugugucagaccaugugcagagggauuucuuuggauccucacuaugacucuccaaaggagguggggguucuccuuuuacggaugaagaagcagagaggguugcucaaggccaugcagcuauuaugggggcagaggcaggauuugaccccacauaugugacuccagagccugggccccuaagcacugccccagucugccucuggugaguguccaucauacauuacacaccagacaggugaaguggauccuaagagugaugagauuaggugcccagucccaaggagcuggaaaugugggugacaacugugaugaugcagagugcacagcccagaccagauccuaugggagcacaggagagggagcagcuuacucugcuauggggcaugucacaggagcauaccaucccucugaccagcacggccauggcuuucaccacuuuaaagucacgccacccaaguuuuaugugucucuagagauuugcugagacugguuagcaaguaccaagggcucuuucaaugaugaucugggaaacccucugccacuuacgucuccuucccaagggcauguuccuggcagcagcuggcagccugcaaugcagugucagaggcuuccaaaagcugccagugccaggcagucaauccaguauagaggcuguaguggaagauagcaugaagggagaggcucaugccagggccaugggccaauaccacacagccaggagggcaaucuuagugacaaggacaacacuuguaauuugcaucugaguugggagcaggagcccucugugccccucaccuuccuccacugggugcaugacaacaauuagggcaggaaucaucacuguaucuccuagagccuggcuucccacuacacugugagcuccuggacuuuagauauuaucaauuacugacauguuguauaccuagugccuaauacagugccugcuacuagguaggagcuggguaaauauuuuugaauugaauugaaucuucuccacugagcccauaguacacucccuccucaccccacuuaucuccauaaccaacuugacugcucuccagaacuuguuuauuccaaaaauccacagccauagguagauaucaaagugcuuggcuaaaauagaaacaaugucaauugaguuuugaagagaggaugacacugcaaauccaauuuaauucuucaguuauuugagggacuacuugagcuaguuaucucccauuuuuucaugugugauacacugguaguaaugauaccuaccucaaaggaugugguaaauuagauaaugcaugacaacacacuuggcaaaaugccugauagauaguaagcacucaauaaagagaaguguggggccuugggugcaaaauuuaaggaggcaucaaaaaaacucaguaaucaagaccaauaacugcacugauuuccuagggcagcugcaacaaaguacugcacacuggguggcuuaaaacaacagcaacuuauugucccaguucuggaagcgagaagucaaauaucaagguguuggcagggccaugcuccuuuugaagcuucuagaagaagguccuuccuugcuucuuucauccucugguagccccagcuguuuuugguugugacaguaucacuccaaucucggccucccucuucacaugccucuucaccuaaugucuguggcaucuccccuucuuaugaggacaccagucaaauugaauuaugggcucaccuuacuccaguaugaccucaucuuaacucauuacaucugcaaugacccuauuucccaauaggggcauucugaaguacuggggaugaggacuccaccauauuauuuugggagacaaaacucaacccaugacaauaauacuuuaaaaauuauugaacaaaacaucaaaaugcuaaauaacagcaggaugcagcucugcacuugcacaacccuguuucacucuccucacccuaauccuggcccugccagacaaugucuuuaucuaaaauuuaguuguguaguuguugguauuguuacagggcaccguaaaagauguggggaaauacagagguggggaggucauuccaagcaguuccaaucuaauaggggagaaaaaauacacagauugagaaagaaaacagcagcccugacagcuguccccuggcugcuggccuaguugcuaccagagaggcugugguguucugcugcugagcauaaacgaugucacagaauaucaccaucagaaaaaagacucaccauauccauggaggaaaagacaaaaacuaagccagggaauaaucaugucugaacagagacucaacaacaauggacaaccaugagaauuacccagcaacugccucuccuggcugauauaagagccuacugcuacuucucccagaauggcucacccuugcuucugacuugguuugaccauuggugcucuccugguggucuucagcugucaggcauuaacaaaccucuaguugucguagggugcaauaguggacacggaacaaagaaagugcugcuggagccagaggagcacagauuguuuggagaccacugagauggcaacacagaagugggggcuuuggcuggccuugaaggauuccaguuagcacacaaaagggagcacagcagaggaaaagccuggaggugugaacgugcaagaugcauuuccugcugcuuccaccuggcauggucuucccugggccaaccccacuuuaucuuuuccuggccagcucccauugguuggucaugucauagcauuuaucccagugcauugugauuggcuguuuucuucugccauuagauuuugaucucuuugauggcagagacuuuguccuguuuauuuuugggcauuaaucucuagugcaguacucugaacauaauauguauuccauaaguguuuugaaggaaggaagaugaauagugaaugaaucaucccacaugcuaagaaucuaagauguauaaaauaaaguggugaaagaugaaaaugaaauuuuaucaagguuagagucagguuggaguggccauuguuuaccaaacugagaaaucuaaauuuuauuugguugguaauugagagucauugagauauuuuggggaaggucacccugaugccuuugcuaaucaaaugaaaugaaugaaauggagaggcaagaaacuggaaauagcaagacgagguaucaugcuacugcaauaguccaggcaaaacaugauaaaggccucaacaagaauggcaccaguggagaugaagagcagaagaucaaggugggagacagagacagagaaaacaaaggauuugauggcuuauuagauguuuggaauacuuuaaacuuuauucauccuugcuuugcugguauuucugguuaaguuuuuaagcaggugcaucuucuuaauuauguuucauuugagcuaacauuaaguuggcuuacgugcaccgaagacacguguaguaggcagaaaaaugagcccccaaaauguccuaaucccuggaaccuaugaauauguuagguuauauggcaaaggagaauuaagguugcagguagaauuaagguugcuaacuggcuggcuuaagauagggagaguauccuggauuauccaggugaguccaauguaaucacaagaguuguuauaaguggaugagaaagacagaagagagaaccauagaaaugguagcaugagaaggauuuggccugccauuguuagcccugaagauggagaaaggguuucaugagcccaggaauaaagaugggcucuagaagcuagaaaagacaaaagaaaagauucuccacuaaagccuccagaggaauagcagcccaacugaaacaucaauuuuagcucaaugaguacauuuuggacuucucaccuccagaauuauaagauaaauuuguguuguuuuaagccacuaaguuuguggaacuuguuaugacagugauagaaaacuaauacaacaugcugcagacagggcuggccauaggaugacaauggccuagccugauaguaaaucuugcuacaaaccaaccacaaacuaaagaguugaccauucacauucauuucaaaugcccuucauuuaucaucccugaaaugaucugucacugggcuaaaacaucaagcuagaaaauauggcaugguuauucuagacccuuuggaauauuuuccuuuuuuuauccuugcaucaccccaucaauagguaggacuuauuuauauagauaucugcuaccaacagugacugaguuaguaguagcuuuucucuuuuaaacguaacagguguauauaagacacuaaauuaauucucuuguugagguauccaaagaugaaguaaauaguuugagagcagggaaaagaacuccaaugcacaugauaugccucauaugcuuuauauacauuauguuacuugacucuauagaaaucccaggaaguaggcauuccuauccauauguuaaacuuaaaaaaaaaaaaaccuggugcugauaaaagagagaggagccaaaguucaaacaacaugcagagucucagcaaagaugaucuaaaaacacuagcuuuccagaauguuuagcaacagucuaugucagguaauaaaaaucccccacuuucugucuccagugugcaacugugugcauggggugugcaacaguggacuagauggcgauggaaccugugagugcuacucugcguacacuggccccaagugugacaagcguaaguacugcuaguucccuuaaugccacaccagaucaaacaggcacaaauguaugcauuucaauuuuguaucuguuacugguucucugcaggggcaagguacuaccaaaaguuuucuggaaagaaacuagaaauuaaaaagagaauauagaagagaaaaggaaagaagaggagggaaagggaggaggaggaagagagagaacagaagcaauguggugucaaggcuauagcuguguuuuaggaagguugaacuggaggccaggugaaggguagaauggagagagggacaccgggacugggaagccaacacaacccaucucaacaagugagucaccuaguaaaggagauacagcaucuucucaauuaugagccucaaaggcggaacacauuaacagcccuaaggaagaggaaagggugcuucaccaacgcugagugauucaccaaaggccacacaacuaggagagcugggacucaagucauuugaauccaugggaaauucugaaaacaaucuauuauacuggguccaaucaagagcuggaaaccaaggggugauuuaaacaagggaaguuuaauagggauaauuaguacgcuaugauaggagagcagcuguaaaaaugcaaacacaacucuagagaggauggagcauaacaaaggaaggagaaauuuggaaugggguggccguccccaaggcuggauuuaaaccuuguuggagagggugugguggguggccgagaaguuugcuguuuuauccaggccagcacuggaccacagucaccuagcaggcauggggcaacccuccagggccuuggggagcugaggcuggugggugaggcacaggaaaucaggggccucucaggcaaaauccuggaauacacaaugucuaugucgagagggcugugggaagguagucgcuagguccaggccaaggaugcaaggucagccacugaggaacucugggugcaccgcuggggcagagcaucccugaacagacccugcagcagcagcaaaggaacacgcagcagcagcagcacacugcacccuggaggcagaaagaggaguucccgccucccaccgugucccgccagcgcccucuacuggcaaaacuuaacaucgaccugugaaggagaaacucacaggauggcagagccggggagcugagauguuaagaaaucgaccauucugccucugccacuagccucauuuaacuuauccucgggacuuuagucuccuguaaaaugaaaggguugggugagauugaaagucagcaaaugcaaacucauuuuauuggaagcgguugagaugccgugagcggugguaguaacaggaugaauaaacucagccucugccuucuuccuguagcugggacagccaugaaagccuccaguccaaaugcaaaggcaaguggguaggacaggccuucugugguccucagucagccuccuuccuuggccacuccugccagugugcaguggacuccugggcagaggccuucucaguaaggcaggagacccaguccagaagccagccuaagggaaaacccuaauagauaugcuuccaaguaaaaaaauaauaauaauucuguccagccaaaugacaagagacuaggacaaaaauauuuaaaauucacauggcagauacauuuuuauaacaaaaaauuggauucauguaaaguccaaaaucuaaauuucagaauaagaaaugaaaacaggccgggccuggugguucaugccuguaauuccagcacuuugggaggccgaggcggguggaucaccugaggucaggaguucaagaccagccuggccaacauggugaaacccugucucuacaaaaauacaaaaaucauccaggcaugauggcgggcgccuguaaucccagcuacucaggaggcugacccgggagaaucgcucgaacccgggagguggagguuguggugagccgagaucacaccauugcacuccagccugggugacagacugagacuccgucucaaaaagaagaaaugaaaaccagcaauaaacaugaaaaaggugcuaaguccacuaaucguuacauacauacuuauuaaaauucagucauauuuggaguccuggagguuuauuuucauuuguuuuuuuauuuuugcccacuauguuacaaauuuuacccaucuguggguaugagaaaaaugacaguaagaauguggauuccuacaaccuacgggagaaauuuauuuacuaaauuugaagguaugcuuauaguaugcuucuguguccccaauucuaagaauuuaccccgggagaggagaggaauuagacaaagguaagcauauaugaucaaauaaauuuauggaaaugcuauuuguaggaggauaacaagcugaaaacaacuugaauucccaccaguaggaaauugguugaauaaguugugguacauccuauacuaguuaggauaaugcuaguugcuauaaaaaauaaacacaaaacuucaguggcuuaacacuaugguuuuaaaauugugcgccaaggugucccaagguacuacaaucaaauuuacuggcuacuauugguauuuuaaauuucugagggaaacacagagauacaucugucagauaccacaugaacugcuagcuugaguugguucacaauuucaacaugaggucgcacuaauuccuugcagugacaucauaucuuugcaaagguacauuuucagugauugcuaugauaaaaggcaaguaccgugugaaaaucaaugugacugaaaugagggugccagucuacaaucuguaucaaacuuuaaaguuugagaaguugugcaguguccaacacacucacauaucuuauacguaggucaaugugguuacuuaagaauagacauuuuucuauuaagcaugucacuuuuucaaauggcugcuaagugauucuaacaacuaaauaaaugaaucuuuucgguguuucuuuugaugucgggauaccaugaaaaaauuauugggaaccucuggcuugacacuaaagaaguguaguucucacucauguaacaguccaauguggguguuccuggcuggcgccagcuucccccuacauggugauuagggauccagaucuuuccaucuugugacucugucauucucuaguaccucagaguucucugcuuccugccaucacagaugggaaagagaagauggagaggcaccugcuuaugaaaguccaggaaaaauauauaaaaccucuacucaauauuccaucagagugaacuagucacgugaucuuuccuggacguaaagugggguggaaaauguaauccugaaggagcagccacuuucugccaaaacuucggguuuauggaaggggugggggaauagucucugugaacuauuuuacucaacuagccacuguugggagacaauucuccaugcaucucucacaugugugcacaucuugagagcaauacacugacugcucuuuguuccagaucaucuguucaaggauguuuguauacugaacagacuuggaaaacauaguaucucccucaggagcaaagggcaggcaugcucacugccagugccucucagcuccaaagccacccuuuuugccugcucgugauaauggagcugggcuuuauaaaugauucuccuucacuagcuagcaaaacgugaagccuuaucaaugaagagugccagaaggacuguagaggaggaagccggggcucucucccuguuucugguuugacucacucaccaggcucccgaaaaacagcuuuucucuguuucuuagccccacaugguuucuccagugccggguuccugcagagcucagcucccuccagcauuuggccacugcacacuguccagugcuugacucaggaaguggcagcacagccaggagccccagacugcgcaggcccaugccucagcccaggggaaggcuguucgguacuccucuccucagccccaugcacagcaaggccccugaagagcuggucaucuggagagcuggacacauccccugaaucccacacagcuggucuggagcugcccaggccugaaccacacacagaggugcacugcaugacagagagguggcuucuuagcugcugcugccagcagcgcccacuggcuaacagauuccuuuggcaccuagugaguuccaaggcuugugaccuccccaugcaugaccucccagccaccccagagagcagauuuccagcaaauauugucaaggcaucucugcaacuuugcuauccagugacuaacgccaugcuuuuuccagugguauucagaucucagccuggagggaagaagguuauacguuggguacuugucucagcccuaguacaguaguugcucuuuauagaccugcuauuucuuuauucuuuuuuuaauuuuauuauuauuauacuuuaaguuuuaggguacaugugcacaacgugcagguuuguuacaucuguauacaugugccauguuggugugcugcacccauuaacucgucauuuagcauuagguguaucuccuaaugcuauccauccccccuccccccaccccacaacaguccccggugugugauguuccccuuccuguguccaugcguucucauuguucaauucccaccuaugagugagaacaugcgguguuugguuucuuuauucuuuagaauuauuuuauuuuaaacucucacuagcugauuuuucaugauuuuaauuguucauaauccuuuauaguacaacuuucccuguucaaauaauuaugugguuucugucuccugcuugucccuaaauaauacauugcccauuuuuuaaaaaaaauagguacccuaagaucagggcucaccuccuauaaugaaacccacugcauguacaugucucagucuaguccucuuugaauugccccaugggaauugagguuuggaaaaacuggugccaaaaugcugauacccuggcugcugccccugcuguaaguauuaagcuguacuucacucuaacccagaaguuuuguaucuucuaccagcauccaugaaacuuuauuagcccaacuuguucacuuugcaaguuggcugaugucagacucuucauagcuuuugacagccaucuacgucacaccuaccuuuugaaauacuaugcaguuacuagagaucaaggcagauccuuaaagacuuucauaauauaucguuaaauuaaaaauuacauugcuaaauauuuuaacaggauucuauuuuguuacaaaaucagacaaauaaauguuauaaauuaauauauuuuauugauugaugauaucgguaaauuugggagacuaagaagaagacaauuuuaacuuaacguguucuguauuuuuuaaauuauuacaaugaguuuguauugcuuuuuaauaaaagggaauacugcaguuugggggucuuaagaacugguuauucuacuaaugcaaguacuucaacaauuuuccuaugcagccaucccugaaugugcagccuugcucugcccagaaaauuccagauguucgccuuccacugaagaugaaaacaaacuggaaugcaaaugccuucccaauuaccgaggcgauggcaaauacugcgaccgugaguagaauuuagauucugcuaguuuauucauugagauguuuagguuauuuaacaggaaaaaaaaaucucacaaccuccuuaacacaaugaccauuucuauuucucgcuguguaguugagugaaacguauauaaaaggugccaagcaaaaugcucaauaaauggcagcuucuccuucucuuaugaaagcacauauagagauuuuuauguuuccauaucaccuuaaucaauguuagaacauuuaaugcuucuuauuuuaucuuuuugauuuuauucacuuuauaaaaagcuguauuauguaucaguuaaaaacauggacucucaagccagaccgucuggguucagucccagaucugccuucuacugacuacaugaccuuuaaccugccgugucucaguuuuucugucuaugaaauggggauaauaaugguaccuacuuucagggauuauuguaaagauuaaaugaguuaauacauagcaaauucuuagagcagggcuuaguacauauuauaaauucuguaaguguuaauguuuucuuucaugcuguuuuauauuuaacuacacacacaaaauggccuacuaauauaucaacacaauaucuguacaauuucugauggccauacauaaaucugucugguucagggggaaaugaaaggaaauguuugucuuugaaaacugugaguugccuuugagguuuugauccacuguugcucacgguucaguuuuccuucuccauccccguuaacuaacugccucucauuuugcuguugccucucaagccaucaauccauguuuacgaaaaaucugccacccucaugcucauuguacguaccugggaccaaaucggcacaguuguacaugccaagaaggcuaccguggggauggccaagugugcuugccuguggaccccugccaaauuaacuuuggaaacugcccuacaaagucuacagugugcaaauaugaugggccuggacaggugagcaaaugaugcagggaacugauguaucuagaaguuugacaagccacuaugugucacagguaucauuugucuucuaugccaucccaauucucccuuucaauguuccgcuuggucuuccccuccagacaguccuccaugugcucagagccugaaaucagugccugcucacccagucuauccuuuaaacucacacuuucccagcuccccauccaaacuuaauugucuuacguucucuccugucacaguccuauaugguguuuggcaaaauauacacauaauucaaaauuagauuaacaaauuaacuguugaacauaugauugacuuuuaccagcaauccuccauucugcaauggcuuucuaauuuaaaaggugcucuuagaaccaaaaauacccuguuccaaacgaaugaaacagauaaaaugucaggcagcacugauagauuauagggagcagugggaauauucuggggagagacacugucccucuaaaugacaucaggaccuugacugauaaaaaaucuggucaggagacccucacugaggaauccaguggaaagagccuuggcccuaauagcacauucguccauugaguauuuauuuaguggaugccuucuguguccauaacugcacaucaagccuucagugaaggaaauguguccauacagaaggguauugcugcacagguaggaggaagggcucagugccugacccaaacagccaugcagucuaaucaccuggaugcuagcugaugggaauauuccuagaauucccugcagagaauccacccaaccuugccuccaaagagaaaggauauauuaugcaacauuuuucugcuaucgauuucuggggaaggauugcagaaaaauucaaggggcuaaauucccaucugcaaaaugagggucuuuaugggaaaauuaauguuaugccaugaaugucaagaccucgcaugugagauaaaagauaugcuuuaucucugaaaauggguuccaagacagauuuucaagucuuagaaauucuccauuguucacacagaagcagcacgugcaugauuccaaagcaggguuucucuaccucagcauuuuucacauuuugggcuggauaauucuuugugggaaggggcuuucuugugcauugugagguguuuaacagcauucuugaccucugguagcaccgccuccucccaucauggcacucaaaaauguuuccaggcugggcaugguggcucauuccuguaaucccaacacuccgggaggcugaggcagauggauugcuucaguccaggaguucaagaccaaccugggcaacauagcgaaaccucgucucuacuaaaaauacaaaaaauuagcugggcaugaugguccacaccuguaaucccagcuguccggaagacugaggugggagaaucacaugagccugggaaguaaaggcugcaaugagccaaaauugcaucacuacacucuagccugggcaaccagaguaagacccugucucaaaaaaaaaaaaaaaaaaaaaacacuuguuuccagauauuguccaguguguccuagauugagacuccugguuggaaaccauuauucuaaagcaauaauaccucccauuuggacaucaauuucugcucaccuauagacaaucuaaaacugggacuuauggagcuagggaggucaaggguuaggaaacaagaaaauugaagcuaaacuuuauaagcaaggaguauaagcuuuccagcaggugacauguguaaacaugauuucuacuuuuagauacuuugacaaauuuuuaguuuaaguccacacuucagacauacucugagugaguuuuuauggaagaauaaaaauacaaauuaaagaagaaugccagcugaaguaacuaacuaggauccuauuuguuuuucucuuccugucuacugaagucucacugcgaguguaaggagcauuaccagaauuucguaccuggaguggggugcaguaugacugauauauguaaaucagauaacccgugucauaggaaugcaaauugcaccaccgucgcaccaggccgaacugaguaagucuuuucaauuccuccaccaacauuuccaaguggugaaaaugguguccagucauugcuguaaguuucuugaaggggaggaaaugugucuuauucagccuugcauccacccccaccccacauaguaggagcaaggauuguaguagguacucaauaaaucuuuaauuaauuaaacacucaacaauuauuuccuuuauaugaccauuagaauacucuggaauauuguuguggccugauaacuugauaugaaguggucagaaugugggagaaggaagccacugcgacuggggaaacaaaugguuguugagauuacaggguuaugaccucuaauguacaugccuguuuccucacucaugacauauugcuuguuagaggugcaaaacaagacuagggaaagugaauaagcacuagugguguuuccuggacucuagauuucaaaagaagggguuuacugugaauaaaaacauuugugugaaaguuucugaggcaaaggcagcucacaugauagaaagaagaugguauuuggacuaaagaucuagguuuaagucucagcacugauaccuaccagaugcaugaccaaggaaaguggcaccauaucucuggccucaguugcuccauguguaaaaggagcacaaugauuuauacuucauaagguuguugugaugauuacaugagagaauguuucuagaaacuaugacaccaguguaauguguuuucauuagugacugaccugaagcuagaacccaagucuuugacucgcagacugagguuucuaucucuguuccauuuucaauucucgcuaccaucagcaucugagaaagacucauagugccauugugagcucaaaaccacaaucaacaucgaaccauagcaugauaaaacaguuucugugauuccagagcccccuucaucuuuugggaaguucacgccuuuuauaacuggguggucaguguguagauuugccccaacagguuguauuaucaucauguccuaucuggacaaauaaauagaucuguacuuauuguacauggaguggaaagagcugggauaucagaacacuuagguucaaaucccaagucugccccuuaccuuacccucucugaacugauguuucuucaaccauaaaagggagagaacuauaccucccaccagggcugugcugaaaguuaaacaggauuacauucgucaaucucugagaagaagauggcaccuagaaauccuucaauacaugugaaugcacacacaaauacaccacagccaugcauauaggcacagaggcacccaacacacauaugcauccaggcacacccuccccucaaacauauauucuggcaauacugagaaccaaacaagcugguguaugcauguuuuaccacccucugagaaagucuaaauagaauaccuuaagcgaacucuuuccuuguguuugagaagauaaaaucuaaaaaugaaaugagaauaucagaauaauauaagcugcuuccaaauuuguguuuagaaugucagauaaccuaacauugugauguuagggguacauguaucacccacaaaccuucccacaccucaaauugacugucuucagccaaaaaaaggccuaaguaaaaaagcuagcuaaguuauauugauaaaauaugaagucaucaguccucagguaauuuaguucaucugggauaaaaauuuauuucauuuaugccuucucaauauggcaaguagcuuaugcagaaucuucaaaaucagacugcauuugucacagaagaccaccugaucgagaaggguggguugaaacaugaacucuaccacucccccuggggugaccuuaggcaagacuaaacuuuucuaaaccacaguucccucaccugucaaguaggucuagagaccaggaaucucugccuguggagagcuaaugaguucauguauauaauaugcuuuuaaacgcuaagcuccauuuugauucuuacugagaacaaauaacuuuaugcuuugccuuuuuacuuuuacuuauuaauagauguaggaaguaagggacaguagaagagaugagcauuucucucucauuuaacuaaacucagcugaaaaauagccaggacacggcugagugggccuauuguaauaagcacaguuuacauuccaguugugcaaaaguacaaacaacagugaaguguagggacucuuggaaugcuagugacauugaugauauucaguguuuauauaagaucuguacagguugggauauccucaguguaaacagucuucccaagaguccuuuccaaggcaacaugguacaguggcaagagacauucucagauggaucuaguuuuaaaucccagcucagccacugccagauguguuuccagcaguuugacccuuagaccugggcaacaggagccccuccccugggcacugcauguuagaagcucccauucuggcccucugcuggcuacuccagggcaaggaaucugaacguccaaaggggcaugcuccccaagagccugggccccccacuagaccacacucgggguacucagaagccugcaauuuccugcccaaacagcuccaaaccagcuuccagggccugagaccauucccaggguauggaggauauggccaaaaguggcuguucauagcaggugcagauaagccagcauuaucuccaccauacuugugaauauacccuugccucagguucugcugaacuacuuauuauuugucuuggucuguuuggguugcuauaauaaaguaccauaaacugaguggcuuauaaacaacaggaauuuauuucucacaguucuggaggcugggaaguccaaaaucaagguaccaguaguuucaggaucuggugaagccugauucauagguggugacuucuuacuguguccucccaagguggauagggguagggagcucucugggaccucuuuucuaagggcacucauuccauucaugaggccuuuacuuucuugauuuaauuauuauaccucccaaaggccaugcuuccuaauaauaccaucacacuguggguuaggauuucaacauaugaauuuugaggugaacacaaacauccaguccaucgcacuguucuucaaacaugccauggugcuccccacuccuggcccuugcacgugcucuuccuuccacuuaggaugccaucuccgugcuccacccaccuccugugagucagccuaacacccugcuccuucaauggccagccuaaguaucuccaccucuaggaugccucccuguccucccagugcucucugaugccccucccucugggcucccagagcacccuggaaugugucuaugagagaauuuaggguccagaacugugauaaggauguagcacaguggcagugagcauaggcgcugccaguuacaggcugugugaucuugagugagauacuuaacuucucugugcuucaguuuccuuaucuaaaauggggcuaauaacaggaccuaccuuauaggguuguugcauuagaaaagauaccacacugaagcccuuauaagacuauguagcauaagagcuauuaauaaaugcuggcuauuagccgccccgaccgggagggaggugggggggucagccccccacccggccagccgccccguccgggaggugaggggcgccucugcccggccgccccuacugggaagugaggagccccucugcccggccagccgccccguccgggaggugaggggcgccucugccuggccgccccuacugggaagugaggagccccucugcccagccaccaccccgucugggagguguacccaacagcucauugagaacgggccaugaugacaguggcgguuuuguggaauagaaaggggggaaagguggggaaaggauugagaaaucggaugguugccaugucuguguagaaagagguagacacgggagacuuuucauuuuguucuguacuaagaaaaauucuucugccuugugauccuguugaucggugacccuacccccaacccugugcucucugaaacaugugcuguguccacucaggguuaaauggauuaaggguggugcaagaugugcuuuguuaaacagaugcuugaaggcagcaugcuaguuaagagucaucaccacucccuaaucucaaguacccagggacacaaacacugcggaaggccgcaggguccucugcauaggaaaaccagagaccuuuguucacuuguuuaucugcugacccucccuccacuauuguccuaugacccugccaaaucccccucugugagaaacacccaagaaugaucaauaaaaauaaauaaauaaauaaauaaauaaauaaauaaauaaauaaaaauaaaauaaaugcuggcuauuauuauaacuuaucucaauccccaacuagaauauaagguccaugucuuacucaucuuugcugcagcaaugccugucaccaauuaacacagugaaaugauagguacaaaaaauauaaacagauagaaugaauaagaccuagcauuugauaacacaacagggugacuacagucaacaacaauuuaucguacauuuuuaaauaacugaaagaguauaauuggguuguuuguagcacaaaggauaaaugcuugaaaugagagcuaucccauuugccuugauaugauuauuaugcauugcaugucuguaacaaaauagcucguguaucccauaaauguauacaccuacuauguacccacaaauguuaaacauaaaaauaaaauaagaaauaaaaaacagugaaaugagugagaauuuggaggaacaaaugaaacaaugaagaaaugaaaugaaccagugaagaaauaaaggaagcaacuguacuaagacuuugagacacccuauauacuaacuaaaucucaaccagcauuaaguguaauuaauuuuaacccauaacuguaaaaugcaaauggcuucuggguguuuuuaaagccuuaagacagcaagagacauuuacuccuaauaaaaagaaaacaauuuccuaaagaggugauguugugaauguuccauggcucaacugagaacaguuaagucagaaacuggucucauaacgucucagacuuuggacugagauuugaaauaaaaauuuaaaauagugaugucucaugcauuccauuagcacugaggccauaaaaauaugauucuccugcaauccuuaggaaagaaaggccaagucacuugacacaaaacagaccauuggccaccuaacaacucaagaaacuuuuacagagaaacauacucagugguuuguaaagguuacaugucuugcuguuaacaguugucuucaaaugaaggaauguaacuuauaguaggauuaauuuuuaagaaugacuguugucuuaugucacuucccagaguuaccagucuccuccuuuccaucauuaaauuagcguagcacagugcuugcagaggagguugacauuuaaguaggaaacuauuauuugauuguauuaaauuguuucaugauuagaucuacuuuacuaauuccuuauaaaaagguuucucagccucagcucuacugacauuuuuggccagacaguucuuuguugugaggggcugggcuguguaaguagauccccaucucgguuguagcaaccaaggaugucucuagacauugccaaauggcuucugggcggggcuggggagggggggcaaaauugccucugguugagagccaauucuucauaaaaaccccaaaggcuucaucaguaaaugaucccccaaguguuuguccagcuagaaaacucauaggcagccgagcacgguggcucacaccuguaaucccagcacuuugggaggccaaaacuccagcuacucaggaggcugaggcaggagaaucacuuggauccaggaggcagagguugcagugagcugagaucacgccauugcacuccagccugggcaacaagagggaaaacuccagaaagaaaagaaaagagaaagaaagaacucauaugcaaccuucuagaauuaaauauuacuuucuccuagaagcuguccccuauuucuccagguaaaaucaguuacuuccuucuccaugcccuauagcauccuauucaaucuucuaucauggcacuuacaaugaaacuucauuuaucucucuacgggcuguccugguauaucccagcaccucuaggucacuguugucauuauagucaccuuccucaucaugucagccuuguccuugucguuaucaucugccaagcauugagcuuuuucuauaugucugucacagugcuauuuuucuuuccuuaucucucuaucaacuauccuaaagguauuauuaaacccauuuuauagaagaggaaacugggacucaaggaggucaaguggccuuaccauguugcuauaauuauuuuguuuucagguccauccuuagcauguaagacucaagaagggcaaagugucucuuauuaucaucuuuguagcucucuuaccuagaagguuccuagaauuaagaagguacuuaaauaaucaguaaauaaucaguuaaacaaucaggcacugcccuaagugcuaggauauaaugaggaauuauuauaguugggauccaucuucuaggacaguauaccaucuagcagaagagacaaugucuccagagguaguucugguggauaggguugugauagagguaucgaugggaugugcuggaagugcucaacacaacuggggagaggucacaccagagugauaaggugaggaugggaaagcauuccuggugggacaaacaggcugagaaaggcauaacagccuaaaaaaagaaguaguuuagcgcugcuggaauuuucaguggacagcaaaaagaagacagagcaggauucuccuguguacacuuucucauguggauaaaaggagucagugaggguuuuaagcacacaggugccagaauuuuaaagcgcagucaggagacugcaugaaaaacagauuucaggguagaacauaugggcaaaaagaccagguugaggcugugcaacaauccaggcagagggugguaggauucugaaggucugcagcaaacuuguugaacauguaaucuauuugccauggaaauauauuuagaaacacacguggauuaaccauaaaaaaaaaagagugcauagucuuucuuuagaaugcuuuccucaaugugagucacagcugugguguggugugagcacugcaaaacugugauguagucacagcacaucuuuuguucccugcaucucuccucucuggaauguucuucccuuacuucgcuuugguuccuggcucaucuccaagaugcuugugaaagucaucuuccucaucaccuugucaauuucagccagcugucaacuccucuauacugcauaguuguggucugcuauagccagagcuuauggacucacaagagcugaguuuuaaaguuucagaaauuucacaagaggguuagcaucaucuuauuaguuugaaauuggucaagauuggcauauuaaccauggaaauuggcaaaugcuacaaaguagggcuucccccucccccagagaguugguuguuaaacauuuaucagcauaccacugauaguacauuuuuaacucuacuucugucuuaugaaacuauuguacaaaaucucugugauuuucauuguuuacauauuuauuucauaguuuguauauuuauuuucauuguuuauauacuucauuguuugcuauuuauuuaauucaauuacuacuuauuguacaacuauugagcaccuauuauggaccuacccugugcuggauucuggaguucacaacagugaacaaauacacacauagcccuuacccucacucuuuucucaaauguuauagggaagcagauauuaaucaaauaaucacacaagucagggugaaauugcacuaugaucgcugcuauggagaagagguaugugguuucaugagaguauauauaauggagacacagugagggaguggagaaagagacaggcaaucaaggaagccuuucugaaagaaguggcaauugagcagagcucucagcuaggaaggagcaggggugggggaagcauucuaaguagaucaauaaugcugaaucuuugcuguccugcaggcugaauucaguagcuuauucugauucagucaugcaguggagcccuaggguccacauuuauuauauuaaauauguuauauuaaauauauuaagcacuccaagugauucugaugugcaugguuucuugaucacacuuugagaaauacugagacaaagagcauacaaagauaucuaguguugacagauacauuuaauuuauuaggcauccauuucuugaggagcuacuagaugucagauaccacacuaggaaugcucucuugucccuauucaacccugggcauccuuugcuccaucuguucaaugaggggauuggacuguaugaucaaaauacucaauggcucuaaaacccugaggaugucuuuucccccucucuguagaugcauuugccagaaagguuacgugggugauggcuuaacguguuauggaaacauuauggagcgacucagagaauuaaauacugaacccagaggaaaauggcaaggaaggcugaccucuuucaucucacuccuagguacgcagcuauggguacagauuuccacacaaaaguccucuuucaggaaagggcaucugcaagauacaaugauucagaaagggacaggcgagccuugucuauuagaaucagccuuuuuggaggggucaugcaggugagagggaaagggcaggcagcuguuucaaagaagacaagcaaagagauagugccaagagaucuagcaaugcaagaauuagcaggcagagagcugaggacaggguuugggggucgccauagaccaacagagcugcaguaacaguaagaacaggacagcuacugaugugaggauacaaacugucccccucguccuugaccuucuagauccuucagguaugaacaaagcuuggcagguaaaacugggaauagagagggugacugagaccccagggcagcauccuuguuccucaguggaggggcuguuugaauuuuggaauagucuugguuguaugcaaccaucuuagcacccuuggucccccagucacuaauugccuacagugacacauucaccuccagccccccaggcaaggugagagccuaaaacacccucauguauuugcaaaugacuucuaagggccauuacuccacacucucuagagaaugaaauauuauaacugaucacagcauuggacacaacuuccaauaaaacacaaauccagccguucugaaaaaaguaaaacacagacuuggccaaucaacagaaacuuuaaaaauaucagcuuuuauguuggaauuuaccaguugccaaaaaugaucucccagcaagaacauagauaaaccaguguaauugaugggucaaugcuguguucucugcauaaaucuuaagguuaaauaucccauuuaaugucuccugcauaaacaucccauuuuucccaaggcaucccauagggcaucaaguauuaguggcaucccuugggcucaggggcaaucuaccaguuuccucacagccuuacucuaagaacucuuagaauaccaaaugggaccagacaggggggagguaguguuuuuugcagaccaggcccuccaacauuucccuagacagaguccuguugaccuuucaccuuccccaugacaaaguccuuauacacugccucugggugugagaacacagagccuguccugucgucccagcuuccccaggugauggaagcaggauuaccuacauacuuugcugggcccacuggaaagugaaaauguaggauucuuuguucaaaauuuauuaagcauuucaacauggcaacugcagagcauuaaaccaaucaucggggcucuucugagcuggcccuggauaaaaacaagggcugccucuuugcucaccgagacagugacaacucaaaguuaagcgcaggaucagggacccugggguugugguaggauuuugucaugccugaacugcucagccaggguaucuuugaagcugaggcugucugcaggaaaacucucacggcauuauguggaauguauugaggccauggcuuuagggugccuuacauucuuagagagauucccaguugacacagggccuacacaugcccauuagaauagagaagggcauaaauggaccggucgugacccaagaccuguugccugauuuuacuccuccuguaccacugacucauuuggcguuuucuuucuuuguguuauuucgacuccuaagacaaagcuuaugccuggccacugaguaagcugggacccuucacggugcuguuaccuacagacaagggacugaaaggauucaaugugaguauuuaaaaugacccuacaccaaggggcuaauaugaaaagccuuaguagggaguaccuucuuuuauuuaaagugggaaauccccauuaaaauuaaaccuacugaugauaaggauggugauuuuuugauaaacuucuuuuagugauauauaacauccuuacagaaaguauacaaauuguaaguguacaacucagugaauuuucccaacgugaaccuacuuguguaaacaccaaguccauugccagcaaccuagaaggcccccuggucccccuuuccaaucauuacccucuacagguaaccacugaguguucuuaacauauauccaggugauaaagaagauuugcuuaaagcaaaacugcucacuucccacaggaagaauuaaauuaauguauuagcuagauauguggguuuuuuaaaucauuauaaaugguacaagcgauaaggaaaaaauaagaagaaaauuuuagucuucagugugagcagcuguuguuugagauaaugucauccagugggaaugaaacuuguagugccugguggaggcguccuaucgagauggcaucacuaauauaguuauauuuggucuaauguaaauaauggacuuaucgauuuguauacaacuuauuaucuucacuggccuccauuuuaaucauuguguaggaacugguauucuauauaucuuucucccucccaccuuuaccaucuaacauguguuuuuauuuuuccugaucuugauuuuuuuuuuuuuuuuugagacggagccuugcucugucacccaagcuggagugcaguggcgcaaucucggcucacugcaaccucugccuuccggguucaagcuauucuccugcuucagccucccaaguagcugggacuacaggcacaugcuaccaugcccagcuaauguugauauuuuuaguagagaagggguuucaucauguugaccaggauggucuccaucuccugaccucgugaucugccugccucagccucccaaagugcugagauuauaggcgugagccacugcaccuggcccagaucuugauuuuuauuguguguucuugucaucugucuuaaaugcucugugaaacagaucagccagaaauaaauaaacauuuaaguaaauggauuaacaaauacacauaaaaugauggaagccaauaaaagauugaaaucugggaagugggaaaaaauaaaaaugaaaaaauaaaauugaguuaucuuaauccaagauauuuugugguaauaauuuuuguugcaaugaaucaaaacccaguaaguugccggcucucuaacccucauauaccaccacgauuaaccugucugauauucaucucucuauuguucaccuucagagauguccucauaccacuccuguuggaaagaaccagcaaacauuguaugccucuaggcuaggcacuuugcacguggucucucauuuaacacauaguuuacacagaguuaauauaagcaucuguucaguguugacuacguaguaaugacaaaaguagauuugaucccauggauuucaaaaaucuuaacuuuucuauucaaaaguacaaucagcuuacuugcuuuaccuacucuuuccaugaaacuucaaauuuuauucccaucugcuuuccauguucaagauagauuccuuguuccuuguuccuccuggggccauugcgaugcugugcuuuccccaugucaguuucaaugcuaaagcaaccuccccugguuugagaguagauugugcauugccuccaacucuccagguuucuacucccuggaaggccuggcccagguugauugcacugaugguaauguauagcaaguauaauugucagugcuuucaugcauuuguauuugcaaaagcccaaacccaaguuagggugcccuggcuuugaugucuuugauaauaaguaaggcacagcauguguuacaaaacucauuuucuucuucaaauaauaguaaaauuggcucuucucucuuagguaaaugagcuuuugguggauaauaaagcugcucaauacuuugugaaacuccacauaauugcuggucagaugaacaucgaauauaugaauaacacagacauguucuacaccuugacuggaaagucgggggaaaucuucaacagcgauaagguaaggguuccucugauuuucacucccagaacuaaauuauccaccaagccaaugcccauauccuucucucucuuuuuguuugggguuugugaaaaauuacaaggaaauucuuuccucauguauuauuugucaaacaccuuauauaggaagaaacagacagcaacaccagggaaggccauggaggaaggguggaguguuaugcaaaugggguuacaaaguguuugacuuuggucuggucugauuuaguuuucaaggcaacugucauucaacugccagcaggaaggagaaacuuugcuauaaaccuguuuccugaaagcaucagcacaaagccagaucagcauuccucuuauagaaggaaauagauuguauuuguuuuagauugcuggaguugauccaucuucuccaaccuaacauuccucucucccaaugccauuaguucuguuuguuuuuuauauaaacccauccucccccaccccacccccacuucuuaacucuuucugugauuuuauugagcuggggagcaggugauuagucaacaaaaugugcauguauauaggcauaggaccuauacuauuacauuuuacugaacaucgauaguuaauagauccuugagugcuuguucuaagcaaaguauggggauaaaucuuuaucuuuguuacauaaggcucacaauaacccuguaaaggagggacuucauaaucccuguugcuccaguaagaaagaagagaggccacacaguaagugccagagccaggauucaaauguggcuccaaaguccacauucuuaaccaaucugcugcagugcaugugugaagauggaugaugcauggauggauggauggauggauggauacauggauaggucacuggauggauggauggauacauggauaggucacuggauggauggauggauggauggauggauggauggauacauggauaggucacuggauggauggauggauggauagauacauggauaggucacuggauggauggauagauggauggauggauggauggauggauggauggaugaauggauggauggauggacggauggauggauggauacauggauaggucacugaacagauggauggguagauacauggauaggucaccggauggguggauggauggauggauggauggauggauggauggauggagagaugcauggaggaugcauggauagguggauggauggauggacggauggagagaugcauggaggaugcauggauagguggauggauggauggauggauggaugggugaauggauggaugguuggagagauggauggaggaugcaugcauggauggaugaaugacagauaggaagauguggcuugcuuucucacaaggauaugcauguauuuaccuguucauucauucaaccaauauuuacuaagucugucacuuauuaggaguuauaugggaggaagaaggaauuagcuucaguuauuuauuccacaaauaauuuuauugugugcuuucucugugcaagacacuaaagugagugaugaauuuauaguaaauuaaauaguuuuguccuuaugaagcuugcagucugcuggagaagagcuugauaauaccuugcccagguuuagcauauauaguugucagugcuuucacacaucauaucauuugaucuuaaugaaaacccugugagguuaacaaagcagacacuuucauccccacuuuagauuaagugacuuauccaaaaucacauugccaauaaauaucaaagcccaaggacucaagacuucugacucuacuccagugcuugcuccuuccaggacaccauaguaaucuuauuuuaucuuucuuugguguuuuaggacaaucaaauaaagcuuaaacuccauggaggcaaaaagaagguaaaaauuauacaaggggacaucauugcuuccaaugggcuucugcacauccuugacagagccauggacaaguuagaacccacauuugagagcaacaaugaggugaguauucagauaaaagucacaucaggccagguccaucuuccuuuguucccuggagagucacauccagagcaugccagcacucugugcuugugcuucguuugugcuaggaucccgagcagagagaagaagaggugguuugucuguuuccaauagaaaccugggaaucucugcagaaagaaagcaagacguacaguaacauaugugggaaagaucuggauuuuuuuuuaccucuuuuauuacugcaucaggcaacucaguccaugaccaaucaucaugaaaauauuuuauagagggcaguuauugcugcaauaaaacuuauuacuucugaccuagaugaugagggccaaaggauacuucagaacaugcagaucugaacuacuguuucaacgacagcgaacauuuauauaaugcauugcaguugaccagguucauuuauauaaauccauacugacacauaaacucugucaucagucuuuaaauguuagaauuuguauuuccuaaaucacaauauuuuauuuccugauuuuuaagcaaaaugucucuuuuuagcaaaccauaaugacaaugcuacaaccaagguacagcaaguucagaucuuuguuagagguaagcacuuuucauaauuuucugaaaaauauuuaugucaagacuuuuguaaaauuagcaggggugucaauuauaaauuucuggcgaauuauguuaaauauuuguccaagguaggcugcagauacaaaauuucauuucccaaaugcaggaaaccaauuugggacaugccuuagaugaggauggaguugguggaccauacaccauuuuuguuccaaauaaugaagcauugaauaacaugaaggacggcacucucgauuaccuccuuucuccagagguaccguauucugcuugcucugauggcaucgugucagcagcacugccucagucugugucuaaacagguuuuuccuaaacuagagauaguaaauaaguuguacauguaucaccaccuacccuccaacaaccaaggcaggcaucacuaaucaaucacaacauucuggaacuaagccuggauguggcuucagucucuucgauagaauuucaaguugccaugaucaauuagacuugauacaggaaaugaaauguauuugcaaucccaggccuaaaugguugguuugauuugucuugacucuucuaauauuucucacuaguaaaaucaacacuucaaguucccuacaacucuaaaaucaccuagagaaugaagccuaaacuaggccauucagggccaggucuaggcuaaacuuuaaaaagaauacguguuauuuuuagaugcuucagccuuuccuuuccuuucuauugcuuucaucuuucuccaccaugggcuuucaguucucucacauucuccucuaaaagggcaauuauugacuucuucauaucggggugucaaugacugaaaccauuuaaaguguuuccuuucccagaaauaauagccuuaacuugaagaggacagccuauuguggaauuuuguucguuagaaugucaaauaguggaauuacaugaaaggucacaugcuuucuuucagugcccugaaacuaugccaccaucuugguaauggggagagaugaccuaugacuucauaaagaucaguguugauuauauagaauguggagagaaggaggaaaggaugucccagucuuuuaggguagugauucccaaaguguaguguagacagaaaccauccauggagcuugcuaacuaggcagauuccaaagcccuaccucaagcauucugguuuaguggugcugggaugaggcccagaaauagacacgcugguaaccaccaacuuucuaauucagauagccccagcccacacuguuuugggaaugcugaaaguuguugccuguuagguuuaggaauucacauagauauauaucccuuuuuagaaugcuuucagguaucuauaaggauaucuugcugucaaaaaacuuaggauuuuuuuuuuuuuuuuuuuugagacggagucucgcucugucgcccaggccggacugcggacugcaguggcgcaaucucggcucacugcaagcuccgcuucccggguucacgccauucuccugccucagccucccgaguagcugggacuacaggcgcccgccaccgagcccggcuaauuuuuuguauuuuuaguagagacgggguuucaccuuguuagccaggauggucucgaucuccugaccucaugauccacccgccucggccucccaaagugcugggauuacaggcgugagccaccgcgcccggccaggauuuuuuuaaaacuuaacaaggagauaaaucaaaaguaaucucuuacauugcaaacagauguucaacauaugaaaagauuaguuauaaguuuccauagaaaaagucagauuucccagggucuuccaaaauagaaugauauuucaaaauaugauucacacccaaauuuuaugaaaccuagcuauugcagaaaacugcuagaccucucuuuagaacucacauucauacuuaaagugagcuaaaaaaaaaaaaaaaaaaaagguaauguuguuccccuaagaaauuauuaaaauccugagauuauguggccucccugaguacauagcuucuaauuugaugcacauuuuaauaauaauaauaauaaaggaguucuaugacacacuuaaaauuaaaauaaaaccuuuuaacuagaauaggaaaaaaucaaccucauugcuuaguucugucagccaccuuuguuccaaacauucuucucuuucuccucccuuguaacuccuuccagugguaucuggaaaugacucauuuaagcucuccagaguagauuguguacaucucuucugagcucuguucaaugagaugacauuuauagcuugaaauaagccuuugguaagaauacuuacaccacaaaaaugguuaaugcacgccacugcuccuggcucucaaucuuguuucucuccaagacguaucuuucugccugcaaagaacaugaaacuucaggucucuuuguucugaguuaaaaacugcuuuuccauuucaauuucuaggugagaaguacaaucauuucugcuucuuucucagguacagagggguuaauuuuucucaaccuauaggaagcuccuucugucuccauccaucuuaacggcuuuaucuucaaggaagagugcaggaaauuccccaucggcuaugccaaugaaauggaaaauaaacaguccucuuuagaagaagggcuucuaauucugacuuuggaaugccaugucuucuucccaguguaucuuucuacuucucucugaggcaaaauuucagucuggaaacccucccauuccugcagagaccacagcuucugauuacaagccccaguucaagguuucaucacugaaccagacagaaauaaaagcaaagagagcaagacaccugcccuugccaauucacagacacccugcaaguaaaguggggaaagggacgugaauuuauacaguucaaggucaaauuaucucuuucugccucuggcaccaaagaacuugaguuugguuuuguuugauuuuguuuuuaccugaaacagcaggaaggaagugagugcccucauaaaagaaagaaugugucgcaccaaaaggcucuucaacaacgacagcuccuggaaaccuacccuguucgagccacacuggagugaauucgaacugggcaauggcuccaauagaucucagccagauaagacacaggcacacacaguaacgggagugaugcggaucaauuucuuugucccucucauucuucugcuucuugucaaaaggauacaauaauuaauuccugaggcuuugaaaguggauuaucucauugcuaaaugcuuuccuauagaagcaucagaagacuggaaggaauccauaccaguccccuuauuuugcaggugaaacugagacucauggguuaagugacuugcagaagguuacacacaagcagaaccaggacuagaucucauguuccugaaggccagcucagugcuccucccaggaccccuacccaugcccuuuaauuuacuggcacaaauguuuauggaaaacuuauuuuaugccccacacugcacuugcuggggacauggugaugggugguuagcaaaccagacagacccagccccugccuuccaggaguuugcaguccaguuugguggacgcagucaaguuugggggauguuucccaacaguccccacuuugucugacuccuucaaccacuggagcaucagagcauguaauaacauugcuucugccuguaagucuccauuucugaauaccaugcaguaacugagacguaaguugaagauguaaguugagauguaaaggcuaggugacuugcucaaggucacauaguaacagaaccagggcugcagaaagcaucacuuccagggcuggcuaacugguggucaauuucaacauuuuuauugacaacccugcccugcacauaaugcuauuggcuaauagauaugguggccacauaacuuaucauccaugccaggucacuucugaaagugaauggaggugccaggacaauaggcauagaccaggauuguaccagacaagccaggauaggugguccugcuacuaacagguaacucccuuggcacagugaccaaggccaaaugcagagaggaggcugggugaggaaacucagguucagcagggcuuucucuuagccugggacuucacgcuguugcaaccuguucuuagaacauucaaccucuuggcaguuauuaggaucuugauuugugauccuucacuuuuccaagccagagugacuguggcugugcuacuuaaauagcagaacuugagggcugugaagcuuguaacucccaucucugacuuagcuggcagauugcagauaaauuacagcagaccacuguggucacugccuucuucucacaaagaguguggucccuguguuccucaacucugcagccucucuccagggcacccuauaggggcugcucauccugucuauggucuccuuuguggggcuaggacccucuuuucuccacugcugcuucaguuuuaugaagcuugagaaaccuuggaaagggcuuugaaggagagggacaaacuucucauggaaggaagaggugaucgcuaucccuaugacucuauaauccuaaaugaccuguauguggucugacaaacagacguuuauuuauggagcaaauggaacagaauaauaaaucaagacugucuuagaaaauccagaauauagccuuagacauucugagaagugauggagcagaguaacugagagccugggcuaauucuuaggcucauauccugaguuaguuuuuugaccuuggacaugucuuugaaugucgguauuaccacacauaaaaugggucaauaggaguccccaccucacacggcuguugggaggauuaaaugagacgugcauauuaugcuuucaaaacagccucuuccacagagugggaauuuggugaacguuagcuauuuggaggugggguuucucucacccuggauuucccaauagauuaugggucauuuuucuugauugucuaacgucauuugaagaggauuccacaagaguggaaguguugcauuuucuucuuugacuaaagaaguauuugguuccuuugcagggaucucggaagcuucuggaacucgucagauaccacauugucccauuuacccagguuggccccacuuuuccugcugcuacuuucucucugcuuccaagauagcuaacuuagucuugaauuccaauauuuugacgcuagaaaauguccuuuaucuguagcucugaauaaacccucagccaugaacaaugaguccauuaucagagcgaucuucaaagccacaaaaacucuugagaucaaaacucccuuuacuuauuucacuuugaaaccuauuuuuucuagugaggacuuuaagaacucagggcccugcguguggucccaaauaucucugccuuuuguucucuucuuauugcagcuugaaguggccacucucaucuccaccccucacaucaggagcauggccaaccagcucauacaguucaacaccaccgacaauguaagugaaaacucaaccaccaccagcaucacuugaacacaucuuugcucgauaaugauuauucaucagguuauccugccucuaugcuaacucaugggcuuaaaaucuuuaugauuauuucauucauuugcucacuucucucagcagauaugugcugagcaacuacaugcgugagagucugcacuagaugccgagaauaaaggagugaaaaagauagacuucuaucccagcagggaagacagacuuuaaauaacucacugggcaaugaguuaauuauuuaauuacaaugguaaugaguguccccaagaggaaauucagggggcugugagagcacagaacaggaggagucugagagcaucuucaggccaggagguccucauugaggaggugaugcuuuggccaugcuaugaauaaagugaaauuggacagggaucaguagaaaagaguuccagacaaaaaaaaaaaaaaaaaaaagagagagagcaugugcaaagacccugaggucaggggaacacaauucauuuuuaaaacuccaaagaaggcugcauuauucaucuaacucccugggguugcaauaugaacaaacauccagcagcacaggguugauauagaaucacuguugauggugaugauuaucucauucuuucaacaaauaucuauugaguuccuacugugcaucaggcacuguuguagguccugaagacagaccaaugaacaaacagacaaaagucccugguuguauggaaauuucauucuaguaaauaggggauagaaaauaaguuaaaugcauaaaauauaucaucuauuagacagcagcaagugcuaaggagaaaaacagcaaagcaaggaagggggacagaagguggggauggagcugacaucuuagauaaauacucaagaagcccucauggggaagaaacaucugaacaaaaccugaaccugaaggaauuaggggaacaaacagugugaauauccgggggacauuccagagggaacagcaagggugaaaagcacagagcagaaaggagcaugcugggcugugugaggaacagcaaggccaguguggcuagagcagagagagcaaaagggagaagaguaggaaaggaggcugggcaagagagagaggaggagagugggggucaggucaugcauggccuaagaagucaggguaaggaugcaggcucuuacuuggaaugagaggagaagcaguuggaggauuuugaacugaggaaugacaugaucgggcauacauuuugagaggcuggugaggagauuugauugcaauaaucuggagaauacugaugguaacucagaccagggugguagcagggacauggugaggaauggcugaauuuugaauguaucugguuggugcaaaaguaacugcagucuugcaauuuuuaaaaaauugcaaaaacugugauuauuuuugcaccaaccuaauauucugaaaguagauacagcagaauuugcugaugaguuaaaugggggugaagacagaggaagccaggauaacucauggagcuugacuugagcaaccagaagaaugaagcugucauuaauacugcaggggguggguggcagguuuaugaggaaaguggagaucagaaaucuuugcuaauugguucauuuucugcucccuccacuaaaacauaagcaagaacucaucuauuuguucacagauguauacccagcuccaaaggcagagcauaagugaggucaauaaauguauucaaaugaauggaucccuauuucaccagagagaggucaaagaauuugcgcaaggucucacagcaaguauauugcagagcuugaauaauuauaauuuguacuuagcccugcaccugcaagaaccauuucuacaagggcauccuugccugguguuagucaagaauucacugaacagauucaaucuuucccugucagccaaacccuuauaauagcaaccuacccuccaaugaaaaguuaagugauguugaggacuuuuuagcaaaguugccaccauucagucugccugaggaucacuggcaguccugcaguacagaauaguacagaauuagagaugucauuuuuucuuuccagggacagauucuggcaaaugauguggcaauggaagaaauugagaucacugccaaaaauggccgaauuuacacacugacaggaguucucauuccucccuccauugucccgauucugccccaucgaugugaugaaacaaagagagagaugaaacugguaagaaaacuaggaaaauaaguaagggccccaaacagccccucagagcagagagcaucccacuccucacaauucugagaaaggugucaaagaaaguuggacuuccagaaccuuguccccaaagggcuuccgucuucaugaagaugcagguggaucugaagucccaccucauaaacugugaaccacaguuccuuggggaauuuccgcaaugauagaugcugcccaggaauauuggcuccucagagcugccaugaugaauuaccacaaacugggaggcuugccacaacaguaauuuauucucucacaauucuggaggucagaagucugaaaucaagauagcagagccaugcucccucugaaggcucuagggaagaauguuucuuuccuugccuccuucuggauucugggggcuccaacaauucuuggcauuccguggcuuguagcugcaggggucucacuguguugcccagucuggaaaugacaggugcacaccaccacaccuggcuaauuuuuuuuucuaguuuuuuauuguagagaugggguuucaccaucuugcccaagcuggucucaaacuccuggacuuaagcgauccucucaucucggccucccaaagugcugggauuacaggccugagccacuguguccuacccaccucuccucuuuuuauaaggacaucgaucauuauauuuaaggcccacacuaauucagcagggccucauguuagcuuaacgaauuacaucugcaaagaccuuauuucccaacaagaucacauucugagguuccaggggacacaaguuuuuggaaagauauuauuuacccacuauaccagagcucugggauccaaucaggguuuuccaacccaaccccugggauuuaggaucagucuccugccucuuccuuccccugucccugucaucugggaccacuugcuccaggcucacagcuuuacuguaagagggacuuaaaauagaauuucuucucagguagcugcucuagccuagccaaucaaccgucuuucugcaguacuuuucaaaaaaccaaacuuucuguuucccuaugagcuucuguacccucuagccuuuccuauuuccauagcaacuuuuuggcucagccaguuuuguuuuguuuuguuuuuguuuguuuguuuuguuuuauuuuguuuugagacagagucucgcucuguugcccaggcuggagugcaguggcaggaucucugcucacugcaagcucugccucccggguucaugccauucuccugccucagccucccgaguagcugggacuacaggugcccuccaccacgcccggcuaauuuuuuuguauuuuuaguagagacgggguuucacuguguucaccaggauggucucaaucuccugaccucgugaucugcccgccucggccucccaaaguggugggauuacaggcgugagccaccgccccuggccaguucagccgguuuuaaucaaagcaccugaaauuccaauacugcuguacaugcacuauuucgguucccauggaaaacauaaccccaaguuuuaacaauaauaggucugggucuuucuuuucaggaugcuucaauaauacauuagugauugcucugacaauauccuuggaacaugagcauuaaacaaggaaaaauggucucauuuuauuuauuguuuuguuuuacugauuccucuucuuguuaugaaggcuggaaauagcuggccaagcaccuggcacaggauuguggcugauucuuuuaauucuagauauuuuaauugauguaaugacucugauaugauuuaggccacagaggacggagcugauccucugugccagucagaugccaucuggagaauuugauuccaugcugagaaccccuuuuuuaagagaggcagaaacauggucacuuuccuagccaguccccagcagugauuuauguuugguucauucuguagaaacaaggauugggcaggugcaucaccuguucgauuucagauuauucaaaagcuuauucuccaccucccuaaagaacagaaucaagauguggguuugagcuacaacccaaagaauuuugguuacauaaggaaaagaacuuccuaauagcugccuuagaaugaacucuuccuuuacuaguuucucuagguuuaaagucaaaucuauuugcucuacaugguuuagaaugguuuuugaguggguucaucaaaaguccaaaugcauucucuggaaaguauuuaggacuagcaaagaguagaagcagcugguacccucuggaagucucaguguuuaccaggcugaaucuauagcugccuuuggccauguauguuuggauuuuagagguuuaauaacaacacuguacuaguuauggucucugcaagaaacagaauccaucugagaugauccaaacgaagagauucugaugaaggagcuacugcagagguguggacagggcuaaggaaacgaauaaguuuugcuggagcuuugagggagaagcaggaaaccacugcaacuagggaccaaagagcccagggacaggacauagaguuaccugaacccagugagagcaggaagcguggaagaggugaccuccuucaggagccguagggaugguaccaaagcagagagggagcagggaugaaauccuugaccuuguuguccuccuacccaccaaaauccugcuagugacuggacguuggccaacaccaaucagaagcuggcaagggagcuugagaacauccuucacggucuaccuucuggggcacagagccagauggagaaggucagagaggaucuggagaaauuggaggcacacucccaauuccaucacccugaaccaguagaggagaauccaggagacugaaaggcagagauucaguguucggcuauauugcugcuaagcuaauuggaggacauggccuuaagucuguaaccaaagcuaauacuucaucccuagcacaggucaauaacugcaauguccccucaggggcaggugccucccugcaugcagagaauugaucagaagcugggagcccguggacaggcuggcucugaaagaaguaaaaaagggggcugcucugagcaggcucaguuuucucuccuaaacuccucccaccagcccccacccccagcgcugacuucacuccuucucccacgguggagucgguguggggaggggguggguagagaggccaggaucauggcucagugggguuuccuucacagggagggaagcaugaaaccagccacaggaccaucgccacugcucccucucauagggacaccugcacugaccuccugucucucccuccagggcacuugugugagcuguucucugguguacuggagcagauguccugcuaacucugagcccacagugagugugacagcuucaugaaagcacagaucacccaagcagccccacuggugugguuucucaaccuaucuaccuuccuucuuuagaagauauuaauugcagcugggguaauauaagaugggcucguagccuacuauaugggggaugguagaaagcgaucccacagaccuguguuugaauccuuguucauugacccuagagaagucguuuaacccuuuuacuguuucuucaucuguaaaugauaauaacaaaaagauucacauagauaaaaauugaagcacaauaucuaaaucaagaaggcacucaguucccaucuacuuuuucccuuuugggacuguaauauuauagauguccacuuuugggugguacuggcauauugugcagaacugucuguaaacaaguccuaauauuuguucuucccaagcacucuucugcagagacauacaagaaaauaauacugggacuaucaaaagcuuccaaguuuaauugaauucuguacacauuuauugaggauugagcauauaucagacauagugcuugcuuccagaggcaugaggaugaauaagaaaucauuucauuuugcuuuuaucugagaagcuccaucuaaaaaggaaaacaguugugcaaugaucuaucauucauaugccaaggacucuauuggugguaaaaagcaaaguguucuaaggcaaaaaugaugauagaaauuuuugccuauaaguuuaucauaagaaagaacuuaccaaugagaaguggcauuaaacacuagaauagaucauuagguaagguuaugagcucuuuaaugugauucuauugugaaguauuuaguaaagcaaaacauuaaaauuaaauagaugcagguguucagauauuuauuuugcuuaacaaaggcauuaccccugaguccuucaggaugcugucaagcagggaaugugagagggaggagaagaggaaauuguguuggcuggugucacagugauugcugugugccagacauuguucuaaaugcuuuaugcagcagccccacgagguggguauauuaucaccauaaccaauguaugauuagggcacuaaggcaaggaaacguaaaccaccuuguacaaggucacacagcugauguggcagaaccaugauuuguucuacauguuuaaucaccauucuaugauugucucagcccagggaaagagaaggaagagggaaaagaaagggaaauuagacacauggguaggagccaaaagaagcccucaaaucacccaucccgggaauccugugacccacaccugguuaauuauccugagauucccaaaaggacuguagugcuccuuccucagugaccucagaauuccuucauauagcuaauauuuuaggauuuuauagccuaggaaagucucauugcccucuucuugagcaacagccuaagaugaagggauaagcuugacaucaacaauuaucuaaaacaaaauuugaaccagagacuaaauucucgugacaaaacuugaaaucagcauuauugucucaucaauauuuucuugauauuuuauaaauuaggcagcugaggcccacagaggcuacaugacugugauccuaaagucuguacgugauaagacccauucucuagaccuuauacuuacuaucaguguuucuuggaaaaaaugauuuaaccugucugggccuguuuccuuaucuauaaaaaauggcaugagaaacauccacauagaauugaagauugaugaacucaucugugcaaugugucuggcccauaaaauguucucaguaaacaugaguucuagauaauuaugagugggcauuguugguuagaauggaaggaugcauauaaaucugccccacuccuaagagaaaaacucagacuaucacaauuuuguuuggcaaaccuuucaaugaaguguagauagacccuuugggggcuccaaaaugucucuguaggagaucuuagggauggcuauagaucggaaggggagacuagaccguauccagaaugaacagaaaauauuuucugcuuagagacaucugcuguggcauggaagagggaauaaagaucugugggccauggaugaugcaaacucuggccuguauuccaccaacaagggaacaggccuaaaaaaggguguccaagcucugauguagacccaggucugcuagugugguccagcacucucuccugacgucaguggugaaauggaaguacaauggcaagugucugcagagggugugcagugccuggaggaccuaaacaugcugacugccaugcuuucccuccuuggcuuucuccaggcacucuucacacacagaugugucuacaguggcagguuugggagccugaagagcggcugugcccgguacugcaaugccacugugaaggugaggagcgcguggccgaggcccagucuaggccaguagggccaggcagcuccagggccaugcucuuggguccuaggguccacguggucacagguggcccgugcuugcuguugucuuccugcagaggaaucaaagguagauucuucauaugguggccagacucuguccuuuccugcaucacagccucccaugguucccuacccucuuaacacagaucacacucuuaacacuuccccacauggcccacccucugccuguggcucugaccugccugucacccccauuccuaccucagagcaugcacacuugccauucccucccucugaaugcucuuccagauuucccugaggcuaacucaucuucagugucuccauuaaccagcacugucaccaccaaucugcaguggccucccuaguacccaccugacuucuggcccuaccugccaccacuggaugauaauacuuuguuuucccagcacucaccguucucugaaaugaucuuguuuuacuguuuuuaaaauucauacauugacucuuccccaacuuagaacguuggcuccacaagcaugagccuuccucugucuguucgcacaguguuagagccaguccagcacccaggggaggggcucaguagaguuguggugaccagaugacugagcacuagccaugccaucaacugccaaagaaaagggcaaccucauaaggagaggcgaauauggcuuaguauaauaauggaaauuaaaaugcauccccuuugaggaauuggugcucuacuuggggguucaaaggggaacacgcauuuuguuuuucagauuccaaagugcugcaaaggcuucuauggaccugacugcaaccaguguccaggaggcuucucaaauccaugcucaggaaauggacaggugaauacugaagacuggccuuccauaagucaaaucaaacaauaauuuuuagaacuucuaaaccaaaaugugauauaaugccagcuacucuucccaggaagcaaaagaaaugaccccuuacuaaaagaacagcaggugucugcaguagaaggaucugggucugggaugggggaugggagagagagauuccgguaauguugccucuagucugcuucucuauugcgggcugcaggacguuggguaacucaagaaggaucucugggccucacguuccuccugugggagauaucaggguugaccugcauugaucuucaagacuccuuccagaacuaagauuuuaugauaguuaaaaaauagcucugccuccugauugcuuuuuugaaccuaugagcaaaaccuagugaaauguaacagccgaaacuuaacucaucuagcuuggaggcaaaaguagcugugguucauacagggaaauuauacaucugugcauuuaauaagcccgccucuaaaacguggcuuuuucaaggggaaaguaucagccaugaguggggacaccauguggacaaggagaauagggagaggccaguacaaaugacugcggccagggguuagaaagggcccacacccaacacugaugucaaucagcacacauaugaccuugccagggcuagagaggugggaggcaaauauguuuaccacugaagagagaaaacacugcaguuuggagucacagagcugagcaggugagacuguaaagggaggcuagucacucauucuggaggccccugucuuaucacuuaucccuuaagcauuguugaaagguucccaguucagcauugugaugcccccuugagugacuucccuuaaaguucuaaauccuggcuugggauucccaagcucggcacugcuuuagcagccucccugauaucacaugacuccacuuuccacgaggagucccagagggucaugucaagugggauuuaaucugaauucaaagaagucaggccaugaaaugaaaacaccugagaacuauguguccuaauggcccaugggcccugccuuugcucccagugugcagauagccucggcggcaacgggacaugcauuugugaggagggcuuccaaggcucccagugucaguucugcucugaucccaauaaauacggaccucgguguaacaaaaguaaguggcacuuccagagcuuccuuccacuccuaagcaagguucccucucgugcugcagcagggugcuggugcagggcuggugucucaggaccccuuugcuuggguuacaccaucaucacagagcauucauuaagcuuugguucucaaacuggagcgugugucagagggcugaucccugagccccaccugcagaguuucugauucacuaggccccaaugggucuucagaauuugcauuucuaacaaguuccgagggggcacuaacacugcuggucugggaagcacacuuugaagaccacucuccaaaaguuucuccacauucuugaagugauagugggcucuauaucaggaaacagauucaggccagacacaguggcucacaccuguaaucccagcacuuugggaggcugagguggguggaucacuugaggucaggaguuugagaccagccugaccaacauagcaaaaccccaucucuacuaaaaauacaaaaauuagcagggugugguggcaggugccuguaaucccagcuacucuggaggcugagguaggagaaugguugaacucaggaggcagagguugcaguaagcugagauugagccacugcacuccagccugggugacagugagauuccaucugaaaaaaaaaagaaucagauucacucccuaccuuucaggcagaccucuuccaucagcuccuuuauuugcaaggccuguggccuugggcaaguuacucuacuucucuaggccucaguuucuucaucuguaaaauggggaugaugaaaauagcaagugucuuuuaaaguuaguacaacuuauaaauggaaaccgcuugccuuagaaccaugccuaguacaaaacaugugccacaaauauuauuaucucacuauuuuuaucuauuguuguugcuguuagucuaaguacagugacauaaauaucaagaagcuuguagaacauguagaaaguuccaccacaauaggcauugaaaaaaauaaaguuaugcaaccucagaaaaugcauucccucauucuguucuuuaaaaugacauccuguauauauuuaaauaagcauauguauauuuuugacauauauuucuaagcuaacagcucguuguggagucagaccauccugaaguccccacacuccagccuaccaaccgucugaucucagaaaacggcuauuucuucaccuauaaaaugaagauaauagugguaccuacauuauaguuugcugacaggauuaaauuagaccauaauuucgggcuuuuggcacagagcuugcacugagcaagucaucaauaagcaaagccgcuccucuuacugucgcuacuaacuccacacauuuccuaugaaacacacaacccuuccgcucuccuaccuuauuugaucuucacaaauaacucucaggauggaugggaaagcagagcacaucagggucgaggcuacugaacccuuuccaauguucuuuuugccaaauuagauuuucauauuagaggaagaaaaaaaucaggguuuaucccaaggccugacaauguuggcauuugucugaggccagccgggcaggacaccaaggcugggauggggcgguggccuuccagcugucacaccucucaauccagggcuacggcugugcacagucucauacaggggucucguaccuugcaaauuaaaugcugacuucccuaaaauuguauaacaauucuuuuuugcuuuaagucuggcugugauuuuccaggcccgcucacuuguguuguucucuuuccuggaugauggcuccaagcacccacacgaauuccucucccaugagucccuucuggggugaaacuccagauuccuuuauuucugaucauuuuccaagcccccccaguccuugccaggugccuuugaaaaucuccauguccuucuuuccacuuucacaugcauaggaaccugagucugaugagguggcccguguuacaauuuuuaaauaccuacaauugaaagcaaauucagcagcuaagguuuaaaaugauaacggugauauggaaaugccaguucauauaaugaucuacgguguuuacacagucacgaacggaaauggacuuugaauccugguuuaaguuucugccugggaauuuagcagcaaguugggcaacuugcuuccucucucugggccucagcuuccucaucugaaaaaugggggauauaaaaguaccuaccuucugggccuggugacuauuaaugagauggugcauguggaaggcugaccuagugccuugaaugaagucagugcccaaauaucgccuauugguuaucauugguuugaugugauagagugaaaaacaaacauauuagcuacuuaucaggaguccugccagcaugggagaucacuucuauuuauuccagaauaucuucaugaaaggugagaaauuuccaggcuaaacucuccaaccaggaaguaguugaaaauggaguuccuuggccucuuucaaagcgucacauccucuuccccacaccccacacacauauagauaaaaaggaguucuuuuuucuuuuuuuuuuuauuuguuuuguuuuugagacagggucucacucuguugaccaggcuggaguacagaggugcagucauagcucacuauagcuucaaccuccugggcucaagugauccucccaccucucggccucugcaguaacugggaccacaagcacacaccaucaugcccggcuaauuuuuguguuuuuuguagagacaggguuucaccauguugcccaggcuugucucaaacuccugggcucaagcaauccucccacgucagcuucccggugugcugggauuacaggcaugagccaccaugcucagccuuaaaggaguucugagaccaaguucuuccccuccugggugggacaagcaagcucuccagggcugucccaggcacucugagaacacuugagacuccaagaaauagcagccuaagucuucucccggcucagccccgauucugcuuugacaagagugaguggggggugagaagagguggucccuguccuccagggugcucugccucagugcuuggcuuguccccaaggccuggacggaugucccuccuccuccucuuucagaaugccugugcguucacggaacaugcaauaacaggauagacagcgauggggccugccucacuggcacaugcagagacggcucugccgggagacucugugauaagcagaccucagccugugggcccuacgugcaguucugucacauccacgccaccugugaauacagcaaugggacagccagguaggucugugagggaauggcccuuaaugacgcugagucauuaaguguaaggggauggcacuuaaugacgcuguguuaccuguagacggagccaacccauaucugaacucugaacugaggccuguuaucuccagcugacagugugguguuugugaaaagaaccucagucugagcuggguuucaauugcagcacucccugcuuugaaacuuaccaggugugugacugugggcaaguuacuuaaccucucugaaccucacuuuccucaacaguacagugaggaugaugauaccuaccaagcagggcaguuguggagauuagcagaacucaaugcagaaucaccuagcaccggggcuagcacaucaaagauguuccauuauggaaaagauaauuauuaucaccacauaugaaagaaaugaagauuuguccaccaacuuucuaaccuuugaagacaccuuuacuuuuuaaggcuguuaauaauugcuccccuguuaaaggcaucuugcaggaaauugggucuuuaaucaguagguugccauuuguuuccuuaauacugucuagcauucugcaguggguuugagggggaaaaugccagaggaaauuuaccucucuggaaauaccuagcuccaaggcaguaaccaccuaaauuauccugggaaaugcagaggaugucuggaauucuugguccucuccuugcacugcuuuucuuaauuuuuguuuacauaguuauuuguuuuggucugccucucccacuagacuauaggcuauaugagacaagagacugucucuuuuccacaguuguacaauagaaaugccuuuuccuaaggaguuaggaucuauaucggugcauaaggcaaaacuacauguaaucaacauuaccgcugaaaccuaugaaaucauccacagaggacugucggcaugggucuguaugaacuauauugucuuagguaaaucaaacauuauuggaacagaucaaccuauuucuucauuuggacacuagauaauguauuuuguuccuguaggaagcuugauacaugaaauauauauuuuuuuaauuuuuguaaggcauguaugacugaauuugcaguaagaccuggggguacaauguccccagcaucuaucauaggccacucaacaaauauugguugaauagaugaaugaaugggccaccuuuaauaguaaaagugucaucacggaacauuuugagaggagcgucuggaaagguaaugggucaagaaaccaagucagcucacagaagaggcacuugaaaaugugguguugggggaaaaaaccucugaggggccagagaaugggagaggauaagucucaccugauugucauuuucaaauauuuuaagagcuguugcauagaagacagaguagaacucuucuuugcugaaccagagguaauaauuaguauugagcaggaagaguuauaaaaaggcagguucugguaaaauaagagcagagacacugucagguguugagauuuaugaucugcaagcgcucugcuaaacgcucagugugcauuugcucauuuaaccuucagccuuauaugggagguauuaggcccauuuuccucaugagaaauaagaucucucaguuguuaagggacucgugcagugucacacaacugcuaagaagugggcaggcuucauuuccacccagguguaucugauuacagaucccagaaguaccccgaccacauuugagcgcuggcuuccuccacaggagcaaaggauggagccauuuggccaggaacuggcucaucucuagcuggcuggcucucuucugggucguuggugcuuauucuggggcugauauugcacacucuccuuugcaguuguauuugcaaagcaggauaugaaggagauggaacucuguguucugagauggacccuugcacaggacuaacuccaggaggcuguagccgcaaugugaguacuggucuucauuuccacccugccugguuucuuuuuuuuuuuuuuuuuuuuugagacagagucucgcucugucgcccaggcuggagugcaauggcacaaucuuggcucacugcaacauccgccucccggauucaagcgauucuccugccucagccucccgaguagcugggauuacaggcacgugccaccaccccggcuaauuuuuguauuuuuaguagacaggguuucaccauguuggucaggcuggucugaaacuccugaccucgugaucugcccaccuuggccucccaaagugcuaggacuacaggccuaagccaccgcgcccagcccugccugguuucuuguuggcuuuuuucaguugauuguuuggguuuuuuuaggaaauccugaggaaagacauuccauaggucaaugucugaucacuuuucauaugcaugaagcauuuguguuuaaaccuugaauuuuuauuuuaacacagggucucacucuguuacccaggcuggagcacaguggugaaaucauagcucacugcagccucaaacuccugggcucaagugaucauuuuacuugauuaggaaacugggaucuaggggagucaagugaccaaguucuguuguugguagggguguauccagaaccuaccauugcuuucacuaauucccuucaaugaucgccauccccaccugacccuagucaccuucauuccuuaccuaugguuuaguaacugguuucuuugcuuccucuuaucuacccacagugcauuguccacucacagccagaguggcuugaagugaaucagaucauguuuuucagguuuaagccccuucaguaauuuccucuggcucugaggauaaaaucuagaugaaaccaccugaccccagccuacagauuccuuugauucccuuugagugagccccaucccaaccccaucccccucagccucagcuccguaucuuguaucccucucuccuucucauucuguccuccagccuccuggugaggcuccuccugagaggcccgggagcuaguauaguggaguuuggguugccacauuauacaggcccggguucaugucuuuuuauagcugcaugaccuugggcaacaccuguuuccuuagcuguaaaauagagauaauaacaauacuuuccucaagaugaugguuuacaccugcaaaacaauauaaacagucccuggcuuaauaacuaacacagugaugucaguggccaugagcuggccaguuccaagcaauuuuguucuuuaaaugaccuaaucuuuucaugaaucucaauguaaauuaagcauuuccaccucacucaaugcaaaucuguguuucuggaacauaugucuggaaauucucucuuauuuuuggaaucauguggcuggacugaggauucagaggcuuugcuuuuucuuuuccuccugcaggcagaaugcaucaaaacuggcacgggcacccacaccugcgugugucagcaggguuggacagggaaugggagagacugcucggagaucaacaacugccugcugcccagugcaggcggcugccacgacaacgcauccuguuuguaugugggucccgggcagguagguuggaugucaugagagcaaagagaaagcaggaauccugcagugacuuugcuuuccccucaggacacagaaguacuuuggcuagaacuuacugcagcuuuuuucagucauucguggcagugaacauggguucauugccacaacaaaccuaugauguauuauuaucccaucuuauagaaaaggaaauugaggcaaugagaagcuauuugcauaaaucacauagaaaauaaauaauagugcaagauuugcauccagucugacuccagggccgcccucuuagucaccacccuggaucaaccuuauauuucuauagcucugcaguguauugaucacuuucacucacugucauuuaauggaggacaacgcagagaaggcuacugcuuaaaaauuaaggagcuccaggggagggacuaccaacuacacuaggauuguggcaauggaaaaagagacaacugauaaggcucccuucccccauccauccccaccugcuuccaccucuuuccacagguaggaccaacagguguguuuauaauacaaggcuaaggaggucagaacacacggaagaugggaaccaggauuuuaaaucaacccccuuaucuuuugaaucuugauacaguuucucacuuuuauguuuuaggcugaacuuuuuuaaagaccuacaaauuauuuucugcucuuugagaaauauauuucuucccaugaugauggcucuguuugaggaaagccuaaccuugcucaccaugauaucucccacuugaccccgagccuuuugguucucagaccucucauuucugugcacaaguuaauaaucggagaaagccagagcuuguaguggaacuugaugagauauuaaagcccaccuccuaccuucccuuuccuucauggaggaauuuacccagacaaauggagaucugcccuauuuuauuuuuugagauggagucucgcucugucgcccaggcuggagugcaguggcacgaucucggcucacugcaagcucugccuucuggguucaugccauucuccugccucagccucccgaguagcugggacuacaggcacccaccaccacgccuggcuaauuuuguuuuuguauuuuuaguagagacaggguuuuuccauguuggucaggcuggucucaaacucccgaucucaggugauccaccugccucggccucccaaagugcugggauuacagguguaagccaccaugcccagccaaucuuccuuauuuaaaaauauccaagaaguuuuuagggccucccucuguggcuuuaggcaucauucccacucacuccuccauucugcuaggaaugagugauggaacaucgguccugcgggccagugcagggcuggacacuugugcagagacagucagaaguguuggagcuccucugggagcucauaacuaccaaaguuagugaucuguacagaacucuuuccaaagagacccccacaggggguuaaaagguggucaacaugggccgggcacuguggcuuacaccuguaaucccagcacuuugggaggccaaggcaggaggaucaccugagauugggaguucgagcccagccugaccaacauggagaaaccccaugucuacuaaaaauuagucgggcauuguggugcaugccuguaaucccagcuacucgggaggcugaggcaggagaaucgcuugaaccugggagguggagguugcggugaacugagaucgugccauugcauuccagccugggcaacaagagcaaaacucuguaucaaaaaagaaaaaaaaaaggggggucaacaugauuaggagcaaggguuaaaaaguggaacugcuuagcuaacagcauggcaugcucucacccuagcccaccucccacucuugaaaacuggugggagauagaagcacacuacacccaggcaaauccucaacguugacaugucuauuuacagcuaggguaaacuauuucaauagaccacagaaggugcuucucggggagugacaguuggcaaugggacagggauagaaaaucugugucagggagaaaucuuucaguuauaacagaaaacucaauuacuuguggaaguguaaaaugguacagcugcuauggaaaacagcacagcaauucccccaaaaaauuaaaaauggaauaagcauaugcucuagcaguuccacuucuggguauacacccaaaagaaucaaaagugggacucaagcagauauuuaagcacccguauucauagcagcauuauucauaguagucaaaagaugaacacaacccaauggccauuggcagauuaauggauaaucaaaacgugguauauguauacaauggaauagcaaucagccuuaaaaaggaagaaaaugcugacacaugcugcaacaugggugaaccuugaagcuguguugcuaagugaaauaagccagagacagaaggacaaauacugugugauuccacugcucugagguuccuagaauagucagguucauagagacagaaaggagaaugguggcugccgggagcuagaguagggagaggaacgaggaguuauuguguaacgggucuggaguuucagucugggaagaugaaaacaaguuuggagaaggaugguaaugaugguuguacacgaaugugaauguauuuaaugccccuuaacuauacauuuuuaaaugguuaaaaugauacauuuucucauacauauauuuacuucaauucuuaagaagaaaaaaaaacugguuuaaaaagaaaagagaauguuuuggcccacaugacucuaaaggccauauauggaucuagcugcugguacaacaugauucagggcucagaaggcagcauaaagggucuguuucuuggcucagcuucuucccagguuccuggggugagggaugaccuccggccacuuccaauuuauaccauugcaacucuuaagcagaauggaguacauuaucugguaacuuccuccaaaaagccaggauucauucuuucauugacucagauugagugcauccacacccauccucauuuccuaccacucccaucagcccuugugcacaauuacagaaaucaggcuggggaggcccaggguggaagaugcagugauaagcacaggccaaggcccugcaccucacccugggguggaggaaucagccacauuuuaucauguggacuaggagagggggagugaugguguccccagagccaaauggcguguaguuuccagaaagugagagaacagaugcuagccagacaaaaugaaacagauguucccuuaucuauucauuugcucauucauccaacacuucucaagugccuacacccacucagccacuaagcucaguggugaggauaagagauuaccguggccagggcccucagccagacuugaagaaaugcgaucuugugcgaggcgacagacaaaccuauguauaacgcuaaagugauaaauguuguaaaagccacauaggguaagucccauggucugguuguuccacagcgucugagggcugcuuuccuauuuaucuuuuugauuucucugacagcagagccugcucaugggucuggagaaaauuagcuuuaaaauguggcuccaggagucuuaauugugaaaaagcucacugcagucuuaugucuugccaagcacucaguaaauaauugcauucauuuuugacgcacuugaguuggcagauugcacuugagaaaaggaaaaaaaaaaugacuuggugucuguauuagcuuucuggggcugccauacaaagugccacaaacuagguggcauagaacaacaaaaauguauuguuucacaguuguagaggcuggaggucugagaucaaggugucaucaggguuguuuccaucugagagcugugaagaagcuguuccaugccucucuccuaauuucaggugcuuugcugaaaauccuugguguuucuuggcuuguggacacaucacccugaucucugccuucacguucagauguuguucucccuguggguguaucugucuccaaauuccccccuacuuuuuuuuuuuuuuuuuuuuuuuuuuugagacagagucucgcucuguugccaggcuggagugcaauggugcgaucucggcucacuacaaccuccaccucccggguucaagcgauucuccugccucagccucccaaguagcugggacuacaggugugugccaccacacccagcuaauuuuuguauuuuuaguagagacgggguuucucugcauuggcaggauggucucgaugucuucaccucaugaucugcucgccuuggccucccaaagcccccuuuuuauuaauauaaggauacuggucuuacuggauucaaggcccacccuacuccaguaugaccucaucuuaacuaauuauaucguaucaacccuauuuccaaauaagguugcauucugagguacuggaggucaggacuucaacaaaugaauuugggaauaaggggacgcaguucaaccuauuacaguaucugucuccucuuacaguaucugucuccucucugcucuguccuccuuucuguagacaaacuugaaaaacauccugaugggaagaugggaagaugggaaaagaggggggucucuuugugguguucuauaagaaacagaauggaucaaaaacccaggauucauucucuuucauugacucagauugaguguguccacauccauccucguuuucugaugcucccaucagcccuugugcacaauuacagaaaucaggccaggggaggaucgagacugcccuccugucuaggauugcccucagcugggacuaguuggcuuggaaacuuuuagacuuuccaaauggacacaaaccuuaauuacgaggaaugcugcuuuaaaaagacaaaccgugcuggagccaaauguuucuaaauugaacaaagugccuuacaggcuagcaauggccucaugcaugcaucuccaccaaguggauaccccacagcuugcuuaaccuuucucauuagguagaagggccauccaauaugaugcuuuuuagggcccaaguucucucugagacuaucuccauaggacccucuggaguaaagaauucaggaagaggcugggcgugguggcucaugccuguaauccuagcacuuugggaggccgaggcaggcguaucacaaggucaggaguuugagaccagccugaccaacauggugaaaccccgucuguacuaaaaauacaaaaauuagccaggcgugguggcacgugccuguaaucccaacuacucaggaggcugaggcaggagaaucgcuugaaccugggaggcagaaguugcagugagccaagaucaugcuauugcacuccauccugggcgacagagugagacuccaucucaaaaaaagauaaauaaauauauaaauaaauucaggaagagaguaccaagaaacuaucauauuggaaaauguaauguagaauauggagacuaauaacucuagaaucugaaguguaucaagcaaaaggcauuaacacuguucucugggacagccaagcagcuucaguuuccauaguacguuucucagugcugugugagggaaagacauggaaggcacuugcuuucaauaauccacuugacucuguucuuaaaauuauagaaugagugugagugcaagaaaggauuucgaggaaaugggauugacugugaaccaauaacuucaugcuuggaacaaaccgggaaaugucauccauuggugaguuauuuaaccuuguuuuucauuacuuaaaaaaaaaaaaaaaacaaugcuugagaaagaaagauuauuuccugucuggccuagugaugaacaaaaucucuuacccccaaaagggaaucucuaagcagaaugcgaguaguuauugcaacuucuacuucauuccaaagcuuggaagaaccaacauaugacuuccagguaaaauacagaaguucugguuaaauuuaauuuugaaguaaguaacaaacaaucuuuaagcacaaguaagucccaaauauggugugggauaaacuuauaauuacucauuuuucaccuaaaauugaaauuuaacaagucauucaauauuuuuauuugcuaaaccuggcaccucuaaaccaacaguuuaaaggauaguuuaagagguaaccggacuuccauuucgaaugucacaacagaguuuuacaaguuaucggugaaaaugcccauucaaggguaaauggugccuugcuucucaacuuugaaagaucaggcacagguauuagggcugggggugguuaugcuuucaaaagaacgcuaagcaccaaacauaggaaucaaugaagucugaugccuuaaucacaguguuuggaguuccagguaacagaguccaugcagaagauaaauuugcugggaggacccccaggguagcucugggaaucuagaggcaggaaguauagcuagacuucccaagagcccagaaccaggacaugaagagagcaggaucaccagaaucuaagcaguuucuuuccccaguccucugagacaaugugaccucucguuugacuucccucugugcauuuucuuucucucugccucugucucauuccccgaacuuguagugcuucuguguacaucuugagguaaacgguucccccaccaucagugaugcccucuaauuuauuagcaccccauguccccguucaaaaucauagaggaaaggaucuaacuggcccaacugggugcaggugucuacauaugaguccgucaauuguggccaagaagugggguuguuaugaacauagcugccagggcccaccccuaguacaugugcaggguggggcgugggggacuaauucucugauagaagaaaaaugaggagggagaugcccccaaggugucuguuacucaagaaucucaagaacauuuugcaaagcugaaggagcucucacacuucugcuugauuuaagcccaaccaagcccugacauuccagaugugaguagcuauugcaaguuucauuccauugcaaagcuuggaagaaccaacauaugauugccagauaaaaugcaggauacccaauugaaugugaauuucagaugcacaaguauguguugaaaaaucuuucagcacaaguaugccccaaauauugcaugggcaaacguauacucaaacuuacucauuuaucugaaacucucauuuaacugugcauccuguauuuuuuuauuugcuaaaucuggcagggaugagaauaaauaaucgugauuaauagcugcaucaaacaugcagacaggagacuuucacugcaacacuaaagggucuauggguuacuucuaccaucuuucagccccaaauuugcaguuaucaccuuagauggagccugucgucucauagauguaacucaggucuaacguuuuuguugggguaaccauuucuuucaucuugguuuucucaggcaagcugucaaucuacuucgucuggugucuggagcuguguuugucaagagggcuaugaaggagauggcuuucugugcuauggaaacgcagcagugguaagucaucgaugaugaacucaauaauauagacaaaacccuuuaaaaaccucuuagcuaagaugccuuuaaagugaucuauugacauaucuuuugcugcaggagauuuuacaugaagcaagcuguuucucacagaugacauacaugcucugugggucacguuuucuacaggcugaaggcagcuggcuuuuuggcagcuucuguguaccaagcaguccuuacuucucuuucuugauacucuaccuguuuccauucucagacuuccuaaagagcaacuaacuggccucugcuggguucacugggcucuccugucugggcuacccuuugcuuacccaugcugugugugugugugugugugugugugugugugcgcgugcgugugugugugcgugcgcgcauguguguguguguguacacacuucuuuaugccaggcgucuugcucaguccuuaccaggcaguagcacuccaucuaaaucucaacaaccuucugcuacuauuaugcccauuuuacaggcagguaaacugagaggcuuagcaaaacuugcccaacacccuucagcuccagagugaggaauccagcugauagcucugauagcugucaagugcagagcccaaauauuuaaccaccaguguagaacauucuaucuguacagcaugggccacacuaaaucagcauugcuccuacauuuuucuauuuugaccauaaacuuuuuuuuaauuuauugagguaaaauauacauauauaauuuaccaucuuuaccauuucuauguauauaguucagcaguaauaaauacauuuauauucuuuauuuucuuuucauccccucccuccccuucccuuccuggucucugguagccacgaauccacucucugucuucaugagauccauguuuuuagcucuugcauaucagugagaacuugugauauuugucccucuacaaccauaaacucuugaaagaugaucuuugucuuguuuccuacgucaguccuauugcuuauaaauauuugucaaaaugagaaagucaauugacaaauuuccucaucacuuacuuuuuauucaacucccugcuguugaguuccugccccuccucucugcugaaaucacgagccuaacaauucccaggacccgcagccugcacuaagagucucgcccuaagaaccuugcccuuggggggcccuuuccacccuuccccucucacugucaacugugccuucuacucaccgagucaggccaaggagcugucuccugacaugcagaccauggcacauaaaucacaacauuuucucugcacuagcuacagacccugguuuccuaaaauucuaaaauccugcuuucacgacgucccucuccucccacgaaaagcaaaauuaaguccucagcuuggcucuccagguaucuccacacagacuucacucuuguuuuuggucuuuuucuugagacaagaucucacucuguugcccaggcugagguacaguggcaugauuauggcucacugcagccuugaccuccccagguucaggugauccuccugucucagccucccaaguagcugggacuacaagaaugugucaccacacucagcuaauuuuuguauuuuuuauagagacagggucucgccaugugagauaccucaaacuccaagugauucacauaccucggccucugaaagugcugggauggcaggccugagccaccaugcccagcccacuuguuuuucuucuaaacagcuuuccgcugcaguuuagccgccaccuccccagcuccaggucugccauguuccucucucuccuccccaacucuggccuucccaccagcagaucaggugcaccucagcccuccucucccuuaaaauguccccucuaagggauuacucaggcaucucugcucuuguguuuauucacuuucuugcuaacuuacuuuuuuaacaugugcuuauugacuugcuuaauaaccucaacuacuagauggaauugagucagcacugagacuuauuguauucauguaaauuugcauaggaucaugauauugccauuuuucugguauucaguaguuuaaaaaauauuuucacauauauuaaugcacuuaauuuucauaaucccuggagcaagguuucaccauauucauuuucagauaaagcacuugaguucucagagguuaagugacuugcccaagaucacacagcugguaaauggcagauccaagaagugaacccagucuuuuuuaauaacucuguguuuagagacauuaaaaaaaaaaaacuauaacgccuucaaaugucacugcucugccagcaauauugguuaucuuuucaaggccgaacuuccccuaaacaacuguaagucauagaggagccagggccaucuuuucccuucaauaucuuacauccucuuucauaucuuauagcuucccuucaccccaccccaguaccaacugggguggcucuauauauagagagagccauauggguaaauuaaagauaauaggggcuaaaacuuacugaaauuacugcaugccagccucuaaucacuuuaaaaacaacuccuauuucucuuaucaaacugugaguuggagcuuuuauuaugcccauuuuacagauaagaaaauugagguccuuuagguaacuggccuagggaacuaggaaauggcagaaccaacaugaaaacccaugugguuugcuuccauuguucugagccacuacucaccaacggcucugaaagggggcuauuugcugagcucugugacccccacuuagcgucuagguagccgcguucuuacagccuaaauucugauuuggaagaaccuugaguuguugcuucauucgaaguuccuggaauuacuuccauagagaauaaccaagccaccuuagugugaaagaaaugugcgguucugucagcauggaaaugcagcuagcuggagcacgcauucacaucagcaucagggaggcaggccaggacaacgagccuagccccaggaaggcugagugcaggugacccagagaugcacugugauugcacuucucauuguucuuucucuguguucucucccaucucuucuucccucccuugcaugauaugaauaaggaauugucauuucucuccgaagcagcuauauuuaaccgauggauaaaugugaguaccuuuauugggacuuaggauugggaauguauauauuuuagaaacuuggaaugcauacaauagaaaaccgaaaaugcagcugguaaggaguguaggcaauugugcugagcaguguuucucaacgcuggcugcacuguggaaccacauggaacacauuuuuaaaaaauauuccugcauaggucccaccccugaagacucugaugugauugaucagagguuugcucugagcaucagugugucggggccagaaagggggcuucauucaucacaggauucuuuuuuguaaguuaacaugacucaucauuguaauucaccaaguucgauuugggauuuauagcugcaaucugacauacuucauaugugcuuaacucucagcucaacaagagcugccaagcccagccagccauugcaacaaaugguuuauccccuuaaaauagacacaugccaaauaguccaugccuggucagcacccaccccaggacagcuuccuguugcuucuguauggggccucucugaaccccccaucccagcauaggugaaagaagagacugagcgugcucucuugagcaugcugacuuucaucuagacucuucauucuuggucucaccccacaggcaugagcuggcccaguggugugcugaacccuguucacacucacucacgaaagcugauugugcacauuuuuccuaacuccacuuucgguacagucauuuugguaucuugaaaucagcccuggugggaguauuuacgccauagaaaucaguaaauacuacaaaccaagucuuuugguuuuuuuuuuucuuuuuccuggagauccaguuguuaaacaugccacugcuucuaccaaaaacuggcucucuaggcaagaaugaaauuuauguaagguuuuauuucagcccucuacuuucucccaugcugaaacuguuccugcagucuccccaccauccuuacuucaaagacguccaagaauacucaagguggcugggcgcaguggcucaugccuguaaucccagcacuuugggaggcugagguggguggaucaggugagguuaggcguucaagacuagccuggccaacaucgugaaaccccgucucugcuacaaguacaaaaauuagccaggcaugguggugugugccuguaauuccagcuacucaggaggcagagacagaagaauugcuugaaccugggaggcggagguugcagugagcugagaucacaccacugcacuccagcuugggugacagagugagacuccaucucaaaaaaaaaaagaaaaaaaaaaaugaaugcucaagguucucugcacacacacauacucacaagaaccuauuaaggcuauuucuuggcucuucauuuagacuaaaguguaaaggacuuauaaugacugaaagugugaucucauuaucaaaggcagauuugcuuugauaagacucauacauugaauuaagugagucucacaagggaaaaugaggcaacagccagugggugggguggauuugggaaaggagacccuaggacccuuccaguaucuuaugggaaauugucaucucuuccaagcauuuaaggcagcucuguuuguccccuaacauaagcaggucacuuuauuuuccuucugugguucagaaugcuucucuacaacccacacugucagccaccucaaaccucacuguccucgugccuucccaacaagcuacugaggacauggaccaggaugagaaaagcuucugguugucacagagcaauauuccagcccuaauaaaguagguguuacuuauuuuauuuuacaucguaucugaauggcaucuguguaaacaugucuuugaaguucaauguaggaaaaccacaugguccuucaaauucguggagcugaacauguucuaggauucuccuuuccucccaccccaggauaguaauagucaacaauugcugacagccaacucugccaagcacucuuuuacauauaacccaguuaauucucucaacaacccuaugauagauauuguaaugauucccauuuuacagauauggaaaccaaagcacagcgugguugaguaacuaacucuagccaaggcugguaacugcagggggaacuugaauuuugacuauggcaaucuggcuccagagccuauucucuuaacuauucaaugauacagccccauacauuuauauugaauuauagccuuuguggacuauuguuucagguaccauaugcuacuaggcacauacagaguggcagaucugcagacccugucuucuucugacauguuggcaacaucuuugcagggcaacuuccuucacuuggcaaagguggaugggguaagagcucuggaauuugucuguuuacuugaaacauaacagcuuuguuuauauuguacuuuuuaaauuuucauguuaugggaacuuccaaacaugcgcaaaacuacagagaacagaaucccucaugugggcaucacccagcugcaauaauuaucaucauauaucaauacauacacauauacacguuacccuauagcagugauccucuaaaauguggccuucugcccacugauuggccacaagucuugcaacagaccacagacuaacccagaaaggguaaaggaugugcaauuccacaacuuuucuuuugacguauaguugauuaagaccugguuauuaguaauugaaucuguauagagaaaugaaauugaaucuuuauagaguugagucuauauauacucaaucuuuauagaauuaaaucuuuauuagagaaaugaaauuuuauauuaagguagaguuaaucaaccaacaacuauugagcaccuacuacuauguaccaggcacagaucuaggugcuggagauagggcaaugcccaaggaagaacccagcccuagagaagcuuaucaucuggcacuuucuacagugugucaaagacucagauucagaauucugugagggagucuggccgcccugcugcacgggcaguguuucagagcucuuccugugaauugcacaagaugagaaugaagauuccacugcaaaaugagaacugcuacauccaugaaccaugggcuacagucaaaaauguuugagaauuacugcccuaaaacauuucuacccucccacucaucagugugagcacuaugaaaaagaucuaugcguaguaauaccuacauauaugugacucaucagauauuuucuuuuagaaagcagaaaacagugguccuauggcuuuuuaauaucuuaugauaauucuggugacauugaaguuauuuuccaucagguuuuaaauuaaaauuguauguauuuaaaguguacaauaugauguuuugauauacaaauacauuguaaggugauuccuacagucaugcuaauuuauugguguuuuaaaucauugauuaucuuagcaagcauuaacuaaacacccaucugggcaggcauaucccaggcccuacagauucagagguaaaucaaucaaggcccuugaccuagaggagcuaaccauuaaagacacauuuguaaugaguucauuccuauguccuauauaaauaucuccugccaggaggguuuucuucagguccucugcagaugugacuugggaguugcucagagugagacaagaccaggguuuccagaagggauuucaacuggggagaagaggagaggaaaccagaaagaguagaguccaguugguguugauugguggcugaguggguggguggguggguuggauuuuacuuagccccauuucuuaugcaauucauagccucaaaaaguaguuggauucugaucaggaaagucaauuaccaucuguauuaguuugccaacacuaccauaacaauguaccacagacugggaggcuuaaacaacaggcauuuauuuucucacaguucugaaggccagaaguccaagaucaagaugugggcaggauugguuccuucuaaggcuuugagggaagggccugucuuuggccucucuccuuggguuguagauggcaucuucauguucacauggcagucucugaguguagcugucucuguacaaauuccugcuucuugugagaacaccagucaaauuggauuaggguccacccuaaggaccucacuuuaacuugaucaucucugugaagacccugucuguaaagucaucaucugagguacuagggguuaggauuucaguauacaaauugugggggcagggggggacacagcucaacccacaguucugucuccagggucaaaccacagggucacuuuaaugagccucgaacagcacuuuugucaaugaaauagcauggaauagaauagacuugaugaucacaguaccucccacauaggggaaaguauuauuucuuucuuucucuuucucuuuuucuuucucucucucucucucugucucugugugugugugugugcgugugcacgugcacgugugugagagagagagagagaggggucuaugggacaacaaguuaaagguauuucuuacugugggucuuggcccaaaaguaugaaggucacugcugcucaaaaagcagaaaccccagagaucaucucaaucccaaggugcgcucuauaaagacucaucuucccacugugguuugcauuuacagaauaucacaauugaaggggccuccauugucgauggggacaacgcagccacaaauggagugauacacaucaucaacaagguacaagauuccauucuccugugcgugcagcaucucuuuucccuuuguuguuuaucguccuauacagcauuuuuuuuuuuaaauagaaaaauacuuagccuuauauggaaguaaccgguacugugccucaugacuuuuauuuuaaaaccaucaagagagucuauugauucaaugagacucaguuuccauuuauccagccuguauucugcaaugggcccuuuaucaaguguggucacauauauuaucuuucuuguuuauggaaacaucucaaaagacacuugaggccaggugcuguggcucacgccuauaauccuagcauuuugggagucugagguaggaggauugcuugagcccaggaguucaagaccagucugggcaacauaaugagauccucucucuaccaaaaaaaaaagcaugcaccuauguggucccagcuacuaggaaggcugaggcaggaggaucacuugagcccaggaggucaagacugcaaugagcuguguucaagccacugcacuccagccugggcaacagagcgagacugucucacaaaaacaaaaaaaaaacacacuugagcuuaagcacccuggcacugugaagucuguacaaccagaugggauauaaucaagaacuggagggagaggcaugugauuacauaucauuuuuccacucuccuaucugcauuaaugcauccuaaaaagaugagguagggaaggcccuaaggaaaaaaguggaaaagaauauaaaaagcauggugacauuuuuauuuucuucuaauacccaguauaacaaagguaugacauaggaaaaaaagaauaaugagaaaugggauuguaagcuacccugcaauuuucaguuaccauauuaggaucuucauuuaaaaugaaaguugcaaguuggaauuuaggguacauugggaacuuuuguaagauggaagaucagaaaaaaauaacaauuaauuguguuuuaauuaaaauuguucucaguugggcacgguggcucacucuuguaauuccagcacuuugggaggccgaggcgggcggaucacaaggucaagagaucgaaaccauccuggccaacauggugaagcccccucucuacuaaaaaaaaaaaaaaaguacaagauggcuguuaauugauucaguuaucuguguagccucugggcugcaggcgcucccuaaggagcuccuucucuaucugucaauuggcaucaagggcaucuuugucagggccaccauugugcccugcauaaaggugccuggccagaguggaggcuagcuaaaucccagcccacuucacuccccaugcugugcaccccuguuugggguugcaaacuccuagagaaaggagugucuuuuucuugauuuucaguggcccucaucacugccuauuguuaugugacauagacauagaaccaucaaguucuaucaggccuucuccucauagcucuugaaucugccaaaucccgucuaaucaccuuaagccccuccucccccuucagcuccaacaacucagaaaugugucugucuuccuccaacacagggguugguacaacguuucuggaaaaagccagauacaauuauuagacuuugcaggucacauggucuccaucauagcuguucaacucugccaccguagugcaaaaacagacuuagacaauauguaaacaaauuugcauggcuguauuccaacaaaauuuuauuuuuaaguacaagcagcagacuggauugggcuuucuacuguaguaugcugugagcucauuuagggcagaacccagaccucagucacacuuguauacccacugccuggccuguaguaggcaagcaauaaauguuggaaaaauacugauuagauuagaaaaacauuccaguguugaauucuucaaucugacaaaguucuagguagaaugcaaaggugaaaauagugaucuuggccagaagguuaauuaugcagagcuugcaaacucaaaugcccagauagaucagauggauaacaaaaugaguaaggaguaugucccaaguagaagacauuagggagugguggagccuauaaugaaaguggcugcugcuacucucugcagcugugugucugcagaaauucagacugauuuuuuuuaaaggcaaucuaaauuuauauguaaaaauguccuauuauuacauagcacaagccaaacaaaacauuuuuacaagccagauucaggccacuggguugcaguagauuugagacuucagagaaaauaaauggagaaccuaaagaauaaacacacgaauaacaaccaagaagaaaggauuagauauuagcugcaaccugcuguguuucaccucgauuuggucuaaggucuucucugacaagguagauuaaugcgagcuggaauuaauuacuuaggagaagcugaaagucuuucgugcaagaagaacuuuucucuaaucaaggagguuuaacgguaaggcauaaaauugaaugacuaacaucuccaacucugcuccagccuugucaugcuguauccuggaauauuuuuauacugugaguaaucuucaaaagguugucaaugucaauccauugaacugucuaaagagguuaauggcauuagacucuccuauguaucgaaaagcaguagguccuaccaaaacaugcuaacaggauucugggguuucuuuuuucaggugcuggucccacaaagacgucuaacuggcuccuuaccaaaccugcucaugcggcuggaacagaugccugacuauuccaucuuccggggcuacaucauugcaaguaccacauucucugccugaccaccaugcucagguuacccaggaacaggaaucccucaugcacucuugucucuuuccaucgcagcaauauaaucuggcgaaugcaauugaggcugccgaugccuacacaguguuugcuccaaacaacaaugccaucgagaauuacaucagggagaagaaagucuugucucuaguaagugucaagaacuauaacuagggaaguuauuuugugaaaauucaaacacucaguguuuguaauccauuaguugugugccauuucacuccuucauccuuguccauagccacauacuugacguagacuggugcagagacucucucauacacaaacauccccucggucagagcugcuggaugcuacucacaugccccuggaauugcacacuugagccuguauacacaaggaugcagguguggugcauuaagggugugguguugguguguauauguaaauaugaacaaaggaagcccaaacccacaggugcuuggccuguuuaggaucuaucuauagaaccaucacucugguucuagcccgagugaugaaaccacauggagaaaccacaugguuucuccagagcaguggugggagaaaagagugggcucagggguggcuucucggggcuuucagugccacccccaucuuauuaacauccucaucucagccacccaauauaaacauggaagugaaaacagugugcuugccgugcaaauccagcuucaaaugugucuucucaugugggguuggggugggguggcccugggcccuucccguauaaaaauucuggagccacuacugaauaucggauaaauuaugaucagcuuaugguagucuuaaauaccuggagaggucauuuggacuuaguccuguaagaaacaggauccacaaaagaguuuuaagucagaucguggcaugauugaagcuuuugaauuaauucacaaaauccuuugacaaacuuugacuauuuaccccuagauguuaggaaucagggaaaauagagaaggggagaagaggaggaagaaagagauaauccaccccucuaggucccugcugcugacaucuuagcuacuggaaccaaggaaaggccagggacggggggaggagaggaggggugaucaugaggauucuuccagcuuccugggacaccugcaugcuuguuccuaugagcucaaguguguaauuccagggguaugcauaaaacacacagcagcucugcuaugggggaggauuguauaugggagagucucugugugaggcuguauuaaguauguggcuauggacgagaagguuuugauggaaaagugaaaugacacgauugaacugaaaacgguguuugaauuuucagcaaauagggauuuuucuuauuuaauaaggaaauaaggaaggcugcucuucuuccucaccaccuccuaaauuaucccuauccacucaucauguccagucccaccuccucagggaagcuggcccuggccaccugaggugagcugcucucucccgccucugaauucacaccauguguacccccuuucagcauuuauuauguauccccaauaggaugaacugucuucucaaagaagcaagucuuagcucuccaacuagauuauaagcucugaaggcagggagaguguccuaaacuccuguaacaggcauguugcacuccugggauggaacuggaaaucuucuaccuugucuuuucccugcccucuaacccaacccauuucuuuaaccucuucagugagaaauguuauuuuucugccacagaaugaaacuucagacagucccauagccucucugccuucccaaaaaguccuauaaucaccuuggagacaaauguacuuuaagucacaaacucagucucagcuaaguaaaaauaaagaauccaauuccuuacaauaauuaacacuuugaauuggauuuaaaacuaguucuuccucccucccugcuccacagcagagcuuggugcagaaaacaucucgguccuugaaucaagguccacaggagauggaaaacauaccaauuacauaaacugagaauuugauagaaugaauuguuuauuggauauaaagcuguauaaaugaaagguuaaagugagaaagaaauaucacaaugguagcaaucacaggauucacuuaugaccccuaaagcuaggagaacaaugggaggagguuggaauuucuaaaauguauaaaccuagagccucugagaaggggucacuauucagcuggugcuggugucuuugagcuuggaugaguggcgagggucucugugggucugagacccagaccuccaggagcaggcauugccuggcuggugucuuaugagcggagagggcaggauuaagcuggcucugcgagugacgggaaacugccaaccagauucaggugccacugcagggaagagaagugaggcugggugaugccaauaggaacagggagagaacaggaaggacugaguuccucuuuccccuccagcccucugacugucuagagcuucucauuggcagacccuaauagggagccccuugcaaaggagaaaugugggaaacagccucagccccagcaucaucaagcagaguguaggagguggauuuggagcugacaggcaaucacuuaggaaccuucuccucuccuuccccacaggauguuucucuucccuuucugaucucacuaaauuccauuuugguuucacuagguuugaaguagcgggguaagaaggguuagugguugggaagagacaucaagaggguaagaagguuaagagggguggaagagggcaggaaggacccuaaaaccacagagcccaccccuagcucugccccggggagccugcccauccaggcugacauaggcucucucagacacuccccaugucugagccacagcaaacacccacauucuugucccaagccaacuaugcaagugcaaaucggucccacgcagcaacaacccuccucacuucaccaagaggcagcucaccagcagucccugccuuggucagaccccauccaacaugccacccuaucuccacgagacacagaucaagguccuuggagcauccuagugaagcuccucucgugccccagaggugaaaggcaggcugggguguggggacucuaacuucucaguaguucugcccaaagaauuaucaccuuuaaaaucuacccccagcucucauaucuucagucuggguuuuagaauccucuaaugaguucuugacugugcuaucuggaaaauuuguaaguucucugaagccaucuguuucacaacucacuuucauauugaauauugugucuuaauaccucugucaaaacuuccacuuggacaagcuguuguuccucuuuguaaucuccacagugacagcacaugggagaagcuggguaacugucaggcugaucucuugacugacuuccaauucugugugugauccaggaggaggacguccuccgguaucaugugguccuggaggagaaacuccugaagaaugaccugcacaauggcaugcaucgugagaccaugcuggguuucuccuauuuccuuagcuucuuucuccauaaugaccagguacgauccuuuuauguaaaaccccagcaaugccaccgagaauuacaucagggagaguaugaggaaugagugucuuggcuccugucauccuucaucacuucuguauuagucaguuuucacacugcugauaaagacauagccaagacuggaaagaaaaagagguuuaacagacucaguuccccguggcuggggaggccucacaaucauaguggaaggcaaggaggcacaagucacgucuuucauggauggcagcaggcaaaaagacagcucgugcaggaaacucccccuuaugaaaccaucagaucucaugagacuuauucacuaucacgagaacagcaugagaaagaccugcccccaugauuaaauuaccuccuaccaggucccucccacaacacgugggaauucaggaugagauuugggugugggcacagccaaaccaugucaacuuccauauugggaucaucucaccagugcuuccuaagccuuaccaacacaaaacgguugucuguguuucaccauaaaguaaagccuaaaccagacugucaagcucccacucuccugcccaguugccagccuucagaugaucaguguagccuuacaaauuguggcauugaaucucugcagucauaggcguccuucagcgcugguacaacaaacccaacagauggcccccaagccgugccuaggaugggagggaaccugggagaucaaccuaauucccaggaaguggugugggcuccagggcauaagagccccaugacauacacaggagccagcagccaaguguauuaauguuauuaucauuguauaaccauagagauagauugcaguccuaggacuaaccgaccaccacacugguauucuaguguucaucucacaugauaccuaaauauuuaaacguguuuacaauucauagaaaagaauucaugaggcucaauauuuaauauauuucaguuauaaaauucuauucacauauuucaaauaucaaguaaaaagaucaguuugaaauucaauaagaaacucauaauuuuaauguaaauuaucacaagaaaaauuaaaacaaauuauuuaagagacacuaaacacuauauugaaaugaagguuuaaucacagaacuuuuuaagcgacaauauuugaaccuuucuaaaaaguauaauuuuaaaaacaauuucuucaguggugucacuacugaauaacaaguaaauuuuuauguaaaaugguuuuuaucugcuuauggggaaaaaagucuuucugacucuugauugauuaaagaauaaucuaacuucaaauauuuuucucagacuccuacagauaagucuaccuauuguguaauaacuuggaagaggcccuuuuaaauauacuuuuuauuuuuccaggauugguaauuaugguauugacagagcuucguuuuugcuucuguauguguuugucaccuuuuauuucaucauguagagauuaaugcccaaugcaguuagcugaaucaauuuuagagcugcagcguucauuuuuccaugugugcagaaauucuuuuaucuagagaaagaauucauacaauagaggcuuuuauugauaauuuacuuucucuuaugacaauggaaguauagagaaaugcuuucuuuuuuuuaauuauuauuauacuuuaaguuuuaggguacaugugcacaaugugcagguuaguuacauauguauacaugugccaugcuggugcgcugcacccacuaacucgucaucuagcauuagguauaucucccaaugcuaucccuccccccuccccccugcccccaccccacaacaguccccagagugugauguuccccuuccuguguccauguguucucauuguucaauucccaccuaugagugaaaauaugcgguguuugguuuuuuguucuugcgauaguuuacugacaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugcugcaauaaacauacgugugcauaugucuuuagagcagcaugauuuauaguccuuuggguauauacccaguaaugggauggcugggucaaaugguauuucuaguucuagaucccugaggaaacgccacacugacuuccacaaugguugaacuaguuuacagucccaccaacaguguaaaaguguuccuaagagaaaugcuuucuaaaugaguagacacagucaagucaaaauuucaaugugauccauaauucucugaauauaccucagaauggaaauaauuuagacuuuuuuaaaugccaaaucaacaguauuacaauaucaaauguucuucuauuuuuaguauuuaaaaauagcucaacaucuuagaauucuggaaauuuauuacaaucaccauuugagacuaagguuuccucuuaauuuuccaaauguacacagaccuuggaacaccucuguggaguucagccagacuuaucccaacauccaaauggaagcucauuugacugcaaguaaaucauaagggacuuuaacauucaguggaaguuugaauuaagcacuuaguacggucauuuuaauauugcuguaacauggauuucugggauaauauaugaauuuaagaauuuuaaaccauuguuggauccuaacuugaguuuuccccucucccaacuucagcccugcuacacacacacacacacacacacacacacacacacacacacacacaccccaccccaauuuuucaaagaaugauuugcuuccaguuauauauguguuauauuaaugaaugaauccauggcuucauuuauuuuucauugauuacucauuaaaguguucuucccuaaaaaaaaaaaaaaaaaucaaaacaaauugcaacucaaaguugaauuugacuuggcggcauuuagauacagacuucauacccaugccuugguuguuuauggacacgcuaaacaaggacagauauaaauauaccauuuuuuaaaaaauuaucaguuauuuuuuuuuuuuuuugagacggagucucgcucugucgcccaggccggacugcggacugcaguggugcgaucucggcucacugcaagcuccgcuucccggguucacgccguucuccugccucagccucccgaguagcugggacuacaggcgcccgccaccgcgcccggcuaauuuuuuuguauuuuuaguagagacgggguuucaccuuguuagccaggauggucucgaucuccugaccucaugauccacccgccucggccucccaaagugcugggauuacaggcgugagccaccgcgcccggccuaucaguuauuuuuauucuuguauaaccaucauuagccuuucugaggguuguuugcacauuaaccaugaagcggagacauacugaaaggaacaguugcauucuucgauucuugguuauggaaggcacuaccaccuccagaaccacuggucuacagcacaacugagcaaguccauggagccgucuugccggugggcacuaacauaaugaucaugggugguauuuuucaaacaaacauaagccaauuaauuugcuucauggaagauaccuagaaauuauguagaacaacuucuuccuuuuacaaaagagaaaauuaaaguucagaagaggaaagcaauuggccuaaggucacacagcuagauggcgccaggacuguuauucagacuuccgcuccuaagucagagcucuuuccaauacaagugacuauuauaucuccaggugaauauuguaauaucuccuaggcaauuguccuauugcuaaccuccacuuccuaucuuuuccauaucucuuuaaaugucauaaaaagugacauuuaacccuguuguucacagcucuauguaaaugaggcuccaauaaacuacaccaauguagccacugauaagggagugauccauggcuugggaaaaguucuggaaauucagaagaacagaugugauaauaaugacacuacuauuauacgaguaaguucuaugggccagagccagugauggaacuaaugaauauuggcuuuuuuuuauauaauuuugggggcauaaggcuuuucuauuaagguguaucaauucaguccauaaaccacugaaugaguaucuuugaugugccaaggagcauaccaggcugugguucuacaaagauacauaagacaugaccccugcccucagugggcuugugaucuagugcaagagguuguaccuugugugccugggaaaggcugccagguguguggggauggugggggggaguggugugcuguguugggcaggauuuuggaccauggcuuucuucaaagggaaaaugugccauaucuaggacaggcacaggguaggaaccauggugccccuauggcaguuaugggccaagccugcucuaccaguagagaaaauaaggaaaugaaugauuucaguguauuauggaauaugauaauggaggcuuuucaugccaauucauggggcuauguaggaccuuucaacaauaauuauaaccacugacguuuaucggacacucguuauaugccgggcacugcucuaaacauuuuacaugcacuaaccuguguaauccucacaauacucuaccaaguagguacuauuacuauccccauuuuacagaugggaaaagugagccagagagguuaacuaauacaugcagguucauacacuaccaaguggcagagaagggguuuaaauguaggcagccuggcccagaacuggaacccugaacaaccacauuauccugucugguaggcuuaagguucagaacuagacacauugaccaccuccuguuuuagggacagguugagcuugaggguuucugucauugugaacuuuuacucuuuguuuuguaauagcauguauuaucucuggggcaucuccaugcugaaccccucaucuuagcaaugugcuccgaagcugggcacuggguacaguaacuugugaguuucugaaucuggcccaauucacuuaauaguugguuuuuaauaaauaaaaguuauuguuaaagaauuuggacuuaaaugagauaaggucacacuuuaaagaguuagcagagucagaagaguguuuuggagaaaagugaugcaaaugugcaagacccagaggaguugaaguguuugucucagaacauuaaagaggcugcccagauaaucugccuugauuuuuaauucaaaaaccuucauuuccaaguucuggacaugcagcuucauuuuguauuaaaguuaauuacauugauugcuuuuguguuuuaccaagggaagauguaggacaugcuccucagagcugaccugcccauucggaacuaaaucucuaguaaguacuuugucuguuuugauaaaauaguuuccagauccgaggagucccaauuagaaaaugaaccucaagauuaugugauuugcacuucccucauuccuucacuuaauuugaauuacacuuuaccucguuauauuauaugcaucuuuguaaaaucuuacaucuauuuuuuuggaccaaggcaaaauuuaauaaacauaaauggguucauaugaaucaacagacaggacagaaauuuuuuaugcucuacgucuuucauauccuaguagccaguugaggaccgcagcaagaaaucuugucagagaagagagauuccauauccaaaaccauauccagccuggauauauuccaccugccugauuuccuuuuauaguugaaguugcaacuaacuuucucaaagaaacagauggcagguacgggggagguagacaauccauguuucuuguugcuauuuauuguaaaagauacuucugauuacauuacaaagaauacucauguaccuucaacagcauaauaguuuuuacuaaauauaugauaauuuuuaauuuaugauaaauuuuaaucuauaacaaccauacagauguucucauuugagguuuaauuuaaucuuguauauuauaaucuuuguaugcagccuuaauccuuuccuggaccaaagcagacuauaaaucaauagaaaccaaaguucaguugagucaauguacggugcuggaaggacauuuuuaccugguuuacucuacaauucuugcaaacuuaaguugauauucuaaagaaauguucuuuucauggaguacuacuuuaaaguauaauuauuggauuuugccaccuggcauuccggcaaccaacauuguguuuucauguuuucuugcuuaagaagcagugccaacaagccaccaccuucucuucccacaacacuuuagucagagagacagcaaugcaucacccaccuacuugcuuucggagacuggaaaacuuuuuccuaacuuaggagcugacguagucauuaauauuucacaggguaaugagaagaggagaugcaucuauaccuccuauuucaugggaagacgaacccuguuuauugggugccagccaaaaugugugagaaccgucauugugaguacaauaauugaaucauacuaacuacugcagcaccauugggaaaauccaucauaugguauccuuuucaaaaucccugugcagguaugcuuucugccaucuccucuuccuuguuaccugcauuaucauugucauccaauguaguagugguagcaguaaagcucagaacagcucuguaauccagaaaauggguaaaagcugcaauucaauucaguuucaugaugaaaaaaacugagaguccgagaggcuaaugggaccacccuguucucacaacaggguagcucugugagcaugcuuguaagcaaaagagagaaaguguccacucacauugugaagauaaggugcacuuggucauuuagaaaacaggaccccaaggcuaacuaccucuaguggugccuuuggaauuugcaggaaaagucaugagaacuuccugugcugcuccuuucccagaugacuagacauaaccucugccuagcugggcagagguggggugaucuggcccuuaggcugcagagcauaggggugggggagauuuuguguuuuaaugcacucaagaauaaaggcaaggcaaacccaagcagacacccuacggggcuucccugaacugcaaaagauugguuuguaaaaugccaaaagccucaccugcagaggccuccucaccuucaguaguagacgaaauaacaucgaugugaaggggcccagaucuggguuggagacggccccuugguccucccacucuccagcaucacaggcauuauucuuuaguuucuucugcugccccuccuccuuucucauuuuucuucauccucuucucugacaugccuuuuuccuuucccucuuuccuaccuccuuaguggagcccuugguccuguuccuagcaccccuagaaauugccaagccucacccaguccccagaggguccugcccccaccccucacccacuccaugugaggucgaagaaacaggugcacaagaagucacccacagcaggauuucuacaccgaggcuggacaacaccagaggauagaagugcguugucaagcuuuguccuucuguuucagacgagagaaugcugugccggcuucuuuggcccccaaugccagcccugcccagggaaugcccagaaugucugcuuugguaauggcaucuguuuggauggagugaauggcacaggugugugugaguguggggagggcuucagcggcacagccugcgagaccugcaccgagggcaaguacggcauccacugugaccaaggugagcaccguccucuccacagaggaucuugggcugcugaaaccaaccaggaauaugcagggaaagagugaucccacacgugcucucuagcuggccugucgccccaagugggcuggaaucccaccugcuacuaucacugugaauuauaagagcaucuguguugucauuugcauuugcaguguucccaaacauuuucagucucuaacuugaaccuaccaacucacuuccaauuugcucauugacauucccagcccaaaugcguuuuuauauuugccuaugcacacuaaucaucacggcuaaacuuuccauuguggacauugcuugauaguuugaaaaacagauuugcacauguuauucauuuaauccacacaggaaccuuagguacaugaguauugcuaugcccauuuuacagaugaggguaguaaggcaaagagguugaaugacuucccccaaggcuacaccugaugagaggcagaacugagaacugaauguacaccuuucuugacuccaaagcuugcuuuuagaucaugcuguucuuuaccugaggguugcucuauuguuucaccagcagcaagacacaugcuuuaaguaguuuuugcaaaaacaaugaucuguuugagccaagucaucuguauucucacauccagauuuccuuguguccaggaacacacagcugugagaguguugacuccagaguuuggguuuccuaacaaagcauuauucuaccuaguacuaaaaaccauacaguucacuuggcuaucacuguuuucuccucagcuggucuaagccagacaaaauuaauguacaauugaaucauuauaauugggccauauaauauuuacuuggaauuacaguguugauuuuuucccauguuauuuggaguaauuaucugcuugcauuugugcaugaguuccuaaaaugggauuuguagaugacccugaugggauucagcaaaccgcuaaagcugaauacauuuuucuggggaaggcaucuguagcuuucaucaaguucucagagacucaucuguguaauugaggaagcagugccacaccaggcuuauacaaacccagugucaaaugggcuucuuccugaaguccauucuuaaggggcaaacgugguuccaaucaaaggagcccugcauaacccuggauccucagguaaccuugacugaggacacucucacacugcuugggucacagaucuucagugcuacacugucucaaaacugcagucugagccacuucauugaagcuagagcuaguucaccugugaacuugcuagauucugucuccugcaccccugcccuuuuugugauucaagaccccuguuaaagacuaugauuccuagaaguagguuggagaauuaagugcaauaaagcaaaccuaguaaaugacaaaugaguuauugaacauggguuagaaucugacgauuugcaggugauuuucccacuuagcauguucuuguguccaugggagaugcaaccaaggacccuugggagauggcuccugugacugugauguuggcuggcgaggagugcauugugacaaugguaagagugaggccuccaguauuuauaaucugcucuaagcuuugcuucucagcagcuacauuuuucuuucuaaaauauaaaugacaccuuuuuuuacuucuucuggcaauaaacaugauucuuucuugcagcaaaaaguuuguaaaauaaagaaaagcagaaagaagaaaauaaaaucacucauaaccucaaggcaggaaagaacuauuacugauauuuuauauuaggcuaccaaccuuuuucuagguauauaagcaaauguguagggaaucacacuuuacauauugucuaguaaccuacuuuuccacuucacaauauauauauagauaucuuucccugugauuaaaauagaaaaauauuaauuuguaaucuccacaaaauguuacaguaugaccaugcuacacuuuuuugaaccaauuuucugcucucucaaacacugcuacaauaaccauauucauuuagucaaauuccuagagaugagauuucugagucaggggauggcacucugggggaaaggucuugcuacuuauugccagguuguccuccggaggaaauagcaauuuauucuccugccaauagugucugagaggcccauuuccuucaauccgaccacaucacauugauuuuucuuaaugugcuucaggugagggcggucaaagagaagggaauuucaggcagaaagaagcaccuggaauaccacaacgacaugggaaagcucaacacauuuagggaaucaaaggauugcagaaugagaggacuuuaagggcaaagaggaggguugaugagaaaaggcaggagcagugggcaggcgccgggccgugaaacgcuaaggagguuggacuucucacuaaaggcaacaggaagccauuaaagaguuuucaacaagggagcaauaugaucguauuuggcacuuaagaaaaaucauucagacuuuggauugaagagaauaccccuggaagcagguaucagagacucccccucuuccggguugggagcuggggaggagaucacaagugauugcuagccuagugggggcuccauggauguggcauugacagagggggcgucuuugcccaaagcuccaggcaaugcaaaaaucaagggaaugcaguugccuuuuaauggucagcaacaaggggucagggaggaagguuaguugaaaagcugaauugggaagucugaauggucccaagccaaagaaauaucccagagcagaugucaaaugucaggguacagagccaggcuucugagagccugggagagggaagcaggaagcaauggggucacauaaacaguaggacauuuucggugaauccccagaauaaauacaauaggcucucuccucuucuugcuuucucuacucugaagaaagaccccaccacccaugcaccuggucacccaaucuaggaaccucccuacucagcuuccauaccuccuugucccucacuaacauaccuaacauauuccaugucuccacaucucucaauccaucucuuccuccugcuccccucucaccaguagccuuguggucucuuuguuuccuguccuaucuuccuccacuccguacuccccacuacugccagauagaacuuaccaaaacauagaucguguuuuucaccccagcuccuccccagaacuugacaaauugcugugguucuucauugccuacagaagaaaguccuaacuccuuagcaggguggagcacaaagacucuucaccaaugaacacucacccaguuuuccagacuuaucucccaucccugucuccagugcacauucuacacaggaaguuuccagucuagaaaaggaaauaaauguuuaguaaaaggaaaaauugugguauggaguacaaagcaaagagccuguagacuauaacaaagaagacaacuccuuugugugcaaacuccucgcuccuaaguccacagcagacaucacuaaucaaucaugacacucccucccucugugaccagccaggggcacccaacccuucucaaaguagcacaccauuaagcugcuaccaauuaauugaaguuggcucaaagguuuagagcagguuccagagaaaaggacauaaaacaugauugaaaugccaauagguagagaauagagagaaagggauuguuuaggcucaaggaauaagauacaggcacaaaauugccuccauuccagcccauuugagucuaaauucccuccgacacaaaacagaccacuuuugcaggccucuguuucaggaccuccuguaugacucagccaggauugguaagauuucuaucccaaaagcucuuaacaugagcauccuauccaagaguauucuucccucaucucuaaugauuuacuucuggaucuuguccugucaagaaauagguaggcauccaagagcaauaaccuaugcuguguccaggaaauuuacauauuaauucaacaaauauuguguaccugcugugugcaaagcccugauuuucugcacaugcaaaaaaaucuuuuauaauuauaguuuugcuuguuuacagcacuccauaauaaaaugaugaaaaccgggaauaaaguuaggaauaaacuagaaagaauagcauaggaaauacaaauaaaaguagaaaaucaaaacccagaagagggguacacaucaacacccagaccauaagagcacauggucacauuccagggagaauucuguguuuuauucacucuugcauccucacugccuagcacagggccuggcaaacagaagacaccaucaauguauuugaccuucagauuuggcuuugagcuucauggcagccaguauaaaaaaggauugacaugaccucauaguuuuauaucgcucacaugauacauaucacuuccaaagaaguagcuuuucugagcacaaaauacuaaaaauccucaggugagauuuaguaagagggcuaagacagcaacugguucucuuuuucagcaaccacagaagacaacugcaaugggacaugccauaccagcgccaaguagguagcccugggccaccucuggggacaguguaaaggggauuuuuucccaauauugucuacccuagucucuauccucaggggauuuguuuccugacaccauuucugagggcuuaggauaaacuugaguaugaaacuaaaaauaucucugaagaggccacuaucaaauagccagauccaggcuuucuaacaagcugccaucugacuuaccuggcacauugacgaaaaugcccacuguuaccccaguccaagcuaccaggacucauggagacugaggaaacccagugggccucaguuuccauaaaccuuguuccugacucacagcaagucauaacuuggcuucauaaugcuaacucccagagaggcuuaaugaauuaaguaccuaguaguggaguuagacaugaauucaaagucagccucuguuauuugcacuaccacaugaucuugaguccaacguugaaucccuccaaagccucagauucuucauuuguaaaugggaauaauccgacuugccagggcuauuggauagugaguagaugacacaaaauaauacaugaaacauggcuccuagcacaucaguggcucucuaaagcuuggcagcuacccaucuuauuccugaacugacaccuauaucuaugcacgcuguaguuugccugauaaaugaguacaguuuuagcugcuuguggugggguuaugccagaauuagacucuucucccaagccuuaggcaggacuuaugagugucucaugggggcaggggccaggauacugagggugaagggcauuugugagucauguggugggagguggaguauuuuucuacaaaccccauuuguccuuccuuguugcagcugccucaccaacucagaugguacagcuucaugcaagugugcagcaggauuccaaggaaacgggaccaucugcacaggcaagcgaaggaaggaauuugcugggggggcuggcaaggcuugcacaggcuauugagagguucuuguuccugcagucugaaugggccucagcagcuggugccaaccacugauggugaauuguauguaauggggcaguugauugugccuggggacaggaaaccaacuguucacagccuugaccacaauugggaucaccugggaagcuuuaaaaaacagugauuuguguugagaacccacauaaugaucgauguuucagaugauggauaugcuaauuacccucaucuauacauuaugacagcauuacuauauacccuagaaauauguccaauuauguguccauuaaaaaagaauuuaacucacugauuugauuggccuaggguauggcuggagcaucgagggucuggagcagacuaaaaaagaauuugagcccugguucuuccuccaacuacccagguggccuuggauagcucauuuguaaaguaaacuuaaaacuaccucccuugcagagugguuuugagguuaagugagcucucuguguucaauggcagaauaaugcagcuguugaaaacucaggucaacuuagacuccccagguuugaaccuaaauacuuauuacuuacauuaccuugggaaaguuucuugacugcucuuugcauuauuauuuuuaucugcaacuuggggauaauaagaagaccucccucacugaguuggacaauaaccugaauuaauaccugugaagugcuuagaacagacccagcacauagaauucaauaaaugcaagcuaauauucuuauggugucuggugcuagaaaaaauggaaaaucuuaaggucauuuuucucuugagcacuguguccuggcaggcuuugguccagauuguggcagcacuggacaaugaucaugccaaucugcuuucuagaccaucuuacccuggggauucucccagagggccaaguagacucaccuucauccccagguguguccugcaguaggauguguacagaaugcuaauaaaagcagcuagaaagggcaaaucacagauguuuuacuugcucucuguuuuugggaauuggccauauuuaauccagugccugcucaaguaguuuugcaguauguuccauuucucaaugacuugaggaaaaauacaucaauggcuuuugcccuucccucuccccuucugcucugugucaucuucuauagcaaucaaugccugugagaucagcaauggagguugcucugccaaggcugacuguaagagaaccaccccaggaaggcgagugugcacgugcaaagcaggcuacacgggugauggcauugugugccuggguagguguccuucccucuuccaucggcgaaaugguauaagagucauagcccuauuaaaugauuccaacgugugugcccugauuaucaggacacaaaacugaggucaguauuccauuugccagggcaggaaaguauaagggcauggaaaagugaccacaggguaugaaggcaugucauguccaaaaauuacuucggaaggguaaaaggagauacauuuuccaauuaaacaucauggcgaugacagaacauuuaaacuuuuauuaguuccuuuuuauacaaguagcacaugcucacuguagaaaaagaaagcacauguacuggagaaaauacucugaagauagugcucuuauuauugucauuaccccauuuugcuaugccuacauguauuuuuuuuuaacaaaaaugguaucucaggauauacagcauuuacuaugcuuagcaauauaucaaaguaacucucccugaaaacaaguauaccucuaacauuauuuaaauauccacacacuguucuacuauaaagguaugccauaguaaguugucugaauuuaacuguuuaguuagaaaaaaauugacauagaagaguuauacaaauagcacaaaaaagacccacuuguucuuuacccacauucaccuauuaacauuuagcccuggcugggcgcaguggcucacaccucuaaucccagcacuuugggagaccaaggcaggcagaucauaaggucaggaguucgagacaagccuggccaacauggugaaaccacaucucuacuaaaaauacaaaauuagccgggugugguggcacacacagcuacuugggaggcugaggcaggagaauugcuuguacccagcaggcagaaguugcagugagcugagauugugccacugcacuccagccugggcgauggagugagacuccauuuccaaaaaaaaaaaaaaaccauuuagcccuguuuaucauuugcucucuuuguauauauacauuuuuaagccauuugagaguaaucuguguauauuguauucccuuuguuccuaaauacuugaguguauauuuccuaagaauaaggauagccucuuacguaaccacagcacaguuaucaacuucaguaaauuuauuauugauguaauacuuuugucuaauuaccauucauauucuaauuuugucaguuguucaauaauguccuuuuugacaauuuuuccuccagugagggaucaagucuagggcuggauauuguguuucauugucauguaucuugaguccccuuuaaucugggagaguuccucagcuuugcuuugugucuuaugacauuaacacaugggaauaauauccuccaccucgccaacuuuuuuuuaguagcauguccuuuauuugggguuugccugauguuuuucauucuuagauucagguuauacauucaaggcccaaaugucacacaagugauauugcaucugucucagggaaccuugagcucuccuucugcccucugugugugauguuaauuuugaccacucagugaaggugcugugauguuuccauuauacaguuauuuuuuuuuucuacuuuacuacugauaagcagucagaggagacacacuuuaacaccaagcagauauguuguucccccucaaaauaugcuccuuaguuuagcaucuuuugaugauucuucccugaaccaaucuauauugugaugguugcaaaugauuguuuuuaauuccuaagucucuucauucauagcagucuuagauuagacuccaagauucuaugguuucaaguacuuugcuacaaaugcucaaauuuauuccacggacugauuuaagccaguagacaaucccucugcuggaacuggccuaucccagaauagucaaucuuaagaaaccauauacaguacccuccuaguucaguuauuucugucucagaacuuccagaaaacugaaucaugcuuugacacccgcucccuucagucaguuagccaucuuagcucaucccucaagcuggcuucacuuggaaaccagacuggauuuccaggccagauguuggcuuuuuguuuuaaagaaaucaacccguguuuggagaaccaugguggcugugacaagaaugcggagugcacacagacaggacccaaccaggugagugccaccucucccaggcccuuagguuuccuaaaagggaacuccuaggucuuuagacacaggccugagagaaagaggcugagaacggaccucuaaagagcugcagcugaaaauaaauacuuuaggggaaauucugaaagaaucaagaggcccuucuuugggaaugaggugaaaugggggaaaaccaaggguacuaggacaaggggcuucccuagagugcggagaaguagguaucugcaaauaccaugugauuccagaagcaucuagacaguccccuaaaauacuccacuuucuuucagcauucugaugcccagaaucccacacuuuaucuuuggcuuaaggcucugaagcacaugugccaugguggaagauaauacugugggcacucuaccagucacauggcccugaguaccaugagcuugcagcaucugucuggagagcaggcugggggagguggggaaaacaugagagcaaccgcaucagagaaugggggucacaggguggaaagauacaggcagggaagcuggaggccuggagacccaaguucggccuuccucaguuucugccacauggugaacaagcaaaauggccagacaggaaaucacauauauccaaaauuggaugacaaagugaagucaccagugaaugcucuauugaccuaguugagccaucuggagaccucagugccaggucucucaaugggcagaucaagcaaguaccuaaaguacgcaaaaauaaggaaaaaaaauugucuugaaagaacugugugagcacacaugcacauguguguggacacauuuagucaugggggaauucggaacagucaaugcugagcuuucuuagacaucuuuugagguuugguaguuuuuauuucaaacuacauaugagguaggagauaaucuauaaacuuuuuggugcuugggaccuccaagggugcccauccaguccuagggggcaguaaaggaggauguggaguugaacuuugagaacaagacguuagcugaggagggacagcuggugaugucuugggaaagguuugcacugauauuggggcccauugugaagaaagaggaagagaaacgggaaaaccugcccguguagcccuagcuggcaccaaugaugacuuaaaguucuaagaagcagacgucaacccagggcccuugcugcuacauaggaggcccuugugugaguuagaaaagcugccuccugggagggcacagugggagcaggugucucuuccuuuggggacaucagugaauagagugugagcugggcuucagcccaguggccgggugcuccugcgcagacaugggacaugggaccuuguccccagcuucuucagacaguguccccucccucaacuugaagcuuccacccaacuuccugggccaaccaauggguuugauagauuguuuccaugugcacaccucagugggcuauaaaggucucuccuuagcaucuccuagcacuggugccuuucagcucagcaugggcgcagaugagcaagauaugaguaugaaugagagugggauauaguugggcuucuucucaacugaccuuuaccaaucaaagaaaagaggugaauaccugaaggcaagggaccaaauggagugagaacauuaaaaagaaaaaaaacgguaucuuagcaacaaagauaggaugugcaugagaucccagugcucaagugaagugugucaagugcuaaaauauuaaacauagggugacaauuaucauuauaaaauagauauuaccaacgucaaauagagacucuccuaacauuaccaugaccaugauggaguucaggucugagagccagaccaugcggccaguacagaacccaccugcaaaaugaccccaugugcuucuacuccuggacaggcugccuguaacuguuugccagcauacacuggagauggaaaggucugcacacucaucaaugucugcuuaacugugaguauggcucuaggguggauauccuucaagccucagagcccagggugccucccaccccacuucucggggaugcagaguugaggaacucuuccucuggaggccucagagcuguguguugaccaugaggcuuguuucucuggcacacuccauuguaauguuggggagaaaagagagaaggcacagucugcuacccccagccugccccuuuggcugcaccauauugagcuaagucuauccacuugcuuauccccuauccauauugccaacucuuaugaaaaagaucccuuuccaccaagcaugucucucaccuccucuaggaagccaucuuagguaaaccucacagcaacuuuccacuccuuauucuccuagacuuacacguaggaauccacagcgagcgcacuaugagucaacaauauaguguagcauuccaaaagcuuguucugucaucacagaggccuagaggacaggcuaaggaagaugauucuacucucaccccacaacuacccuccauggccccuaccacccccauucuacaugauaacucuaccuuagaacagaagauccaguucuagaugcucugcauugagcagggguucauauggggauagaagcacugugucuccuauguccaugcacacaucauuaguucucccaguucucucucucuaaagaggaauugggauguaggguggaggcugccaccaacauuucaaggauugccacaaaacagaaggguuguucuuguucuguguaaguccaagcaguaggacuaggaccagcggauggacauuagaagaaaacagauuucuuucaacuuaacucacuuauuucauuagaacuguccagacauagagaguuuugagaaguaaugagcuuauuauaacucaagguauuuaacuauaggaaugaagcaacagauggguuaucaacccagacagccauuuagauuccucccagcccugauccacaugacucuaggguuuucgguugguuugcuucuugggaccucaguuuccuuggaugguuauaagugucccuggaauuccuuuuaccacuaacaucugggcuuugacuuucuuccuccagucuguaggauauuguugacacacuucuugucuccguuugcaugucgauccuggcaggagcaggaucuucugauuuucuuauaacccuugacugcaggcuggacccauguuaugcaaacgaggaguuuacucagucauuaaucacugagucucaaacugggcuagucgccuacugcugcucagagccuaauugucccaggccugguaccugcaaagggaugagauaagccugcugacccagccugucacauccggagcaguuuguguggucagcuaggccucugaaguccugcaucaaugucacauucauauccacugcuugccaggggucagccacugugcuuaggggugcccaaucauucuuucguuuaauuucucuaacagccauaugagguaagaacuguuauuaaccccauuuuacagacaaagagacucuagcugugccucuuuccuaggacugcuauaacaaacugccacaaacugggugggugaaaacaauagaaauguauuuucucacaguucuagaggaccaaauccaaaauuaaggugccugcaaggaugugcucccucugaaggcucugugggaaaauccuuccuuuccucuuccagcuucuggugacuccaggcauuccuggccugcggccgcaucacuccaaucuugccuccaucuucacauggccuucacuucuguaucugugucuucuccucuugcaaggacauuuguggcauuaagugguuaaucuaggaugauguuaucuggagauccuuaauuacaucuguaaagacucuuuuucuaaauaaguugcauccacaguugcauccaguccuuaggacaguucaacccacuaggcugugaggagugaaggcccuugcccaaggccacagagcuaguauguggcauggccagcacuugagccuaucucuguccuacucaagaccugcacccuugaccacuucuuggggugcuuauucuuccuacaaggcccaaucccaacaccuugcuuuccuguuuauauuacuucccaccugagagccuccagcuguugacaugagaacagugcagacgcccuguaauuaaagcccuucuucuucaauugaggcucccauuaucuccuuguguuugucuggcaagcuccucaagagaucaauguccucuacaugaaacaguuauguaaggauaauaaagaagaagcuacggaaaagaugggggcugagaugugaagcuauuaccacuagaacuauggccagcuuaauuuucacagcaauucuuccaugggccauucauguuuuguaaaaaaaaauggccaccuugucuuggacaaaugacuccugauacagcugaccugggagauucugaaggucuuuugcuacucuaucucagcagcauauucccaugggaauuaacucuauugcaagauuguaaaauuauaggccaucaggggccaggcagggaauaauaucaacaggaagacccaaaucauauugcugcucuaauggggaaauaucuacuccaacugacuggugcucuaagcuaugucagcccaguguugacgguacuccugacauuuuaaaagauaugaaaauuuaugaauuuguauguaaauuuuacuaauuuguaaaugaugguaauucauuccaaaaagcucuuuuaaauacugggcuaaagaaacaaaauaguccuggugcuaaaucuggcccaagaacaauuauuucugcucaaguccuaccaacaaggacugugaaacauugccuuuccugaguuaguccccaguccaaacuguuuuaguucauuugugcugcuuuaacagcacagaggauaccugagacuggguagcuuauaagcaacagaaauuuauuucucacauucuggaggcugggcaguccaagaucaaggcacuggcuaguucugugucugcugcaggucugcuuccugguucacagacggugccuucuugcucauugguagaagggacaacugaguucccuugggucucuguuuucuucucuuuucacaucagaaggguaaugugucaauguuguaacaaguuuugagggaggcacaucucauagaauagugugaaaacccaauaucaagcuaaugaaccacaaaaggaucucucuuuuauaagggcacuaaucccauuuauaaaggcuuugcccucaugaaccuaaugaccuucuaaaggccccaccuccuaauaccauagugaggguuaggugggggacacaaacauuuagacuagagcaggaggcaaacauguugauggaacagagacugggugagaggggaagggucguagugaucagacaaggccucucugccgaggugacucauuccugaauguuaagaagcgggcagccacaugaaaaucuuggggaaaauguauaagcaaaaggaagagcaagccagggguccugggaagaggaagagcuuggcauguucugggaacugaagagagagccagugugaaugcaguaaagggaauaaaagggagguggugagaggggccagaucaccuuaccccauguaggcuaugcuguggagcuuauauuuuuuuccaguugugacuaggaagccacuggaugaucauguaggucaaugucaaugucuggcuuggcucucaaaucucauucuggcugcugugaugacuaugcaggauagggguucuaaagcagaagcaagaagaccauguaaaagacuaaugaugcugaccaagaaagaccagggugguaugacuagagcuauagcaguggguguaauaagaagucgcuugggccagguggacauaguggcucaugccuauaaucccagcacuuuggggcacugaggcaggaaguucacuugagcucaggaguuugagaccagcuuggagagagagggagauaaaucacuggacaggggauguauuuuggagauaaccaauaagaccugcugauagacuggauaugggaaauacaaggaaaaggaaucaaggacacuaucuagauuuuuuguugagacauguugguucuacucaugaagauaaggauggcuuaggaggaaauguugagugaaauaucaacaggucugucuuuuuguugaguuugaguugcuugguagccauucaagugaagauuuccagugaaauguaagccugaaggagagaucaugacagagguacaaacauagcggucauuggcacacagaugguauuuaaacacaggggacugacugaagcacaagaugaaagguagaggcaaagacggggcagguggaggggcccuggauauuaagccauugagcagaggaagaaguacuuacggagaagccucaguaaaaaagcccacaauguggaaggaaaaccacuuaucaaguauagugucaacagagaccaagagaagaaaauguuucaagaggagugauuguacaggcaaaggauguugagaugucaccuauguugagagaagagaacugaccacugccuucucaaggucucaauucuugaagacaagaucaagguggaggcuuguguaaaaguggcaccaagagccuggaaguaaguugagaagaaaauuggaaguaaggaaaguagaaacauagacauuugcaaggaucuuccugggcaaauaaauggguaguuaauggagaaggauguggacuaaaguaaguaauguuccuaacacuuuacccuggaaaauuuuaaaccuacaugaaacuagagcaacuaauacaugaacccaucuguaccugacacucaggugaaagagucaacucauggucagucuuuguucaucuauaccuaguacguucucuuaaaggaaaaaaaaaggaguuuggcuuuuuucaagaugaguaauaugaaggcauguuuuugugcuggggaguaugaucugauagaggggaggaaaccacuccugaaggagagcagguuguuguuacaggagggggugagagggagugggacccagaccccagguggagacaucacccucagauagaagcagacguagugucggucaguauauuagucagugaugaacuagugaguccauuaaugagucaguccauuaguuaguuaguuguuaguacacuuguuaaauaaggaaagcacaguccgugaguucagacccaaacaaguggugaagcucaggauggggagaugaggugguucuuguuaccugugucucuuuucuccaugaggcacaaguggggcucaucaacuaagaugagaggacaguaauugagaguugagaaaggugaggaguggaaugucaucuguauuagucaauuuucacgcugcugauaaagacauacuccagacugggcaacuuacaaaagaaagguuuauugggcuuacaguuccccauggcuggggaggucucauaaucaugguggaaggugacaagcaugucucacaugguggcagauaagagaagggagcuugugcagggaaacucccauuuuuaaaaccaucagaucuccugagauucauucacuauuacaagaagagcacaggaaagaccugccccacaauucaaucacuuccuaccagguuccuccaugacacaugagaauugugggaguuauaauucaaaaugagauuugggugggaacacaggcaaaccguaacaucaucucuagagagagggaaauuaaauguacugcaaaagugcaagcaucuguguacauaccuuugaagggaguccagauagcauguaucgugacuuucucaggcaaugcaccgccagcccggcagacccagagaaguuagaguggggcccaggagggcuagggauuugccaagccauagugauggagggagagaagagccagggagggucacaguguuccaccuugccagcuggcugggguucgaggggacugagugggugggcaggaaugcuggggagaaagaaguaagcucaaaggaggggagguuccuguggaccaaaggagguuggagacugcaguauuagaagagauaaguugaaaugauaaaaguugguggccagagagagagggaugcuugaaauggagcucucaggagcagucagugcacuuuaauguugacugcaaagccaggggauggggacaggggugguagaggccguugacaaggguauugacacugccacggacggcaacaucaagaaugaagggaaaggcggugauccaggcaacaccauuaggaccaaagaguaaaaauugguaaaggauuauggauacuauguguuuaaaggaugaggguguuuggaagugacaauguacaguaagaaagacacucucccagcacagccaggacauugccacuucaaucccucaccaguguggagguaguggaggaaaacagcuucacuugaggggcauaggaagggcaauguuugcaggagacaaagaccucugcaggaagaggugaagggagcuuacuaaggugagaaugucagaaaguugcuaauggcaaugacuuugagaaagcacggggaaggguuugugaggaaggggccuauggggucaggugaugcguguguagaggaacauggggugagugucccugcagugagcguucccauggauguuagcuuugaaccgugcuuugcuuuguuuguauuuuaggucucugcccaucuuccacaacuuauaagcucuuugagggcugggacaauguguucuauuuuguaccaccugccuucucucugauaaugguuaccuuuuccuaugaucagaguuuagcuuaaagcugggaaguaucaaacagguggggucuuccuaguuaauaccuggaugcugagaaauuuccaauuuggcaacucugggcuuaccuguacagggcuggagaucugcucaaagggaccugucaucuuaggauacaaggccaggugaauaagaugccccuaugagcauagggaauuggaaggcaagcucaggaaaaggauaaacaauacaaaugaaucaaagagagugagacaaaaaaugaauucaaacgcagaauugcuuuguaaauaucgguagagcuggcaaacuaacuggucuaauccccaucccuugccccuuggcaauuuuaccagaaaaauggcggcuguagugaauuugccaucugcaaccacacugggcaaguagaaaggacuuguacuugcaagccaaacuacauuggagauggauuuaccugccgcggcagcauuuaucagguaacgcgagacauguuuccaucaaguaaacucuacuucccuaaaaaugccaagaauccagguagcuaaggaguauuuaagagcuuggugaaauguaaagcgcuauaaaaauaugaaaggcaauuuuacauaaaucagcaaugaaaagaaauuuugucuuccucugggaauucauuugaccugaggaagaguguaauguagggauuaagguggaccgacagcucuggagucagaaacacuuggguuugaauucaguucuccugguugguaaugugacuuugagcauauuaugucaccucucuguauaucaauuuuccaaucuguaaaagaaaauaauggugguacaaacugcaucagguuguuaaaauaagguaauaugugcaaaggacacagagugcucaauagcucaaccacauuaccauggcguggauugcagugugugcaugugugcgugugcaugugugcgugcacguguuaauguguguacacgugugugugcauguguguacgugugugugcuugugugugcaugcaggugcauaugugcauguguguaugcacgugugugugcauguguguguguacugagcauagugguugaggcaaggugauauuugcagcuuucuauuauaaaguaaauguucaguuauuuaaagagggacaaaaauguuccggcugaucaaauauuguuacuagaguaaccaaaucugccauaaaccuauaacugauuuuuuuuaaauauuugaaagucagaaaaugcucuuaaaguucagauacuucuggaaauggcugaaccuuucuuucauaaaucagauggcgauuccagaaagguuauagaauucacacuauguccacauagucauucugaacguuaauugucagccuacagaugaagcuccaaaaaggcccgguguuacagauuuccagcugaagggauggcagagaaaucaucccaugacaacccuguauuguucuaauauauauuucacaggcauuaagugaaacuacucuuuguuugcaggagcuucccaagaacccgaaaacuucccaguauuucuuccaguugcagguaggaaauauacaugucugucuagccauaagaguucagccuaggccaggugcaguggcucacaccuguaauuccaacacuuugggaggccaaggcgggcagauugccugagcucaggaguucgagaccagucuggggaacauggcaaaaccccgucucuuuuaaaaauacaaaaaagauuagcugggcaugguggcgcaggccuguagucccagcuacuuggaaacugaggcgugagaauugcuugaaccugugaggcagagguugcagugagcugagaucaugccacugcacuccagccuaggugacagagugagacacugucucaaaaauaaauaaagaguucagccucaagccaaauacaggauaaacugguggccucuagaguuggugaggguagaagaaagucugggacccuggauuucuagaauuuucuacauaagaauguaguacaugaaaagacucccaucacacugguagagaaaaaggugugacugggacagcuaguuaacacuugggguaaaaauuaaguuugaucuuucugcacaucauacaucugaaugagauucagauauaagaauaaaauauaaaaaacuaaaauaaaaucauaaaaauguaagaaauaagauuuuaauaaaaucauuaaaaacuagaagaaaauaugcucauaguaaccauaugaucuuagaauugcaagaagacaauuauaacaguuaaguauaucaacucacguuuuauguuuguauuauuauccuaaugauauaaaauacugauaugugcaagagacauuggaaaaaaauaccugaaaauaguaagagcugcuucuagguggugggacuagggaggcagcuauuauuuuuuucuuugugcuguauuuucaaaaucuuuaauacaauaaacguguuaauuuuauaaugagaagaaaaccacacacaauuucaacgacggagaaucuggguuucauuugaauccaagacugaaacagaggucuccucauccagucuuugcuucacccaggugccaucaucucugguauuaguuugagccccggcauguauugauguuaagugagugaugugugagccucaccuuucuucccacaggagcauuucgugaaagaucuggucggcccaggccccuucacuguuuuugcaccuuuaucugcagccuuugaugaggaagcucgggugagcaugagacugugggcagaagggggaggucugcggcuggaacauaguccuugggccucgcccuggaaccaagacuggagauguuucuaagcaggagcucugagaucagguggaacucaccagcaauagaaggggcugccucuuggcacagggaccccugucaggggaaacauucagguggauuugggguaaccacuggccagagacuuucuaaaggacauuccugaacaaaguaugagguuggagaagauuaacaauucucaagugauuuagaccuccuauagacaaaaaacaggggaguggagggagagaugcuggguuaaagagauuuaaauagauucuuuucuugcaggauuuaucagagccuuuacuguucuaauauucacgggggcucuucauacuggauugcccauucauaauaaugauggguaacauuuacugugaguguccaacacuguucugaguacccggcuuagaaugacucauuugguccucacaacaacccugugaguucugcugugauccucauuuuacagcugugaauacugagggaaguagcuuucccaagaucacaugacuagcaggggguggagcaaagacccaaaccugggcccguguacuuaaccacuguacacccagccucuccaugccuguauuuuggacaccagcaaagcagaggcacaaaaauaguuuuugaaagaacuugacacuuuauaauucaaaauaaaaagccauuaaaggaguuaugaaacaaugagaauuuugugggcuuuugauuauuuacuuuauguuaauauuguuugauuguuuguuuuugagacagggucuugcucugucacccaggcuggagugcagugccaugaucucggcucacugcagccucuaccuccuggguucaagugauucucaugccucagccuccggaguaguauuuuuaguagagaugguguuuuaccaugugggccaggcuggucucgaacuccuggccucaagugauccacccgccucggccucccagagugcugggauuacaggcaugagccacugcacccagccuuguuuguauuuugaauuccaaauggagauacgucaugaucuucccacuacuaaagguuuaaaucuggcacugauaccucuccaagagggcuauauacuaugcaguguuucccagcauguuucacaagaaaauucuuuuuugaggaucaucucacagaacuugggaucuuugcaacauguauugugaaauccaggccagaggaaccccauguuccuuccacacugauauuccacaauggaggcaagaaaggagcuagagucacuuccucccuuuugucugaacagccuccacucuauaauccugaccacaaagcuuacuucccagagucugggugggccgagagguguggaagagagaauggaggacaggagagccaaauggcacauugcagcaaaagacuccugccucuggcugaaacccucugaucuucuguuacagguuaaagacugggacaaauacgguuuaaugccccagguucuucgguaccauguggucgccugccaccagcugcuucuggaaaaccugaaauugaucucaaaugcuacuucccuccaaggagagccaauagucaucuccgucucucagguagaugccaguuauccuuagguccucucuccccuagaucauguccuuugcaggaaccuggauggagcuggaggccaucauccucagcaaacuaaugcaggaacagaaaacccaaugcugcauguccucacuuacaagugggagcuaaauaaugagaauucacggacacauagaggggaacaauacacacuggggccuaguggaggguggagagugggaggagggagaggaucaugaaaaauaacuaauagguacuaggcuuaauaccugggugaugaaauaaucucuacaacaaacccccaugacacaaguuuaccuguguagcaaaccugcauauguuccccugaacauaaaaguuguuugcuuuuuuuuuaaacaaaguaagugccuuauccuuagguccucuuucucuuuuuuuccuuaaaguaauauaagaaauaauaauaacauacguuaagugauuucuguaugcaggcacuuaguauuugauguguacuaacucauuuaaucugcaaaauacucccuugauauagacaguguuaauccuuaauuuccgaauaagaaaacugagcucagaaagguuaaguaacuuguccaaggucacacaaagagcaaauauuaaagccaggauuaaaacucaagggcaggccucuccaaguaguaaauagaacugcuuuugguagcauuagucagaagcugggaagguuugaaagcuuuugauccaagccacuugaccagacugguccagucccucccuacuacagagaaaaaaauggugacuguagaauuccuugcagaaggaaaaaagccaggggaggagguauagaacaaauauaaaagagaagccaauuuugagcugcuugcuuauuucacauuggagaaucauauugaaauuacuguuuuagaugauucuauguuauaauuaacuucuccaggugaaaguuacauuuuuaucucuguuuucacuuuauaaucauaauaaaaauacacucaaguauuaacuuggauauucaguuuuugcuccugauaauuugacacauugguaaagcauucugugagaagcaauuuugugucuauuucacuuugcacucauuucuuuuuuguuuuugguugauuucagagcacgguguauauaaacaauaaggcuaagaucauauccagugauaucaucaguacuaaugggauuguucauaucauagacaaauugcuaucucccaaaaauuugcuuaucacucccaaagacaacucuggaagaauucugguagguaaacucucuguuauguuuucagccuggagugacucaauacauuaucaucucuauucugauucgaagucaucauuuugaaacauuuucuuuuucugcuucaaucucaagcuauuauuaaaagccuaguaaacauuauucuuaguaagaaauaaauaaguaaaagacuaucuuaaauugauaaguggguuuuauauguuuuucuauagcauccacaaggacagguagucuuacauagguuuagaaaauggagaagauagauaaaauuaauucuggaguaaaauuccuucuaaauugacagaaaauguaauuuuaacuuuuauuuuuauuuauuaauauaggucaaggucuuccacagcagaacacagaauccacuacacuuagacaaaaaaaaguuucuugagauaguagauacaucaucaaaucucuggaaggguagagccuaauucggaugcuacacagcugggagcagagcagcccaaggaggucuacaaaggguagacaccuggcuaggugcaguggcucaaaccuguaaucccagcaauccgggaggccaagaugaacagauugcuugaguccaggaguucaagaccagccugggcaacauagugaaacccuguuucuacuaaaaauacaaaaaacuagccaggugugauggugcaugccuauaaucccagcuacuugggaggcugaggugggagaaucaccucaucccaggaucagaugcuugcagugagcugagggcagugaccugagaucaugcuacugcacucuagucugggcaaccagagugagauccugucuaaaaaaguuuuuuuuaauuaaacacacacacgaagggugaacaccuaaccugauaaccuuaccaccaacaccaggcuguucuggcuguccuggcugucacagcucugugacugccaccugucuccagccucaccaccuuggacacuagacacugggcuauagauguccccauugugcuugccagagggguugaucucccuucuagcagcugcugccaccucauauuauuucuuuccaccaagaagcuuugcacaagugcuucugcuuggaggaccuuauauaucacauugggguucuagcugcaagggagucugggaaaaaguagcgcuuagccuacuagucucuagaaugcagaaaagcguggucagaagagaguuggagcaggugcugaugagcccaucuauguauccgucagguuauguuaccuuuacuuuuuuucacuugagcucuuguuaaauuccucuuaaacuguauaaggaaaaguuucaugcccauucuuauuaucuuugcagcaaaaucuuacgacuuuggcaacaaacaauggcuacaucaaauuuagcaacuuaauacagguaaaaauuuaggggaaguugacucagaggauaaccugccuaaagaaguuuuguuuuguuuguuuuguuguuguuucuguuuuguuuugacauuggccagcuguugugggaucugcauggggaagucucaguuuucuggagagcaaagucauucucugccacucccuucuuagaauguuauauggcuuguugagcuauauaauguacauuggcugaguuagaaauugaggauuugaggcuggggagagggaaagaaauuggaauguggcaguaguguacuaggugcuucacaucuggaauuaucaacuccauuauaaagauggggaauuugcaugggagaguugggaacucuaugccugugaggcagguagaaauuaaaaccguaucuuucuggcaggcacaguggcucacaccuguaauuucagcacuuugggaggccaaagcagguggaucacuugaggucaggaguuugauaccagccuggcuaacauggugaaacucugucucuacuaaaaauacaaaaauuagcugggcaugauggcauucaccuguaguuccagcuacuuaggagggugaggcaggagaaucacuugaacccaggaagcagagguugcaguaagcugagaucgcaccacugcacuccagccggggugacagagugagacuccaucucaaaaacaaaaaagacauaucuuacugacuccagagauuguucccaugaauugaguagaaacuuccaguaugaacaaaagauugcagaggagaauagggaggagcaggccaagcaucuuucugaggcucccucuucccugauacucaacccugagcagucacuggggacuccagaauuugacuuucugauuugcuguccaagaaaauacaggucaggaugggcacaguuggcucaugccuguaauccuaguacuuugggaggccaaggcaggaggauugcuugagcccaggaguuugagaccagccugggcaacauggcgaaaccccaucucuacaaaaauaccaaaaugugcagagugugguggugcaugccaguagucccagcuacucaggagguugaggugggaggaucacuugaacccacgagguugaagcugcauugagcugugacugugcuacugcacuccagccggggcaacagagugagacccugucucaaaaauaagaaaaaaaauuguaggucagaaugguuggggugugaugggcuucuaguuucucuagcugcaucacccuugaaccauccagagucccaguaagccacgggcuugagcauggaggagaauccucagagacagaaccccugcccacaugucugggccuugcucaagccagcaaggggcugaaucccuguguuucaggacucagguuugcugagugucaucaccgaucccauccacaccccagucacucucuucuggcccaccgaccaagcccuccaugcccuaccugcugaacaacaggacuuccuguucaaccaagacaacaaggacaagcugaaggaguauuugaaguuucaugugauacgagaugccaagguauuuaguuuacaugcagacauaagugcaagaaugucccaggguggugauaaaauucagcaccaaggcauuguggccuaggaacugucagugugucccugucaccacuguaugcaggaagccacagcauccccugccccacuguguccuccucugacuggccgugguugauuggcuccugcaguauaccacauuugguucuguuccuuggaccugccaauuuuuuuuuuacuuuaaucaauacccaagagcaucauuccucucucuacugcagaucagcguuuccuccuuccuaguucuccuggcaaaauggcugcugaaaacaguucucaaguuuuuccagauggacucuuucucauccaauuccaaaauuucuaggcaaaugacugauugauccagcuucaaucaauuguggccccugaacugauuaacuguaucagagaagcacgaucauauagaaacuagcaugaucauauaggaacaugcaugaucacauaggaacauaugugauauaggaauaagcaugauauaggagcaagcacaaucauauaggaauaagcaugaucauauaggaacauacaugaucauauaggaacauauaugaucauauaggagcaagcaucaucauauaggagcaagcacgaucacagcagcaagcaugaucauaugagagcagcaugaucauauaggagcaagcacgaucauauaggagcaagcacaaucacauaggagcaaacaucauaaaggagcaagcaugaucacauaggagcaagcacgaucauaggggagcagcacagucauauaggagcaagcacgaccauauaggagcaagcaugaucauauaggaacaagcgcgaucauaugggagcaagcacgaucauaugggagcaagcaugaucacaugggagcaugcagucuuauaggagcaagcacgaucauauaggaguaagcaugaucauaugggagcaugcacagucucauaggagcaagcacgaucauauaggagcaagcacgaucauauaggagcaagcacgaucacauaggagcaaacaucauaaaggagcaagcaugaucacauaggagcaagcaagaucauauaggagcaagcacgaucauauaggaacaagcgcgaucauaugggagcaagcaugaucacaugggagcaugcacagucucauaggaacaagagcgaucauauaggagcaagcacaaucauaugggagcaagcaugaucacaugggagcaugcagucuuauaggagcaagcacgaucauacaggagcaagcaugaucauauaggagcaugcacagucucauaggaacaagcaugaucauaugggagcaaacaugaucauauaggagcaagcacaaucauauaggaacauggcagccauccugaguccucauccaggacucauguuucucuccaggaccaagucugcucaguucaagaaugccaaaugccccaacuuuaguucauccacagcaucuagauuaguuucccagggcugccaucacaaauuaccacaagcugggcagcuuaagccacagaagugguuuuuuuuuguaguaaacaguucuggaggugagaugucggagaugaaggagcuggcaagguuguuccuucuggaguuucugagggagaauuugcuccaugcuucucucuccgcuucugguggcuucuggaaauccuuggugcuccuggauuuguaguguaucccuccaaucugucucugccaucacaggacugucucucccuguguguuucugugccuucacguagcauuugccucuucuuucuuauaagaacaccauucaaacuagauuaagaguccacucuacuccaggauuaccucauccuaacuaguuacaucagcaaugaccucauuuccaaauaagaucauauucugaggaacugggggucaggacuucaacauaacucuuugaggggcacagugccacccauaacugcauccuaugucauuucccagccucacccacucauucuuucauuggcuucauacgcuaagacugcaucuucagagacucccaagcauagaugggagauggaagggugauugaaaccaguccaccuggucaacucuuucccucaagaaggaauuuccaaccucccagagagccccgauuauucuucccauugguuauaccuacggucauuuguaaagcuaaaguuauuauaacucguggaaaaauuugcaucugaauuugguuuuuugguaaagcuccuucgggccgucccuucuucggcccaaauuuggggcagucacguggugccaucacuccuacagguuuuagcuguggaucuucccacauccacugccuggaagacccugcaagguucagagcugagugugaaauguggagcuggcagggacaucgugaguaucaucaugaagggugggcagggagggguuaacacauucacagcaagcuauuccccaacaacugccccuucaaggagauguucauuuuuuccccuccauucauagcgggcucauuuuuuuucucacuaccuucagagguauuuuuccugagacugcgucauuggauaugaaaaaccugauaaauccuggccaacccaagcccuccuagcagguggcaggaagccucuuacacuguggagagcagcuuccaguugauuucauuuuuuguguagagcauuuuccaaugugagauacuuuccugaaacaggaaaguauacagucauuccuuucucuuccuucccagccccaccacugugaccucaccuccaacccucucuugucagucagggccagcucugggcuauacuuaccuagaucagccaacugagagguuugcaauuuuuaccuucccuggcuaguuccugaacaauucugucuuccuguaauuccauaugaugaaugggucuaaugggauuauuucaacugcauaucauggaaaagccaaaauccugugacuuaaauauauaaggauuuauucucuuucauaaaagaaaucuuuaguaugauggcucaguggagaggugccuucucuuucugcucugcagcacacgguucaagccucuaagguccagcaugguugcuggagcuccaggcaccaugucuacuuuccaggcagugggaaggaggaagggcaaaagggaugcaucucccaauugaguuaauucccuucaaggaggauuccaacaaguuccauacaacauucugcauacaucuuaugaccaguaucccuuugguauuugaauuagaauugcauugaauuuauaacugacuuugaagaguauucacaucuuuucauuccagcuucugguacguuaucccagugugcacucuugggauuguccugucucccuagaccaaaauagacaacuaucagagaaggauaguaagaaugcccucugcuuguucuguguguugauauagcuuucagagcacuuugcaauguauuauuuagucugaucuguauaacaacccuauauuagaaauccuuuacucuauuuaccuggugaaaaaaacaaugaaccucagagagguucagugacuugcccauagucacauaguacaugagugaacacgcaaggcuuuaaccacaguuuucugguguuccuuccacugagucacacuaucuccaucccauccauagaugcugggaguuaucuuguuuuccucucaaaagcuuucuaaaagcauuuuguauauuggaagaauaauguauccaucaacuuacuagcugggugaccucaggaaaggaagcccugagauuauugccagcauuaaaugaaauaauaucuccaaagcccaguugauuaugccugguacaugugaaaaaagaaauuaucauuacaaaguuaaagccugucacuuguacacccuggaaagaaagccaaaccgggcacuuugcuaggugcuggcacuaaauaaggagacucaguuacuacacacaaagagggcacaucagcgaaguucaucccuaaccacagcaaggucauccuugcuccaaccuaucacccacugcugacguuucuccuuugguagaggaagugaagcagaggguucaagggggcaggcuuugaggcugacugccugggugcaaaugcccacaccaccauucacugggcaagucauuuaaccucucacugccuuaguucccucgucuguaaauggguacuaauaauaauagcuacauccauagagacaccuuggauuuuuguaagaauuaaaagaauuagcacagguaaaggacuuagaacaguaucuggcacauaauacaagcuggguauuugauaaauauaugaauacaugggguuuuauuaaguucuuccugagucuugcaguuacuggccauguuacauggcugggaaagaagagaugugugaaagagauugacuguuucucucucucucucucucucucucucuuucucuuuuuuuuuuuuuuuuuucuuucuuagggugaccucuuucugaauggccaaaccugcagaauugugcagcgggagcucuuguuugaccuggguguggccuacggcauugacugucugcugauugaucccacccuggggggccgcugugacaccuuuacuacuuucgaugccucggucaguccuaaaaacaacaguguaguaagagaaccuuaagccaaagaauggcccucaugauccaguguggacccuguugugaaaccauuaagggccuguccucagcaagacuaggacccagaagaccugagggccaaaugauguaguucuuuagacucagaagcaacaggcaucuacuuagccccacacagccuggaauauucuuguuuauccacccaucuacucacccacucauucacucccuuaucauugagaaaacaguuuuuggauaccaaccauaugccaacugccauucguuuucaaacacaucccucuauucagucacucacucaugcauucaacaaauauuuguugaaugucugacagauuacaccauaugaaauugccauauuugacagucuggagccuaugaaaagggcaauuucacauagucagucuaauaugauaugccacucacaccucuauucacuuacccauugauucauucauuugacaauauugauugaacuucuaucccaggcccugcacugugugaggcauuuuuacauucacucauucauccauccagcaccuuuacugaguacuccccugaagccagccauuguguucaaugcuuagcuuaccccuacaauaauccaauaauaggaacaguuaucaucugcccuauuguguagauuuagaaacugagucucaaagagguaaagugacuuuacauggcaaaguuugucaccaguugauaucaguaccuggcauccccuaggaauuucaauaacuaucccaaauuuuuuggaucccagucagccaaaguaggagaugaaaccaguuguccuuucuacaacaggggucuucuuaauuuccaaauuauauuccacacauauuuuucauuuaaucauuuuuccucaucaaucuucugaagaucaaauagcaagaauuauuaucccuauuuauuauaaaacuaaggcucaaauaguauuugugauuggccaaaaguauaccauuuaacuuaaaauggaacuaacacuugcacccauaugucccacugcuaauagcauaugccuguaagacacugcccugguccagcucuguauaacagauuuucccuucagagaacaaaaccacggagcuaaugcccaagacagaucuucagaauuaucuguggcaaaguuaguguguguguguugauauucuuuguuguuguuguuguugucgucuugagauagggccuugcucugucauccaggcugggguucaguggugcaaucacagcucacugcagccuugaacuccugggcucaagugauccccucaacucagccuccaaagucgcugggacuacagguucaugugccaccaugccuggcuaauuuuuuuuuuuuuuuacaguuggagucuugcuguguugccuaggcuggucucaaacuucucgccucaagcaaucuuucugccuuggccucccaaagugcuaggauuacaggugucagccaccaugccuggccuguuuucauauucuugaucauagccagagucuuaagauuaguuaagcccuuaauccauccagguauuaaucaggaacauuuccuuguguuuucugauauucuugguuuucaaguguuucuuuucuugcauacuagggggagugugggagcugugucaauacucccagcugcccaagguggaguaaaccaaagguaauuaagacugcagugauaauguuuggagagccauaggucuguuucauuaucagaccugugugugugugugugugugugugugugugugugugugugugugugcccgugcacguauguugcauaaauguaauuuaugucauucuuucaacaacaaagccaaugggguaagauagauauucucagcccaggcaaccugucaacccauguucuaggaccugucuagaaaagucaugggaugguagaccuagaaggacuuagaagauaauuaugauuauaaaaauagcugcauuuuguuggcugcucuccaugucccaggcucugugcugagccuuuauauacucauuacucuaucccucuuuauaauacucauaggaagcuauuauuaccuacacuuuacuuaugagaaaaaugggucucagagaggguaagcaaucagcccaaggcuacacagcuaguaaggagcaaugcuaggaugaaaguccagagagcaauggagaguaauguuuaagucaaugaaauuuggaguccacagguauggggucaaauuccauaaucuuugacaaaucuuaugaccuaucagguuugccucuguaaaauggagcuaauaauggacucucugugcagcuauuaggaaaaguaaauuuuaaaaauguggguacacugaagugccuggcacauaguaagugcucauuaaaugcuguuuuguauuacuuauuccaaagucaagcucuuucuagucuacuaguaaaaccuauaacaaaaauaucucuacaaaacaaaaucuaacucauacccucccugccuacaauuugggagccuugccccacaccccuuccaugacagcaagcuaccuccuucccacucccuccccaggcaaccaugccacuugcagagcacucuaagggucugaaaguucuuccccuugagacuggggagaaaucuucccauggacccuagaucuacucccuccccuaucugcguguuucuguugacucccauaggaaaaauaucaccuuggaaaaaaaaaguuggcucacacuggaagucccauuuuuuauuugggcaguaccuaagaccuccaugagggcacagacuagagccccagagcccuagucccugcagugguaagugaagggaugguccacucucuucccuuagggugugaagcagaagugucucuacaaccugcccuucaagaggaaccuggaaggcugccgggagcggugcagccuggugauacagauccccaggugcugcaagggcuacuucgggcgagacugucagggugagggugccucuuccccccucgcaacucuaaaagugguaauaugcuccugcucguuguccagucuuugaauguaccaaaauuauagggggaugggggaaacacugcuaauaaugauucccagaccccagaacucugaagaguuguguaucauuccuucuacuuuggcauauuuuuuuuaucgaguugagauccugcugugcauauauuguaauugugugucugcuuuuucccuugacauuacagcauagacauuuauuauggugcuaaauacaccguauuucauuuuugaugcugugcaacaugauuuccaugauauugauaagcauguuuaaagacuuugaugugacucucccuuggcaggugauguacugacacaguauguaugggccauaauuuccugagcgcaccccugucccugguagaggauguauagcauuggcucccucuguuaccucaucaggaaagggcuccuugccaaagcacauuugggcccauucugaaaccccuguguuaacuucuagccaacaauacaucaacaggugcacguaacaaaugccucaaaagcacuaucugcuacauguuguucuaaguaggcacauuuauugaguuuuauugagugcuuuuucccauacauaucaaaacauuuaaucugggcaacaaccccuagggaguagguuccauuguugucuuccccuccccacugacuuuuuuugagagagggucucacucuguuacccaggcuggaguacaguggcaggaccacagcucacuacagucucaacccucugggcucaagugaucuucucaccucagccucucaaguagcugggacuacaggcacaugccacaagacucagcuaauuuuuuuguauuuuucauaggcuggguuuucgccauguugcccaggcuggucucaaacuccugagcucaagcaguccauccaucuuggccucccaaagugcuaggauuacaggcgugagccgccgugccuggccuguugaccccauuuuguaaaugagaaaacagaggcacagagaggacaagaaguaaacccaaggucccacuggucugucuucagcagcugugauuuuuacuagcaugcauacuccauucaucauaaucucacugagaauacucuggguugagagcccccaugaccacccagcuccacccuccaucacuaaaguguggaccauucaugaaaaucaguaucauucuaauauuuguucagugcuuuauauuuucaaaauguucucaguuauaaugccucauuugaucuucacaauaacaacauggguauaggucaagcagacacuguaucaucauuauuaucaucaucauuuagaucuaagaaaacaaaagcucagagcaaguucauuacucaacccagauauccucaaauccagugcacaaacccccaaauacagugcacaguucaguguaucacccugccaagacagaaucauaucagauaccauaaaguucaugucccauaggccagugacgugccuuaaauauccacugacacugaaggcgauggucccucugggcuaacagaagucagaugccacagcacauuuacaaaggugcugagcugcucuggcuuugggagacuguugagucacugcuguuucaucucuuccagccugcccuggaggaccagaugccccguguaauaaccggggugucugccuugaucaguacucggccaccggagaguguaaaugcaacaccggcuucaaugggacggcgugugagaugugcuggccggggagauucgggccugauugucugcguauguggcgccgcuucuccgugcuagagcuuguuuuuugacugugugcucccuguccuuguucaugccaucugccugaccuggaggcauccuuuuguccuuucucucagccacaccccuccaaucugccugcccuauguguuuauuuccuccuuggaugcauucccaguuuccaaugaaaaagcuucgccucuagaagugaaacuuguccccagcagccacuaaggcaagauguggcugaacaauguucauucgaucauucaaccaauguggauuuacuaaguccuuacuaauagugaaugcugacauugauuaagugccuacuaugugccaggcacaaauguuuuacaauucaauccucuuaaccacccuuugagauagguacuguuauuaucugcaaguagcagaugaagaaaccaagguacaaagagcuuaagugauuugcucaagagccagcaauuuuuuuuucuuuuuuuuuuuuuuuugagacagaguuucgcucuuguugcccaggcuggagugcaauggcgcaaucucagcucacugcaaccucugccucccagguucaagugauucuccagccucagucuccugaguagcugggauuacaggcgcccgccaccacacccggcuaauuuuauauuuuuaguagagacaggguuucuccauguuggucaggcuggucucaaacucccgaccucaggugauccacccgccucagccucccaacagugcugggauuacaggugugagccacugugcccggcugaauauuucuaaugucuagggauuugugguuuagggacugacagggacaaaauuccagcucucaaaaggcuuacagacacaaauuuuucuaaaaaauaguuauaaaggauauaaaagcaaagaagcagguagaagggugaagaaugaaaggagacauuguuuuagaagacaccucacauagggaauauuugaguagagaccuaacagacgcaaggggaccaagcaugagguaugaagagcaggccaaucaaacuuucggcagugcgggaaagacuccaugacuccacuggccaguaugguagccacuaggcacauguggcuaucgagcacccaaaacguguggcugaggaagcaaauguuuaauuaaauuuaaauagccacgcguagauaguggacagugcagaccagaggaacagcuuuccuccaggugagaugagcaagugcaaaggcccugggacagaagccagcuugguguguacagaacagcaagaagaccaggguggcugagcggagugggcaaagaggaggaagagaggaagagaaugcaaucugaaggucaccaggggccagaucuucuuggccaaugaaaagucuuuagcucuaugugugacaggaggccagcaaaggguugugaacagagggauguugugaagagauuagaaaggauggcucuggggaggguaucuguaggagaacaggcacagaagcagggccccuuggagaaaauaaugcaacaacccaggccagcgcuaauggugacuugcacuaguacgguagugcuggagguggugagaggugguggaauugguacauauuuuuuaauguuacuuuuuuuuuuugagacaaaaucucacucuaucacccaggcugaaauacaguggcgggauuauggcucacugcagccucaaccuccugggcucaagcaauccucccaccucagccuucugaguaguuaggacuacaggcacaugccaccauacccaaauaauuuuuuauuuuuuaaauuuuuuguagagauugagucucccuauguuccccagacuggucucaaacuccuggccucaagcaauccuccugcuucagccucccaaagcacugggauuacaggcaugauccacugcaccuggccacaauuuuacuuuuuuuuuuuuuuuuuuuuuuuaagacagggucucacucuguuacccagacugguauacaguggugugaucacagcuuacuguagccucaacaucuugggcucaagcaguccucccaucccagccucccaaguagcugggacuaaaggcguguaccacgacaucuggcuaauuuuuguuuguuguuguuguuuuguagauacgggguugcaccauguugcccaggcuggucuugaccgggccucaagcaauccucccaccucagccgcccaaagugccgggauuacagacaugagccaccacacccagccaaaauuuuacuuuuaaauagauuucuccaucaggaagccccagaugagaugaucucccuaaauguucauugcguaccccaugauacucucuacugugauuauaacauucaucucacuuauaauuauaugaucaacagcugggcacucugagacuguaagccccaugagaacagggaccuucucuauuauguuuuucccuguaaccuuaucgcuuagcagugccuggccugugauagucccugaauaaguuauuuuuuagauguuucaaugaaugaaugaaugacugugacauaagcauggugccucccacaacugaaaaugcauagcaaacaaggggucagggagcugguugauugggucucaaccccugaugacugaccauauccuaauuuguuuacagccuguggcugcucagaccacggacagugcgaugauggcaucacgggcuccgggcagugccucugugaaacgggguggacaggccccucgugugacacucaggcaggucagucaugggaguggucagcugcuggcagcccagggcugcaguggacacugccaagagcauacaagugagguugggagucugagugacaucugaaaaaagugacaaagcagguccaugugguaaaagauaauucagaucuguagccccgggccucaggaggauggagacuugcaguaaaacuagaugaaaagauuuaacucaaaccuaugaaacuagcaugucauccuguaugauuauaggacccaccucaagcacagaaucccagguucaagcaaggacugugccuugucuuggugauuuuggggcccagauggguacugacacagaggcugagugguuucauggaaaucacuuugaaggcccgagaccagggucugaccccugguucugcuacuuacuagaugaauggccuuagagaaccacacucucugagccuugacuugcuuauccuuaaaaagaacuccaugcuacacauucugcaacgcaaggauugcuggcagggucagcgagcaugguuuugaaguucccaguguacgcagaugcucaaaacaagcagcugccauuaucacacucaucauuuauaaucauugccauagcucgauccuuacuagguggucaguuuucugaugucuccuuuauacucgaagcccuguguucugguagaucugaaaugugcugguugaauuauccaugugaaugacugucauuuaauccucccuggggucacagggcauggcgaggcccuaccugugggcuuuagcaaccugaaguuucauggguugcagcaguauggcuaacuugaguuccuccucccuguuccuucugccuccucccuccuccccuaagcacuacauggccuccugcugccugcaugcacuguaaccccagccaauaccaaagcuccaggcuucucccuagcucaguggugcccucagaaggccauggaauuucuccuccaauuuaaccauauccaucgggaaccccuguccuuagagccagagagcuaaucugccaaguucauuccugcuaauaaguuuugugguauaaaguuuuaauugauagccccuaaagaacauuuuuucucauauaaaucucaaugacauugcagagaucaugucuuacuauaaaagaguaauucuagaaucccagaaucuccaaggcuagaaaagaccuuagcaaaucaccccaucuuccugcuguacaggggcacuuaugaacacaguggucguccagagagagucuuggaaagucuccuuagauggguuuuaacucuucacaccauggguacagaaugaaaguggccccuuucuuugcaguuuugccugcaguguguacgccuccuuguucugcucaugccaccuguaaggagaacaacacgugugaguguaaccuggauuaugaaggugacggaaucacaugcacagguaagccaccuuugugcacaggugaaauagcagcauggugugggagaggagcaggacuugcucacagugccugggcuucauccuagcccuccuuccugucugggccacuucagcagcaccuacccucucuaugacucaguuucuuuaaugggugugcucaugcuugaucugcucacccucuaggucaggguuucaaaauuguuuugcaaacugggaugcacuuuacuuuagaauguuuuucuuucuuuuuuuuuuuuuuuuuuuuuuccgagauggacuuucacgcuuguugcccaggcuggagugcaauggugcaaucuuggcucacugcaaccuccgcuucccagguucaagcaauucuccugccucagccucccaaguagcugggauuacaggcaugcgccaccgcaccuggcuaacuuuagaguguuuuucuaacucuacaaguaauccagccuucaaaaaaaaaucagaaaauacacaacaccauuuuuuuaaguuaaaccuaaacauacucucaccacuaggugagaaccacugugaacacugcaauaucccucuauaguaguuaggauauagguucagccauacagaggcccaaaugaacaguggcauaaauaaggcagauguuuccuauugucucauauaacagguuggaaguauucagggcuaauacaguuucacucugaaagcucauuuugggggcugaacuccuuuucugaacuccuuuuaucuuguggcucugccaucguucacucaccucaccugagguggccaauaccauaagcccagccuggacagcaagauggaaggagaggaaggaggcaaaccuccuucccuuuaagaaugcaaacuaggaauuguuaaaaaucacaucugcucccaucccauuggcuggaaucucaucauuggucaugccuagcuacaagggaaccugggaaaugucgucuuuuauugggcaaccaugaacccaccugaaaaucuauuauuacagaaaaaaagagacuaggcugggagcaauggcucacaccuguaauucuagcacuuugggaggccggggugggcagaucacuugaggucaggaguuugaaaccagccuggccaacauggugaaaccccaucucuacuaaaucuacaaaaauuagccgggcauggugacaggugccuguaaucccagcuacuugggaggcugaggcaggagaaucaccugaacccaggaggcagagguugcagugagcugagaucaggccacucuacucuagccugggcaacagaacaagacucugucuccaaaaaaaaaaaaaaaaaaagggaagaagaagaagaaaacagagacuagguauugaggaaaaaucagcagucucagccacauguacuuucuaauauuuuucauggauaaauauucacagagauauauacuuucuuuacacaaauuagaucuugcuauaccuguucuuuauucagcuacaaggcauuccagaagugagucagcauucaacaauggcaacaaagaccuagauucucuuuucccacccucccauccuuagaaugagucuucuuguccuuguauuuauucuuccagggucucaaguggcugcauaaaugcagauggcuuuucagcuacuccugaggcuggagcuaaucuaucguugggucgauauuugggggaucauaaaaacaaagguucuaagaggcagcacagugaggaaagcauggauuuuuggaggcaaaccaaccuggguuuaaaucuucagccaggccacauuuuagcuguuuuagcuuugucaggucaguuaagcugagucucaguuuguucaucuacagaauggggacaacaaugucuaucucacagggugcucaauauuguacuaacucuacaccacacacacacacacacacauacacacacacacacacacacacacacacacacacacacacacacacacacacacuguccuaacauuaaaaauccaaauuuauucugaaaacugauaccaaagucaagccuggagguauaugacaaagggggcagaagcggacagaugucaucaggcugcaucuaugagggugucacaaaaauauucauguugcaaaggccagcacagaggccacagggcauggagagagaagcacgaacacgcaggggcccauuuacucacccaacaccacuagugcuguggugccccauacccugaccugaagcccuaguuccacagaaggugguaaguugagcccucucuccucugcucuugcaguuguggauuucugcaaacaggacaacgggggcugugcaaagguggccagaugcucccagaagggcacgaaggucuccugcagcugccagaagggauacaaaggggacgggcacagcugcacagagauagaccccugugcagacggccuuaacggagggugucacgagcacgccaccuguaagaugacaggcccggugagucgcucuuucccagggaaauuugggagcagcgccgugggcuucgcuccuccuugccuuuccaccucccauacucugcuuaucuccuggacucuuccuaaacauuuuuucuagcacagucuguuucuuguuaaaagucauugggcuaaaugcaagguaguccccuaggcagaaaaaggacguccauggaaaacugguuaaauucuuaaguguauugcuuaguuaacaguaauguaccaacauuaauuucuuagcucugacuaaugugcuauaguuauguuggacaucaggggaaaguggguagagaguauaggagaguuugcucuuuggccacccuucuaucuaucuaaaauuauccuaaauaaaaggcuuauuaaaacaaaaagcuggccgggcacgguggcucacgccuguaaucccaguacuuugggaggccgaggcagauggaucacgaggucaggagaucaagaccauccuggcuaacacggugaaaccccaugucuacuaaaaaaaugcaaaaaaaaaaaaaaauuagccgggcaugguggcgggcaccuguagucccagcuacucgggaggcugaggcaggagaauggcaugaacacaggaggcggagcuugcagugagccgagaucgugccacugcacuccagccugggugacagagcaagacucugucucacaaaaaaaaaaaaaaaaaaaaaaaaaaaaaaagcugguaagauguggcaggaaaagugccgaaaagaugaugcaagauaauguccguuccugguuauaaaggugguucuagagucagauugcuuuugcaucuuaccuccuggacugacaagcugugugaccuggagguggcuaauuacucucugagccccaguuuucucauuuguaaagugggccucauaauaaugcagacaucauagaguuguuguggggauuaaaggagaucauucauugauucaaccaguggucauugugcaccuacuaugugcucuugcaggucccaggguuacaacaaaaagacagagucccugcuuuccuggugcuugugcacaaguagagagagggggcaaugcacuguacagaaacaaaugcauggaauuuuuucagagagcacaaggagcccugugaagaacauaaaucaggccaaugugauagaagggaauggaaaagcuacuuauguaggguggucagggaggcugucucugaggaagucacauuugaacugagauguaaaggaugagguuucaucauaagccugcauaaaagcaggacguagcaguuauucccacuggacaggaaaggcacguucucuugguccaucugaacaccuccuaggcuggacauuggucccaugggcacuugggcauccugggguccuagagaaggaacuuuuucaucucuucccacucucccuccacagggcaagcacaagugugaguguaaaagucacuaugucggagaugggcugaacugugagccggagcagcugcccauugaccgcugcuuacaggacaaugggcagugccaugcagacgccaaaugugucgaccuccacuuccaggguuagugugaccagggccuauggcccaaagcacccuccucuucaggccuggggaagggacccucaagggaaagaagaaaaacaaaacaggccaagccugguggcucaagccuguaaucccaauacuuugggaggccaaggcagauggaucacuugaggucaggaguuggagaccagcccggccaacauggcaaaaccccaucucuacuaaaaauacaaaaaaucagccgguuguggcagugcgcgccuguaaucccagcuacuugggaggcugaggaaagcgaaaagccacauagaagugcagaggcaugggcaauaggacaucuugaaacccaacggaggaagccagaaaggacccacaaacauaguuccuagccaaggcagagggacuucagugguucagaaagugacucagggcacugcacuuuauggcuaaucaguauguacuggaucucuccaggguuggguuuguuugacagauguggucucugguggagacuuccuggaggcuugaauugggcuagaggagcuagcaagccauuucugcuggccaggacagcauggccaggagagaaugaucaagggucagcugagaaggaugaagccaugaggaagacacaugaaggcugugacccccuaguggcagggucuguacugaggagugagaugagguugaaagaacuaacaauggacacagaauagagaaaaggaaaggcucagccaugacauaaaguuuccauccugagaccaaaugcagugguggugcuggguuaaagcagcuggggagggaaggugacgagagguuugaaagcuugguuggggauauucuauggucuagguacaggggcacuuccaagcagaaagauuuuaugggcaguugcuacuuagcauggggauaaaaaugcacagcugggaccagcugauuuggaaguuauuugccccugggacugugaagucaagaagagcuuggcuuuuucuuuaggacacaguucauucagccugucccaccuguucccaaagcccacuuccaaguggaaaucuacccagaccauagagugugguccagcuucucccaugggcuuuucucuucuguuuucuuaugaaugccaagaaaauguuggcagugauacuaagugacugugcaucacguuggaccucccuucuguuggagcugugugguuaccauuagcuugggagaaugccccagcuuucccuauaggcacaguuacagaaccaucccacauucaggaggaagcgccugcccucacacaguucauaggagggcaaacugccuucaugauuugcagccgauuugguaaugugugcagcagacagccuuaaaauaacucauacugagaccugaugguuccguuuccaggaccccauccuacagaaauaaucugagaauugaaaaaagauaagcauacccaucccaccauuauuuaacaucacagaaaauuagaaauaacauauauaucuaauaguaaaugaugauaaaauauauugauauacaucuacucaaauucauuguaagguauuuuguugucucaauaaagagacaaggaacacuuuuccauacuucuccaagcuguuaaauugguguuugcauuucagauauggccaagaucauuugacuuacgcacugugcuacugaaauauguucaaacgagaaaaacuuagucuucuuugguguagaaaguaucauuuuuguggcauuauacaaugaacuugacaauauaaaaaugugacuugcuucuugaacuauugcuggugucugcacugaauuguuugguuaggaaagguaucagcuaugaaccaaugauaaaaaucuuccaguaucuuagggggaaaugaauuuuuaaaacuuuuuuaaaaagcacagcaggggucagaaaacacacagcccugggcagaaacucacuuuaauguguuuuuuauagcuguaaaggucacaacaaauuuuucaauuauaaauauggggaggaggagaaaaucauguuaccagagaaauuuuauaauuuugggauauaauuaugauuuaauguuguuuuaaaaagauuuaugaaaacuacaucggcaguaugcuaccacauuuagaguauauauaacaugaauaaauaggaaagaagauugaaagaaugucaaauuauaucaaauuaaaaauuuaccaaaaaauaaaguaaaauucuagaaggaaaugcaccaaaauguuagccauggaguaaugauuauuucuggagaauagaauuguaggugguuuuugcuuauguuuuuacuuuucuguauugcccuaauuucuacaaugaacauaugcuaguuuuauaguuagaaaagaaauauuuuaaaugauguacuucaacauaacuugaagggaaaguggcuucuggagacacccugggguauagcuggccuucauuuugaaaguccuucagaguccauuguuggaaacacugccaaccuggugggcugaccugggcgauuccuccucuuccucauccagauaccacuguugggguguuccaucuacgcuccccacugggccaguauaagcugaccuuugacaaagccagagaggccugugccaacgaagcugcgaccauggcaaccuacaaccagcucuccuaugcccagaaggugggucuucaguuagcagauucugugcagacagagucugcaggggcggaagugcagcccuuucuuaagauggggaagacuugagcuguugccuucaagcaagggagugcagguagcuccuggaacaaugcuaacagucaccauguccauuuauugggcaucuauuaugugucagggacugugcaggguacuucguggauauuauuguucauccuuacaacaucucugaaggcagagcagguguuacuuacuauucccauuuuacagauagggaaacugaggcuuagaaaguuuaaguacagugccugaugucacccagccaagagguggcagauccaauauuuaaggguagaccugacucuuaaaagucuauuucaaccaugacauucaacugccaaggcagaaguggagacuggaagugcaucccucacagcuggaaaccagaaagacagcaauacccacgagccuaggguggaucuccccgaacccacaaaacaguggaguuucccuggaauagcuggggcucucucuggcuggagggacugugaaaagaaaaaagagacugcacaagcuuucagauauggcaggaaggaaacggagcucuuugaucaggugcugcucucuuaaccucuaaaacuagaaguccuacccauuuggaaaagcuagcagguuggaguuccaggcuggugguuuaucacugggagcagaggagaugaaugccuaguacguaugauuuuaaagccccuucuccaaccuccaucacuaacaaaucucuacuuuuucagaccugguauuccuuuaccaaggaauaaagccuuugaugccaggacccagacucaaggagaaucugaaucucugcucuccugcuugcuggucauguggccuugauaucaagccacuaaaaucucugacuuaccuggaauguuuguggaaggacuaaauguaauauggcacacaguaggaacucaauuuuuaagauuauuaaaagaucuggaauaguagaccaccuggguuugaaugccaguugccagcugugugacuuugagcaaguuacuucucuuugccucaauuuucucaauuguauaaggauuuaaaacguucccaccucauaggguugauugagaguuaaagguguugacacaugaaaaacucuugcaagagaaccugaccccagauaagcucccaauaagucuuaugaugaugauggugguuguggugauuaugauaauggugguggugaugauggggaggaugacaauaauuauaauaacgaugagagcaaugaugauauuaugaugaagaauuagaguucuaggccaggcguggugacucacgccuguaaucccagcacuuugggagccagaggcggguggaucacuugaggucaggaguuuaagaccagccugaucauggagaaacccaaucucuacuaaaauacaaaaauuagcugcacaugguggugcacaccuguaauccuagcuacccaggagguugagacaggagaauugcuuaaacuugggaaauggagguugcaaugagccaagaucaugccacugcccuuuagccugggugacagagcaagacuccaccucaaaaaaaaaaaaaaaauuugaguucuaucaucagaguucuaccaacccauuagcagaaaaauuugcaccuaguaucaauggaugacagcaaauucuuucucaagagcagagagaagagaaaugaguaugaaagaccugggcaccuacaagaaagagaggacacuuuuguucacccaguggcucaaucaaucagucaacaucuaaugaccaccuacugugugccaggcacagaggugcaauaggcaaagugagacuuuauggguuuuauggccuaauaggggaaucagacauuaaccaagugaugccacaacacaugaacuugcagcugacccauggcccugucuguaucccugcaggccaaguaccaccugugcucagcaggcuggcuggagaccgggcggguugccuaccccacagccuucgccucccagaacuguggcucuggugugguugggauaguggacuauggaccuagacccaacaagagugaaaugugggaugucuucugcuaucggaugaaagguaaccgccccagcuacacuucagguucugggccacacagcugcugagcaauccucagccuggccagucacuccccaagcagaagcagugcagcccuggccccugccuuacuugugugggacccugugugccucugcccuccagaugugaacugcaccugcaaggugggcuaugugggagauggcuucucaugcagugggaaccugcugcagguccugauguccuuccccucacucacaaacuuccugacgguauguaccaugucugcuugguuugccucaggcagggagggguugccucaaagcagguauuagaggggugaggccuuaagcugaaggccacagucacaguuaagagcaugggugcuggaccaccuugccugaaucuaaagccuaguuuugccacucacuuguaaaaccuuaaagaaguuacuuuccucucugggacucaauuuccucaucuauaaaauggagaugguaguagcaucaaccauguagggucauugugaucauuaaaugaguuaauaguugugaagcauuuagaccuguggucuguacauggaaaauucuauguucuugugagcugguauuaucaucucuguuuguauguggaacaguuuaagagcauggucuacacaaaugagacacucuuuaauccucuucauggauguaguuagcuaagccugccuggugaucacccagugagccaaauuaacauggagucaauuugcgucuugcacugcacuuaaagucacgucaauauucuacaagucauauccagcgaagagaaagccucaucuggagaaagguuuggugcugacugaucaaagaacugaccuaacaguaauaaugacaacaacaguaauaacagcuaacauuucuugagcauuuaagaggacauuucauucaagccauagaauguaaguuccauaagggaaaggauuuucuuugccuugaccaccauugucuccccaaacccucagauagcagguggcacaugacaggugcuccauaaauacuuguuagaaggacuaaauccuccugcaacuguauaaggccacuucuauauccacguuuuagaugaagaaacugaggcuuagcaaggccaaggacacagccuaacucaucagagcugggcucaaucucagacugccugguuccagccucccccucaugcuuucgaguacggaacaaggacagccugggccacuguuccgaguagaaucuacagucagugaccgcaggaggaaagggcacugagcaugaguauagggcuuguaggauccauguggaaguuagaccaaggaccccaaaauggagucucuguccacagaccaaagauauccaucucacugguguaaaaaucaggaccaccauuaaauacacuagagaugaacacccacacuaaucuuucugcugugugggagccuggcuuacaacagcauuucaaagaaaagacggugucagaacaaaacauuuucagcaaauuaccuaccuucucugggccucaguagcccagaaggagggaaaauauauauauauauauauauauauauauauauauaaaauauauauauuaaaguauguaaauauauauuuuaaaaauuauauauuuauauauauuuuguuuguuuguuuucuuaagagagucuuguuguguugcccaggcuggaguacaguggcaugaucucggcucauggcagccucaaccuccugggcucaagggcuccucccaccccagccuccagagcagcugggacuacaggcacacaccaccacacuggcuaauuuuuuaacuuuuuguagagauggacucuuacuauguugcccaggcuggucucaaacuccugugcucaagcugcucucucaccucagccucccaaagugcugggauuauaggugugagccaccacacccagccugaucagugaauauuuagcacuuaccaugugcuugagauauaucagugaacaagcaagcaaacaauaaauggaacaaacacgucaauaguauugagugcuagaagaugauagauccagauccuauggaaaaaguggagcagggcuuggggggcaccccagggucccccuucugucugaagugaugggggaaggcuuuggggagaaagugacauguaagcaaaguguaaacaggggagagggagugagccaugcagacuuaggggaagaacauuccaggcagaaggaacaguccaacaaaggaugagcagcaggagcgugccaggcaagucugaggaagagcagggaggccccauauggcuggaacagagugagcaagagaggacaagcuaggccuggggucagagaugcaacagcagccacaugcuuugggccucgugagcuguuaugaagacuuggacuguuccucugagugaaguggggggccacugcaggauuuugagaagacucgagauuugaugcaccuuucaaagggcugcucaagcagccacguggaggaugggcugugacguggcugugucuuaaaccauaggauucacugaggaaaggaaaaguccucaaacucucccacggcgcaggcagaagacacagcaaaggagcagcaggcugaguuggcucacaccaugaauauucacagaugggugaugcccugggaccuucuucagccacccaggucccugcacaccagggcuggccccucugaugacuuccuucuucuccccaggaagugcuggccuauuccaacagcucagcucgaggccgugcauuucuagaacaccugacugaccuguccauccgcggcacccucuuugugccacagaacagugggcugggggagaaugaggugaguugagucccuggugccuuugcuuuagacuagcauguuaucuaucaccacaacaaugcugugucacaaauuaccugaaaacucaguggcuacacauuuauuuagcucacagaucaucugcagaucaguuggccacucccuuggucuuggcacacucgggucugagaccagcugucagcugcucuagcugggccaucaauggcucugcuccauggaacucucaucguccaacaggcuagcccaggcgaguucucagggcaauggcagggagugagagaggcgagaguaggcccugucccaacagugcuuucucaagccucuguuuggucacauuugcuaaugugccccuggccugauaggucacaugacugagcccaaagucagcauggggggcaaagggccaggggugcagggaguggggaagaaccagggccacugaugcaaucuguguuccacaccaaccuucuucauaucacggcacacagaggauuggcgguauuuauucaauucacgcacagguggcugaccugaggcuccgacagccccaccagccaccugagggcugaggaaagcaauaccucugccuaccucaagacaccgcuggaaagcucugcucuagacaauacaaaugacauucaaucccccauccuagcuauagguggccucuggcagagcccagacaaccagaagccuaagaaaaccuugacauuuccugaucuccacauggaggcaggaaagccuaggccaugagaagcaauuuucuucgucauccccaucauuaaaaagacaaaauauugcuuggccuuugaagagcauucuguguuucuccuuuuuucucagaccuugucugggcgggacaucgagcaccaccucgccaaugucagcauguuuuucuacaaugaccuugucaauggcaccacccugcaaacgaggcugggaagcaagcugcucaucacugccagccaggacccacuccaaccgguacaaagucuucugggcuucuugggggaacgggagauaaugcaugcaaaguuccuggcauacaguaggugcuuaauagauggcaacuauuaugcaaacauaaacucuaaaccugcagauaggggacgguguuaacugcccacuacagcauaccacacugacaauugggcagccccuaccccuugggaaauagggcagccucagaagcugguuauggggaaggauaaugaacccauuuuaaagcugauucuccgccuucauuuuggucagcuugucagacuauuccaggcauuaacaugagcuccaaagucaaaugaccccaguaugaaucccaguucugccacuugcuaacuguaaggacuuaaacaaguuauccagcuucccugugucucaauuuccccaucugaaaaaucaggaugauggugaugguggugaugaugauacaggucauuauuuucaugauugugauacaagggagggaaaacuuauucuacccucuuagggucuguggcugggccugagaauuaaauagacauacgauaaauaggagagaagcauacacauuuuauuuaaucuuuuaugugaaucaagggaacccucauauggagaauagagacccaaagaacaguugggaucaagagcuuauuuacuuuuuaaagaaaugauacauuuguggaaaauugaucaaauaaagagcuuuaggcuaagggcaguaaauuguggcaugacuaagaaauagaugguggauaugaguggaagauaaggaguauuucaguagauuuguuuguacagauccauuucgucaucuacucccagucuccaguaaggauguucuucucuucuggaacagaaggggcacuuucucaugggaaauuguauuaccugcuuuuagggagacagcaggucagggaacccuuccugcaacugccguuucucaagugacuucugcucaaaauaacuaauaaugccacaaugguguguggggggugguuuuuuguuguuuuuuagacagucucucgcucugucacccaggcuggagcacaguggcacaaucucgguucacugcaaccucccccuccuggauucaagcgauccuccugccucagccucccgcguagcugggacuacaggugcccgccaccacacucagcugauuuuuguauuuuuaauagagaugggguuuugccauguuggccaggcuggucuugaacuccuggcuucaagugacaugccugccucggccuuccaaagugcuaggaucacaggggugagcuaccaugcccagcccaaaaugguguuauuuuggggugacauguccuaagccccuucaguguggaugauggugaugauacugauggagaugaccguggggguagcgguggagguggugauaaccaugaugucggauucagguucugagacaugcagagaguagugccugacagguagcaagugcuuaauaaauauugguuuuaaauauuuaucucauuaaaugauuucuauuuaagagcaguuuagacuagugucucucaaaauuuaaugugcauuugaaucugcuggagauuuguuaaaaugaagacgugauucagcaggggagaaggcacagggccucagcuucugcccacacaagccaggaaaucacacugggacaucacuuaaaauacagcuuuucuaacaguguggugcgauguucagugcauggacgcagcguccacaggcaugggguuugcuacuuccugggugaucugggucaggccacuuuccuucugaucacucaucugucagacaaguggguuggacaaaugacccauaagguucucugcagcccucagaucagcuuguuggcacaggacaauuaauguguucugggcuguccagagggugaggagaaguccugggcugccuaucaguggagacaaaccugaaacaugggcucaggggccuugggaaaauugaacaacuucccuccauggagggcugcccacucggagaguaaaagccaucaacccucuucucauuucccuagacggagaccagguuuguugauggaagagccauucugcagugggacaucuuugccuccaaugggaucauucaugucauuuccaggccuuuaaaagcacccccugcccccguggugaguaucuagggucccugauaacgggccaggaggagccccggugcccacucaccaacaggcaaaccauuaccagaagcccuguccuccucccucuuccuccagagacuggaggagccuccagccuccaaccuccaagguagcuggccaggaccgcccaacccugcuuccugccauccccacucccaagcauuagcaacacagcaccagucaccauuaauaucuguugaaugaaagggggaggaugggccaccaaaggaagcgcuggaaggggagugagaaauccuaagcuaugguuuggccccuccacuucguagcaucucugagucccaauuuucucaucugcaaaauggggcucauaaugccucccuccuggguuuugggaaggauuguaaguuagaaauggaaaacacuuagaacagccccugacacacaguacaugcuauauaaaaguuggugauggugguuguuaguauucuuuuuugcaaaagcaugaggggagaggugagcugcuggagaguuccacagcauagugguuaagcacagaagcuccaaagccagacuggguucaaagcccacuuccaccacugacuggcugugugauaucgggcaagugcuucaccucucugugccccaguucucccacaauaauaacucucccuaucucuuuggguuauuaucacacuucaauggguuauuucacagaaggguauuagacccuggcaguaauaagggccagauacauguuaacaugucaguauuuuuauccccacuggcuccagaaugccucgggccaccaaggguuccccuuuuggggagucagaaguuuuaagaaugggccccuuuccuuucuuuguguucagaccuugacccacacuggcuugggagcagggaucuucuuugccaucauccuggugacuggggcuguugccuuggcugcuuacuccuacuuucggauaaaccggagaacaaucggcuuccagcauuuugagguaagagagaaaaaugggaacaugaugaugggguccucuccaaaaacccagucccuggaccugggcugcuucagucgguggcugcgccagaguccucacccagaagcagugugucacacaguagcaggggcggccacccaccccacgcuuacugcugcuuggauggggucccugcucuuaagaggaacagcaguggugguuccaagccccuccuucuggcugagacagggcuuggcaaggagagaacccacccugagccucugugccagggguuuggccuggaggcacauucacuaggaccuaggagucuuguuuaccuuggaggauucacugcacaagcacaccccaugaccuagcuugggcuucaagaccggcucugagaacugggggacagggcuagggacccuacacagccagaggcuuuaugcugcagccagugacacucauuucuauuugaacaguugaguccacaucccaaucagcagccagcucuugacuggcuguguaagaauauggccggggcagcagcacagcgguugagcaucuuuccuuauggacuuuguccuccucucuggcccacccucuccucaaaacacuccugguaaaggcuguggugcagagcccccaagcagcaguuugcugccuucuggcagacagcuuguauauuuauaagcuccagggaaaaucucaaaauccccauuuuuagcaaaaguguauaggcuguaugacugcauuuauauuaaguuaaaggauaggcaacaccacuucagggugaugggagucagaacagcaguuacccuggguggcaggcaccagcaggcuaagagcaugugaacacauccugggguauggaaaugcccuaugugccgauuugguggugaucacaaaugggcagacaucgguaagaugucacugagcugaaucuaaagguugguaaauuuuauuauaugugaaucaucucucaacaaaguacuguuaaaaaaggaaaagcucccagaggcaaaggguggcuugcuuuaccugccaacuuggcugagacgcuccugcuuuggggaugcuccuggcuuucaugcuugucuuuccaaacagucggaagaggacauuaauguugcagcucuuggcaagcagcagccugagaauaucucgaaccccuuguaugagagcacaaccucagcucccccagaaccuuccuacgaccccuucacggugaguuugcauucuuaucuaggaauagguucccuugggguacaggggaaugaugucuuuuaggaaauuucaguggagaucuuuguaccaaagaagguucauuucuagaauguaugucagguaacaagccuaaaagccaguuuugcaagcugacugaagccagugugguugcucagaguuccuggguucucuuggguagacagcagaauccuugaacaaacagagacaggcgagaacaagagguuguuauccaagcccaaucucaugaccaggugagaugccacagugaaaaaaagucuugggcugaauucugcugcaaucauuuaugagguagcaggugcaaaacaagauggaaaaaggauuuuuccuuuagauguccuuuuuuuuuuuucuuugagauggagucucacucugucacccaggcuggagugcaguggcacgaucucggcucauugcaaccucugccucccgaguagcugggauuacaggcgcauaccaccaugcccagcuaacuuuguauuguuaauacagacaggguuucuccauguuggucaggcuggucucgaacucccaaccucaggugauacgcccaccucggccucccaaagugcugggauuacaggcgugagccacugcaucuggccuuagauguccuuuaaacuuacuuacacugacauuguuguccaagauuuuacugcuuguugucagagcugcugcuuucuugcuuuuggagcuacuuuucuuugaugaggccuuauaguauauauggguggguguucugcucuggucuuucagaaggggaccauuuaucucuagagucagugaugcuuuagcuuagcuggggccuccacugacaucaauccagggggaccccuuggcaggguaccccauacauaacacauguggaaguacauccugccuguaguuuaauaccaguucucgacugaaaaaaauacauaggaauagaacuuaauuuuucuuuuuauaaaaggagagaaauguuuucuuccaccauguugaaguuuguauaguguaacagauauuauuuuuccaaaguaaaucaagguaaauaucuugugguucuucaugccugugguaacagauuuaauauaaaugcaauagacugaaaaauaaccagauugcaaaucauauuuuuuuaaucaaacccauguaaaggcuucugguucacauuucaaggguaaguucgggccgggugcaguggcucaugcguguaaucccagcacuuucggaggccaaggcagguggaucaccugaggucaagaguucaagaccagccuggccaacauggugaaaucccaugucuacuaaauuaggcaggagcgguggugccugccuguaaucccagcuacacgggaggcugaggcaacagaaucgcuugaacugggaggcggagguugcagugagcagagauugcaccacugcacuccagcuugggcagcagagcaagacucugucucaaaaaaaaaaaaaaaaaaaaaaaaagggaggugguaaguucagcuaaauuacauuuguuaacuaaguacuguuaugcugaaaucaccuucauuuaaaaagcagaaacaaaugcauacauccucuccaaugcaccccaugccuucccuguugucuguccccuucugagggcucuaucagcaccaugcaugaaagauuuaccugaggcaggugagaaaguagccuaaaugcaggauucagcuaaaccuacuauucagacuacauggcaaaaacauuccagaauccuaagcauaagguaccagcuuacaaagugacgugcuacauucucacgccuuugacacuauuuuuagugacuccagacacauuuaccaccacuaguuuuacccaugaaaagccauuucuagcaucuauuaugcuaauugacaaagccugggugccagucagagcuaaagucagcagaaggcuuggcauggccaccucuagaguguggccuuuuuuaggcaggguccuggugugucacgcaggcuggagugcagcggcaccaucagggcucacugcaagccucaggugauccucccaccucagccucccgaguagcugggccuacaggcaugugccaccuaauuuuuguauuuuuuguagagauaagguuucaccguguugcucaggcugaucucgaacuccugagcucaagugauccgccugccucagccucccgaagugcugggauuacaggcgcgagccaccaugcccggcugagcgggguuucuauuacacucucucaggcacucaagagccaccacugguucaagaugaauuuucaaaccgaaaggaguuuuuauaauauuauuagccaccuuuugugaggugcuuauaccuugcuaaauguaggcucuaauuuaauccuccuaccucccugugagguauauuaugacccuuuguagaugaagaaacugcagccgaguugggaugauuugucuugggccacccagcuucaagcaggagagacuaaaacagguggcccuacccccagcccauccugccucccaacacaaggcagcagcacaaacaaacacgcccagcacauacguguucacagugcucagggagagucaugccucagaccaguggccaccagaaagauucaacuaggacucaacacacagaaugcccugcccccuuacaacccucucuuuuccaggacucugaagaacggcagcuugagggcaaugaccccuugaggacacugugagggccuggacgggagaugccagccaucacucacugccaccugggccaucaacugugaauucucagcaccaguugccuuuuaggaacguaaaguccuuuaagcacucagaagccauaccucaucucucuggcugaucuggggguuguuucugugggugagagauguguugcugugcccacccaguacagcuuccuccucugacccuuuggcucuucuuccuuuguacucuucagcuggcaccugcuccauucugcccuacaugauggguaacugugaucuuucuucccuguuagauuguaagccuccgucuuuguaucccagccccuagcccagugccugacacaggaacugugcacaauaaagguuuauggaacagaaacaaagucaa

SEQ ID NO: 192187 - RNA, 72957 nt, Homo sapiens
ggugaugcugcagccaagauggcgcccgcggcggccguggcggccugagcgugaugcuccggguucucggcggcggcuguggccuuggccggggccuugggucucucccggucgugagcgaucagcgccucuccgccggccgggcuagccgggacagagaggagacggccacgaagagaggaggcagugagcaacaggacgagaccgcggcgucuccagccucgguaccauggccgggaucaucaagaaacaaaucuugaagcaccucuccaggucagugagcgccucggugucggcgccagucggccuccaccccagcccgcacuggagucagccugcggcuucgggggcggcggcgccuggcggcugugcgggaggcgaccuucggacuuccccgcucuggccggggcagaggucgcggccccggaucucuugucgccggcggcgccgggggcuggccucacgaaucggccccugacgcgucuucucccagggugggcgcgcggaggagcccggagugcggagcgcggcgggcugggaucgcucccggcgcggcgucugggggcgucccggcucggcucugugcgguacugagcggaggcuggagguggccuggcgucacccaagugccugguuaaugugcugggcucuaacucgaguucggugcuccuuccccuuggagcagagcgguuccguuaaccgagggcuucuggcgcaguguggacgcucaguggaggcuguguucucaguggaacguuaaccuugugauuguucugaauuccucccaccuuggcguucccgcucuguggcaucagagggugugccuguuugcacaguuaggauuuguuuuagguaaauaagcagaguucgcagcuuuggcagguucuuucuggaguccuaugagacccacaucauuauuacugaacauuuuuuuuuuuugguuuuugcucuuuuuccucugcaacucuaaaauucagggaguuaacaucuguggugauuaaacccaagacaugucauucucuccauuucauaacgcgguuuuagucagaaacaugacucaguaaggcuggcaguuuguuacugcucuuggcuucuccguguuugucucaagacacaggcuaaauguaggcucuuguuccaaguuguuaccagcgaacucaaagcccuugguuaggaucccuuucuguucgauuuguaaguuaauuuuaacuaauuuugggaagacacggguaugauuauagacuuguauaguaaacauaauucuugauuccccagauugucuuauaccacagguuauauauugggaacagaauucuacuucugugauucagcaaauauuuuccucacuuauaauacugaauaagauauagcacuuuucuuaaaaguagcaaaguauagcagcguguguguguguguguacauauauauacauauguacauauauacauauacauauauacacauauauacacauacauauauauguguacuacauauauauguguauacacuacacauauauauguguauauauguaguauuuuuuuaguagagacuggguuucaccaggccaggcuggucuugaacucccaaccucaggugauccgcgguccucggccucccagagugcugggauuacaggugugagcccccacgcccugcaugaauauguauuucuuaauguuaucacucauugaaaaguuucuuuuaaaauuauauauauggcccaaucuugaacuaucuuauuuuggaagguuuuaucuauuuuuaauuuauguccucccgccuuucucauacccagcuccacaagaaaauacagaucugcagaaaaugauuugaaugccuacuuucucacucguccaaggaugaugcugcauagcuaguaccacucuagaugcuuggaagaaaaguuaauucaaucaacagauagugcauuagaguuuaauucuuuuauagaacuccauuugagaggggcucuuaaaaauuaagagcaugcauaccaaaguauaauaaaaaaaauuaagaacaaagauguaauggcuuacugcaugagauagaaaacacccauauauugaaaauugagucuuuagggcuaguuuuuauuuuauuuuauauauauauauauauauauauauuuuuuuuuuuuuuuuuuuuuuuuuugagacagagucucacucuguuucccagacuggagugcaauggcaugaucucggcucacggcagccucugccuccuggcuucaaucaguucuccugccucagccucccgaguagcugggauuacaggcaugcgccaccacgccuggcuaauuuuguauuuuuaguagagacaggguuuuuccauggugguuaggcuggucucaaacucccaaccucaggugauccgccugccuuggccucccaaagugcugggauuacaggugugagccaccgugccuggcccuuaggguuaguuucuaaaucuguaugauuuguaauagcugugugauaaauagugugaugaggauuuuuuuuuuuuucagagaugaguuuuugggacacuugaguuuucaguuauuucauauuucaaaacauccuuaacucaggugacuaaagaguaucaaauuuuuauuuuugguuaauaaguuaaucuuacugcuaauugcugucaucuccuaagaaaaauaguuauucagaaaucuaaaggcagcucguaauugacaaaagaaggcagguguugugauaaauuauaguuacucaggaaggaaugaacuuuugaaauuaccugguucaaguuuaauuuuauagaauauccaguaaugaagaugucacuacauugaccuaguggucugggauacaguagaauauaguuuaccaggaaauaguugaacauacuaguuucuaauacuagacaucaugugaggccuguguaugcaacccauugcaccuucucaaaggugaccuuuccugaccacagaguuuaaaauugugagcccccauauugccaguccucuugcuugcauuauuuuucuccauagcacucaugcuugucugucguacauauuuauuucuuuauguauuuuugucuuucuccacuuaaauguagacucuaugagagcagggauuuuugucuugaggcuggcauaaaguagguacucaacaacuauuuguugcaugaauguggauacauaacaugaaugagcuuacuuucucuuacauugcuuuuuuuuacugaggcaagacuacugccaauauucuuauagauuugggaaugaccaguuucccuguggcuuuaggaggcagugaguaauugaaucauuaaauaaauguggugccuuuggauccuggaaaauaacuaggaaaaugaccuaguucuuacagggguuuauaugaggggucuuccgguaaggaaauaacccaguuauuguauggggggaggaguucugccaguaaggaggaagacugugaaccaacaugagaaagagcucucauuuuuagccuugagguugaaauauagugcaguugcaagauuaaaaccaucuuugccuggaugaagggacuugagaagcugguauguugggaaaguauggaagaggaauuguucuuaagagauuaacagauucuuuaacucaaugcuaaacuauuugagaacuguaaaucuauauacuuguuccuugccuaauuguuaguuuguauuccaaacaucucuccaguuguuaauaaaaaguuuaucuacuugaagaaucugaaaugaggacaaggagguguguuggugggaugggggagcuuagaguagugacauuuuuccagagugaaacaggaaaagcuuuugaaggagaaacugccccgauuuuucaaacuguaauaggacugaauguauuuugggaggguuuucuaggagaguaguuuuucacaugggaauggaaacuucuaaagagaagucguaacaaaugugagaaaggaaauaaaagcagaagcuaccuuucagcucaagacauuaguguguguguguguguguguauguguauguguauacacauguacacaccugugaacaggcgcuugcaaaucggcaaaguggacguauauuuaauuaagccaggaccugaaaagggguagggaaguuuuggauacagacacucucuucuccuucgcucccuuaggcuaagggcauacugugcucugcacaagguuuccugggagugggaguugacugggcagacauucaccucaccucgguggagucaucguauaguuuaaagcagcaguugucaaccagggucaguuugucuugaggugacauuuggcagugucuggagauauuuuuaauugucaagacuuggaggggaggguaauacuacugccaucuagugaauagaggccagggaugcugcuagacguucuacauugcacagcauauucccucacaacaaauaauuauuugcccaaaugucaguaguuccgagauugagaaaccagcuuaaaguguacaggugugugucguaugauugagcuaggguucugugcuaguaaaguuguuuugccugcaaacaucagaaagcugaucuauuuaaguaaaaagggaaauguaacagaaagcagaagaauaucugaacaaccaaaucaaggaaagaacaggaaccagcuagcuccuagaaucucauuggaagaguucuuggaccuuccucuuaaaguagcagcaggguuuuuuaaccuuggcaucauuggcauuuugaaauagauaguucuuuguugugaaggcuguucugugcauuguaggauguuuaaugucuccagacauugccaaaugucucauaggaggcaaaauuacuccugguugggagcuacagcuuuagagugcuggccuaucuuccauaauucccagucuuugaucucuccugucagguuucagaauccccuagagagaaagccuuugugacccaguuuugucuacccaugguucaauuagcaauggcaaaggguuguacagcaaaaauaugguaauggagagggcuauuuugaguuaggcuuguugcuccauuagucaucuguaauaggcagugcacuaaauuagauuuccaagggccucauuugcuacauuaaggaaauugaacuuuauccugggggugaggagugacuacuaauaaagguaagagggauaugcucauuaaagcagucuuauuuuugaagucuaggguuuaggagcaauaucugggguggaaauacggagucuacaaauggacucugaguaacuuaaguagaaaauggggccaggugugguggcucaugccuguaauccaagcacuuugggaggccaagucaggcagaucacuugagcccagcaguuugagaucagucugggaaacaugaugaaaacucugucucuaccccaaauacaaaaauuagccagucucauaaccuggucucaaaaaagaaaaaaagaauauucauuauggacauucagaaggguuaaacacaugcaggauuuggugccugaauggcaaagugaugagagggauuagagugccucacuuuguguugaugggauuggccacuagauugaggauauauaaggaaggggaggagagggcgguagcugauagccuggagagaaaaggaaagaaccgucaaaggauugggaaugcuaucuagguggaaaaguaauggaguaaaggaaugagauaauuggaaggguuggagauuuugucugaaacugucacauugaaguuuaagauuuuagaagugaaguagaucugguuuaggaaaagcuaucugaggcugggcgccguggcuuaugccuauaauccuaccacuuugggaggcugaggcggguggaucaccugaggucgggaguucgagaccagucugaccaacacggugaaacccugucucuacuaaaaaugcaaaauuagcugggugugguggcccaugccuguaaucccagcuacucgggaggcugagacaggagaauugcuugagcccgggagguggaaguugcagugagcugagaucgggccauugcacuccagccugggcaacaagagcgaaacuccaucucaaaaaaaauaaaaaaaaagaaaaaaaagaaaagaaaagcuaucugauauggccauagaagugaguugcugaagaaaaguuaaggugcauauaauuggagaucaauacugcuaggucuaaaaucuuuccaguacugaccauuccuaaaaggaaaugcaguguagcuuauuuagucugccagacauuauuuuuucaaaugcuaacuucacaucauuacugauaggcuaauauuuguaucauaaacuuuuaugguaaagcucaguaaauaauuuuugagaguuuauguauuuaacguuuuugagcacauauauauauaugccacauagugggcauuagagauacaaagaugaguaagacauggcuucaguuugugggaagcuucagcgauuccuauucuaauauaagaagcaugaguaggaucacuaacuguaaccuauuucuaaauuggacuacuugucuggcauugcgggugaugugaaaaaggaagaaaaaaauaaaaaaaauuuuauugcuauaugaaauuuguuagauuuugcaacuaggaaaaaaacugauuuaaauauuguuuuuuggauuauaaauuuacuugaguagguuugagguguuuuuuuuuuuuuuugagacagagucucgcuauguugcccaggcuggaguacaauggagcaaucucagcucacugcaaccucugccuccuggguucaagcaauacuccugcccuagccuccugaguagcugggauuacagacaugcaccaccacacccagcuaauuuuuguauuuuuaguagagacgggguuucaccauguuggccaggcuguucucgaacuccugaccuugugauccacccacuuuggccucccaaagugcugggauuacaggcaugagccaccgugccuggcugacaguauucacuuuuaaauaaucucuaauaauguggauuuugacacuguauguacuaguugcuuauuuaaaauaauuuaaugagugccugccuuguaccaaauauuguaccauacugcuggggauguagcaguuaacacacuaggcaaagaucccugcccucguggaguuuacguuuuaaucagaaacagauaguaaguacauaaauaggugaaauacuguguaaguacaguauaucaguguguuaaaugcuacugaaaaaguaacauagggaaaggggaugagaaguacaauaaauuggggauggaguuugcaauuuuaaaucuggugauugggaaggcuuaauugacaaagcaauauuugaggccggguguggugucucaccuguaaucccagcacuuugggaggcugaggcgggcagaucacuucaggccaggaguuugagaccagccuggccaacauggugaaauccugucuguacuaaaaauaccaaaauuggccgagcgugguggugcgcaccuguagucucagcuacuagagaggcugagaugggagaauugcuugagcccaggaggcagagguugcagugaacugugauagcaccacuacacuccagccugcagagugagacccugucucaaaaaaaaaagaaagaaagaaaaaaaagaaagcaauauuugagaagagaccugagagagauagugggaacaaaugcaaaggguccagaacugggaacuuguuugauauuuugaaaacauacgaagaccaccaauauagguggagagaguaaagugagaagaggaagaugcgaucaaagagaaaacaagggccagaucaugugggaccuuguagugacuuugacuuuuacucugagauuggaagccacuggaaugccuugagccaaggaucacucuggcagccaugugggaauuaaauaauagaagcacaagggcagaaacaggaacccaauuaagagauguuaacuauuuaggugagagagaaauuggauugaacgaaggcagaugcaguggaguuguugagauagugauagucagguucuagguguauuuugaagguaaaggcaggauugaccgacagguaagauguggauugauagagaagagaggagagcaguaaugggugaccauccagaguuuuugacauaagcaacauaagcaauggaaaagguggaauugcuauuaacuaaaucggaaaauuggagaagacugcaggaggagcaggcuuaugggagaagaucaggaguuuguuuuggauauguuaaguuggaugaaaguucgauuuuuuuuuuuuuuugagacagagucucguucuguugcccaggcuggagugcaguggcacaaucucagcucacugcaaccccugccuucuggguucaagugauucuccugccucagccucccgaguggcuggaauuacaggcagccgccaccauguuuggcuaauuuuuuuuuacauuuuuuauuuuuaguagagaugagguuuuaucauguuggccaggcuggucucaaacuccugaccucaagugauccaccugccucagcuucccaaagugcuugggauuacaggccugagccacugcgcccagcccaaauguuagauauuuaauuggagaugucuucucuuuuauuugugaucuaauuuagacuauacauguuuuagucugacaacaauggaaguauguuugugguuauccuuuggcuuaugcaauaaacaauuacugggaagcgaauugugaguugaauuuucagggguggauuuuuugcuauuguuguuuuuuuuuauccuuuuaaguacaugcacuacaguaguccuccuccaugggcagcacacuucaagacccccaguggaugccugaaacugcagauaguacugaacgauauguauauuguguuuuuuucuuuauguacaucccucugguaaaguuuaauuuauaaauuagucauggucagagauuaacaaaaacuaauauguaauagaaaaauuguaacaauaucuguauauuguaauaaaaguuauaugaaugugaucucucucuuucucaagcuaucguacuguaccacagguaacugagaccguggaaagggaaaucuuggguaagggaggacuacuguauauagcaggugucuuucucuuucauauuaauuuccaacuaaaaccggauacugauucuuguugggugcuuggucuaggagauguugcaauauuagcauacuagaauccuggaaucagaagggauuuguuccuaucucagagaaggaaauuauuaaaacauugacauuugugacuuguccaaggucucacagauaguguugaaugguaaagucacugauccaguacccuuuucauugauuuuucugugcugccuauuaagguguuuccuacucgcccccaccccaccucaacaguuugcuuuucuuuuuacccaguuuucaacacuacucuuguuuuaccauccugcuguaguaucccuuaggagauucuuuuaugacuugagaaucauuugacucugcgguccuuugaaguuagaggaacauaauguuuugacucagcauuucuugaaaguugggggaugucucaggccauuuuauguugcuauaaaagauuauggggcuggguaauuuauuuuaaaagacagguuuuauuuguuuauuuauuuauuuauuuuuuugagacacagucucacucuguuacccaggcuggagugcaguggugugaucucggcucacugcaagcuccgccucccggguucaugccauucuccugccucagccucccgaguagcugggacuacaggcacccaccaccacccccagcuaaauuuuuuuauuuuuguagagacaggguuucaccguguuagccaggauggucuccaucuccugaccucgugaucugccugccuuggccucugaaagugcugggauuacagaugugagccaccacgcccggccuauuuauuuauuuuugagacagaguuuacucuguugcucaggcuggagaauaguggcacaaucucagcucacuguaaccuccaccucucaggcuuaagcaauucuuaugccucagccuccggaguagcugggauuacagucaugugccaccacgccuggcuaauuuuuguauuuuuaguagagaugggguuucaccguguuggcuaggcuggucucaagacuccuggccucaagugauccaccugccuuggccucccaaagugcugggauuacaggcgugagucaccacacccggccaaaaaauagguuuauuuauaaagaaaagagguuuauuuagcucgugguucuacuggcugagaaguucaagggcauggugcuggcuuccagauagggcuuuuaugcugcaugacaacauaguggagaagguaaggggaaguggacacuuaaagagggcagagccugagggaugucuuggcuuuauaacaaccuacgcacgugagaacuacuuuauuuucugugagaacuuacuacugcaagaacaauaccaagccauuuaugaagaaucugcccccaugacccaaacacuuccuaccuacuaggcgccaccucccaacacugucacauucgggaucagauuucaacaugaauuuugguggggacaaauaaaccauauugagacucuagcgggaaaacauaaugucuuuuuuucuuuucuuuuuuugaauaauuuuccuuuuuugcaguauuacacuuugcuuuaguacugcaguuuaaacacuuuuuaaauaaguugaucucuuaucaauuacauguguuuuaaauucugcauauuguaugcuuaggacaaauaauuuuuuuaacaguggguguggcugggcacggugguucacgccuguaaucccagcacuuugggaggccaaggcggguagaucaccugaggucaggaguucgagaccagccuggccaauauggugaaaccccaucucuacuuaaaaauacaaaaaauuagccgggcaugguggcgcaugccuguagucccagcuacucaagaggcugaggcaggagaauugcuugagcccaggaggcggagguugcagugagcugagauugugccccuggacuccagccugggcaacagugagacuccaccucaaaaacaaaacaaaacaguggguauuaguggcuggaguuuaguuugaauguaaguuacaaguaaaagacuuuugguuauuuucauaagugaaaaucgaguaguuauauuaaaaucaaguuauucaaauaaaauugaagccagugugauucaggauauaauuuauuguuugguuuuucagacauuauauucacuaauaguuugauugacaguuuauugacuuauuuuaagauuauucccagccaagaugaauguuguguauaaacuuugaauuuccauauuagucauaaacuagguugaauuugaacuuuaugcauauuuacuauuuuucuacccaaaaauacuacuaagaaagagaucuggcuucuuuuuaccacuaccaguauagcaucaaauguuuuccuuuacuguugucuauuuguaaaucuuuaaaaaauuuuuuaaauaaauuaaaaauauauauauuuuaaaacuuuaaauuaauuaauuuuuuuuuuuuuugagacagggucuugcucugucacccaggcuggagugcaguggcaugauuacagcucacugcagccucaacuucccaggcucuagcaauccucccacuucagccuccugaguaguggggaccacaggugugcaccaccuugccuggugaauuauuguauuuuugguagagaugggauuuugccauguugcccaggcuaaccucaaacucuuguauuugggaauaaacuucaugauaccagaaaauucagugauuuuaagauauggcaaaaaacucuuucucucucucucucucucucucucucucucucucucucucucucucucucucccucccucucucucucucucuauauauauauauguauguauguauguauguauguauguauuuuuuugagauagaguuucauucuuguugcccaggcauggagcgaucucagcucacugcaaccuccacccccuggguuaaaaugauucuccugccucagccucucaaguagcugggauuacaggugcuugccaccaugcccagccaguauuuuuguuuguuugguuuuaguagagacaggguuucaccauuuugaccaggcuggucucaaacuccugaccucaggugauccgccugccuuggccucccaaagugcugggauuacaggcaugagccaccgcgcccagccccaacuuguuacuuuugcugugcugcaacuuuauauauaacugaaaugcacuauaaagaggggcauccauaaaauguaagauuuaucuuauuuuuaaagaauauagguauuacugaguaugauuuugauuaucucuuuugguagauuguucauuccuaccaguacuuaaggaagguucuguaaaauauacaaauaaaauuaagauauaggaaugucuucuggaaacagucugguagaugagugaauaaauagaauucaagauaaugaaucuuaugagagagucacaagcaaaacgcuaugcaaccuuaacagagagacggugaaacagagguggucugaaugucagaaaagcuuguaaagaaauaaugaaaugaggccggguguggugggucacaccuguaauccuagcacuuugggaggccaaggcgggcgcaucacuugaggucaggaguucaagaccagccuggccaacauggugaaaccccguuucugcuaaaaauacaaaacaauuagcuggguguaguggcgcaugccuguaaucccagauacucaggaggcugaggcaggagaaucacuugaaccaggaaguggaggcuucagugaaccgagaucgugccacacugcacucuagccugggcaacagaguuagacuccaucccaagggggggaagaaaaaggacauaaaugacagcuugagaguaauaaaauaguuauuaaaucuauuuuccuggacuagagcguguauacaaaggaaauauuuaaggcaaauauccagagaaguuaaggguaauuuuuuagguccuccaaauuuggcugcaauuuuaauuuccaauauuacaguuuucuccuuuuuuuccacccauguuuuguugucuuauuccugcagccagauugucuguaucucuucauaauaggccuucuucucucagcuuuauuuuaguaguacauuuuccaugggcagcuuuaaugaggcuaaucauuggccuccuccauuuuaaaacuccuuuaggucuuaaagcauauccuguuuguuuuauuaaaacaaaugccuuguuuuuuguuaauuguguggauagucaucucuuuaagggcagaaucgcccuggcaauguuuuagaagccagggacuuugcuugucuuguucaccguuguaucuuuagcauccgccacaggacugcaguacauaguaguuguucaaaaacauuuuuaacugacuggagaaauaaauuuguacuacuuuggccuccauagaauacauagaacauaaauugguugcucugaauacauuuuuggcagguuuaacuaguugaaucauauccggaaaauuuagauuaaaagcuuuucuccccccacuaugaauacuauaguuuuccaauuuauuuuugaguauauagauauggccuauugcuggauaucucuuugguuuguggauuguuuuuuauggcuagcuuuaugccucaguauucucggugaaaugagaauuacaguuaaaaguggggguuuugucacuuaaaccaguuugauaaucuguauguguagacugcuugcuuuguagauugcuuaucuuaauugauuucauuuaauguaaauuauacaguucagcuuuuguauaacuucuaugacauaguaucucauuuuuguuaauugacaguuuaauauaaaauuaaaaagauaaugugaauguaauuggggaguaguaguaacagugacagagaaaaugaagaaaaucuuaaaugguuaauucaucuuagaauuuaggcaguuugccuuuagugaauccagugugaaaugcaacuguuuuuuuuuuccaaagggcaccacagcuaaauuuuuuuaaucaucauuccuuuccucuuccuucccuuaaacuugcucccuucuguguccccuguguacccauucccugcagcguucccugcuggcugugguggagauuggugugcugugaauugcauaaucacccaaaugaguaccagaggagucuaagaaacccuggcaacugacugcuugcuuucaccaggaauagggaccuuuuucugaauuuccugcccucagguaauacuucuauuccccaugcuuuuuuuuuuuuuucauucuauaaaugcaagcacuuaauaugcccugcauaaagauacuuugagaauauuuucuuacuguuuuagucagauaccuauuucauuuucuuuacuauguagcuagaggcucauguaauuccucucugagugucuucucuuucuuuuuuuugagacugagucucgcccuguagucagugucuuuucuaauagauaagguuuggcaacauacuuaaaguuauaaccaucucuuccugauguugcaagagaguuuuguaacuuccugccagcuguuuggaaauaguaguuagcauuugaucuacuuuuaaaugaauggguaaggcuucuuagucuaauguaauuagugagguacaaagucuccuuugauaaagaggcuguuuugaauaauucauucaucauugagggauuuaagaauuuauuuuguguauuuaaugauaguuaucuuuaucaaagagauugaaauaagucucacaaacagcagugcaaaugggauucuuuuuuuguuuuuugaagugguaggggugguggggggaaaagguguugcucuguugcccaggcuagagugcaguagugcagucacagcucauuauaaccucaaacuccugguccccaguuauccuccugcuucagccaccagaguagcugggacuacaggcauguaccccaugccuggcugaguuuuuaaauuuuuauagagaugaagucucacuauguugcccaggcuggucucagagcuccugggcucaagcaguccccccaccuaggccucccaaagugcuaggauuacagguaugcaccagcaugcucugccaggauucauuuuugaagaauuuaaggguuuuacagcauucucuucuacccucuccugucuuuuuaaaaauuucauuaucagggaaagcaauuauguuauaaaaccagguuauuggaaauggugcugaauuucuuucaauuuaggacucaaugaaaaaccuagaaacucauaucacugaauacuucuaauucuugggaaauuuauccacauaaauacuuugaacuuccaaaagucuuguaauaaauuguuaauuaaaugccacaaguagaauugugcaacuuauuacauacuuaccuaagaguaauggacaaaugagaaacuuauuggcuauaugcuaaagcaauuguauaggccuaguggccuaaauauuguuuuacguucuugccugcauugauuccaugcuuucauuugggaaccuggaucucaaacagaauugccaagggaaaggugccaagcuuuaaccucagguggaaaccuuugagauucacuuuaguauauuaauaguuaaggucuuuuauuguuuaaaauggcuuucaaggaugguucugauuuuguguauaccucuagcaaauccucugagacgcuugcucgugaaguauaaucacaaguguagcccuuuguuuuuucuagauuauaccuccuuaaaacauaucuuuuuuuuuuuuuggccugguuuaugcuuagcuuauucaaggugaaguguuaugauuguauuccaaguuuuaaccacagcuauccauguguuuauucaaaucaccuaccaagauucauuccuuuuucuucuuuaccuuccuguuuuaaucagucaugauuacuuuauauugaaauaacuauugaacuuaucuucuuuauccuaaaccuaggacauagcaggcugcuuggaauaaaguagauaucaguaagauuugaauaucucucaucaccagauuucauuaauuauuuauugcaucaguuguugcaacuaaacacugaguauuuucaucuccuuugggucucauacuucuguauuccauccuuggcgcuguuaagagaaagauguuuccaaaaugcuaaucuuaacauuuaauuucuugcuaaaaaucuuuuaauggcuccuguuuaagcuuuuuuuuuaauaaaaaauuuuguuuauaacaguagaauuuuugugcccaaagagauuuuaaaagagaacuuuacuacauaaaguagacaaaaguagagcuccucuaguugagucaguaauuggauggugggugguggugguuccuuuggcauauucuuucuuuuuuuuuuucuccucucacuugaguugaaccaugagcagucuucuuaggggcacugugggaaaaacauugauguguagguuaaaacccauauucguuggcuuggaaaacaagaguccuucaugaucuggcuucaguuggcuucucaaggaauauuguuucuuuccaaacuaccugaggccuuaucuuacaucugugucuacugugugacccuguaaucuugaacgugcugcugcugccgccucugaaauguccuucucucugccuuauucacuugacaaaaacuuacuguuuaaaaacguagcuugagugcugccuacuuuuaugaagccuucccaaagucuucuuuacuauuuucuuuauuuuaauagauagccuuacucuuuugcccaggcuguucucaaaccccugggcucaagucauccucccaccucagccucccaaaguguugggauuacaggcgugagccacugcaccuggauaucuacuuuacuguuaagagaauugaucaucacccuuuuccuugugauuccauuuuauccuguugccauuuuuauuguaugaccuaucacauaguacccagcacauaguaagaucauaacauauugcaaugauuuauuuauaugcuugcuucuaauaauaaaaugugaaguucuugaaaaacaguaacuauuucuuauuuguuuaaauuucccaagagccuaaugagugacuggcaaauaguaggcacucaguuuuugcuaugaaggauauaugucuaguugugucagaucuucugauauuucaauaaaaucuggaugcccauauuuucugcccugcccugcuccccucacucuguugcccaugcuggagugcuauggcgugaucacagcucacugcagccuugaccucccaggcguaagugauccuucugccuuacccucccaaguaguugagaccacagguacaccaccaugcucggcuaauguuuuauuuuuucuagagauggggucucccuauguuucccagacuggucucaaacucuugcccucagguaauccuccugccuugggccucccaaaguguugagauuguagucguuagccaccauacccagccugaugcccagauuuuuuuuuuuuuuuuuuuuugagauggaaaccggucgcucugucacccaggcuggagugcaguggcgcaaucuuggcucacuguagccucugccucccggguucuagcgauucuccugcuucagccucccugaguagcuggaauuacaggcgugugccuccaugucuggcuaauuuuuguauuuuuaguagagacgggguuucaccauguuggccgggcuuaucuggaacuccugaccucggaugauccgcccaucucggccucccagagugcugggauuacaggcgugagccacugugcccggccucaaugcccagauuuuaauguaaggucuacccauauauauauauauauggaccuuaauaaauaaauauaaauauauauauauauauauauauauauauauauauauauauauaaaauuuuuuuuuuuuaaggcagggucucacucugucacccaggugggaguauaguggugugaucauaacucaaugcaacuuuuaacuccugggaucaaacgauccuucugccucagccuuccaaguggcuaggacuacaggugugugccaccaugcccagcuaauuuuuauuuuuauuauuauuauuuuuugagauggagucucacucuguuucucaggcuagagugcaguggagcaaucuuggcucacugcaaccucugccuccuggguuaaagugauucuccuguguuagccuccuugaauagcugggauuacaggcgcgugccaucacgcccagcuaauuuuuuuguguuuuuaguagagaugggguuucacaauguuggucaggcuggucucgaacuccugagcucgugaucuacccuccucagccucccagagugcugggaucacaggcgugagccaccaugccuagcuaauuuuuauuuuuuuuaauauuuuguagagacaggaucucuguguugcccaggcuggucucaaacuccuggugucaagcaguccuccuugccucagccucccuuagugcugggauuacaggcgugagccacugugcccugccuaggucuacccauuuuuaaugguuuuuauuuauuuauuugagagacaaggucucacucucucucccagacuggagugcaugguguuaucauagugcacacuuaaaugcagccucaaacuucuuggcucaagugauccuccugucucagccucugaaguagcuaggucuacaggcaugcaccaccaugcuuggcuaauuaaaaaaaaaaaaaaaauucucguagagauggggucuugcuauguuucccaggcugaucuugaacuccuagcuucaagcagucuuucugucuucggccuuccaaaguguuguggguacaggcaugagccacaaugccuauccuauuuuaaagguuaacaacaaauugagauuuuuaaaaacacugugugggccaaauaguaucugugggcagacagcucacaggcugccaguuugcauucuuucauucuuuaaauguuuauuuggaaaaacugguuauaugagauugauuuuuuuucauuacacgcauaauuacaaaaauaaccaagccagacaaacucuguguaaauugagaaugcauuuaaaaaaaaaaaggcaguuuaaaccauugggagcauacuuugauucuuguuccauuaauauuuuagguuuuaguuuaaaaaauuuaugccuugacguuaaucaaacucaaagagccuguccgucagaaguucuggaggcccagacuugcaauggguuuggugggcaaggacuggggugacggagggcagucuugggacugagcccucagccugugggauuugggaucugauaccaucuccagauagacagugucugaacugaauuagagggcacacagcugguguccacugcuuggugugugggggagaaaacuccacgcacacggucacagaauuuuucuguguugaugauuauuguugugugagcagaggaaaaacaucguuagagaguuucccuauacacuacaacacucaguuccuucuaaaauaccauuuuuuuaaauuguuuuuggcucugucugcccugacuauaguaagcccuauagggcaaagaucuuugucugucuguucucucauacaucccaagcacccagauuggugucugccacauaguagguccucaguuaauauuuguugaauguacaauaccuuuaaucucucagacacucugcuagggacugaggacaagaucccugcucucuuggagcugaucuucuaguuggggagaggcaaacauguaagaaggcaaguaauugcaaauucuaauagaccaggaagaucaaaguggaugaagcgagcagagcaugggaugggaggagagaggagagaagcugcucugaaggggugaugaauuaggguaaaccuaagagaugagaaggaugagagggugaaaagcaugccaggcacagggagcugcauguccaacuguucucaggggagaaaguuuggccuucucuaggaacagacggagagaaggcaagggauccuaagggagauggugcaagggcuuuuggggaguuugggguuuauccaaaauguaguagagaagaggguucuugaagaguuuucagcagggaugggacaugugggauuuguguaaagcagggagcaaacuauggcucaagggccugcuuuggcucacugccuguuuuuggaaacaaaguuuuauuggaucacagacacaccauuaguuuucuuaggagcuacaaaggcagaauuuaugaaaaaagaaaauguuuaugccuggaauauaugcuaagucuuacaaauuuacacugaaagcuccuugaggguaagaguugccauauauugcuacaaugccuaguaaaugcucaguaaauaugguugaacugaaaauuuaucaguaugauaauggaaugguaacugauccuaaaauaccucuuaaacuaaaauuguacagguuugauuauagucugggcucuacuuuagugugaccuucagcauuugacuuaaccucucuaggcuucauauucucuacuauaaaaugaggagguuggauuaaauuauuugauauucuuuguaguaugaggacugccuauggcuccacuuuuuuaagcuuaaaauugcuucuaauaucuccauuggauggcagaugcaauggggugguuuucaaaaggccaugguucuaauaccuuauauauuuuuauuccauuguauuuuauuaauaguuaacaaguucauuuauuuuauuuuauuauuugagauggagucucacuguguugcucaggcuggucuggaacuccugggcuuaaguaaucccaccuuagccuccugaguaucugggauuacaagcaggcaccaccaugccuggcuaaauucauuauuuuuuaagauauuuauauauacacauauauguguguguauauauauaguauguauauaucuuauuugaacagcuuuauuaaaauauaacugauuuauaggcaauacacugcacauauuuaagguguacaauuugaugacuuuuuuuucuugagacggacuuucgcucuuguugcccaggcuggagugcaguggcacgaucucagcucaccgcagccuccgccuucuggguucaagcaauucuccugccucagcuucccaaguagcugggcuuauaggcgggcgccaccacgcccgcuaauuuuguacuuuuaguagagacaggguuucaccauguuggucagacuggucucaaacucccgaccucaggugauccgcccuccuuggccucccaaaguguugggauuacaagcuugagccaccaugccuggccugaugaaauuuuaacauauauguaaucauaauaccauuaccauaauuaagaaaaugaauauucaccacccucaaaaguuuccucaugcuccuuuguaauccucucucuccuucugccucauuccugggcaaccacugaucuacuuuauaucacuuagguuaguuugcauuuucuguuuuuuuuuuuuuuuuuuuccaugagauggaguuucacucuuguugcccaggcuggaaugcaguggcacuaucucagcucacugcaaccuccaccucccagguucaaguaauuuuccugccucacccucccgaguagcugggauuacaggcaugugcuaccacaccccacuaaaaauucuguauuuuuaguagaggcaggguuccuccauguuggucaggcuggucucaaacuccugaccucaggugauccgcccaccucgaccucccaaagugcugggauuacaggcgugugccacugugcccggccuaguuugcauuuucuagauuuuuauauaaauaugcauuuuuuccuggcuucuuucacucagcauuauuaucuugcaauuaaucuauuuuaucguauguguacauucuuauugcugauuauucuauuguggauauaccacaauuuauccguuuaccuuuugauagauauuuggguuguguccguuugucagcuauuagaaauaaagcuauuaugaacauucguguauaaaucuucgugaggacauaggccuuucucucucucucucucucucuuacauaauuguaugugcuauguuuucauaugaagguccuaagcuuuucauuccuuuuaaguaaauucuuaguaguagaaugguuagguauaugcuagguauaugcaucacuuuaaaaacaaauuccaaacagcuuuccaaagugguuucaacuuguucauuuuacauucucacaaauacguauaugagaguuccaguugcuccauaucuucaccaauacucaguauaguuagccuuuuuaauuuuagcuauuuuaguggauaaguagugguaucuuacugugguuuuuaauuugcaguuuucuaaugacuaauguugggcaucuuuucaagugccuaucugccaucugugucuucuuugguuccaaggucccuuuaaaucuuuugccuauuuuauuuuuuauuuuuauuuuuuucuuuuuugagauggaaucuugcucugucacccagguuggagugcaguggugcgaucuuggcucacugaaaccuccaccuccuagguucaagcaauucugccucagccucccgaguagcugggauuacaggcgccugucucacgcucagcuaauuuuuguauuuuuaguagaaaugagguuuugccauuuuggccaugcuggucucaaacuccuuaucucaggugauccgcccgccuaggccucccgaagugcugggauuacaggcgugaggcaccacgcccaggccuuuugccuguuagugaauugucuuacuuucaaguuguaagaauuuaaaaaaaauuguagguacaagucuuuuuucaaauauaugcuuuggaaauauuuuuucccagucuaugguugcccuguaguuacagugucuuucaaagggcagagguuuuaauuuugauccacuaacuuauuuuuuucuccuaugauuugugcauuuuuuguugcguuaaaucuaccaaacucaagguuacuaauauuuucuucaggaguuuuuaaguuguaguucuuagauuuaggucugugauaauuuagaguuaauuuuuguuuauggggugagguaaaggucaaggauuuuuuuguuuuuuguuuuuuuugcauauggcuguaacaucauucugguaccacuucuuaaaaauauuauuuucauugacuuguuuuugcaccuuuguuggaaauuagcuaaccaugaauuugggucuuuuucuggacucuguauuuuguugcauuuauuauuuauuuacacccaccauuaucagacugccucgauuacuguagcuuuuagauaagucuugaaauuggcaguauaauguuuccaacuuuguucaucuuuuucagaguuauuuuggauauucuaggucuucuacauuuucaugaaaauuuuagaaucaguaugucauuucucucaaaaaagaagccugcuuggguuuugcuuaggguugccuugaaucuguaagucuuuuugagagaauugaugacauuuuaacaguauugaguuuaauccacuaauauguuuuauuucuucauuuauuuagaucuucuucaauuucuugcaacaguauuuuguaguuuucaguuucuaggucuugcacaccuuuugacaaauuuaucccuaaaaauuucauauuucuuaugcuaauguuaaugguaguuuaaaauauucaguuucugauuguugcuacauauagaaacauaauuuauuuauuuauuuuuuuauuuuauuucauuuuugagacagagucuggcucugucgcccaggcuggagugcaguggcgcgaucucggcucacugcaaccuccgccuccugaguucaagcaauucuccugccucagccucccgaguagcugggacuacaggugcaugccacuaagcccagcuaauuuuuguauuuuuaguaaagacagaguuuuaccauguuggccaggcuggucuuugaacuccugacguugugaucugcucgccuuggccucccacagugcuggaguuacaggcaugaaccgcaacacccagcugauuucuuuauuauaauuuuuauugagugaaauuuacauacaauaaaaugaauaaacuuuccauaaucagcucugauuuuuuaaaaauaagcuuuuaaucuuagaauaguuauggauuuauagaaagguugugaagauaaugcagaauucucauacccaacauuuagucucucuuacuauuagcauuuuacauucauaugguucaucacaauuaacuaauguugauaauuauuauaggccauacucuguucaaauuuccuuaguauuucuuuuacccaauguccuuuuucuauuccauggucccauuccaaauauauuacauuuagucaucaugucuuuuuaggcuccucuugguugugcccauuucucagacguuccuuguuuuugaagaccuugagaguuuuuuguuuuguuuuguuuuguuuuguuuugagacggucucacucacucucccagacuggagugcaguagugugauuaugacucacugcagccucaaccuccugggcuuaagcaguccuccugccucagccuccugaguagcuagaacuacaggcaugcaccacuacaccuggcuaauauuuuauuuuuuuggagaggcauaagccaccgugcccagccaaccuugaaaguuuugaggagaccuggccacguguuuuguacaguguccuucaauugggguuugucugcuguuuuccuuuaaaaaaaauacaaaaauuuauauaaaauuacucauuuuuuuuucugggaccaagagaaaugccaauuucaacugugucaagauaucuuugguugcucuauaaaaucgauacacauaaguccaggauugauaagaguaguauaaaaaaggcauucuuuguaucuccuccacgauaaaucugugauuuuaaaucugaugcauauaaaugagucccccagauaacuuccuaaaauggagauuucuaggcccugcuccauaucaagagcaccagaaucucugggaaugggcuugaaauggaguaguuuuaaaaagcaccccaaaggucaggugcgguggcucaugccuguaaucccagcacuuugggaggccacagcaggaggauugcuugagcccaggaguuugagaccagccugggcaacacagcgagaccccaucucuacaaaaaaauuaaaaaugagcuggacgugguggugcugggcauguugaggaggucaagguggaggcaggggagguggaggcaggggaggaucuuaggaggucgaggcaggggaggaucacuugagcccaggaguucaaggcugcagugagcugugaucacaccacugcccuccagccugggcgacagaacgagacugccucaaaauaaauaaauaaaaaguucugcagguaauucugaagucacuaguguaugucuacccuuuuucuuaggauuagauuggcauuagggguuuuuggcaaggagaccacagagguuaguuaagagcucuuuuuauuaugucaaaucagggguacauauuaucaacaugucuuauugccgauguugacguugauaaccuggcugauguagcauuugccaaguucuccacuguaaaguuauucuuuuccccauuuucuuacugaacauuuuggaaggaaguacuaugugcagcccucacuaaaagaaugaggaguuaugcuccaccucccugagacuagaauaucuauguaauuuuuuuggaacuuuucugccaggaagauuucucuauuuucuccaaguuauuuauuuauuuaaucauauguuuauauuaguguagacuucuguauuuuuguuuuauaguuuguguuauuauccaguacuguuuuauuuauuuuguugcucagauucuuucagcuuuggcuauugguaauucuuucuuacggcuccucugucccuucaacugauuuauuuuuauauuggccuuauauccugcaacauugcuacacucauuuuuuaguucuggcaaugucuuuaauaauucuguaugauuuucuacacaggugaucaugucaucugggaaaaaauaauuuuacuacuuuucaaaaccagaugccuuuuauauauuuuucuuaccuuauuguguuggcuagaaccuucaauacauuguuggaaaaaagugaugagagcaaacacccuugccuugucccugucuuaggggaaaagcaauuuuagucuuuucucauuacacguaauuuuagcuguagaguuuuuguagauguccuuuagaguuuuggggaaguucucuucuguuccugucuuguugagaguuauuuuuucaugaauggguguugacuuuuguaaaaugcuuuuuugggcucuauugagaacaugauguaauuuuaccuuuuuuuuucuuuucuuuuuuuuuuuuuuuuuugagacaggaucuugcucuguugcccaggcuggaguguggugguaugaucuaggcaccaacuccaccuccugggcucaaauaguccucucaccucagccuucugaguaacuuggacuacgggccccugccacuaugcuuagcuaacuuuuaauuuuuuguacagaugaggucucacuacuucugggcucaagccauccucccacgucagcuucccaaagugucaggauuacagccgugagccacugugucuggcuagauuuuacuuuuuuuuuuuuuuuugagacagucucauucugucacccgggcuggaguacauuggcaccaucucggcucacugcaaccucugccuccuggguucgagugauuccccugccucagccuccugaguaacugggauugcaggugugcaccaccacacccagcuaacuuuuuuuguauuuuuaguagagaugggauuucaucauguuggccaggcuggucuugaacuccugaccuuaggugauccgccugccuuaaagugcugggauuacaggcgugagccaccucgccuggccuagauuuuacuuuuaauguggugaauugcauuaguugguuuuugguuuuaaaccagcccucauuucuagaauaaacacuuggucaagauguauuauacuuguguguuuuuuuuguuuuuuuguuuuuuuuucccagacaggaucucacucugucaccaaggcuggaguacaguggcacgaucacagcucugcagccucaaucucccgggcuugagggaucuuccuaccucagucucccagguagcuacaggcgugugccaccgugccuagcuaauuuaaaaauuuuuuguagagacaaggucucacuauguugcccaggcuugccugaaacuccugagcuaaagugauccaccuggcuuuggccucccgaauugcugggauuccaagugugagccacgacgcccggccuauacuuacuuauuguuuuaaacuuuaguucauaccuuggcuugugaaaucauuuuaguuaugaucacuauuuuauuuuuugagacagaguuucacccugucgccuaggcuggagugugguggugugaucucagcucacugcaaccucugcuuuccaagcucaaaugauucuucugccucagccucccaaguagcugggauuacaggcgccugccaccacaucuggcuaauguuugguauuuuuaguggagacgggguuucgcguguuggacaggcuggucucgaauugcugaccucagaugauccacccaccuuggccuuccgaagugcugagauuacaggcgugagcuacugcgccuggccgaucacuauuuuaaaagacuguaauagaacauaucagacgauuaaaauacugcuucaugaaauuuugcaccuuuuuuuuguauccuuacgaaauuguuauguauaguguauuucuugccuuagguuauguaaaaaaauuugaaaaucccuuaacuaauucacauugugagccuggagauaaucaaguaccucaaauaaugaaguguuguauuaaaagagguacaccuggagugacaggaguguaggugauuaaaagagaaaaugaggaaauaggaguuucuguagaaaagccuugaucuguuucuuaguuuugauugaagggaucuuuaugguugcaugaugaggcccaugggcugugaaaggauuuaauuaguuacagauaauaacuuagugauccaagccaaaguacuuggcagucugucagauuugggcaaguuuuucugaaaacaucuucucuuguaugacuuuaaaauguggcuuuaagguauuuucccaucugaaaguauuguuuugaauaaaaucaaacagaagcuguuaaauucauuugcuugcauacacauacugguucuuauaaaacucuucauaugauaaugagaauuucauccuuguagggacacacagucuugggauacuagcuagugaugucaauuacugguucauauuaaggauuugaauuggguccaguugagaagaauggaaaaugguggagaauaaucuuuucaguaccuuucaguucuaaacguuguggcuauguguuucucagucacucuccauuauuaauuuauaaguuugaucccaaaguagucuauuuguuucaaauuucuggaggaaagaauaugaucgaauagccuagaugccaugucaaccuguagaucaaucacuauaaccaaggaaguauguuaaaaaaaucuuagaugugcaucuuuccccuguauauacaguuuuucccagagaagaaugaaucacuguuagcuggguagccacuccaagagguauuuauuaauaacaagcuaaauaauugaauuauaaccauuaaauauugaauuacagugcugaaauaauuuacuuucuaggugacuaaaauuaaucauuuucuuuaaggcagugguucuuagcauauucuguguccaaaaacccccuuugaaagucugauaaaauauuguagacuccuugaagcccaucuaauaccugcagaucaagagugccuacuuuuuaaguuuauuaauuaaacaaucuaacaugcauuguuaaauucccuguaacaucuaguuuuucauguuauaccaugaaauauuguauaaugggaauuguuuuucucuuuuuuuuuuuucugagacagggugucucuauguugcccagacuagugucaaacucuuggccucaaguuaucuuccuaccuuggccucccaaagugcugggauuagaggccugagccaaccugucuggccuauaucuuagucuuaauaauagugaacacuuacugaguuauuacucauauuggggaucauaacuagcauuuuacauguucugaguuaauccuuaaaacaacucugugaggcagguacuauuauccccauguuacagaugaggaaucugagauauagguuaaauaguaagcaguagauagcauuuuaccucuuguugagaugagauuuuuuuuuuacacagagucuuacucugucucccaggcuggagugcaguggggcaaucucagcucacugcaaccucugccuccuggguucaagugauucuccugucucagccuccagaguagcugggauccacacccagcuaauuuuucuguauuuuuaguagggacgagguuucgccacguuggccaggauggucucgaacuccugaccucaggugauccagccaccucagccucccaaagugcugguauuacaggcaugagccaccgcacccggccgagaugagauucuuuuugugugugugacagggucuuacucugucauccaggcuggagugcaguggugcuaucaugguucacugcaaccucgaccuccugggcccaggugauccccccaccuuagccucauggguagcugggacuacagaugcaugcuaccaugccuggcuaaguuuuguauuuuuuguagagaugggguuuugucauguuacccaggcuagucuugaacuccugggcucaagcaauccacuugccucagccucccagagugcugggauuacaggcaugagcuccugugccuagcaagcugagauucuuuuuuuuuuuuuuuuuuugagauggagucuugcucugucaccaggcuggagugcaguggugcaaucucggcucacugccaccuccgccucccggguucaggcaauucuccugccucagccuccugagauucuuggcuuuuugugcauuuauucucuguucccuuaaccaaauuauaaaucuuugauuauauggaccuuuuuguuuuguuuuguuuugcccuuaaauguuuacuuagugcagugcacauaauuuagacccuaauaaugguguauugauuguaaaauguauaaucuaaaucaagucuacuuuuuucauuugcuuggaaauuuuauugcuguuguuagcuauuauuuuuguuuuuuguuuugucuuugagacaaaggcucugucacccaggcuggagugcaguggcaaaauuauggaucacugcagccuugaccucccaggcucaagcaauccucccagcucaguccccucaguaacugggacuacaggaguguuccacuaugccuggcuaauucuuuuuuaaauuuuuuguagacauagggucucacuaauauagucacucacuaauauauagaccagcccaggcuggucucaaacucuugggcucaagugaucuucuugccuuggccucucaaacugcugagauuucaagcaugagccacugcuccuggcuaaauuacauauauuuuaauccuccucauuuuucacuuuugcucuugccaggccaggcuuuuuugguuucccuugaacuuuugucuuuauaaaagugguacaugcucguuauagaauacuuauacagagaaguauaaauaaggagaaguaaaucuaggcuggguguggugguucacaccuguaaucccagcacuuugggaggcugaggcaggaggauugcuugaccccagggauucgauaucagccugagcaacauagugagucccugucuuuaaaaaauaacuagcuggggcugggcacgguggcucaugccuguaaucccagccagcacuuugggaggccgagguggauggaucacaaggucgggaguuagagaccagccugaccaacauggugaaaccccgucucuacuaaaaauacaaaaauuagcugggcgugguggugcgugccugucaucccagcuucucaggagguugaggcaggagaaucgcuugaacccagaaggcagagguugcaaugagcugagauugugccacugcacuccauccugggugacagagcaagacugucucaaaacaaaacaaaacaaacaaacaaaaaaaaacaaaaaacuagcugagcaugguggcaugugcccauggucccaacugcuuuggagguggagguugcagugagccaaaaucaaaccacugcacucuagccugggcaacagggugagacccugucucaaaguaaauuaaauaaauaaacuaauuagcugggugugguggucccagcuacuuggaaagcugaggugggaucaccugaguccaggcggucgugguugaaaugagccaugaucacaccacugcacuccacccuggacaacagagcgagaccgugucucaaaaaagcaaaaaaaaaaaaaaaaaaaaaaaaaaucuaaaaccccaccagccauagguagucaugggauuuuaugaugcauuuuuuacauacuugaaauuauagcacauaauuuugugacuugaauuuucaucaaacauuauaauauaaacauuucuuuauaagacuggcaacauauauuacuugauauguauguauuaauaauauaguguauuauaauuagaugggguaucccucuugggacguuuagauuguuuucacucuuuuuuucuuguagauauccuugaaaugaacauucuuguacauacccaaucaagguguugccugauuucuucacuaaccaugcuucaccuccauccccauauuccuccaugcccaagacuaaggauauauagucaaauguuagaauauauagucaaauauucuguuugaguuacucagauuagucuguuguccauccuuccuucccuauaaauauuacagauaacaguauuucugauauuuuuucaauuccacuuuauaucaucucccuccugucuuagaaccuuuaugcauuuuauuccucugcuuggaauacuuucuuucccuacccccuuuuccuccuugccuaguuaacuucucuuccuuuagauaccagcucaaaagucccuguuucagagaagcucuggauuagaacuccugcuauauucucucuuaguugugccauuugauccgucucaccaacuaaacugaaaacuccacaagggcagggaccucaaguguacugcuucccaguaugugugucugcauaaugaauucucaauaaauacuuauugaguguugucuucuggcucuaauauucugccucagggaaguggcaggguuuuuuguuuguuaucuaugguuaggaauggcauucuaugagaaagcgucgugguauugaaucaagcgugaucagaagcaaguguaauacagcucagcaucauuggucaaauacauguguuaaaugauuguuguauuucucaguugacauccugugagaagauaugaauucagauagaaucuggcucaaauucugguuuggagucaguggagaaacaugaguuuauugauugguauucuuguugacaaguagggcaugugaauaacccaguauauaauguugcuuuauauuuaauuuccaaaaaaaguaaagacuaacucuuguuagccaguaguuuaguuuuuuucaguaauuucacuuuugaaaaauuauuuguugggcauaguuaguaauuuuuauuuuuuaggguuguuuggaagauaaaguaauguauaugaauguauuucaaaguagauguguaauguauuuucauuguuaguugugauauuaggcaaguaaguucaaguuucuccuuagguuuacuuauucaaaaauuggguuaaaauuaguauagacccuaauagguuaucaugggaacuaaaugaaauagucacgcauguaugccaagagcuuggaacacaguaaacccuuggaaaaugcucacucuuacauuaacuauuuccaaucuuuuuuuuuuuuuuuuucugagacagggucucacugugucacccaggcuggagugcaguggcacaaucucagcucacugcauucuccaccuccuggacugaagcgaaacucccaccucagccuccugaauagcugggacuacaggcaugcgccaacaugcccagcuaauauuuuuguauuuuuaguagagaccagguuucaccauguuggccaggcuggucuugaacuccugcccucaagugauccgcccuccucagacuccuaaaaugcugggauuauaggugugagccacgcaccuggcugccuuuaucauuucuuuguguuacagacauuccaguuacacaauuacuuuaaaacguacaauaaauuauuguugacuguagucacuuuguugugcuguugaauacuauaucugucuuaguccguuuuuauacugcuaugaagacauaccugagacugaagaaagaaguuuaauuggcuuacacuucugcauggcuggggaggccucaggaaacucacaaucaugguggaaggugauggugaagcaaggcauguuuuacaugguggcaggagagagagagagagagagagagagagagagagagagagagagagagagagagaggaaaacugccagacacuuuuaaaucaucagaucuugugagaacucacucccuaacuaucaugagaaacuacccccaugauccagucaccucccaccagcuccuuccccugacauguggggauuacaauuagaggugagauuuggguggggacacagaaccaaaccauaucaguauuguauucauucuaccuaauuguauuuuuguacccacuacccauucccaccccugcuccccaccacuacccuuuccagccucuggugaccaucauuucuacucuugaucuccauguauucaauuguuuuaauuuuuagcucccacaaaugaacgagaguguguaaaguuugucuuucugugccugguuuguuucacuuaacuguaguguccuccaguuccauccauguuguugcaaaugacaggaucucauucuuuuuuauggcugaauaauacuccaucguguauauguaccacauuuucuuuauccauuugucguugauggacauuauguuguguccacuccuauuauauuuuuaguucucuguauauuugaaaaaaugacucuggaguauaguaacugacacauaaauaaaugucaauguguauucucuuucagauuuaccaaaaauuuaucuccugacaagauaaaucuaaguacccuuaaaggagaaggugaacugaagaauuuggaguuggaugaagaaguacuccagaauauguuggauuugccaacauggcuugcuaucaacaaaguuuuuuguaauaaagcguccauuagggugagacuuugauaucuguggcuugauauuuguggaaggccuuucauguuuuccuucuauauuuuggcucuagcuuuuaaaauacuuaauuuuagauaauuguguaaaaacauuuuuauuaauauaauuucaaaagaaagauaccuuugcauaaaugugugccuuauguguaaaggcauauauuaacuacuuuauagaucuuaauuuuuguguaaagugauuccauuaauauuucaaaauuauuaauuuguuaauaaaauaauugcauccauuugguacauguucaaagauaguuuuuucauaaguuuuauugucaaaugggacaaucuaaacuuguagugaguugcugggcaugguggcucacaccuguaaucccagcacuuuggaaggccgagguaggcggauugcuugagcccaggaguuugagacuagccuggguaacauaaugagacugcaucuauacuaaaaauaaaaauaaaaaaauagcccaacaugguagcacaugcgccuguaggcccagcuacuugggaagcugaagcaggaugaucgguugagucuggaagggugaggcugcagugagucaugauugugccacugcacuccagccugggugacggagugagacccugucucaaaacaauuuuuaaaaaguagugaguaaauacuuuucaaaugaagacaugagaacuaauaaauuugcaguuuuaucccuuuucuucauuaguuucuuuuucauuuugagauuuuuuuuugagacggagucuugcucugucaccaggcuggagugcaguggugcaaucucagcucacugcaaccucugccucccggguucaagcgauuccccugccucagccucccaaguagcugggauuucaggcacgugccaccacgucuggcuaauuuuuuuguauuuuaguagagaugggguuucaccauguuggccgagauggucucaaucuccucaccuugugauccgcccgugcccagcccauuuugagauuuuuaagggucucuguuuacuguuaguaucauuccuauuauuauuauuauuauaacuuauuauucuacuuaucuuuuuuuuuuuuuuuuuuuuuuugggagauggagucuugcucugucacccaggcuggagugcaguggcaccgucuuggcucacugcagccucuaccucccagguucaugcaauucuccugccucagccuuccaaguagcuggaauuauaggcgcaugccaccacaccuggcuaauuuucguauuuuuaguagagaugggguuucauccuguuggccaugcuggucucaaauuccugacaggugauccaccacccgccucugccucccaaagugcugggauuacaguaugagccaccgugcccggcugaccucuacuuaucuuuaaucauaugucaauuugugucacuucuuggucuuaaagaugaggcuuuguuuaagaguugucugcuuaguugaaauacugcaugcugauuguuuccuaaaacuaaaauuugggcuccuaagaaaagauuauagaaaaguuccuauauccuuugauggucacuuuuaauuuuuguucuauccuuuggaaaccuaaauaucuacaaagacuugacacuuucaguaaauuuuuuuuuauuucaauagcuuuagagauacaagugguuuuuguuuacaugagugaauuguauagugguaaagucugggauuuuagugcaucugucagcugaguaguguauauuguacucaggaaguaguuucaucccucaucccucuccuaccccuacccaccuucugagucuucaaaguccauuaugccacucuguaugccuuugcauacccauaguucaccucacacuuaaaagaacaugugguauuugguuuucaauucauguuacuucacuuagaauaauggccuccaguucuuuucaaguugcugcaaaagacauuauuuugcucuuuuuuuauggcugaguaguauuccaugguauuuauguaccacauuuucuguaaccacucauagguugaugggcacuuagauugauuccauaucuuugcaauugugcauuguguugcaauagacauauguguccaggugucuuuuuuuuuuuuuaauagagucauguuugaaaugaggaccagugucuuuuucauauagugacuucucuuccuuuggauagguacccacucgguagugggauugcuggaucgaaugguagaucuacuuuuaguucuuugagaaauuucuauacuguuuucuauugagguuguacuaacuuauauuccuaccagcaguguauaagcauuccuuuuucaucacuuccaugccaacaucgauuguuuuucaacuuuuuaguaauggccauucuggcuggaaaaagguggugucucaauguguuuuuaauuugcauuucccuuaugauuaaugauuuugagcauuuuuucaugugguuguuggccauuuguauaucuucuuuugcaaaaugucuguucauguccuugcucacuuuuuaaugggcguguuuuuuuucuugcugauuuguuugaguuccuuguagauucugaauauuaguccuuugucagacacauaauuugugcauauuuucuuugucagaugcauaguuugugaauauugacaauccguagguugucaguuuacucagaugauuauuucuuuuguuguguagaagcguuuuaguuuaauuaggucucauuuauuuuuguugcauuugcuuuuggggucucagucauaaauucuuugccuaggccaacguucagaagaguuuuuccuagguuuucuuccacaguuuuuaugguuucagaucuuagauuuaaaacuuucauuuaucuugaguuaauuuuuguauacaguaagagauagggauccaauuucauucuucuacauguggcuauccacuuuuuccagcaccauuuauugaauaugguguccuuucuccaguuuguguuuuuguaugcuuugucaaagaucaguugauuguuaguauuuggcuuuauuucuugguucucuauucuguuccauuggccuguguauucuguucaauggaacagaaacagaauacuuuauucuguuccauugguccaugugccuauuuuuacaccuguuccaugcuguuuugguuacuauagacuugcauaauuugaaguuggguaaugugaugccuccaguuuuguucuuuuugcuuaggauugcuuuggcuauuuggguucuuuuuugguuccauaugaaguuuaggauuguuuuuucuaauucugugaaaaaugauguuaguacuuugagaagaauuguguugaauuuguagauugcuuugggcaguauggucauuuucacaguauagauucuuccaguccacgaguaugggauauauuuccauuugcuuaugucaucuaugauuuuccacaguguuuuguaguucuccauguggagaucuuucaacuccuugguuagguauauuccuacauuuuuuuuuuuuuuuuuuuuuuuuuuuuuguaguagcaguaguuauuguaaaagggauugaguuccugauuugauuaucagcgugguuuuuguugguuuguagcagugcuacuaauuuguguacguugauuuuguaaccuaaaccuuacugaauuuauuuauuagaucuaagagccuuuuggaggcaaaacuuggcauuuuuaguacaggguauaucaacauuauguauuugauguuuccuacauuuuauauuaauggccgaacuuuuguauuugucuugaauauuuacaaaaugauugcucagaauuuuaggauuaaacagguuguuaagcucuucauuuaaauuaugauauuaagauuuguuuuaaggauuguuaaaaaaaaaaagauacuuaaaagaaccugaaauuggccaggcaugguggugcgugccuguaaucccagcaccuugagaggccgaguuggguggaucauuugaggccaggaguuagagaccagucuagccaccauaucaaaacacugucucuacuaaaaauacaaaaauuagccgggcgugguggcacuugauuguaaucucagcuacugggaggcugaggcacgagaauugcuugaacccaggagguggagguugcagugagccgauaucgugccacugcacuccagucugggcaacagaaagagacucugucucaaaaaaaaaaaaaaaaaagaaaaaaagaacuuacaauuucuauucaaaagaugucugaggagauauagcuaguaauaauuucuuaaauaaaauggguacaucugguuucaaaaguaugagugaguugcuuaguuuauuuuguaguuuaagaaaagugauuuuauauaauuuggugugucuguccuauauuaauauaacaccuguauugauuacuguuuacauuauuuucuucuuaaugauugaucuuaaauuaaaaauuuuucauuuguagaucccauggacaaaacugaaaacacaucccaucuguuuggugaguucugaaaccacuuuagaaauaaacauuuauauauauacauuaucuagcuacucuguucauaguaaucuuuuguuucauggaaauauagucuggauuuuucaccaguuagguuucauuuuauuuugauaggacucagguuuuucauccuuuaaaugagaagcuuuaaccuuaaaguaggagcaucuuuaaaguuuuucaggucuagaauacuguguucuaaauugguauaguauuuuauugcaucauuuaacucuuuguugauguacuaugggauuauucuuucaguaacauuugauccagacugucuuuguuucuccuuuuagugaucuaguaaauuaugaaauauguucuuuaauauacuuugcuuuuuaaggaaaguugaagaaaauugaucauuuguucguucauuuaaaaaauacaaugaucaagaacaugaauaaaacaagacaguuucagauaauaauaaaugcuauauaugaaauagagaaugaagaaugacuggaguaguguuagugauggcgauuaaggacauuagaucuuucuucaaggagaaaaauauuacccugagaaagaaccuuuuccauuaugggaguguuuauuuuuuuucacauuuccugcuuauuucauauuucccauaguuuugugucucauagcucagaucuuagauugugauaagcuuuuugggguaguucaguccuacuuauuaauauauaauuucaucaaugaauauaucugggaguagagauucuguuuucaugaaaucugaugauuuuaguaguuaauggcuaugucuuaauuccccaccccccaacaccuguaauacacauagcuuuuccaccagauaauaaaugccuugagaacugauugagugcuuuguguucuuuuuuggcauuugucuuuuuagaccuguagagaggcacuuaaaugacucugcucacuuuuuacuuucuuccuaaagaaaaaugaaagagaaaauaaucuuaaauaauacuuuaauaauauacguagaauaaauaaucuaauuguuuauauuuuaacguuuuuauuagucccuggauaaaguaauaauggaaaugaguacaugugaagaaccaagaagcccuaauggcccaucaccaauugcaacugcuucaggacaaagguaagcuacuuccauuaaucugcaugacugccaauaacaggacauuaaaaaaaaaaaaaaaaaaagccuuaaccucaaauggccucuauuucagucagcucucccaucaaacauuuuacaauuuuaguuauauacauugcaaaguugcagauuugacuuuuaacuuucuuuauucaucuugcuuuccuugcuauuauuaaauaauagugauuaacuaauggcagagcagcaacagaaaauggaagcagaagaauuuaggcauuauauaaaucagauagccucugaucaguuucucugcauaucauuuucugugcaucaguggaacuuuuaugacucuuaagaguuaaguugggaggcugggagcgguggcucaugccuguaauccuagcacuuugggaggccgaggcggguggauucccuggacucagguguuugagaccagccugggcaaaacggugaaacccugucucuacuaaaauacaaaaaacuuuagcugggcauggcgccaugcaccuuuaaucccaguuacuugggaggcugaggcaggagaauugcuugaacccgggaggcggagguuauagugagccaagaucgcgccauugcacuccagccuuggugacagagcgagacuccgucucaaaaaaaaaaaaaaaaagaguuaaguugggcucgguguaguggcccacgccuguaauaccagcacuuugggaggcugaggugggcggaucaccugaggucaggaguuugccaccagcuugaccaacauggugaaaccccgucucuaccaaaaauacaaaaacugggugcggugguauacgccuguauucccagcuacugaggaggcccaggcaggagaauugcuugaacccgggaggucaaggcugcagugagcugagcucaugccacugcacugcagccugggugauggagagagacucugucucaaaaacaaagaguuaaguugaugccuuaaauuacagaccuuuuggguuacucuaaaauucauuaaguuuaaaauguuuuugcuuuccacagguuguauuuugauagaugaaaaucagaugcuaauacagcagaaguauggggaucauuucauaaagucuuuuugaaaaguuagaaguuauuaaauuuuuaaaaauauguugucugcuuuuuugcacucagugaaauuuaaaucuagaacuauacaugauuuuucuacaacaggauuucugcauuauuuuugcguucacauuaauuguugacauagauuuuuaaugugauuaaugccuccucauauugcguaaaauagcagcucugaacauguauaguauucuagguguuauguaaaacaauugauaaaacuuuucuugaggaugaaugcauucguguguguacacagacacacacucacuuacuccuguuuuacaaagguugagccaccuuuauguuagugcaugccaugagaauaccuacagugcaugccaugggaaucuaauggugauucguuccacuucuaagaguugacuaaaggccagguuuaucagaugugcaguuuauauuuggacuacagauauuagugacugggaaaagagcuuucauguuaacuucuuuguaauguagcaucauccugcaacuucagauuuuacagguuagauuaugauuucaguuuucauagaauaguuguuggccuuuagguuggcuagagucggaaagaacuaaaaugaaucauuuuguccuugugugcuuaguauaguugauaguguucuuccuaauucuuguuuuuauaguaucauaagcuuuauaauuuuggcuuucuaaucaugugaugauuuaaacuauuuaaaucauccucauauuuugacauauggcaguaugguuaaucuauuucagcauuuuuucagacuugccugauuguaacagucauuuagagugcuuauuaaaucuacaaagucucugaagcuccuuuucuugaauuucugauucaguaggucuggaauggauaucaauaaaaugaauacauucauugagugguguucagaguaaaaaaaaaaaaaaauagaaugugaauauguauuuuugggucucacucuguugcccaggcuggaaugcaguggcaugaucuuggcucacugcagccuugaccucccaggcucaaucgauccucccaccucagccucccaaguaguugggacuacaggugcaagccaccauaccuggcuaguuuuuuguauuuuuuguagagaugguggucuccauguguugccuaggcugauuuuaacuccugggcucaagcaauccuccucccuuugccucucaaagugcuuggauuauagcugugagcuacugugcccagccaaaaagucuuuuacauuuuaagaagaguauuaaaaaaauuuuuuugcagcccugagaaccagaaaagguuuagagaaugagaagagcguuuuuuuaaaaaauuauuuuuuuauuuuuauuuuuugagacaaggucucacucuguugcccaggcuggagugcaguggugccaucucagcucacugcaaccuccaccucccauacugaagcgauccucucagcucagccucccgaguagcugggacuacaggcaugcgccaccaugcccaguuaacuuuuuuguauuuuuaauagagacaggauuucuccuuguuggucaggcuggucuggaacuccugggcuaaagugauccaccugccuuggccucccacagugcuaggauuauaggugacagccacugucaccaugccuggcugagaauagcauuuuuuuuuuuuuaauaauuuauauguaacuagacuagauuguugugucugagguuuguuuuccuguuuuuuuuuuugaaaugugaucucucucugucacccaggcuggacugcaguggcaugaucacagcucacugcagcgucaaccuccuggccucaagugauccucccaccucagcuucccaaguagcugggaccacagacaugcaccaccauguccagcuaauuaauuaauuaaucaauuaguuaauuaauuuugagacaaggucucgcccuguugcccaggcuagagugcagugguuucaucucagcucacugcaaccucugccuccugggcucaagagauccucccacugcagccuugugaguaucugggaccacaggcaaguguuaccaugcucagcuaauuuuuaaauuuucuacggauacgagaucugucuguguuguccaggcuggucuugaacuccuagguucaaguggccucccaaagugcugggauuacaggcaugagcuaccauguguggccucuuaaaauauuuuguggagacagggaucuugcuauauugcccaggcuaguuucaaacuccagguucaagagauccuccugccuuggccucccaaagugcugagauuacaggcgugagccaccaggcccagcuuagauuauuguuuuaauaaaaaacauuuauuuuuucaauauaaaaaugaauaaacugggccugguggcucacgccuguaaucccaucacuuugggaggccaaggugggcagaucaucugaggacaggaguuugagaccagccuggccaauauggugaaaccugaucucuacuaaaaauacaaaaaauuagccagguaugguggugcaugccuguaaucccagccacuccggaggcugaggcagaagaauugcuggaacccgggagguagagguugcagugagcugagaucaugccacugcacuccagccugggcgacagaguugagacucuuagggaaaaaaaaaauaauaaaauggugacgugcaaauuaucuauguaucuauguaucuauguaucuaugugucugucugucuaucuaucuaucugucuauauuuuuagacagagucuugcucugucacccaggcuggagugcaguguugcaaucugagcuaaccgcaaccuccaccuccuggguucaggugauucucgucccucagccucccaaguagcugaaauuacaggcaugugccacugugccuggcuaauuuuuuguguuuuuuuuuuuaguagagaugggguuucacuguguuggccaggcugggcuugaacuccuggccucaagugaucugccugccucagccucccaaagugcugggaguacagguaugagccaccauccccaaccagaaaugugcaaauauuaauagaauuuuuaaaaauuaguuuugucauuaguguauuuuguuuugcuuuguuuuuccagugaauacggcuuugcugaaaaaguaguugagggaauuucuguuucuguaaauucuauagucaucagaauuggagcaaaagccuucaaugcaucauuugaacuuucucagcuucggaucuauaguguaaaugcacacugggaacauggagauuugagauuuacucguauucaggauccacagagaggagagguaacauuuuuuucuuucuuuuuuaaauguuucauuuagugacaaguaaaagaggacgauuaaaaaaaucacaucucaugguugccuuuuaacuuugcuuuucucuguauuacuuuuuuuggggagggugcggggagacagggucucacucuguugcucaggcuggagugcaguggcgcaaucacggcucacugcagccuugaccucccugggcucaggugauccucccaccucagcaucuugaguagcugggacuaacagcauguacuacugcgccugccuaauuuuuguauuuuugguagagacaggguuuugccauguugcccaggcuggucucauacuccugggcucaagcuauccaccugccuuguccucccauagugcucugagauuacaggccugaaccauugcacccagcucucuguauuacucuuaaucauucauuuauaaaaugugcacauuuuaaugucuuuacucuaguaaaucuuuccauuuaaagcccuauuuuaacuucucagcuacucagaauugaauuuuuaaauuccccaaacuaaaauauguuguuuguuucuugguaacgugauuucaugcauuugagcuuuacauuaacugaauuacuuagauuaaaaguauuaacagcuuuacauaugaugaauaugaauaugaagagguguaauugaauuugauggaauaaugcaauuuacaaaaauaaaaacauggugaauauaucuaaaaugucaugugaaaauuaacugagaauauacauuugcuuuguuuuuaaaaaucuacauuuuucucauucuguuuugcaugaguaagugaaguuaaucucuguguucuccuuagguuuugacuuuuaaagaaauaaauuggcagaugauaagaauagaggcagaugccacccaaaguucacaucuugaaauuaugugugcuccuguucgauuaauaaccaaccaaucaaaaaucagagucacacuuaaaagaagggugagucaacaagauuacauuuuugauucauguguuaacuguuggauuugacuuuuugauuuguguguuaacuauuaguuaacuauaggaaauuuuaaacaaugucuuaggugaaauauuggcauauuaccaguggcauauuaaaauaaugcaaaauaaagggagguauaguuacucagauaauauuuauagaaaacugguauaauguucuucagucuuagguuuaauagauuuuucaaagguuuuuuguuguucuuuuuauuuuuaucuuauuuuauuuuuuuugagaugagaucucacuauauugcccaggcuugauuacaguggcaugaucaaggcucacugaaaccuugaccucccaggcuaaagugauugucccacuucagcuucucaaguagcugggacaauaggcacgcccacuaugccugaauaauuuuuuaaguuacuuguagagaugaggucuuauuauauugcucagacuggucuugagcuccuggagucaugugauccuccugccucugccuuauuuuuauuuuuauuuuuggaguuggggucuugcucuguugcccaggcuggagugcagugggacaauccuagcucacugcagccucgaacuccugggcucaagggauccuccugccuuagccucccaaguagcugagacuacaggcaugcaccaccaugccuagcuuauuuuuauuuuuuuuuuguagagacagggucucgcuuuguuguccaggcuggucaugaacuccuggcuucaagcaguccuucugucuugaccucccaaagugcugguauuauaggugugagccacgaugccuggccuaaacauuuuuauuuuugguaaauugaauauauuucucaguugccaaauacuuguugaacauuuacugucuuauaauuucauuucuucuauugaaucuuugaauuaauacaaguaauuauauaauuuaucagcuauaaaugcaaaauuaaguuauauaagugcuauauaacuuguaagguacaaggauuugucugucuuuuguuaccacugcaucucuaguacuaggugauauuccuuucauauuauaggaacucaguaaauacuacuacuuuuuuuuuuuuugagacagaguuucucucugucacccaggcuggagugcaauggcacuaucucugcucacugcaaccucugccuccugggccaagcaauucuccugccuccaccucccaaguagcugggauuacacagguguccgccaccacaccuggcuaauuuuuguauuuuuaguagcgacaggguuucuaccauguuggccaggcuggucuucaccuccugaccucgggugauccaccugccuuggccucccagagugcugggauugcaggcaugagccaccgugcccggccaguaaauacuucuugugugaaggaagaauccauauuucuauucaaaaacguuuugaaaacauuuuuuaauacaagcguauuauaagguuuauaucuuggcuuaauuuuauaaaacauuuuuuuuuccuacaguuaaaggacugcaaugucauagcaacaaaguuaguucuaauauuggaugacuuauuauggguuuugacugauucccaguugaaagcuaugguacaauaugcaaagucucuuagugaagcaauagaaaaaucaacagaacaaaggaagaguauggcuccugaaccuacacagguaagcuauaaaguuaacaggaaaaauacuuacuuuacaugaaaauaguuuaaaaauuagaaggaauuguugguauuuucuuuaagagacagauugugagguuuugaguacaagaaucuucuuuaucuagauaucuucuauguaauuuuauauaaguaguagcuaucauaucuguuaguguuuauucuguuuagagcucuguauuaggcacuaaagcuaaugaugacauaaaaguauucgauguuuuaauaccucuguuuaggaaguuaaaagaguacaguuuuaaaacuacuaaaguaaaagcaaaugaggaaaaaaccuggguaauuauaggcaagagaggacgugugagaguuaacugugcagagaaucaaagccauaaggaauugcugaaauugaacacaaaacuucuguuggaguugucugauggcuggggcaagaacagggacaagcauaaugagcuauuuaucacuuucuuaaaagugauuauuaguuuguauggagcauuauuaguugguauggagaggaaaaguuuuucuggucuuucccaguaguaaguucugaguaccaguacaucaaggucuuuauagaagagacagugauaguuauaauggauaauauuuuaaauaauuuuaugcaaaguauaaaugaauuuuuauaucuaccucuaguaaaaacguaacuaaauauuauaaaauuauacaccuacgaagcuauuuccuuggaaacaguguuauacaucucagauauauagcuuguuggugauccagcuuuguacaugggaauggcauacauuuaggcuuuauuuuuugaaacagucucccuuuagcccaaccuggaguucacuggcacaaucucagcucacugcaaccuccaccucccagguucaagcaauuuuugugccucagccccccgcguagcugggacuacaggcaagugccaccucgcugagcuaauuuguuuuguaauuuuguuagagauggaguuucgcuguguuggccaugcuggucccgaacuccuggccucaagugaucugcccgccuuggccucccaaaaugcugggauuacaggugugagccaccaugcccggccuaggcuuucaaugaauaucacauuggcauuaucuauugccugccuacuauuuccuaaggugcagggguagggguaaacacugauguaaaaaugaauaucaucugacccuggccugaaggaccucagagaauaauggugagucaaauaugaaacaaaucuuuauaaguaggggacaggggcucaugucuauaaucccaguacuuugggaggcugaggcaggagguuuacuagaggccaauaauucaggaccagccugggcaauauauugagucccaucucuacaaaaaauuuaaaaaucacccaagugugguggugguggcauauaccugcaguccuuagcuacuugggagacugaagcaugaagauuguuugaacccaggaggucaagccauugcaccccugcacuucagccugcguaacagagugagaucuguuuccaaaagaaaaaaggaaaacaaacaaauccccaaaucauuguaguucaacauaaauguuagcaugaagaaguaagggaaaggguucuguguagggacuacagaaacacagagagguuuuaauuaauugcuugcaggguguggaaagguuucacaaagagguuaauaaaauuacgucuuagaaaugaguagcaguucacaggcagacauagggaaaaggcauuucagaagagacaauagaaucugcagaaauauaguauuuuuaaagaucaugauauuuucugguaaagauaagaaauuugguguuacuagaguagcguuuuuaggagugagguucaaaugccucacgauauauuacaauuuuccaaguuuuauauuuuaaagaaauugaguuccacacauuccaccuugauguguauucuuucuuaaacuugaucugccagagaauaugguugcauuaagaugucaggcugguuuucccuuuccauaaugacucuaauccuacuuuauaaaugaaagacauuauuacucauccucagucuuacuaggauggauuugaacaggaaggggguaaaaacuccucugggaaacaagauagaguggcaauuugaaauauugcuauucauguuggaaauugcaagccagaugauuuuuaguuauuuucaacacaugugaaggaagaucaaauaauugucagcuauuagagauuauuaaaguaauuuuuuuauaguagaucacuuugugaauccuggcagguaacucgaaagaaucgagucacauggcuaaaacaaaacugcuuuccuuccaaucugucuauuuaugugaacaaggucuucuagagccuguagccauaaaaacaaauaaacagauauagaauugaagguaaacucuguauuauucuaccaauaaauuauucauccaugaggcaucugcagaauucucugggggaccugauuuuaaacguuuggcaaacagaccacugggcccuaacauagaauaguuuuccuggacugguagcccgaguugaaacaaaaguuugcagugacuguauaugaaacauguuguauaauguauugaagaauuuggacauuuuccuaugggcauuugggagccaguggaaguuuuuaaguaaguugaggauaaggaagagagaaaaguucagaacuuuagaaugacaguugguaguaccguuagccaauaagggaaggcagaaggaaguagauuuaagggaggugaggguaagaaaagucauuuugaagcugaaaaaguauaaggaaagaaguacaggagacuauuuugcaauauuaccaucauagacauaaauacuauucuguuaagacuugcaaggaagauuuugguagcuuagguugugauugguaacagagauggcagucguaguuaaagacuaauagauugaagguugauauuacuauauagcucuuauaauauguggauauguuuauauaaaauggaauauggauuagaaaacuagauacauauauauuaggaaacuaguaacaaggacaaaauuuuguaaucucacuaugcuaauaaaaccugugcuaccauuuugagguauuuucuuacagguuuuugccccggccuauguacuuuuucuuaguuguaguuaguauuuugagguauuuucuuacagguuuuugccccagcauauguacuuuuuccuaguuguaguuagugggcauaugcaaguuucuuccaugucuuuagucuuuguagcuauuacguuuuguugcuccauaauauuuuauaguggauauacuuaaccauuaccacagaauugcuuucuuggguaguaguuaucaugucacuacuucagauaucacacagaauguccuaaucugauuguuucaggucccaagacaacgugucagaaagugaauuaguuaacaguguuucuuugcucaacuuuacaacuaggcaguuguuuucuauuauaaguauuugcuuagcuucauuuuauucuucucuaaaagagaaagaagacuauuuugaaaauuaagaguuauuaacauuauucauaggggccaggugcaguguaaucccaguacuuugggaggcugaggcaggcggaucuuuugaggucagaaguucaagaccagccuggccaacauggugaaaccccaucuguacaaaaaauuaaaaaauuagccaggcaugguggugggugccuguaaucccagccacucaggaggcugaggcaggguagucucucaaaccugggagguggagguuguugcagugagcugagauugcaccacugcacccuguccugggcgacagagcaagacucugucuaaaaaaaaaaaaaaagauuuggccaggcgagguggcucacgccuguaauccccgcacuuugggaggcugaggcgggugggucaccugaggucaggagaucaagaccauccuggcuaacacggugaaacccugucucuacuaaaaacacaaaaaauuuagccgggcgugguggcgggugccuauacucccagcuacucgggaggcugaggcagaagaauggcaugaaccugggaggcagagcuugcagugagccgagaucaugccacugcacuccagccugggcaacagagcgagacuccaucucaaaaaauaaaauagaauaaaauacaaaauuaggggccggacgcuguggcucacgccugaaaucccaguacuuugggaggccaaggcgggcagaucccaaggucaggaguuugagaccagccuguccaacguggugaaacccugucucuacuaaaaaaauacaaaaauuagcugggcgugguggcgggcgcuguagucccagcuacucuggaggcugaggcaggagaaucgcuugaacugggaagcagagguugcggugaaccgagaucaugccacuacacuccagccugggugacagagugagacucugucucaaaaaaaaaaaaaaaaaaaaaaaauuagccaggcgugauggugcacgccuauaaucccagcuacuugggaggaaaaucacuugaacccagcaggcggacguugcagugagcugagaucaugccacuacacuccagccuggguaacagagugagacuuugccucaaaaaaaaaaaaaaaggauuauucaugaggcagagagcuuauaguggcccauuuuuuuucuuccagaaauagcaucccaaaaccugacuuuaccauaguauuaagaaaaagguuuguagguagauaaauguuuauauuuuuauuuuuaucaguauuuaucuugauaagagagaaaacauaaugaaagaaguaccggagaguauuuuaaauagcaccaucauagacauaaauacagucuuguuauagcuuugaaaaugggaaaagcaggagaaaaaguguuugauaucaguuuaacaauuaauuaauaaaaaguuuucuggagucuauaguauuuaacguuuuacagcuauauuucacuuuguuucuuuacuuaccuugggcugcaaucauuuucaugaagagauucucauuuacuaaguauacuuugcaguucuuuuacaguaugaucauaguucuucauagauguaauauguguaaauauauauacaugcaaaauacauauacuuugauuuucuuuaauuaucuuuaguuaauaacuuguucuaaauuugaacauuguuaauuuuuaaaguggaaaauuuggucuuauaauuauuauaaaaauucaucuacaguuuuguggcucauaugucagauaaucuuacauuauaguuauguauacaaaauaauuuuaggcuauuagagguucauauuuauuuuuauauaucaacaggguucuauacuauuucucuucagggagaaaaauauuugaacucacaaccuauuuauaaauccugucuccuuucuggcuucuuuaguuauucaaguucaaaggacauaccacaucuuuuaggagaggcaccagagcacuuagaguacuaaauaauaucacaggggcuucuacaaagaugugcuuuauuucuauaggauaucauauuagucccuuuucacgcugcugauaaagacauacccgagacagggcaaucuacuuacaguuccauguggcuggggaagccucguaaucguggugaaaggcaaggaggaucaagucccauuuuacauggauggcagcagucaaagaaacaaugaggaagcugcaaaagcagaaaccccugauaaaccaucagaucucgugagacuuauuuacuaccaccagaacaguaugggggaagccacccccaugauugaauuaucucccaccaggucucucccacaacacgugggaauugugggacuaccauucaagaugagauuuggguggggacacagggccaaaccauaucagauauauaacaguguauacagggcccacauuuguuuuguuuuuaauauauauaauauucaaauaaacugccuuuaagaguuaacuacauuuucuaaaacaagggcuauaaauauguuaaauauaacuucagauauuuacugagauauauuggguucauauuugauuuguguauaguuuuacaguuuuuuuguuuguuuuuuuguuuuuguuuuuguuuuuuugagauggagucucgcucuguuacccaggcuggagugcaguggcacggucucagcucacugcagccucugucucccggguucaagugauucuccugccucagccucccaaguagcugggauuacaggcaugcggcaccacgcccagcuaauuuuuuauauuuuuaguagaaaugggguuucagcauguuagcgaggcuggucuugaacuccugaccucagaugauucgccugccucggccucccaaaguguugugauuacaggcaugagccuaguuuuaccguuuuuaaauuuuaguuuuauucuuagguaauucagaaaauauuuuagggaaaauauauuauugaugaaaaauaagauguacuaugguuauuuuucaugacuuucgacugaaaauacuuagauuuuugugugaaauuuccaguauuuaaauuggcagugauaaggcaguuucgaaucuuuuuagagcucuacaguagucgcaucugcccagcaagugaagacaacgcaaacuucaaaugcuccugauguaaaugaugcaauugugaaacuauucaaugauuuugauguuaaggaaaccucccaucauuuagugauuucucaucuagaucuacacauaugugaugacauucaugcuaaagaaaaagguaaaauaacuugcuuauuucaaacuauuuugguuuuucuagaauugacuacaaaacuggauuguuuauuaaaucuguuguguaggauguccuguaagauaauuugucauaauuguguucauaugaauauauagaugaaaggcacaacuggaagcauauauugguaugaaauuuuauuuugcuuuagcaguacuuaagcuuaauuauuuguuagcuaucaaugcuaacaauaaaauuagcuuuaaaaaaaucagacugaauagaugauccucuaggaggaugaugaaauauuagacucgccuuugaauuaacuuuuugauaauguugaaauugucuccaaauuaaauuuuaguccauacuuaauucauaauuauuuguagauguguuuucagcauugcaguuuuucuaccuauuuugaauagaagcacaacugugcaacuauuuaacauauuuuauggccaccucucuucccauccuuccaaaauuugauuaggaagcaaaauuccaguuaggaauuuucuuuuaguuuuugucccuguuauuuuuccuuauuuaguagauguaguucuguaaucuaggcgcugggcguuuuuguuucucugcuggagagcaucccuggcccagaaguguugggguugaguucagcagguaggccuaccuuaaggacuauaauucucaaacuuuggugagcauuagaaucaggcugaagaccuuuaaacaauagaguuaucugaucucugugccucagaucugaaucaggaucuauaucuacaaaaauuuuugccauguguuuuuaagcugagaaagugaauauugagacccuggauacuuagcaguagaaguuacccugccuucauuagacaaggcagccuaaaagauuccagccuaaaagguuggaggggcaaaggugaggaagauucgggguuuguggagggauuuguuaucuuuuguucugacuaccauugugucauuugacuuauaguuggcaucuuuuacuuuagagauuugaaaggaaaauccaaaaaaguuagaacaaaccaaacuaagaaaaugagguggucaagauuaaguaguaagaaugagaauggagaaaguguuuucuaaggccuuacauuccucacuauucccugauagaauaaauugaaugauuuuauuuaggaagaaaaccuuuucaccaaaauaucuccuuaauaguacaggucuguaaucacuauugugaaauccaaaaggcucugaaauauuauaaguuugugaaaaacucauuugguggcaaaaccugacuuaugccaauacuuuuuuuuauucuuugccugcuuccuauaaauauuuauguuuugcugcagaauugcuauuuuuauuagugcugccucagaaccugcugagaguguugcaugguauauccuguauauaccguaucauauuacugucgugaaaucuaaacauuucugaauucugaaacauuuggcuuuccaaagguuuuacguaagggauuguagaccugugcugaaaauucuacuaguugagauaaauuggauuuuacaaauuaauauagggaguguauacauagcuaugucucaguuaguauuuuucuuucuucugauugauuugcccauuuuguuuuaaaauuugauuuuuauguucacguuauaccaauuuguaaucuacuuuugauuuuacuauagcugugugacuuuggacaacuuaccuaaccuaacagacuuuuaauaauuucccuuuuuuuuuuuuuuuuuuuuuugagauggagucucacucuguugcccaggcuggagugcaguggcucaaacucggcucacugcagccucugccucccagguucaagcgauucuccugccucagccucccaaguagcugggacuacaggggcgugccaccaugcccagcuaaucuuuguauuuuuaguagagacggaguuucacuauguuggccaggcuggucucgaacuccugaccucgugauccacccgccucggccucccaaagugcugggaugacaggcgugagccaccgcgcccagccuuaauuuccuuuucaguaagagguaggaugauaugguguaguguucaagauuuccuggguucaaauccaagcuuugcacuuaacuagcuguauguccuuggccucuuugugccucaguuuccuuaucuugaagauggggauaauaaugauuguaccuaucaaaugcgguuguuaugaaaaccaaaugaguaaguuuaccuaaaguauuuaaaauaaugccugacauauggggaggccuugucaauauaaaaguugugcuaguaucaucugugaacucuaccagggcagggauucugcuauucuuauauucuuaccuuuuauccuggugccuuacaaaugaggggggcucaguaaauacucauuggauugaauuauauuuccuaaaauccuuaaugugccgucauaaaagagagacaguuauuacuauuuggacuccaaguaugcuaaaauuuuucugugguaaauuaaaucuuucugauaauugacuuaauauuucccccccccccuuuuuuuuucccagagucaaacagacguauuacuggaggggcaaugcaacucucuuuuacacagcuaacuauagauuauuauccuuaucauaaagcagguguguauaacagcaucuuuaaaagauauaaauguuguuuucaaauuauauagcuaauuuauuuaguuuaguuuuaucuugcuuuuauuuguuaacaagaaaugagaugaagagauugguauuuuucuccuggcaguauuucauuaagaaaguagaauugccauggaauauagucauacaguguauauugacauuuauauagauuuuuagaaaucauaauuuuuagaaauugacaguuuuccaaauaaccaauuuaaaacuuaaaaaaaaaucaggguacagaggacauguguuugugcuguuuuguuaguugugaccaaaacaaguuauuaauguuuuaaauuuuuaaaugauuuauauauuuaaaaauuagaaaagaguaugaagcuaggaaugaaaagaguaugaagcuaagaauaagaguauguuuagcuaaauuauaggauuccagauuucauaggcucuuaacaaucugguauugguagauucuuucucccaaauaaugaaaagaaaaaaaaaguaugauuauugugaccaaauuaauuugacuuuauaccguuuuugccuucuguuaguauuuagcauucacacaagugagaaaaaccaaacuagagaucauagaguuuuccaggacauuuaaaaaaugguaaaguuuuucuguucacacauuuuuguuuacacguuuuuuaaccaauguuugucauuucuauguugguaccugauuaaauuuaaaaguuguaugauuuuuuuuucauuuuaaauuuucauugccaacauucaauauaauaauucucuuuugaaggauuuugucuuauauacuaucguccugacucauaaauuaacuuacaaaugcauaaaauuuuuaacuagauauuuauuuuugaagaggugugaaacauucauagaguaaauuuucuuuuuuuuuuuugauccaaggccucacgagugcaguggugugaucacugcucacuacagccucgaccuucugccucagccucccaaagugcugggauugauuacagaugugagccacugcgccuggccugauuuuauugucuuaacccuuuuaugugcauuuuucuuaguugcuacagagaagccuaaugauucugauuauauauuuuucuuccaaaaacuaacuauggcugaguacaucuugagaaguuuuauugguuucuuaaauguuuuaaucaucaucaucuuaucauuuuugugguuuagguuuuuguuaguuaacuugauaacacaucuuugaagaaaggauucuauuuauuugauaauauuuucugggauucaguuuaaugcagguuuaccagguaauugagcauccagugaagggugacgagucauauggcuuuaaauugaaucuuagugauuuucuacuaagaauggguacuagauagaaacuccuccagaugauuugcuuuugacauucuuucccucuguuucaaauguuuuacucauauuucgaaauuacauguaggugaagccuguaaauuuuucagauaucaaagucuuucuugaauaaacgacuaaaucucauuggaagcauuacuauaauauaauaaaugaaaguuguacauuuuucaaugaaauaccuguuguucauuuuacaggagauaguuguaaucauuggauguauuuuagugaugcaaccaaaacaaaaaauggaugggccaaugaguuauugcaugaauuugagugcaacguugaaaugcuuaaacaggcugugaaggaucauaauguagguucaccuccuaaauccccaacacaugccucuccccagcacacacaaacagguauuuuaccuauaauagcauuccccuaauauuaagaguguuugcacucugugugugugugugugugugugugugugugugugugugugugugugugaucauaguauuuccuguaaaugaguauuuuuuuuucuucuuuuuaauguagagaugggggucuugcuauguugccuaggguagucucaaacuccuggccucaagcgguccucccaccuuggcccuccgcaaagugcugggauuacaagugucagcuaccaugcccagccaaguauuuuuuuuuuuucuuugagacagggucucacucugucucccaggcugaagugcaguggugugaucucggcucacugcaaccucugcuucccggguucaagcgauucuccugccucagccuccugaguaucugggauuacaggcacaugccaccauacccagcuaauuuuuggaguuuuaguagaaccaggguuucacuguguuggccaggguggucucaaacucuggaccucaagugaucugcccaccucagccucccaaagugcugggauuacaggcgugagccaccacgcccggccuaagccaaguauuuuuaauuaaugucuaaaaccccuguauccuuugcucagaccaacauaggcuuguggaccaaagcacuuuuaaaauuaauacaaccaauaauagucacacccaggaagaauuuuucuagaagguuucuuuuuuuuuuaagucaacacauaauaauuguacguauuuaugagguacagugugauacuacuacuuuuuuuuuuuuugcuggcccaguaagcauugaaaugugauauuuugauacauguauacaaacguauaacacuaaaagcagaguaauuagcauauucgucaccucagacauuuauuaguuaaguugggagcauucaaaaucugcucuuacuagcuauuugaaaaaauaaauuauuaauuauagucacccuauaaaugcuagaauuuacuucuccuaucuagcuauaccuuuguauucacuaaucacccauugucugccccuccccuucccucccccauacccuucacuuucuacuucuauguaaauaugucauuuuuaacaagagucccauuccagaguuuuuguagaagacuaacuuaaaugugacaugugugauucuucuuaaaagaauaaucaucacaauaacuuacauccuguauuacuuuauaauuuauaaaguauguccacaaauauuaucuuguuugagaaguuaguauucacauauauuucugguaccugccuuaauaauaaaagagugacuguuaaaaauaauuuugcaaugaauugaaaggaguuuuuguuuccaacagagaaggacuacccucugaaagggacaugcagaacaccuucaguauuaucucaacaaucaaaagcuaagcuaaugucuaguucuguugugguuagacuugcagauuucaauauauaccagguauguuuucuuuuccaauuaaguuuucucauaaacacuuuaguaucucaucuaagcaacuuaaauaacaaaugcuaccauuuuauuuaaaaaaucuuuacaagguuuaugaaauggccauauuagauggcauagaaaauaucaguuuauuaauuuuugauuauaugguuacucaguuaaccaaacuaacuuuauaggcacaguccuuaaguuugccuaaaugcuucugacacaaaacagcauguucucauuacaaaaacagaugcauagaccaauggaacagauuagggaaccuagaaauaaagcugcacaccuacaaccaugugaucuucgacaaagucgacaauaacaagcaguggggaaaugcuuuccuauuuaauaauguugcugggauaacugguuggucauaugcagaagauugaaauuagacccuguuguuucaccacacacaaaaauuaacucaagaugaaaugaaagacuuaaauguaaaggcugacacuauagaaacccuggaagacaaccaaggaaauagaauucuagagauuggccucggccaagaucucaugaggaagacuccaaaaguaauugcaacaaaaacaaaaauaggcaagugaaaccucauuaaagagcuucuauacagcaaaauaaacugucaacagacauccuacagaaugggagaaaauauucacaaauuauuuaucugacaaaggucuuaauauccagaaccuauaaggaaauugaaucgacaagcaaaaaccaaacaccauuaaaaagugggcaaaggacaugaacacacacuucucaaaagaagacauaugugcagccaacaagcauaugaaacagugcucaacaucacuaaucaacugagaaauacaaaucaaaaccacagugaaauaccaucucaccccacucagaauggcuguuauuaaaacacaaaaaaauagauguuggugagguuguggagaaaagggaaugcuuauacacuguuggugggaauguaaaauaguucaaccacuguggaaagcaguuuggaguuuucucaaagaauuuaaaaaagaacuaccaauugacccagcaaucccauuacuggguauauacccauaggaauauaaauuuuucuaccaaagauaacgugcacuuguauguucauggcagcacuauucacaauaacaaagucauggaaucaaccuagaugcccaucagugcaguggauaaagaaacugugguacauauacaccgcagaguacuauguagccaugaaaagaaugcagucauguucuuuguagcaacauggaugcagcuggaggccauuaucccaagugaauuaaugcaggaaaagaaaaccaaauauugcauauucucacuuauaagugggagcuacacauugagugcacauggacacaaagagggaaacagaagacauggggucuuacuugaggguggaggguuggggaagggugaggauugaaaaacuacuuaacggguacuaugcccgcuacuuggguugugaaauuauuuauacaccaaaccccagugacacgcaguuuaccaguauaacaaaccugcacauguacccccugaacuaaagcaaaaguuggaagaacaaaaauaaagacuucagacaccaacuacaacuuugggaguuuccaaaaacuacccucugguucaaaauucacuagaaagacucacagaaccacugaaauauauuaaagucacauccauuguagucacauuauacaaauuacaaccagccauaggaagagaugcauaaggcagagucuuuuuuuccuccucuguauuaguccauuuucaugcuucugauaaagacauacccgagacugggcaauuuacaaaagaaagagguuuacuagacauacaguuccacauggcuggggaagccucacaaucauggcggaaggcaaggaggagcaaaucacaucuuauguggauggcagcaggcaaagagagagcuugugcagggaaacucccauuuuuaaaaccaucagaucucaugagacucauucacuaccacaagaacagcacaggaaagacccacccccauaauucaaucaccuucaaucauaauucagucaccuuccaccagcuuccuccuacaacaugugggaauugugagagcuacaauucaaggugaaauuuggguggggacacagccaaaccauaucauucugcccuggccccucccaaaucuuauguccucagauuucuaaaccaaucaugcauuccuaacugucccccaaaguuuuaacucauuucaccauuaacucagaaguccacaguccaauguccugucugagacaagacaagucccuucugccuaugagccuauaaaaucaaaagcaauucaguuauuuccuagauacaguggggguacaaggcauuggguaaauacagcuauuccaaaugggagaaguuggccaaaacaaaggggcuacaggccccaugcaaauccgaaauccagcaggacagucaaaucuuaaaaguuccaaaaugauuuccuuugacuccauguuucacauacaugucacgcugauguuaagagguggguuuccaggaggcggagcuuacagugagcugagaucgcgccacugugcuccagccugggcaacagagcaagacucugucucaaaacaaaaaaaaaaaaaaaagagauggguuccauggucuugggcagcucugccccuguggcuuugcaggauacagccuuccucuuggcugcuuucauggacugguauugagugucugcuggcaccuuuuccaggcacauggugcaaggugucaguggaucuacccuucuggagucaggaggacgguggccuucuucucacagcuccacuaggugguaccccaguagggacuuugugugggggcuuugaccccacauuucccuuccacacugcccuagcagagguucuccaugagggccccaccccugcugcaaaauucugccugggcauccaggcauuuccauacauccacugaaaucuaggcggaggcucccaauccccaguucuugacuucugugcaccagcaggcucagcaccauguggaagcugccaggguuggggcuugcaccuucugaagcuauggcccaagcucuguguuggccccuuucauccauggcuggagcagcugggaugcaggguaccaaaucccuaggcugcacauagcacagggagccugggccuggcccaugaaaccacuuuuuccuucuaggccucugggccuauaaugggaggggcugccgugaagaccucugacauucccugggagauauuuucccccauugucuuggggauuaacauuaggcuucucuuuacuuacgcaaauuucuguagcuggcuugaauucuuccucagaaaaugggguuuucuuuucuaucgcauugucaggcugcaaauuuuuugaacuuuuauacucuccuugccuuauaaaaugaaaugccuuuaagaacacccaagucacccuugaaugcauugcugcuuagaaauuucuuccacaagauaaccuaaaucaucucucaaguucagaguuccacagaucucuagggcaggggcaaaaugcugcccgucugcuaaaacauaacaagagucaccuuucuuccaguucccaacaaguuccucaucuccaucugagaccaccucagcccggaccuuacuguucauaucacuuucagcauuuuugucaaagccauucaacaagucucaggaaauuccaaacuuucccaaauuuuccugucaucuucugaccccuccaaacuguuccaaccucugccuguuacccaguuccaaagucacuuccacauucagguaucuuuucagcagugccccacucuacuaguaccaauuuacuguauuagucgguuuucacacugcugauaaagacauacccaagacugggcaauuuauacaggaaaaaaguuuaauagacguacaguuccacaugacuggggaagucacaaccauggcagcagaaagcaaggaggagcaagucaugucuuacauggaugguggcaggcaaagagagagcuugugcagggaaacuccuauuuuuaaaaccaucagaucuugugagacucauucacuaccacaagaacagugcaggaaagacuugcccccauaauucaaucaccucccaccagguuccucacacaacacgugggaacugucagaguuacaauucaagaugagauuuugguggggacacagccaaaccauaucacccccacaguacacugauguaauaauaauaaaacagcgucuuggagcacuugaaaugugaaacuuuuccucaggacuuauuagcuuucuaaggauguggaacccuauauagauguguaaauauauggauggauggauauuuaacaauaugcaugaaguauuggucaugagguuuuacucaaucucuaggugaauugguaaucagauuacccaaagcccccacccucuuaacgcaacuaggcuaucaaguguggccagcuccacccugcgucguuuugcuaucauaaacuaucagcuguggugucaggggcuguguuaggcuguucuuguguuguuguaaagaaguaccugagacuggauaauuuauaaagaaaagaaguuuaauuggcuuuugguucugcaggcuauauuggaagcaugaugugggcaucugcucagcuucuggggaggaggccucagggaacuuuuacacgugguggaagguaaagcaggagcaggcacgucacauggcaaaagcaggagcaagacagagaguggcgcagggaggugccacauacuuuuaaucaaccagacuuuaugagaacucacuguugugagcacaucaccaagccaugagguaucugcccccaugacucaaacaccucccaucaggcuccaccuccaauacuggggauuacaauugaacaugagauuuagaggggacaauauccaaacuauaucaggggccaaccauaaauaggaaauuccaauuccuaguugcuucccaggagcagggucagagggagaccaauuuccuuauuacacaguagucucuguggaaggaucuaaaaugccuuuuuugcuuuacggaacuacaguauacuauauauacuguauuggcuauacugugaauauaauucuauagcuaagaacucuguccuauuuauacuaacaaucuuacucaguuuauaaucaccuaacguggucuaauugcaauguuugagaccaacacgauaauauaugaucuauucuuaaaaaauaaaagauuucuagauuuaucauuuauaaauuguucugguuuauuuugauaagucuguggcuuugagacuuaguuuuaugugaaaaguuuuuauuuaacucagugauuccccucugggaccaauuuugccccccaggggacauuuggcaauaucugaagauaguuuugguugucacaacuggacagggaugcugcugaccucuagugaguaaagaccagugaugccgccuguuaaauccuacaaugugcuggucaguuccccacaaugaagaauuaucuagcuuaaaacgucagaagugccaauguuuagaaacugauuuaacaguuauuuucucauuaugcaguuacuacuuacuuuacauucgauauacagucauguguugcuuaacaucauuaacuguacuuagaugguauguagccuacuuaaacuccuaggcuauauguaugguauauccuauuccuccuaggcuuuaaucuuguauaucauguuacuguauugaauaccguagcaguuauaacacaaugguauuuguguauuuaaaccuuaccaaacauagaaaauauacaguaaaaauacaguaaauacaguauaaaagcuguguuauaaucuuaugggauccacaucuuauaaguggccugucauuggcagaaaugucauuauauggugcaugaccauaugcuccagcuuuuuaaaagacuuuaaauuuuaggauuuaaauaaauuuauguggaaaugagaaagaggaaucacuuauaaucccacaugguugugagugaaauacaguaagaaaccccacauauauauacgcaaccacaccaaacacaaaacaaaauaaacaaaaguaaguagaagaacauaagauaguauguuugucccaauucgaauagguuuuuaacuauuagaggaaaaaagaauaagccguuauuuguuaaaauaaguugacauuuugaauugaaaagaauuuguuuccauauaugcagagaaaagcuuuuuaauuagauacuguaaggaacugacuugaauuuauaaagacuauacaaauuaaaaugauugauuaagcaauuuggcugggcacguuggcucacgccuguaaucccagccauuugggaagccaaaguggguggaucacuugaggucaggaguuagagaccagccuggccaacauagcaaaacccccucccuaguaaaaauacaaaaauuagcugggagugauggugcaugccuauagucccagcuacuugggaggcugaggcacgagaaucgcuucaguccaggaggcagagguuguugugggccgagauugugccacugcacuccagccuggaugacagagugagacucuuaucucaaaaaaaaaaaaaaaaaaaaaagauugcugaggcaguuuauauaagaggaaacguaaguaaaccauugaaaaauuauucuacuucauaugagacauauacacgucuauugaaugaugaauggaaaaaaaaacaucucuggguauacuaaacuaaaacaaauaaaugaaacugauaaaacuuuauugguugaacuuugugaauauuaauauauacauuuuugaugacauuagcugguuuuggggggugaaaaaaauguaaccagaaccuuaaaacuaauaguuuuuuuuuuuuuaauuucaacuuuuauuguaaacucaggguacaugugcagguuuguuacauuuuuauauugcaugaugcugagguucagggugugauuaucccaccauccagguggucagcauaguacccaacagguagguuuucagcccuuauuccccuuccucccauccuccuuuuggggucuccagugucuguuguucccuuuuuugucuccaugcguacccaacauuuagcucccacuuguaagucagaacaugcaguacugcagccucaccagcaucuguauuuugacuuuuuaauaauagccauucuaacuaauguaucugagaugguaucucacugugguuucgauuuacauuucucugaugauuaaugaugauuaguguauugagcauuguuucauaugcuuguuggcugcacauaugucuucuuuugagaaguguguguucauguccuuugcccacuuuuuaaugguguuugguuuuugcuuguugacuuuuguucaaguuccuuauagauucuggauauuagaccuuugucagaugaauaauuugugaguauuuucucccauuguguaggaugucuguugacucuguugauaguuuauuuugcuguauagaagcucuccaaugaggucucacuugucuauuuuuguuuuuguugugauugccguugaggucuuagccauaaauucuuugcuaaagccuauguccagaaugguauuuccuagcuuuucuucuaggacuuuuauaguuugacuucuuauauuuaaauauuuguuccaucuugaguuaauuuuuguauauaguagaagguguagccgggcgugguggcucacacuuguaaucccagcauuuugagaggccgaggugggcggaucacgaggucaggaguucgagaccagccuggccaacauagugaaaccccaucucuacuaaaaauacaaaacuuagcugggcgugguggugcgcgccuguaaucccagcuacucaggaggcugaggcaggagaauugcuugaacccgggaggcagagguugcagugagcugagaucaugccauugcacuccagccugggugacagagcuagacuccgucucaaaaaaaaaaaaaaggaagguguagggguccaguuucauucuucuaaauaugacuagccagucauccaggcaccauucauugaauaggguguccuuuccccauugcuugugauuguugaauuugucaaagaucagauaguuauaggugugcgauuuuauuucuggguucucuauucuguuccauugaucuaugucucuguuuuuguaucaguaccaugccauuuugguuccuuauaguauaguuauguaaugucuccagcuuuguucuuuuuucuuagaguugcuuuggcuauucaggcuuuuggguuucauaugaauuuuuaaauauuuuaaaauuuuuuucuaauuuugugcaaaaugauguuuguaguuugauaggaaugacauugagucuguauauuguuuucagcaguguggacuuuuuuuuuuuuuuuuugaaacagagucuuguucuguugcccaggcuggaauacagugguguuagcucacuacaaccuccgucucccgaguucaagcgauuuuuaugccucagccucccaaguaacugggauuacaggcgugugccaccacgcccagcugauuuuuguauuuuugguagagaugggguuucgccauguuggccacgcuggucucgagcuccuggccucaaaugaucugcccgccucagccucucaccgugcugggauuacaggugugagccaucaugccuggcccaguucuuguagagaucuuuuaucuuuugguuagauguauuccuaggauuuguuguugcuguuguuguuguuguuguuuggcuuucagcuugaauguuacugguauauaaaaauacugcugauuguuuacauugauuuuguauccugaaacuuuauugaaguugcuuaucagucaugggagucuuuucguggaguuuagcauuuucuagguauagaaucauauugucagcgaagagaaauaauuugacuucuuuuccuauuuggaugcccuuucuuucuuucucuugccugauugcucuagcuagaacuuccaguacuauuuugaguaggaguugugagagggggcauccuugucuuguuccauuccuuaagggaaaugauuucagcuuuugccgcuucagaacgauauuagcugugaguuugucauagauuacucuuacuguuuugagguauguuucuuugauucauaguuuguugaggguuuuuauugugaagggacguuggauuuuaucaaaagcauuuucuuugccuauugagauaaucauaugguuuuuguuuuuaguucuguuuguggugaaucauauuuauugauuuguguaugaaacauagucuuuuuggaaaaugaauucgagcgaucaaacuauuugacggaaguguuuauagcuauuauuuuuaaauuaauuuuuuauugugguaagguaugacugaauuuacaauaauaauuauauauauauacacacacauauacauauuuagguuuuugccauugaaaguaauggcaaaacugcaauuacuuuugcaccaaccuaauaauaucggcuaggugcaguggcucacgccuguaaucccagcacuuugggaggcugagguggguggauugcuugaggucaggaguuugagaccagccuggccaacauggcgaaaccccgucucuaccaaaaaaaaaaaaaaaaucugugucuguaucuauauauuauauaauaauugucguuaagcacauucacguuguuguguaaccaguaccauuauuugucuccagaauuuuuauuaucucaagcagaaacuguauauagcucuguuacuuuucaugguaauggagagauuaugguaaagauuauuuuaaacagcguacggggaagcauucuggauuugaggacuuggaucuauguccugacugccauuuacuuaucuauauuaucugauagaauaucguuaucauuuuucuguuguuuuuaaggcucacaauaauaaguuuguaaggaauauuguacaguguugauuuugugauugauaaggauccaaaaagauuauagaguuuucugaauaguugauggguguuuaaaaauaauuccaugugaaguuaaauauauaauaaaguuuacacuggaaauuaaccauuagcaaaguuuuguaaguaguuuuaaaaguacugucuggguugcauaaauuauuuggaaagguuuuuauucagugugauuucaguaaacuuauuuaucuuuucaggucucuacagcggaacaaugucguucuucccccaaaagcaugauuugcugcaauaaaaaaucccuauaucuuccacaagaaaugucagcugucuauauagaauucacagaauauuacuauccagauggaaaggauuuuccaaguaagagaguuuuuaauuauuauuuguccauuauuugagaaaguauuuuuuucuuguuaauauuuuugaguuuuauaaauaugaaaaauaaauaaaacuguauuguuccuuauuuauuauuaguuuuuugagagcuagcaucucacuguguugcccaggcugaucucaaacuccuaggcucaagccauacuccugccuuggccucccaaaguguugggauugcaggcaugaaccacugugcccagccccuauuguucuuuauucuuauuguguauagugcauaagucuagucuaacaguuuuagauguuguuauuauuuguuuauguauccuuuucccucccuagcuuguagaauccuugauggcaggaaucaugagguuuuuucguuuuuuguuuuuuguuuuuuuuucaaggcagagucucgcucuguugcccaggcuggagugcaguggcacgaucucggcucacugcagccuuggccucccagguucaagcgauucuugugccucagccuccugaguagcugggauuacaggcaugcaccaccaggcccagcuaauuuuucuguguuuuacuagagacaggguuucaccauguuggccaggcugaucuugaacuccugaccucaagugaucugcccaccuuggacucccauagugcugggauuauaggcaugagccgccauguccagcacaucugguauuuauguucauuuuauuccagauauucaacuuacuuugugcuuaauagcuguuuguuaaagaaucaaugaaagcuagguuauuuguagaauaaagucauuuguuuccccuuaguaaaacuccauuuauaugucagcuauauaacuucauuuauauauuauugaaaaaguaacugaaguuguccuuuuagcuguagagaauuuuuuugacuguuuuaaaaugccuaaauguauacuuugggcaacuuuuagcauuuacaauuuucagaaauauugaauuacaugaauuuuuauuuuuagaagcuucuuuggcuuucuaacguuaaaaugauuguacauuuguauucuuugaauauuaaaacucuuuagcuuccuaacauuaaaaugauuguacauuuguauucuuugaauauuaaaacucucugcuauugucucaguucaucuagaaauuccuuuuuuuuuuuuuuuuuuuuuggagacauagucuugcucugucacccaggcuggagugcgguggcgugaucuuggcucacuggaaccucugccucccgggcccaaacaauucuugugccccaggcuuccgaguagcugggacuacaugugugugccaacacucccggcuaauuuuuguguuuuugauagagauaggguuuugucauguuggccaggcuggucucuaacuccuggccucaaguggucugccuaccucagccucccgaagugcugggauuacaggugugagccacugcaccuggcccaucucggaauucuuaaacuaaauguugcccucuuuucugugauaccuuuuucaucaugcuagcugaaaaucauaguugaaaauauuuagaugaaauagguuuuguuaucagaggcauaacaaguuuuauguccuuucuuuaaaaguagaacuccaaaauacuuagaccuacuugcccauuuauuuaauauugauuuauuaauauauguuguuuuuuuuucugagacagauucuugcucuguugcccagacuggcaugcaguggugcgaucucagcucacugcaaccucugccuaccagguucaagugauucuccugaguagcugggacuacaggcaugcaccaccacaucuggcugauuuuuguuaauuuuuuuuuuaguagaggugagguuucuuuucuccuuguuggccaagcuggucuugagcucuaggccucaaaugaucugaccuccuuggcuucccaaagugcugagauuacaggcaugagccaccgcacccacccuauuaauauauguuuuuaguuucaaaaggaacuucugauccuuauaccauagauuuugccuuuguugcuaaauuaagagauggcauccugggaauuacaaggcugucuaucuguuuuauugcuuuauuccuaguuuggguuaaacuucuggcauuggccaggugcaguggcucaugccuguaaucccagcacuuuaggaggcugaggcggguggaucaccugaggucaggaguucaagaccagcuuaaccaauguaguaaaaccccgucuacuaaaaaugccaaauuagccgugcgugguggcaccugccuguaaucuguucgcuugaaccugggaggcagagguuguggugagcugggaucaugccauugcacuccagccugggcaacaagagcgaaacuccgucucaaaaaaaaaaaaauuaauuaauuaaaaauaaaaaaccuucuggcauuuaauccuaucuucauguuucaacaaucuuuugugguuuuuuguuuuguuuuguuuaucuguguguguuucucauuuguuucucucagcugccuuccuaagcagaugagaaaacucaagauagaugaaggaagacaucugcucugcaucucauagggaguaaaauggcacaguugaaacucaagcauugucuuguaaaucuaaauucauuguuuuuucuccacuguauuacacugcuccccuuugccccuguauucaccacggccauugucuguuauugcauaaucauaguauuccagccaugcccccauaauuguuuuucuuaaauaaaauauaucauugaacaaguaa
